United States Patent 7,314,974 (EXPRESSION OF MICROBIAL PROTEINS IN PLANTS FOR PRODUCTION OF PLANTS WITH IMPROVED PROPERTIES) - sequence listing, part 4

SEQ ID NO: 11099 - protein, 426 aa, Ferroplasma acidarmanus
KILVVTSRAPFSYRYAPGGDVRIYNVGGVATALSTMLKGTGGTWVCWGDGKNDMAHQEETTDGYKIARVFLNKTEKFGFYNSYSNRVLWPLFHYFRNNIHFDSTAFKYYYIANEKFAKKIKENITPDTIIWVHDYQLMMIPSILRTMDISNYIIFSWHIPWISPEFFSILPEAKFLAQSISKSNLVTFHTRLYEKNFFNTLEYHEIKVKNRLKTLAIPLGIDKNFFHLSKTMAIKPKKEKASIIFSIDRLDYTKGLLQRVKAIEKILSYRKDLIGKLVYLMNVTPSRTGIPEYDEIKEQLEMEVGRVNGLYSTTSWVPIIYIYRKISQKYLVSLYARSDIALITPLMDGLNLVSKEFVATTDKGVLILSKFAGAAEYMDGALIVNPNNINELASAIVRAMEMDGEEKMSRLKRMKKDVYVKNSNWW

SEQ ID NO: 11100 - protein, 320 aa, Ferroplasma acidarmanus
LEIASRSTGKIKQKRLEQAANLKKIYESIGGEAVEEDRISEGKKILGTLNIEPPEIPKVTFQDVAGLENVKTEIMSKIIYPMRYKELSQEYNIEFSGGMLLYGPPGTGKTFIVKAIANEVKANFINVNPSTLYSQWFGQFEKNISLLFRAAYLLSPSILFFDEIDTLVPKRSGSESDAARRGVSQLLTEVGGLTSQKDRNVFIIAATNNPWGIDEAIMRPGRFDVKIYIPPPDYESRKKIFQLKLSEVKHIDHIDYDELANKTERYSGADIEFICKKAVQNVFMEVIKTGNKIDVSTDDLLEVISQIRPSIDAGLLRKYQ

SEQ ID NO: 11101 - protein, 280 aa, Ferroplasma acidarmanus
VILLSYGSPERIDDVPEYLSGIFNGKPVPEKIMEENIKKYEMVNGISPSNQIIKNLKNKLGKLLARYGDFEIIDAYKHWHPGIEETVSSLDADYEEIIALPLFAFKSNNIRKSYEIPVKKAMEGKNMKLRFINGLDYSILASMWVSEISKYVYDFDNFLFTAHSLPLIDDESDYQASLERNAGKISDMLGIEKYYTAFYSQGPHGKWIEPSIYSKIDLFKEDKINNLLVSPIGFLYEHLEILYDLDVKYKEFLESRGIKYARARTPSDSDGMAILLKNAI

SEQ ID NO: 11102 - protein, 329 aa, Ferroplasma acidarmanus
FIPALKQEPHDHIPVWFMRQAGRYMDEYKELRKLYNIRQMCMDPEITEKITYAPVKLLGVDAAIIFADIILPLEAMGYKIDFNSSGPDIGNGYRHNKSMEGIHEFNTGDLKYRTYDAIRLFKQNHPETPLIGFSGGIITVMSYIIAGVSDNNLVYTKKVMLNDPSFGIMKKMIKNMILDYVTMQVKAGVDAIQIFDSWLGALSPYTFEKYLKNDIIELVESIKSKVPVIYFSTGSSGMIEQFNDIKPDILSVDWRIKLSHARTILNGSIGMQGNLDPYLVQYSREAALEETGRILGEAGKDDNYIFNLGHGVLPETDPDTLKSITDTVH

SEQ ID NO: 11103 - protein, 415 aa, Ferroplasma acidarmanus
YYIHIIMTDNNGFLRLKWARDHMPVCANIRERFLKEKPFKGIKIAMALHVEAKTGIFALLLTEGGAEVRLASCNPLSSDDSVVQSLSKDYNYMVYAKKGESEKEYYENINKTIEAAPDIIIDDGGDLTNLVASKPELVKKVIGGNEETTTGVVRLKAMEKAGALKFPMFDVNDAQMKHFFDNRYGSGQSALDGFMNATNILIAGKNALVAGYGYVGKGVAMRLKGMGARVTVTEVDPVKAIEAVMDGFTVDTMNSAIRYCDLIFTATGMKNVVSYDDMLVAKKGIIMGNVGHFNNEIDYSSLEKKNIGKTPVRNLVTEYKLENGNTVNLISDGRLLNLAAGQGHPVEIMDLSFALQALTAEYIVKNKGKLSNKVYPVPAEIDTEVAKIALESLNFKIDTYTEEQLKYLDSYQEGT

SEQ ID NO: 11104 - protein, 239 aa, Ferroplasma acidarmanus
SVKNLRDVVDMLGTVVTEAKFKIGQQGISVNAVDPAHVAMVSLEIPKGILLEYDVESEEELSLDLEKVKGILKLASGNDSFIITKDKEKLRFEIGNIIKSISLLDNSQISTPRVPQIVAEDYIVINKGDLEKGLKAAEDVSDAIRFTMNPDSFSAKSMSDADESEMILPGDKLKEIQCHESIKSSYPLEYLLKFMRSISPNEEVKLSFKSDYPLTIEFNLGSESADRIKGRFLLAPRME

SEQ ID NO: 11105 - protein, 413 aa, Ferroplasma acidarmanus
MENLDPFDIALEQLNKAAKVMKLDKASIDVLSSPREILQVSIPVKMDNGTTEVFTGFRVHYNNARGPMKGGIRYYIKENLSEVKALSAWMTWKTALLGLPFGGAKGGIICDPKKMSKMELERLSRGYIDAIANFIGPEIDVPAPDVYTTPQIMGWMMDEYEKIVRHSAPGVITGKPLTIGGSLGRGDATAKGGMYVLREGAKYKGIDLTKAKFAVQGFGNAGQFAVKFVKEMFGAKVVAVSDSSGGIYKESGIDYAELLAHKEKHGSVENFPGSKNISNEELLESDVDVLIPSAIEDQLTGANASKVKAKIVLELANGPSTPEADEIFYKNNVLLLPDFLSNAGGVTVSYFEWVQNITGDYWTEDVVYSKLDEKMTFATKDVLATHEKYQTDPRTAAYIIAIQRVLDAMKARG

SEQ ID NO: 11106 - protein, 415 aa, Ferroplasma acidarmanus
MEIKSEWGHLNRVIMHRPGTEITYAMLAPKPFLFERPFNYSIANKEHQNLEDTLRENGVKVDLLENLIVDEAEKKASFRQKLEEKIMALVNFYGTMESVEEAKKDMEKNIKYVDPLSLFQALIMEPSIDLKEYVPGIQYPRVYSNLPLANLYFMRDQQAVSSGVLLGKMKMQQRRKETDITSFVFSEILGAKTKKITEGYFEGGDFIPCGDFCLIGTGNRTDETGAMEAINSGIFNFPTVAIITNPLYDFMDGHDVMVNMHLDTYFNIPAKGMAITSVELARVARAKIYTRDREGHYAQETETTLYDFLKGEGYEFINLGISEQLSYSSNFLTLSDRKIVAIDSSKVIKKLLAENVFDTDTRQKIIKDMELKSGKMFPDSDAMAKSGIDVIKIDLSEITGGYGGAHCMTSAIDRT

SEQ ID NO: 11107 - protein, 301 aa, Ferroplasma acidarmanus
KTDEVKNCPECGSIHLVKDYDRGELTCYDCGIVIEDSLIDQGPEWRAFDSEQDGKRSRTGSPMSFLSHDKGLATEISWSNKDYYGKRIPHKNRSQIYRVRKWHQRIRVSNAAERNLALALQVLNEDGAKLGIPKDIKESAALIYRKAVEKNLIRGRSIESIVCASIYASCRMINIPRTLDEISKVSEVNKKKIGKAYRHLAKELALNLQPTTPYSYVSQFCNKLDLDKQVIMDSEHIIRLAGESGLSTGKGPTGIAAAAIYIAAMKNGKQRTQKDVARVSGVTEVTIRNRYKEISKKLGID

SEQ ID NO: 11108 - protein, 321 aa, Ferroplasma acidarmanus
  unsure (1)..(321): unsure at all Xaa locations
IQKVYIKCXGDKMATEKKKNIYEIDKCPECGSSQLVRDYERGELVCSNCGLVIDDSYIDEGPEWRAFDSEQSESRARTGSPMTYTIHDKGLSTDISWKNKDSYGKSIPTRNRAQLYRLRKWQKRIKVSNAAERNLSQALQELERMASNLSIPNDVRETSAVIYRKAVKQNMIRGRSIEGVVAGSIYAACRITNVPRTLDEIASVTRVKKKEIGRTYRIMARYLKLNILPSKPDDYVNRFCSKLRLSMEARKRAEEILKMAIDNDLTSGKGPTGVAAAAIYIASLITGERRTQRAIAEVAGVTEVTIRNRYKELTEKLNLTI

SEQ ID NO: 11109 - protein, 564 aa, Ferroplasma acidarmanus
RLNNYFIRLLKEILAYKRNSTIIISAILASSVIAMIGPYIIGIATDSIIALKFKILIILAVLYLGIYIINYIAENRRTKYMMNTSQAVIKGLRDRAFRNLQYVPLKYYAGKNAGQIISRITNDAETLSDFLTFQLPQVVAGIAGIIASIFIMIYLDPLLTVYAVIIIPMLLATVFLMNKRIKFNYMNVRRRIAELTGNVGESINGVKAIKSSGTEDVFNDNFETVNSNNYEANIRAVRLTSLFSSIVQIIEGLGIMIVLYEGGAEVFGRVISIGILVSFIVYVQSFFNPIVQLSQFYNSYQSSSIAIERIYRIIDEENDYTTNGSNIPAFTDKLKFNNVTFSYGKERIIDNLSMVIEKGKRIAIIGKTGAGKTTISNLILNFYKPDTGTITMDGVDINNFNTMEYRKLFGVILQDPFLFDGTILENIRFADYSIPEEEIKEKISSLGLDSIIGPLGLYANVGERGSNLSEGQRQAVSILRAAVNNPQIIIMDEATSQLDMKNESIIQSAIFKFMEGKTIIIIAHHLQTIIHSDYIYYIDRGKTLEEGEPDMLMGEGTRFYDLYI

SEQ ID NO: 11110 - protein, 538 aa, Ferroplasma acidarmanus
IGASLAYAYLRLLVPLYIGDAVNNLVGKNYIIILHFALLIFGVTVASSIFDFAIDYYANKASQKFVYNLRKNEFSHLLAKNYEYFNSNSTGNILSKFTMDIETLRRLVNMSLSNLFSVTFLIIIAGIDLTRLYYGFTVIFFVVIAPIIYFTLVMQRKQRKYWRALRDKYGTMNNLINQNIIGNRVVRSFTAEEEEIKRFNNSTDSYFDDYKGIAGVRSLYNPLLALFLSLAIGFVLIYGGIESIDSIISVGSVIAAVNIFTLVLRPVRFYGRYISFYENGMASLDRINAINNDNSDYKGTLIPEVHGRISLENLGYKSNNSTILTGINMDIAPGERVAIVGETGAGKTTLVNIISGLYKNYTGHAYLDGTELKEIDDKLIREKIGIVSQDAILFSGTIRYNITMGKDYTDDQVRNAAKLSMLDDFIDSLPSGYDTPVGERGITLSGGQKQRMAIARIIIRNPQIIIFDDSTSNLDADTETRFLNTIQGFIAGKTTIIISHKISSVMLAERAYVIEKGRVTEYGYIKDLIKSNGSFSDI

SEQ ID NO: 11111 - protein, 84 aa, Methanosarcina mazei
  unsure (1)..(84): unsure at all Xaa locations
VLIARISCENXNLLLDEATSSLDNIAEQRVMESIDRISKDMTVITIAHRLSTVKNADAIYVLKNGEIVESGKHDELLELKGEYY

SEQ ID NO: 11112 - protein, 150 aa, Methanosarcina mazei
RLSVYDNLMAVLQIRDDLSNEQREDRAKELMEEFHIEHLRDSLGQALSGGERRRVEIARALAANPKFILLDEPFAGVDPISVIDIKRIIEHLRDSGLGVLITDHNVRETLAVCERAYIVSQGHLIAHGTPQQILEDEQVKRVYLGEDFRL

SEQ ID NO: 11113 - protein, 315 aa, Methanosarcina mazei
MNNASVEYVRGISVVKAFRQTVYSFRRLHDTIKAYTSMVIPYTLSWQNSFSALSPWSTISIFCGAGGNFIGMRTTDYIGFLSNFIFYLIFVQSVATILMKIMYVNGNAMKIIGGVEAMDRVLAEPELPQPANPQTVTQYDVNLGDVVFSYDKDKKTEALSGVSFVAKQGQITAIVGPSGGGKSTIAHLIPRFFDVSGGQITIGGVDVRQMNSHYLMEKVTFVFQDVFLFKQSVMDNIRMGNPQASDQEVREAAQAAQCHDFIMKLPQGYDTVIGTRGVHLSGGEKQRIAIARAIVKDAPIVYWDEATAFADPENE

SEQ ID NO: 11114 - protein, 234 aa, Methanosarcina mazei
VPPEILELKSLTQINIYENQLTSLPHEISELKSLTQLSISGNQLTSLPSEIANLESLTQLDISRNQLTSLPLEITELKNLTQLDISSNKLTSLPPEILKLGIDIEWGNNSAEKGIFLEGNPLEKPPIEIVKQGREAVINYFKSLEGEKKPLNEVKVLLVGDGEAGKTSLLKRLLGEGFDGNEHQTQGINIKKWGFKDKDKEIKVNFWDFGGQEIMHATHQFFLSKEAFYILVLD

SEQ ID NO: 11115 - protein, 328 aa, Methanosarcina mazei
  unsure (1)..(328): unsure at all Xaa locations
GRVLAVRGALIEVXGLAGAAQIGSRIEIAAPGGIVQAEVTALDREVALCLPFVDPQGVGLGARAELGAGQFSVRPSQAWLGRMVDGLGRPVDGLGPLPNGADPQPIKAPPPAAANRARVGERIETGVRTLDLFVPLCRGQRLGLFAGSGVGKSVLLSMLARWTQCDVAVIGLIGERGREVQEFIEDDLGPEGMARSVVVVATSDEPALMRRQAAWTTLAVAEYFRDQGLNVLCLMDSVTRFAMAQREIGLASGEPPATKGYTPTVFAELPRLLERAGPGAPGKGMITGLFTVLVDGDDHNEPVADAVRGILDGHVVMRRAIAERGRYP

SEQ ID NO: 11116 - protein, 171 aa, Methanosarcina mazei
  unsure (1)..(171): unsure at all Xaa locations
VRIGTRVSPXAVCQAEWVKSQLQAHHPGIIVELELIKTKGDKILDVPLAKVGGKGLFVKELEEAMLDVRVDLAVHSMKDVPAEFPDGLMLGPILKREDPRDALLSIHYQSLAELPQGALIGSSSLRRQSQIKAKRPDLRLDWLRGNVGTRIQKLVEGQFDAIILAAAGVKR

SEQ ID NO: 11117 - protein, 149 aa, Methanosarcina mazei
MEQTYVMVKPDGVQRGLVGEIISRIEKRGLKIVALRMNVISEATAKEHYSEHAAKPFFPGLVGFITSGPSVSMVVEGKDAIRVMRAINGATNPVDAAPGTVRGDFALDVGRNVVHASDSPEAAAREIAIHFKDSEIGNYSRIDEVCLYE

SEQ ID NO: 11118 - protein, 309 aa, Methanosarcina mazei
ATKCVHAAEKPDPIFGAHTTPIFQTSTFIFENARQGAARFAGEESGYVYARIPPNTPTHAVLAEKFAALEGGEAGQTFASGMAAVTAIALTALKQGDHLISTDVVYGCTYSLFSQVLPGLGIEVSFVDTSKTENVKRAFKPETKMVFLESPANPTLNVCDIPEIARIARENEALCVVDNTFATPYFQRPLELGADLSLSSCTKYIGGHADLLGGIVAGNNDFIDRMSEVVGYTGGIMGPHEAWLCIRGLKTLHIRMERHAENAMKVAEFLESRPEVEWVRYPGLPGHPQYELARKQMSGFSGMLSFEVK

SEQ ID NO: 11119 - protein, 363 aa, Methanosarcina mazei
RIKKFSRGKETPFLTVDLQKIEQSYDELVEHMPFAKIHYAVKANPMDEVVLALKSKGSNFDVATVYELDQLLRLGVEPERISYGNTIKKEKDIEYAYEKGVRLYVTDSDSDLKKLARKAPGSRVFFRILTESDGADWPLSKKFGSHPDLIYKLILKAEKLGLEPYGLSFHVGSQQRDIGQWDNAISKCKYLFEAAAEKGIHLKMINLGGGFPAKYQAQAHDLETYAGEIRRFLHEDFGEELPEIIIEPGRSLVANAGIIVSEVVMISKKARFNQYKWVYLDIGKFGGLIETLDECIKYPIFCDKKGCAEEVILAGPTCDSMDILYEHHKYTFPHTMREGNRVYIFTAGAYTQSYSSVCFNGFP

SEQ ID NO: 11120 - protein, 237 aa, Methanosarcina mazei
RHMLGMDGLARHEIGAILDSAQAFRDVNYREIKKVPTLRGKTVINLFYENSTRTRTSFELAGKRMSADVINISASSSSAAKGETLLDTVATLQAMRPDVVVLRHGDSGAPHFLARHLDAGIINAGDGQHEHPTQSLLDLLTIQDHLEEMGKSSFEGMNVAICGDVLHSRVARSNAFALRTLGANVRFVGPPTLMPSEATKVFGVTVHHNMEEGLRGVDVIIMLRLQLERMTSAYLPS

SEQ ID NO: 11121 - protein, 292 aa, Methanosarcina mazei
GHYMDRVISIVGHTALDYIVDVERIAGKNESSPVIDYEEYPGGGAANIAVAIAKLGGKSQLISPVGTDFVSSGYEKLLTEANVDLSRLYRIEDQKISKAFIFTDKEDNQTTYFYWGASSKFKKLEPEPVDFVHLATADSVYNAKLAQIAGFVSFDPGQDLVTYSKENLELILAHTDILFANRHEIRRVSEMTGKSFSELKAMIDIIVVTYDSKGSKIYTDKNEFLIPVISVQAADPTGAGDAYRAGFLLALTRGYPLPTCGKIGSTVASFAVQARGCQTDLPTWEEMKARYE

SEQ ID NO: 11122 - protein, 350 aa, Methanosarcina mazei
IDEERATRQVRYAIDHGVNYVDTAWPYHMGESEPFLGRALADGYREKIKLATKLPSWTINSRKDMDSILNAQLERLRTDHIDYYLVHGLVGLLWDKMEKLEVLNFLDRAKADGRIINAGFSFHGSAGDFKRIVDAYPWTFCQIQYNFLDEKNQAGTEGLEYAASKNLGIIIMEPLRGGKLTNPVPPEVQEIWNEAPVKRTPAEWALRWIWNRPEVTVVLSGMNEESHIEENLKTASEAYPNSLTEAELQLIKKAEQKYRKLMKTGCTGCRYCIPCPSGVDIPGCFEIYDNFYLSGNEKEAKLMYAAKPGGIIRGDAAGYASQCVQCGQCAEKCPQHLDIPSLLEAVKEKF

SEQ ID NO: 11123 - protein, 70 aa, Methanosarcina mazei
FLNAAGAKPVGAPIAIALTGIASAIAGKDIGTAAIGAMAENEGLFGKGLILTVIPETIVIFGLVVALLIN

SEQ ID NO: 11124 - protein, 198 aa, Methanosarcina mazei
VKKALIPAAGLGTRFLPATKSMPKEMLPIIDTPVIHYVVEEAIASGIEDIIIITGRGKRAIEDYFDDSPELEMHLAKKHNTELLKLVRDVSSLVDIHYIRQKEPNGLGDAVLRAENHIGDEPFAVLLGDDIIVNDKPCTAQLIENFEKYGRSTLAVEEVPYEKLSSYGIIKGKPLCDSLYMLEDIVEKPSPENAPSNL

SEQ ID NO: 11125 - protein, 206 aa, Methanosarcina mazei
TAAISTKNLSKKYGSRLVLESLSLNVEKGSIYGFLGQNGAGKTTTIKLLSGLSIPTQGQIFVYGMDLSSESGKVKQILGLVPQDSGFYDERTALNHMVYYGRLKGLSKKESLEQSRILLNQVGLGNEMFKKVGYFSHGMKTRLGIAQALLNSPKVLILDEPTNGLDPVGIRQIRQILFECNNNGITIFLSSIIFWEIREICTYVGI

SEQ ID NO: 11126 - protein, 353 aa, Methanosarcina mazei
  unsure (1)..(353): unsure at all Xaa locations
PCXQLQEIFFRKKYHREIVALEDISFEVQEGETLGIVGQNGAGKSTILKILSGILLPDTGSIEIGGKVTGLLELGTGFNPELTGIENIYMNGTFLGMPRAEIDEKKSEIMDFAELGEFIYEPIRTYSSGMLMRLAFSVAIHAEPKCFLVDEALSVGDAYFQQKCMRKILEFKNTGGSIIFVSHDMNAVKTLCDSAILLDKGRVLEYGDPKSIVDYYYGMILKKSHMGDTEVELTKIDSIERGGASSTSTGEVRLVSFNILNERNEPISYIESEQTVKFVCELESLKDFSDPHYGLAIRNNLGVSVFETNTYCMGITNSPLKKGQNIKITYEMKIPLSAGNYSISIGVANSGYD

SEQ ID NO: 11127 - protein, 272 aa, Methanosarcina mazei
KKYDDFEAVKSISFSIKKGTIFGLLGPNGAGKSTTIKLLTCQFPPTSGTAYIGGLNTVLDAVEIKKKIGVVFESQNLYEELSVYENLNFFRQLYNSPKERINEVLKIVGMERYQKNKVKTFSKGMKQKIMISRALLNDPEVLFLDEPGSGLDPRSAREIRQMILGLKEQGKTILITTHNMEEADFLCDYLAIIHKGSIIAMDTPGNLKKKYGKDVLMIKTVKGDIYESPLNTKASSDIFEKLSENNQISLVHSKEATIEDVFIKLTGEKLTD

SEQ ID NO: 11128 - protein, 233 aa, Methanosarcina mazei
GLALNNSSYYAEALKSYDKAIELNSQDSAAWNNKGNTLSSLYDYEGALNAYNKAVEINPQYSDAWYNKGNTLCSLGRYEEAVTAFNKTLEIDPHNSFAWCNKGIALSSLGNYEEAMKSFDKALEIDSQNSLIWSNKGLALFEFGKYEEAVKAYNKTIEIDQSNTETWNNRGSAFFLIGNYEEAMKNYNKTIELDPEYSLAWYNRACLYSLINDKEQSISDLKRAIEINPAYKE

SEQ ID NO: 11129 - protein, 331 aa, Methanosarcina mazei
EEAIKALDKAIEVNPQNAVAWYDKGSILKNLGNYEEAVEAFDKATELDPKKSSAWNNKGNALSSLGNYDEAIKAYDKAIEIDPQDPGPWNNKGIALSNLGSYEESIKAFDKAIEINLSSSVTWANKGLVLSILGNYEGAIKAFDKSIEIDPRNSIAWVNKGNALYNSGEYEGVITACDKAIELDPKNLDAWTNKGKALSSLGDYEEAIKAYDKALEIEPQDPLTWNNREIAFGHLNNYEEALRAHNREIVSDSEDPEVSWNDKGLALYYSGNYEESVKAYDKAIELDPEYADAWFNKGNSFFSLKNYEEAIKAYDKAIELKPQNSLAWNNK

SEQ ID NO: 11130 - protein, 203 aa, Methanosarcina mazei
MGHLILVRHGEPGLKPEERLAGWVDISLSRKGIEEALQCAAELEKFELDLAFASNLVRTQETLFLILSGQKKTGVVVHESTGKKGNPGKTDWYSYPEKLGKKLIPIYFTPYLNERYYGKLQGRKKQKMEEKYGAEKLASWRWNFQPGPPEGESLKVVYERAVPYFKEKILPAVKAGKNVLICAHQGSLRALVKYIEEISDEDI

SEQ ID NO: 11131 - protein, 377 aa, Methanosarcina mazei
RLIPNQSPHKEPMNMETKGLKDVFDKVFTEIHQARESVTPTLTPKEVGRILTVSTGIANVSGLPTVGFDELIKFPGDLFGIAFNVDEKEIGTVLLGEYSHLHAGDQVERTQRVMDVAVGEELLGRVIDPLGRPLDNKGPIVSSKRLPIERPSPAIMDRAPVTVPLQTGVKVIDALIPIGRGQRELILGDRQTGKTAIAIDTILNQRNFNVLCVYCAIGQRASAVARAVANLRERGAMDYTIVVVTEGNDPSGLIYIAPYAATSIAEYFMEAGRDVLIVYDDLTNHARAYRELSLLLRRPPGREAYPGDIFYIHSRLLERSTHLLKELGGGSLTALPIIETEAQNISAYIPTNLISITDGQIYFSPSLFELGVLAAGD

SEQ ID NO: 11132 - protein, 544 aa, Methanosarcina mazei
IYSLLAPLLMLIEVFMDLQQPRLMANIVDIGVQNRDSGYILSTGFKMVLCAFAGLIGGAGCGVIASFASMMLAGSLREELFHKIQSLSYTEIDHFKTSSLITRLTNDVTQIQNMFLMLLRGMVRSPLLCIGGIFMSFLLSPSLSIVFFIILPILITCVAFVMMRSVPLYTQMQFWLDKVNTVMRENLLGVRVIKAFNLEDKQNTLFSNVNTKFTEKSIRAQNLTFTLMPIATLVMNLSVVAILWFGGNMVVSENIETGKIMAFVNYLVQITNSLIMLVNMIINISRAQASAGRIKEVLVCEASIKECNSPVLPKNYDIEFKNVSFRYGESGEYVLKDLSFLFKEGQTVGIIGATGSGKSSVVSLIPRLYEATCGQVLIGGCDVKDMPVQHLRSSIGVVLQENILFHGTVKENMNFGNEEADEAKIWDGLQAAQAEDFIQALPYKLQSQVEQRGKNFSGGQKQRLSIARTLLKKPKILILDDSTSAVDLSTEARLQFEIAKKMKENTVIVIAQRISGVMDADTILMLDHGSVIAKGTHKEYWKER

SEQ ID NO: 11133 - protein, 333 aa, Methanosarcina mazei
KTTIKLKVAEADQRDVGKGIVRIGESFREKLGLEPFDVIEIKGGKSTSALIGRPYPSDSGLEIIRMDGFIRTNAKTSIGEYVAICKADWKEAKSVIFAPVARGMQIYAPSETLKAVFMNRTVSKGDFISTTSLRKSRESETFGKGVMFEDFFQDFFGQGFEPSFGLGEIKLQVVSTSPSGIVKITDLTQVELLSEATEVIPEQNIPTVMYEDLGGLKEAIGKVREMIELPLNHPELFDRLGIDAPKGVLLHGPPGTGKTLLAKAVANESDAYFISINGPEIMSKYYGESERAIREIFEDAEKNAPAIIFLDEIDSIAPKRAEVTGEVERRVLS

SEQ ID NO: 11134 - protein, 216 aa, Methanosarcina mazei
LLPVYDKPMIFYPIQTLVNAGIKEIMIVSGRGHAGHFLELLGSGADIGVKFTYEIQEEAGGIAQALGLAERFADEEDVAVILGDNIFQDNIKDDVSNFTDGAKIFLKEVQDAHRFGVAELKGDRVIGIQEKPREPKSNFAVTGLYIYSNSVFEVVKTLKPSARGELEITDVNNYFVNNGTMEYRILDGFWSDAGTFESLLRAGVLIQNHCKNKNAE

SEQ ID NO: 11135 - protein, 292 aa, Methanosarcina mazei
  unsure (1)..(292): unsure at all Xaa locations
SGKVSRKIAAKEELLLILPKIDRVLESEPAVLRIDAEPIMIIGDIHGDLQALEFIIEKRQEINCKNILFLGDYVDRGPQGVEVLTRVFRLKLEEPEHIFLLRGNHETVDMNLYYGFFEEIGFDQGFLLRTSRTYDKMPIAAVLSEHTFCVHGGINGTGSIDDIRKEEAFAFPYLWNDPSKHPGLTASTRGSTVKEFGPDIVDGFLQTNNLKRIIRGHTALENGYRWWFDGKLLSLFSCPDYVGLGNAAAFALFEKEEIKLFVFGKQXEXKKTYSKESLPKGRLSKESLPEGR

SEQ ID NO: 11136 - protein, 280 aa, Methanosarcina mazei
IEEWEEYRYVESGINSFIDQMDESSLKKMAEHVCNTGGKRIRPIILLLSSEICSGSYQQSLNAALAIELMHSASLIHDDLLDQGLVRRNLPSAPEKFGPSRALLCGDYLIAKCFEFISPYGEKVVRDFGKAGMDMAEGEVLDLRLDKDNFGENNYFECIYKKTASLFAISASIGAYTGGADEVLAERFNFFGNCLGTAYQIVDDILEFLEVVEGKESKFTSETLPHVYHEEYVKEEAIEKSTDAVKLRVNAAKDALLTFNECPAREKLFQITDYITVDML

SEQ ID NO: 11137 - protein, 307 aa, Methanosarcina mazei
LKTKNVVVTGGMGFIGSHLTERLLEDNEVTVIDNESTGNIENIRHLLDHENLTVIKGSIVDLNLTEIFKDKDYVFHLAAIPSVPRSVKDPFSSNNSNITGTLNVLTAAKDTGIKKLIFSSSSSVYGDTPTLPKREDMPINPMSPYAITKATGEMYCRVFQDLYDLPTVSLRYFNVFGPRQDPNSQYAAVIPKFITAILNDESPVIYGDGEQSRDFTFVKKVVDANILSCESKKTGVFNIACGRRITINQLVDYVNEILGKKIKSIHAEPRPGDIKHSLADISKAKEFGYNPIGNFRDELKTVAEWFL

SEQ ID NO: 11138 - protein, 158 aa, Methanosarcina mazei
  unsure (1)..(158): unsure at all Xaa locations
KIRAAEIEDVPLILEFVKGIAKFENLSHLVAATEETLAEAMFGKKPYAEVFFAELDGVPAGFTVFFHNFSTFVGKPGLYIEDIFVKPEFRGKGIGKAMFLHCVKLAKERNCGRMEWAVLDWNPARKFYERLGGSSADGWQIYRMDEEKFESAFEKXXI

SEQ ID NO: 11139 - protein, 579 aa, Methanosarcina mazei
LWHSLGAEEIFRKLASSSRGLDTEEAATRLHEYGKNILPTRKPPGLAEIVFHQFKSPLIYILLIAGIISVLLNDLRDAGFIFLVVVINAVIGTIQEWKAEKSASQLQTILKIVSRVRRNGSEIQIPAEEIVPGDIVLLESGSRIPADLRILYASNLTIDESLLTGESAAVEKTVDILVEDTPVSDRGNMAYAGSTVITGRGCGAVTATGSRTEVGMIARAVTETESAKPPLLIRMEDFSHKIGIAVIAASVVMSAVALSQGIAPVEVFFLAIALIVSAIPEGLPVGVTVALSIASTRMAKRNVIVRSLSAVESLGSCTTIATDKTGTLTVNQQTAKTVVLPSGDLFEVSGEGYLPVGQIKKIAQTNEASPSDDEEMESLRRLALAATICNEGTLYKEGETWVHHGDAIDIAFLTLASKLGIDQDKVRNEVKIVAEVPFESESMYAAVYYRENKSGPIKIAVKGAMEAILPYCTKMNSLRKVVPTDPDLLNSELNSLMENGYRALVVAEGIVSEETNGAFDLKSVNPELTFLGIVGFIDPLRPDVKEAVQTCKKAGIDVIMITGDHPKTAFAIARELGIA

SEQ ID NO: 11140 - protein, 344 aa, Methanosarcina mazei
LLQKILDGDVALRKIEEFADPETSVKLRRLAIQEFAKLEFEHIQNFSLDVEAASKRNIENMIGAVQIPLGIAGLLKVNGEYANSEYYIPLATTEGALVAGVNRGCSVITKSGGANVRVFEDEMTRAPVFKLESLSRAKEFYEWVKCPEIFEKMKVVAEKTTRFGKLLSVRPFVTGTYVYLRFSYDTKDAMGMNMVTIATDAVMHLIQDEFGAHPVTLSGNMCIDKKPASISTILGRGKTVVAEVTIPKEIVKETLKCTPESMFEVNYSKNLLGSARAGALGFNAHAANIIAAIYLACGQDAAHVVEGSTAITSMELTKYEEIQCSVTLPSLACRTVWGSFGLET

SEQ ID NO: 11141 - protein, 298 aa, Methanosarcina mazei
LIKKFGSLTALNDISFSVGEGETFGFLGPNGAGKTTTIRILTGVSRPTSGTATIFGHDIEHDTIAARQSMGIVSENSNVYDDLTAWQNMMFSAELYHVGRKEREKKANELLKKFELYERRNDKAHGFSKGMKRRLTLAMGLVNSPRLLFLDEPTSGLDVQSNLIIREVVDDLVLEGVTVFLTTHNIEEANVMCDRVAIINKGYIVAIDAPESLKKTMQSVQSIEVSFDHNSADRLDELSRLSMVNGVQKAGDKFKLYTEDPSEVINAVMAYAHTHNLKVVSITTLGPSLEDVFIRLTG

SEQ ID NO: 11142 - protein, 217 aa, Methanosarcina mazei
IEIKDLSKAYMPEKPVLSGINLEFRPPSIVGLIGPNGAGKTTFMKVLVRQLLASTGSIKIDGTDISKSENYLKNRLGYLPQEFGLYEELTVYQFLDYMALLKGLGREKKERIESCIEKTGLSEKKNSRIRTLSGGQKQRVGIAQALLNDPELLIVDEPTVGLDPAERVRFRNLLAENANHRLVLLSTHIIEDVESICNRLIVLNRGEILFDGNPVEL

SEQ ID NO: 11143 - protein, 311 aa, Methanosarcina mazei
KKKCTCDAAIDELLPVAHPEELYKASRYLVDAGGKRLRPAVLILAAEATGSDLKSVLPAAVAVELVHNFTLIHDDIMDKDDIRRGMPAVHTIWGDAGAILAGDTLYLKAFEILSKVQNEPARILKCMDVISKTCTEICEGQWLDMDFEKREKVSKAEYIEMVEKKTSVLYAAAAKIGALLGGASDEIAAALSEYGRFIGIGFQMYDDVLDMVTPEEVLGKVRGSDLMEGKHTLIVIDAFEKGVKLDIFGKGEATQEETDEAVRILTECGSIDYVKDLAISYINEGKAKLDVLRDCPEKELLLQIADYMISR

SEQ ID NO: 11144 - protein, 424 aa, Methanosarcina mazei
MLFKKLSDVSEAEMQKLLSRGSGLEDVAKTVSTVLSDVRTKGDSALREYTAKFDKVELANFGVSEEEFQQALSGISPELLDHLKSAAANIRAFHEAQLPKATWFMELKPGIVLGQKATPLESVGAYAPGGRASYPSTVLMTVIPARVAGVEQVIVCTPPRPDGSVHPLTLAAAKVAGADKVFKLGGVQAIGSMAYGTETVPKVDKIVGPGNVFVTAAKMQIRDVAEIDFPAGPSEVLIIADESADAVMVASDILAQSEHDPNSVSILVTGSDTLAEAVKREVLVQAEQAARSSIIKSSLENAAILIADSLEQCIGFSNKFAPEHLEIMVADPDFVLDRIKNAGSIFIGNYSPVPVGDYASGTNHVLPTSGYARVYSGLNINHFIKYSSIQRISKSGLESLKETVIALAEEEGLQAHADAIRTRF

SEQ ID NO: 11145 - protein, 487 aa, Methanosarcina mazei
  unsure (1)..(487): unsure at all Xaa locations
EEINLRVAEAYHKDVGRGIARIDTRLMQQMGLVSGDIIEISGRAKTYAIVWPNVEREQENRIRIDGNLRSNAKVGIDDQVTIQKVQAKNAQRVTLAPSQPVRLVGGAHYILRIIEGRPLNKGQQIRVETVNNPLTFVVASTRPAGPVVVTKDTDIVIKEKSAEEIRVPEGISYEDIGGLRREIQLVREMIELPLRHPELFQKLGIEPPKGVLLHGPPGTGKTLIAKAVASETDANFITISGPEIVSKYYGESEQKLREIFEEAEKEAPSIIFIDEIDSIAPKRGEVTGELERRVVAQLLSLMDGLNSRGEVVVIAATNRPNSIDEALRRGGRFDREIEIGIPDRNGRKQILLIHTRGMPIQDVSLSEIADVTHGFVGADLSSLCKEAAMHALRRITPEIDIEEDEIPQEILGKLVVTKDDFKEALKNIEPSAMREVYVEVPMXGWEDIGGLENGKQELIEGVEWPXVSGVFKIILKSRGVYIWAPVG

SEQ ID NO: 11146 - protein, 620 aa, Methanosarcina mazei
IPLVAVETEPQNTIVLVTEETLIELRKKPVQGYEKATRGVTTYEDIGGLGAEIMRVREMIELPMKHPELFGHLNIEPLKGVILYGPPGTGKTLIAKAVANESGASFHYIAGPEIVGKFYGESEERLRKIFEEATQDAPSVIFIDEIDSIAPKRENVTGEVERRVVAQLLTLLDGMVERGQVVVIGATNRVDAIDPALRRPGRFDREIHIGVPDTKDRYEILQIHTRGMPIERDEETEEIGKVETEADEAALERERKEKADKYLMYLAERTQGFVGADLLALVQEAAMRCLRENLPDLDLEKEAIPPERLEKIVVTKRNFEDALMEAEPSALREIYVEMPTVSWNDVGGLDEAKQSITEAVEWPIKNPEKFSHMGIKAPRGILLYGPPGTGKTLIAKAVAKESNANFISVKGPEIFSKWLGESEKAIRETFRKARQVAPCVIFFDEIDSIASMPGMESTDSHTSERVLNQLLTEMDGLESLRDVVVIAATNRPNLLDPAILRPGRFDRLVYIGSPDRKGRLKIFRIHTKDTPLAENVNLETLADETEGYVGADIESVCREAVMIALRENFDTEYVEMRHFREALKKVKPTITENIAQFYEKIEAQFKGGQRLTETAGYIGY

SEQ ID NO: 11147 - protein, 378 aa, Methanosarcina mazei
LFGTNGVRGIANEYIIPELAVNLARSLGTYMGSKGTVAVGCDTRISGQMLKSAAIAGALSTGLNVIDVGTLPTPSIQYYVRDHADAGIVITASHNPRQYNGIKLIAGDGTEFPRDGEREIEKIYSSGKYSIVSWEKTGSFRVDPGVNDYYIRNVINAVDAEKIRSRKLKVVIDTGSGAGSLTLPFLLRELGCNVLTLGAQPDGTFPWRNPEPTPDALTELSQLVKITGADFGAAHDGDADRIVFIDENGEFLNEEVLLAMMAKYMLEREKGPIVTPVSSSQRMADVAKEEGVELYWTAVGSINVARKMMEVNAVFGGEGNGGLIFPKHQYCRDGAMACAKILEILAGGKKLSELAKSVPQYFNAKTKVPSVNSQATIE

SEQ ID NO: 11148 - protein, 378 aa, Methanosarcina mazei
  unsure (1)..(378): unsure at all Xaa locations
YENHFFSPXIGRFQMSSIQEQIQEIEDEIRKTQYNKATSHHIGRLKAKIARLRDEIEKKASARGGGEGYSVRKSGDGTVTLVGFPSVGKSTLLNKITGANSAVGAYEFTTLTVVPGVLEHKGATIQFLDVPGLVKGASSGRGRGREVISVIRNSDMVIFLLDVFQPKHYDVLMDELYQAGIRIDQEPPDVVIKKKERGGIEINSTVDLDLDEETIKAVLDEYKIHNASVLIRDNITVDQLIDVVLDNRSYVRSLIAVNKVDLAYPQLIEECRKLYPNAIFISAHEGINIETLKDSIYDRLGFIRVYLKPQGQSADMEEPLIVMSGTNIGQICDRLHRDFRRKFRYAQVWGDSAKHPGQRVGIDHRMQDEDILTIIIQK

SEQ ID NO: 11149 - protein, 221 aa, Methanosarcina mazei
ILSVQSLTKKFDDFTAVKDISFNVETGSIFAFLGPNGAGKSTTIKMLTTVLKPTSGKISINGFNALKEQDKARASFGIVFQDSSLDEELTAYENIVYHAVIYKVPKKERDERIRKSLEIVGLWNRREDYVKNYSGGMKRRLEIARSLVHYPKILFLDEPTVGLDPQTRNSIWSHIRSLNKEKGMTIFLTTHYMEEAEAVADQIAIIDHGKIIESGNVEEIK

SEQ ID NO: 11150 - protein, 414 aa, Methanosarcina mazei
  unsure (1)..(414): unsure at all Xaa locations
LMDGLKARKNVIVIGSTNRPEALEVALRRPGRFDREIELRVPDTDGRLEIFQIHTXGNPLAENVNLMDFAQITYGFVGADIAALCREAAMSALRRVLPKINLNEPEIPAEILDSLQVIREDFENALKDVQPSAIREILIEVPTVGWDDVGGLEEVKRLLKEVVEWPLKNPESYRDIGVEAPKGVLLYGPPGTGKTLLAKAIAHESDANFITAKGSDLLSKWYGESEKRIAEVFTRARQVAPSIIFLDELDSLAPIRGASISEPQVTARILNQLLSEMDGLEELRAVVVIGATNRPDVIDPALIRPGRFDELILVPIPDEGARREIFKVHTEKMELAEDIDIXXXASFAITDQYTGADIAAVCKKAGRLALREDIHAKNVKQRHFLKAITETGPSVTPDTMKYYEAIKGELRTRK

SEQ ID NO: 11151 - protein, 257 aa, Methanosarcina mazei
  unsure (1)..(257): unsure at all Xaa locations
PGKRVLTYRARYEMRNHRGGASFSARETIXRXTGGALAKLLLSRFGILIAGHVLELGALRAKPLSFEEILENVEKTPVRCADLEAAEKMLEKVAALRQEGDSIGGIVELIIRGVPAGLGEPVFDRLDADLAKALMSIPAVKGFEIGAGFEAARLYGSEMNDPFRIKEGKITTSSNNAGGILGGISTGLDIVCRAAVKPTPSIGKVQQTVDLKTLENTEIAIKGRHDPTIPPRMVPVAEAMVALVIADHMLRSGFINP

SEQ ID NO: 11152 - protein, 799 aa, Methanosarcina mazei
IGENVNLKIDEIKDSPADEVLKNLNSSNKGLSSSEAENRIKQYGYNEISEKKINPLIKFFSYFWGPIPWMIEAAAAISGVIHRWEDFVIISLLLILNAVVGFWQEHKADNAIELLKQKMALNARVLREGQWAQIPARELVPGDIVRIRSGDVVPADLKLLEGEYLQVDESALTGESLPVEKKSDGIAYSGSVIQKGEMNALVVATGMNTYFGATTKLVAEIRTRSHFQKAVLNIGNYLIVLAGCIVAIVLVVEELFRHTPFLETLQFALVLIVAAIPAALPAVMSVSMAVGATQLAGKGAIVSKLVSIEEMAGMDILCSDKTGTITQNKLKLSELVPFGDFKENDLLIYGSLASREEDNDPIDNAILQKAKDTESLEDKIKTYTVKKFTPFDPVIKHTEATVKGSEGEFKVAKGAPQVILGMSSNKEEIRQKVEEKVNSMASKGYRALGVCAEEERKYRFVGLFGLYDPPHEDSAETIKTANSLNVDVKMVTGDHVAIAKEIASQVGLGTNIITADDFKEKSDSEAQKVVEKADGFAQVFPEHKYKIVELLQKKEHIVGMTGDGVNDVPALKLADAGIAVAGATDAAKSAADIVFTSPGLSIIINAIQQSRMIFQRMKSYAIYRIAETIRVLFFIATSILVLDFYPITAIMIVLLAIFNDVPIMTIAYDKVKYSQKPEEWNMREVVKVATFLGVIGVFFSFSTIYIGIYFFHLTFNVLQSFIFLKLVAAGNLTIFLSRNRGHFWSPPPGKLLLWAVVITKVIATLFVVYGIYITPIGWGLAIFDWAYALAAFVFIDFLK

SEQ ID NO: 11153 - protein, 359 aa, Methanosarcina mazei
LKIAQICPRYSPDIGGVETHVKEISERLVKAGHDVEVITTDPTGKLRKREIINGVRVLRFRSFAPGNAYYFAPQIYTYLKKHDYDIIHAHSYHAFPAFFASLSRHNGKFVFTPHYHRHGHTAFRDLLHKPYRLFGKMIFSRADSVICVSEYEKKLVESDFEVAAKTVKIPNGINLKEFEDLRQPGKSLNGNSEREKLLLYVGRLEEYKGVQYIIQSLSELQDFRLRIIGKGPYEAELRDMAESSGVEKRIEWLKDLSRKELLECYTDADIFLMLSSHEAYGITVAEALAAGIPCIVAKGSALEEFVDGRNCIGIESPVSKEKVTGALKNIVRQDKIEKSGIDKNIMDWNEVSAEIEKQY

SEQ ID NO: 11154 - protein, 524 aa, Methanosarcina mazei
EKEKAFDPESMNLSIKPGDDFYEYAEGDWIKNHPVPPDKSRYGEFAIVKDRNYDRVKEIMERAASNTSAPDGSLEQKIGRFYSMGMNNATLEKQHLDSIKSELKMIDNISNASDLQTVSTQMMEYDLDTFFSMYAAPDKKNSKIMIATLTQGGLGLPDRDFYFRQDNESIKIREQYLTHVTRMFVFLGDSPEIAENNARTVMRIETRLANASFTNVEDNDEVKTYNKMSLEELQAFAPGINWSCLFVSLGHPDVAEVNVRNPSYFKELSSALQDENIDDWKTFLRWKLILGTSPYLSSDVEEEHFDFYGRKLNGQQEMKPRWKRVIDAENEAMGEAVGRVYVDRYFDPGSRARMQEMVLNLKTAFRERIQDLTWMEPETKKEALKKLEVLEVQVGYPDEWLNYSELEVKNDSYAMNVLRASKFKFHHGPSGLDRIGQPVNRKLWEMNPQETNAYADYNKIIIVFPAGILQPPFFNKDADDAVNYGAIGAIIGHEMTHHFDSQGRKFDASGNLTDWWTQEDAEYF

SEQ ID NO: 11155 - protein, 1084 aa, Methanosarcina mazei
  unsure (1)..(1084): unsure at all Xaa locations
DNSSQVQSNSSSSQHLNIAIVTGYRSHELPLKNLAEEVNSNNSLNLTLSCFMADYVMENDVDLSAMDIIYINMLSPSTAQKLTPTVDSAIANGCVVIDDDTLLNESIPLPEDQIESYREKLNDYWSNGAYDQNNLKNLIFCIASDCCGRSDLLYEEPHTLPERAIYHTNMTGYFTDSLDTYLAWYSNRSDGGHVYDPAKPTIAITMYQSYFPFQIEPIDALISKLEAKDYNVIATYGSDDLASGDFFKQGDEVLVDAIISFTYFGNKFDAEELGVPVINGIVDNYMNRTDYEASSRPLPADKMMKLDLQELWGAIDPIIMAATEVDPETETETSVSIDYQVDWLVDRVESWVNLSEIPESDKKVAIIYYNHGGGKDNIGASYLDVIPSLSNLLDAMSKDGYALNENQTLNETDLLNLMLTQGINIGTWAPGELQKMVDTGKVVLLPESTYEKWFSELPEERQQEVIDQWGPAPGKIMVWENETGKYLVIPRIEVGKNVILAPQPSRGWLDDNEALYHDKDLPPHHQYIAFYLWLQHSEEEGGFDSDALVHFGRHGTQEWLPGKEFGLSRYDWPSLMIGDKPVIYPYVMDGLGEGNEAKRRGGAVIVDHLVPPILSAGSYGNYSNLSEAIQNYEQAEADASLKAAHRSEVLNLTQSLSLDKELNMTEAENNETYFNTTFLEGLEDLLDEYKSQSMPYGLHILGTSPKGEQLVGMVNSMLGTDFADSVNEFNKTEGAQLYLLDLVLNQGVNSTNAQKQVLGKSNETVSTLLSNAEEYAANLALGEEEIDQVFNALDGKFIPGNLGGDPVRNPETLPSGRNFYAFDQRIVPTEAAWTLGQEMADQMLEAYVTEHGTYPKKVAYVLWAGETTRHEGVMEAEILYLLGVKPVWNSGRVVDVEAIPMETLGRPRIDVVMQISGLYRDMYPDKVRLLDKAVKLAYAQEDSPNYVRENADALKSSLTSEGSLNDSEALDLSLLRIFGSSDGAYGTGLPNAISSSDTWESNDALAELYINKMCNAYGEDVWGEDLKDLFKENLEGVEATVHSRSTSSLGTLDYDDLLQXLGGLNLHQDPIGTNIXSYLGNVKW

SEQ ID NO: 11156 - protein, 498 aa, Methanosarcina mazei
MHLIEESLGNYFEKQVAVDPDHEFIIYPDRNLRFTYGQFNERVNNLAKGLLAIGITKGDHVGIWAKNVPDWLTFMFATAKIGAVLVTVNTAYKSHEVEYVLKQSDMKALAMIDSYRDVDYLEIINELVPELKTSERGRLKSKNFPYLKSIIYVGQEKHRGMYNTNELMLLGSHYPDDKLREIMTSVDCDDVVNMQYTSGTTGFPKGVMLTHKNILNNGLSIGDRQRFTYVDKLCFPVPLFHCFGIVLGVMAVLTHRATLVMLEVFDPLLVLAAVHKEKCTALYGVPTMFIAEYTHPMFDMFDLSSLRTGIMAGSTCPVEAMKKVVNDMHCYQITSVYGLTEASPGMTQTAVDDPLELRVETVGKHFPSVEVRVVDPDTNEPVPLNTVGEICCRGYNVMKGYYKMPEETKKVIDEDGWLHSGDLGTCDENGYYRITGRIKDMIIRGGENIYPREIEELLLTMPEITDVQVVGIPDKKYGEIVGAFVILKKGQTLQKSVR

SEQ ID NO: 11157 - protein, 449 aa, Methanosarcina mazei
MENKYDIIIIGTGTAGRTFAGKVAHSGLKIAIVDSREYGGTCPIRGCDPKEVLTNITKVIDSSNRLMGKGVRIDAPLKLDWTSLIKFKKTFTEGYSSKTEKHLVGMGIDTYHGRAHFENQNTVVVGMDKLKGEHIFLATGAKPRTLNIPGEEYIITSEKLMETKKLPEKIIFIGGGYISMEFAHIARRTGAEVTILQRSEKVLRAFDSDMVDLLMKASKAAGIKILTNKPVISVEKDNNGLILKVQSQSETEPEIQIFRADMVVQGAGRVADIEDLRLENARIKTEKGAIVVDKHMRTSNSRIYAGGDCALEGMQLTPVAALQGEVAAINVLEGDSAEADYTGIPSAVFTIPVLASVGISVAKDDDKYKVIFQDRSNWYTTRKKGMEFAASKVIIDEANDRIMGAHILGPNAEEAINIFASVMRLGLKASDIKKLIFTYPTTCSDIPYM

SEQ ID NO: 11158 - protein, 453 aa, Methanosarcina mazei
EKITAKLKVAEADQRDVGKGIVRVDDSFREKLGLKPFDVVEIRGGKSTSALLGRPYPSDSGLDIIRMDGLIRTNAKTSIGEYVDIRKADWKEARSVTLAPVAKGMQIYAPSETLKAIFMNRTVSKGDFISTTSLRRSRERETLGKGIMFEDFFQDFFGPGMGQSFGLGEIKLQVVSTSPSGIVKITDMTEVELLPEAAEITPEQNVPTVMYEDLGGVKEAITKIREMIELPLKHPELFDRLGIDAPKGVLLYGPPGTGKTMLAKAVANETDAYFISVNGPEIMSKYYGESEKGIRDVFEDAEKNAPAIIFLDEIDSIAPKRAEVTGEVERRVVAQLLSLMDGLKARKNVIVIGSTNRPEAIDMALRRPGRFDREIELRVPDTEGRLEIFQIHTRGMPLAENVNLMDFAQITYGFVGADIAALCREAAMSSLRRILPKINLNEPEIPSEILDTL

SEQ ID NO: 11159 - protein, 141 aa, Methanosarcina mazei
LNDVIIVAATNRPDMVDPALLRPGRFDRLIYIKPPDNISREKIFEIHTQGKPLAEDVNLSELADMTEGYVGADIEGICREAAMLALREIVTPGASRKDIEKRAGEVIISKKHFERAIRRVKPTTSRESLAAYERSAELFAK

SEQ ID NO: 11160 - protein, 406 aa, Methanosarcina mazei
  unsure (1)..(406): unsure at all Xaa locations
QHLCTCAAGLKLTPDMEAFLEMPMRELYVSLPVHMDDGSIKVFKGFRVQYNEALGPTKGGVRFHPEDTMETTRALAALMTWKCALHKLPLGGAKGGVICNPKELSHREIERLSRAYIRGIYQIIGPDRDIPAPDIYTNPQVMAWMMDEYSKLAGRNVFGSITGKPTSLGGSAGRYDATARGGLYTIREAAERIGISLKASRVAVHGFGNVGYHAAYLANKLYGCKVVAVSDSKGAIFSPYGLDPEDVSGHKHSTGSVLDYPEAENLTNKELLELDVEILIPASLENIITEENAGNIKARILAEMANGPTTVEGEAILNSKGIHIIPDILCNGGGVIVSYFEMVQNQSSTQWEEEEVQNRLERKMKEAYFSVYDFASKNNVEMRQAAYTLAVGRVVEAMQLRGXIXK

SEQ ID NO: 11161 - protein, 301 aa, Methanosarcina mazei
IEVNNLEHSYGSVKAVDNISFTVKQGEIFSFLGPNGAGKSTVINILTTLRKLQKGNARVNGYDVTKEPNSVRRSIGIVFQMLCLDHEMTVSENLEYHGRIYSMKKKERNKRIEELLKLTDLENKKDTLGKDLSGGMKRRLELARGLMTKPAVLFLDEPTIGFDIQTRMRMWEYLREIKREGTTIFLTTHYMEEADQLSDRISIIDHGKIIVTGTSNELKNKLGKDLIYLETSDNKAAAEILRSLVSVKSVTEDTKSLRIMIGEDVTHVLPQIMEKIRREGIDIIIVNIKKPSMDDVFVHYT

SEQ ID NO: 11162 - protein, 326 aa, Methanosarcina mazei
MKILQVTNFFKPSWEAGGIARVAYEISKNLVQQGHEVTVFTTDGFKSRLKTIKNKPVNVDGINTYYFRNLSNYLTKRNIVIPYYLPFIARIKIQDFDVIHIHEHRTLLAVIVHYYSKKYNIPYVLQAHGTLPNTIGKQNLKKIFDVLWGNKILKDASKLISVSNTEVDQYLQMNVPIEKMVIIPNGIDVDSLSSLPEKGSFRARYHINQKHAILYLGRLHKIKGVDFLLRSFVELVKDIDDSVLILAGPDDGYKDKAKEQIREFGLEKKVIFTGYMGPMDKISAYLDADILVYPSSFEIFGLVPFEAIMSGTPVIVTDDCGCSEFI

SEQ ID NO: 11163 - protein, 382 aa, Methanosarcina mazei
  unsure (1)..(382): unsure at all Xaa locations
GLLLLVKGSDLFVLTSSRIARRFGVSEFVIGLTLVSVGTSVPELASSLTASFQQASGIVIGNILGSNIANIGLIASTAALLTNIKTEEVMLRRDGYIMLFASFLLFFFMLDFKISRLEALIFILFYLAYLLFLLDKVKRHEEEIYFKDFMIYFFKFEYLFDLKSRIKLQVQEREKRNQTLKKRKKAPKXPEKELKENESESEIEMRTKNESXPNWEPIENGSXIXRYXCRSYRRKPLRNQPFNRIFKLIASGAAIIIGAKYFVEQAVFFALLLEVPETLIGISLVAVGTSVPELMVTISAARSDYAGIALGNVIGSNIANILLILGCSGLVHPITVTGLSIYYIAPFMLIMSLLLILFIRTGWRVKKFEGLILILLYLSFMV

SEQ ID NO: 11164 - protein, 351 aa, Methanosarcina mazei
MKGFAMLEIGKVGWIDTERPSAGPYDAIVRPIAVAPCTSDVHTVWEGALGNRKNMILGHEAVGVIEETGSEVKDFKPGDKVIVPAITPDWRSIEAQDGMPMHSNGMLSGWKFSNFKSGVFAEFFHVNDADMNLALLPKGMPLEQAVMLSDMATTGIQGAEMAKIKMGSTVAVIGIGPVGLMAVAGATILGAGRLIAVGSRKVCVDLALEYGASEIVDYRKGGLVEQILEKTNGKGVDSVIIAGGNENTISDAVKIVKPGGTVSNVNYYGTGDILPIPRIEWGSGMSQKDIRGGLTTGGRLRMERMADLCTYGRIKPEKMATHVFKGFDKMEEALMLMKEKPRDLIKPVVLL

SEQ ID NO: 11165 - protein, 233 aa, Methanosarcina mazei
EFAIETIHLSKFFGKENQIRAVDNLNLQVRKGEVFGFVGPNGAGKTTTMKMLIGLLEPSEGSGKVAGFDIIREVINIREQTGVLPEPAGFYDNLTARQNLRFYAKLYNIEPDVREKRIVNLLETVGLTRAIDQKTGGFSTGMRKRFGLAQALINEPSVLFLDEPTSGIDPLGAQMMRDLIKDLNRSKGVTVFLSSHSMEEVEEICDRIAIIARGKLLAVGSVEDLRDIVRAKE

SEQ ID NO: 11166 - protein, 823 aa, Methanosarcina mazei
EMLQRLQTTYEGLSSSESSERLKKYGANLLKPKKSSNTLKILLSQFKSPIILILLFAAGLSFFLGDVTDTVIIITIILISSLLGFWQEKGAADAFEKLLSAVEVKATVVRDGEEKEVPIEQIVPGDVIIFSAGDIVPADCLILESKGLFVNEATLTGETYPVEKSTKTLNSETPLAKRTNSLWMGTSVESGSGKALAVTTGKNTEFGKISEELRTSAPETEFERGIAKFGHFLMEVTMLMVITIFAINVYLQRPILDSFLFSLALAVGLTPQLLPAIISVNLSHGAREMAENKVIVKRLASIENLGSMNLLCSDKTGTLTEGELKLHSIRDVKGSQSEKILLYASLNAYYQKGFKNPIDRAILTQNRFEMGEYKSLDEVPYDFIRKRLSVLVSKNENNLMITKGALSNILEICTLAEVEPGKIVEISEVKEKIEQQYKDFSEKEFRTLGVAYREINRQTKIEKEQEKGMTFIGFLLFFDPLKPEIAKTIENMEQLGISLKIITGDNRLVATSIGKEVGFDASRILTGSEIYQMTSEALIGKVNDIDIFAEVEPNQKERIILALKKRGNVVGYLGDGINDASALHAADVGISVDRAADVAKEAAQIVLMEKSLDSLVEGVKGGRKTFANTLKYVFMATSANFGNMFSMAGASLFLPFLPLLPTQILLTNLLTDFPEMTIATDTVDKELVEEPHRWDINFIRKFMMVFGFTSSVFDYLTFGTLLLLLPGMIEQFRTGWFIESVISASMIVLVIRSRKPFFESRPGKYLLIATVLIVVMTLVFPLTPFAALFGFKPLPLQVILTLGAIIGLYIIAAEAIKRIFYKK

SEQ ID NO: 11167 - protein, 332 aa, Methanosarcina mazei
IFLLGLVLLVKGSDYFVKSASTIAEKLGVSEFIIGLTLVALGTSIPELASSIAASLQHASGIVIGNVVGSNIANIGLVVGLSAVISPVKTEIEMLRRDGYVMLFAAVLFFVFILNREISILESAFFILIFIAYVFFLFEESEKYKGKLHFKEFIIYFFKFEYISSARQKFNCIRDSNAEGENCQSREGFTKDILVLVLSCGAIIIGAKYFVNKSIFFAELLGVPETIIGTTLVAFGTSLPELVVTLSAAKQGFGSIALGNIIGSNIANIFLIIGFSGLIYPIPVEQISLFFTTPAMILISVTLLVFISTDWEIKRWEGIALVAFYASFLIVL

SEQ ID NO: 11168 - protein, 664 aa, Methanosarcina mazei
YPFTAIVGQEKMKKALILNAINPKVGGVLIRGEKGTAKSTAVRALANLLPEIQVVEGCKYRCDPNDVNAMCEECLEKVKAGALKSSSIKMKVVDLPVSATEDRVVGTLDIEHAIKKGEKRFEPGVLAHAHRGILYVDEINLLDDHLVDVLLDSAAMGVNTVEREGISFSHPANFVLVGTMNPEEGELRPQLLDRFGLCVDIKGIMDVARRVELIKYRLSYETDPEAFAANWQAAESELCEQILLAQKLLPEVKISDSMLELISQICVDMGVDGHRADITMMKTSITLAAFNGRTEVLEEDVKEAAELVLPHRMRRKPFDNYSDKQDKLNESMEKQREKKKEKEKEKEKNKNEQQKKEHNEQSGKAQAHPEEQNSDDPQDSTGEQPDASSETIFATGEGYQIKQFSPDFRRENRNGSGRRSKTLTKSTQGRYIKSKIPEEKTTDIAFDATLRAAAPYQLVREKNGNSIVIHDLDFRQKVREKKIGNLVLFVVDASGSMGAQQRMVASKGAVLSMLMDAYQKRDKVGLIAFKGTGAELLLPPTSSVEMAQKYLEELPTGGKTPLSHGLMKGYETIHAELRRDPDTCPFMVLISDGRANVSMNGEPPLQETKTIASMFRKECIQSAVIDTESSIIKFGLAQEISSALGAKYLALEDLKADSIVEAVR

SEQ ID NO: 11169 - protein, 408 aa, Methanosarcina mazei
YKIQKIHAREILDSRGNPTVEVDVFTPKGFGRAGVPSGASTGTNEALELRDADPNRYGGKGVLTAVKNVNTIIQKELLGLDVRNQREIDELMIELDETDNKSNLGANAILGVSMAVARAAADSLNVPLYRYLGGSNAFTLPVPTMNVLNGGKHAGNDLAIQEFMIQPKGAETFYEALQIGAEIYHVLGKILEKKYGRSSTNVGYEGGYAPKMSESTEALDALAQAIEEAGYTDTEVTIGLDAAASEFYEDEAYAIDGKKLSAPELMDYYVELVNSYPILSIEDPFYEEAFEDFEALTNELWDTIIVGDDLFVTNIERLSKGVDMGAANALLLKVNQIGTISEAFDAANMASRNGYTVIVSHRSAETEDTTIADISVAIGAEMIKTGAPARGERTAKYNQLLRIEEDLG

SEQ ID NO: 11170 - protein, 219 aa, Methanosarcina mazei
EQIHMPLIGDDAPSFTAVTTQGQINFPDDYKGKWVILFSHPADFTPVCTTEFMTFASMQEEFREMNTELIGLSIDSVFSHIAWLKRIEEKIEYKGMKNLEIKFPVIEDLKMDVAKKYGMIQPKTSTTQAVRAVFIIDPEAKIRTILYYPQSTGRNMQEIKRVVAALQKNTAEKVATPANWQPGDDVIVPAPSSMEALKERTGKLEENMYCLDWFLCFKK

SEQ ID NO: 11171 - protein, 265 aa, Methanosarcina mazei
KIGFIGAGKMGSALMQGIIKAGIVKPENLGAADVYEPFLNDLKAKLGINISTDNSVIARASDILLLAVKPQTLGSVLENLKADITSDKLIISIAAGVPLATYENALPAGTRVIRVMPNIAATVSEAASGIAPGKNATPEDVKTALEIFSAVGTAVQVSESIMDAVTGLSGSGPAFIFPVIEAMADGAVLEGMDRKSALTLSAQTVLGAAKMMLETGLHLGELKDMVTSPAGTTIQGVHALEEAGVRAAFMNAVIRATERSKELGK

SEQ ID NO: 11172 - protein, 304 aa, Methanosarcina mazei
KISVIGAGNVGATTVQRLAELELGEIVMTDIVEGLPQGKALDLIQAGAIKGYDTSIIGTNDYAEIVDSDLVIITAGIARKPGMTREDLIKTNSKIIAEVSRNIAKYAPDSIVINVTNPLDIITYIAMKSTGFETKKVFGMSGVLDSGRFASFIAEELKCSKKDVQAMVIGGHGDLMVPLPQYTTVSGVPLTDLLPGDRIARLVERTVNGGAEIVELLKQGSAFYAPSAAIVSMAEAVIKNSKRILPASAYLEGHYGQEGIYFGVPVKLGASGVEEILELKLDESQYETLRKSSETIRNTISQLE

SEQ ID NO: 11173 - protein, 384 aa, Methanosarcina mazei
YSDRINALPPYLFATIDEAKDELIARGVDVIDLGVGDPDLPTHPHIVEAMREAVCDPKTHQYPSYAGMPEFRKAAADWCKKYKGVELDPATEVLALIGSKEAVAHIPLAFVNPGDVVLYTDPGYPVYKIGTMFAGGEPYPLPLTAENNFLPDLDSIPENILKKAKLFFFNYPNNPTAATADMQFFEKVVKFCKKYDIIAVHDNAYCQMTYDGYESPSFLAANGAMDIGMELYSHSKTYNMTGWRLGFAVGNKDLIMGLGKVKSNVDSGVFDAIQIAGIAALCSSQTCVEETTKIYQERRDALIEGLKAMGLKVKLPKATFYIWAPVPEGFTSMSFAKLLLEEAGIIATPGVGFGEAGEGYIRFALTKSVERIREAVERMKKLKF

SEQ ID NO: 11174 - protein, 454 aa, Methanosarcina mazei
  unsure (1)..(454): unsure at all Xaa locations
MKIKSVNPYTEEVNWTYDSFSFEECESRIENSRAAFSGWSSLSVEERTKYFSRAGKVIRQNAEIYAEIITKRDGKSYQTDQEARLKTCACLCDYYARKPRQSFXKTKFVDIGSXKKYVTLEPLGLIFGMMPWSFPFWHVFRLAVPAMCAGNVCVIKHSSNMPASALEIEKIFLEAGFPENVFNTLLIDSKTAMEIIEEELVDGISLSGNIDAGSEIGELAGSLVKPLVLELGGSDPFIVLENADLERAVQVAAKSSFLNTGQSHIAAKRFIVLEDIAVDFIEAFELEIQKLKIGDPMDEETDIGPLAKKEFLDSLERVLKDAKKKGAEPHVYGEEQSKGFFFRPTLIPAASTDMKVCNVEVFGPIVPVITVKDEDEAVKVANSTEFGLGAEIWSRDLERAQRLAKSIKSGFVVINGMVKPDPRLPFGGVKKSGIGRELSHYGLKEFVNIKTVVV

SEQ ID NO: 11175 - protein, 540 aa, Methanosarcina mazei
RYLEVMRVLLKYNLIPELYRDLRTDYISNPECTCTFDLENRQTAIKLRKAFEDLGPTFIKIGQTMSKRPDLVPHPYVIEMSNLQDKVKPIPFEEMAESLDLACVCEFETLEERKRKKTDAELKASRERKAKAFIEIFDSFDPEPIASGSIAQVYKGVLEGKTVAVKILRPNLIDIINIDLSILDDFRPVMIKVLGLGSNFDIDAFSLEIREMLTREVDLRTEAVNMRRFEDNFKNVKNVSVPRIYPDYCSANVLTMEFIKGTQIKDITNMPVPQSKKSEYTRIITKSYLKQVYIDGFYHADPHGGNMLVQENNTIAFIDFGAVGSIDDELKKNMLKFYYAINNRDVEGATQGFLKIGGADVRDVDIRRLRKDMDSLIANQNYGLEGRQSDNYAKLGLKYDIRLPGEFSTLQRAILLIEGVCLELDPKYNIKTIAIPVLMDAYKKLNTPKGTALHIEFSTEPMDEKAELRDAIREVTDKMEGMGDKFLFLKQKETRKTTFSKELYLAVLLIVSTYILLNGGVFSWVGLAGFAGSVLIALLL

SEQ ID NO: 11176 - protein, 374 aa, Methanosarcina mazei
MKIAFVYDAVYPWVKGGAEMRIHELGKRLSARGHEVHIFGVKWWEGEDTFEYDGMTLHGVCKARNLYVNGRRSISEAIIFAAKLFPELRKENFDLIDVSVFPYFSCFSVKAVSILKKVPSVLTWHEVWGDYWYEYLGRAGIFGLLVEKVVSKLSENNIAVSKWTKDKLEGLGVPGDKIAVIPNGIDLKRISGIEPNWEMNPVSPENKAYDIIFAGRLIKEKNVDLLIKAVALLKADFPGLKCCIVGDGPEKAALEKLARRSGVCENVEFAGFQEYGALIGKIKASKVFVLPSSREGFGMVVIEAFACGVPVVTVRAKYNAAQGLVEDGVDGFIVGIEEREIAKAVVKIIGKASRNRKASEAALSKAENYDWEEI

SEQ ID NO: 11177 - protein, 231 aa, Methanosarcina mazei
KEKNLTNLNLSGNQLTQVPQEIGELKNLTMLDLSENTLTILPQEIGELKNLKTLDLSGNQLIQLPSEIGRLKNLTILNLYDNQLTQLPPEIKELKNLTALTLFNNKLTQIPPEIGKLKNLETLYIYCNQLTQLPPEIGELKNLSILALNKNKLTQLPSEIGNLKNLETLSLYRNQLIELPPEIGKLENLKTLYIDNNKLTILPPEISELKNLITLNLSANPLTSPPPEIVS

SEQ ID NO: 11178 - protein, 788 aa, Methanosarcina mazei
  unsure (1)..(788): unsure at all Xaa locations
VMPLFEVVVYPKSRAKFLADKVTGEILLNDMKNAESVSAIGLTVKNGTKASDLSEESLYKIGNLLNITYVQPSDDGYLVVAKGIERVEAVSLYQKNGLFYATYRPVHDLPDFDEDAETEVMANIKKTIHEISARFQGSEQFTKSIDKMDSIDQIMGFVMPYIPVKLAEKQRLLELASVRERYLLFLHILTKHKENINLQIEMAKKVTDKISKSNREAMLREQLKVIQEELNEGDDSASGDAAYREKIENSTMPDEVKKKAFSELKKLETGGSHNPEAPGIRNYLDLLLDLPWITEEKKSIDIAEARRVLESNHNGLEKVKERIIQHLAVMKLKHEKQGSILLLIGPPGTGKTSLGKSIADALGRKYIRISLGGVKDEAEIRGHRRTYIGALPGRIIQGMRKAGTKNPVFILDEVDKLSASYSGDPASALLEVLDPEQNSTFSDHYLEIPYDLSDVLFIATANSMANIPWPLLDRMETIEISGYTKNEKLAIAKDHLVPCILEDHGLDAEKLKIEDEALKVIIDKYTREAGVRGLKKQLAKTARFVSEKIVSGKADLPYVVRADMLKEILGKEIIRQEEARKENVPGVVTGLAWTPVGGDILFIEGTFMPGSGKLTLTGQLGDVMKESAKISLSLVRSRLANTANSFDFTSSDIHIHVPSGATPKDGPSAGVTLFTALTSLIIGKAVDPKLAMTGEITLSGAVLPVGGIKEKVLAAHRAGIKKIILPKENERDLEDVPEDARNELQFVPVETIEEVLREALDIDLPRPVVPSSYPGSSYAPAHSVXKLR

SEQ ID NO: 11179 - protein, 92 aa, Methanosarcina mazei
ILNRVYEIILDRKQNYDERSYVCKLLNHRKGMNKILEKVGEESIETILAVRNENHEEIVSESSDLIFHLLVMLAANNVTLDEIAAELSARHE

SEQ ID NO: 11180 - protein, 364 aa, Methanosarcina mazei
MEKHKIAMISDWYFPKVGGIEYSMHTLAKTLSMHGYEVSVITRSYPGVPEYSKRDGVSVIRLKGRPLPGQSRFLMPGAYKELFNLLKDGDYEIVNCHGLDSPIGMIALIVSRKLGIPVVVTNHSLVGDTPYSSLLYLAGKLLLKNTDAVIAVSSAVEKDSNLMTKKPIYRIFNGVDSEDKIIKVPFPVNTEGKLVIVTVARMTRKKGVQNIVDLAPLLLEKHKNLLFVMIGDGPLREKLESTVEESGLSGNFYFTGEVSKEKVLGYLEQADIFALPSSNEAFGISILEAMSKEVPVVAMNNSGVSDIIRNGVNGYLADSLTEFSDYLENLIEKQALRTSFSRKALRGLSNYDWNLICKQTSKVY

SEQ ID NO: 11181 - protein, 613 aa, Methanosarcina mazei
VVLNHNGWVNNVVFSPDGKYAATASNDNTARLWDADTGKQIFVLNHSGWVNNVVFSPDGKYAATASNDNTARLWDADTGKQIFVLNHGDWVNNVVFSPDGKYVATASNDNTARLWDADTGKQIFVLNHNGSVNNAVFSPDGKYIATASNDNTARLWNADTGKQIFVLNHNGSVNNAVFSPDGKYIATASNDNTAGLWDADTGKQIFVLNHGSWVNNVVFSPDGKYIATASFDNTARLWDIATGNSIFALNHDSWVYDVMFSPDGKYVATASGDNTARLWDTDTGNPILIMNHNGSVNNVVFSRDGKYIATASDDKTAGLWDIAATEVLNHNGPVYGVVFSRDEKYVATASGDNTARLWDTDTGKQIFVLNHNGPVYNVVFSPGGKYVATASKDNTARLWNADTGKQIFVLNHNGRVYNAVFSPDGKYIATASGDDTARLWDTDTGKQIFVLNHSGWVYDVVFSPDGKYIATASFDNTARLWNAATGEQIFVLRHSDKVLSAVFSPDGKYVATASNDNTARLWDADTGKQIFVLNHGSWVNNVVFSPDGKYIATASNDNTARLWDADTGKQIFVLNHSGWVNNVVFSRDGKYIATASYDKTARLWNADTGKQVF

SEQ ID NO: 11182 - protein, 220 aa, Methanosarcina mazei
IEIRKLSRYFGNLLAVDNLDLDVGNEIFGLLGPNGAGKSTTVMMLTTLLKPSSGTAKVCGYDIVKESKKVRSKISYVPQDMAVDRKLTGRENVLLYAKLYGIPNRESKVDEVIEMMGLSDRAGDLVATYSGGMRRRLELAQALVHEPEVLFLDEPTLGLDVSGRKKIWEHIRMLKAEGMTIFMTTHYLEEAEKYCNRVAIIDKGRIAVIGSPENLTHSIG

SEQ ID NO: 11183 - protein, 420 aa, Methanosarcina mazei
GPRAREIIEQDCKITSACTARPYPLVVDSAKGSVIRDVDGREYIDLIAGIAVMNAGYSNPEVKAAISAQLEKMTHCGYGDFFAEPPVKLAKKLEDLSGYSKVFYCNSGTEAVEAAIKLAFWKTKRQGLISFYNSFHGRTLGSLSLTCSKARQKEHFPVLHTAHSHYAYCYRCPFKLEYPSCGIECAKELENLIFRRELSPTDTAAVFVEPVQGEGGYIVPPPEFHKEVRRICTDNDVLLVADEVQAGCFRTGPFLAMENFGVRAEISCFAKALGGGLPLGAMLADRELMDWPQGIHSNTFGGNLLASAASLASLEFLEKENIEHRVKELGSQMKQRLRELQENFPCIGDVRGLGLMVGVEIVKPDKSIDPIQRDRILRKAFKEGILLLPCGDSVIRFSPPLVITDEELDSGLEKFQKALE

SEQ ID NO: 11184 - protein, 480 aa, Methanosarcina mazei
DFMVQEYKLFIGGEFKDSSTGETFEDINPATLENLATIQVAGAEDVDMAVEAAEAGFRLWNEVPAAKRAEVLFRAARILQERKEELSVLMTKEMGKVLPETRGDVQEAIDITNYAAGEGRRMLGETTTSELKEKFCMTILRPIGVVGLITPWNFPIAIPAWKVMPALVAGNAIVFKPASDTPLLAFKLIEVLSEAGLPPGVINLVTGPGGTVGKAVVQHPRIKAISFTGSLDTGKWIMEECSKTMKRVSLELGGKNPVIVMDDADLELALEGVLWGAFGTTGQRCTATSRLILHEKIKDEFIKRLLAKAKALSIGGGLLPETDIGPVINKAQLEKIERYVKIGKEEGATLLYGGNRIDPGLPGYFFEPTIFTDVRPDMRIAQEEIFGPVLGIFTVSDLEEAITLANSTKYGLSSAIYTGNIGNAFRAIEKVEAGITYVNAPTIGAEVHLPFGGVKGTGNGFREAGTEAVKEFSEVKAVYI

SEQ ID NO: 11185 - protein, 150 aa, Methanosarcina mazei
SDLKKATFAAGCFWGIEEAFRQVKGVVATAVGFSGGHFERPTYEQVCTLDTGHAEAVRVIFDPKVVSYETLLDVFWKIHDPTTKDRQGPDVGKQYRSVIFYHDEKQKASALASKEKLEKSGVFKNPIVTEVVPVSEFYMAEEYHQQYFEK

SEQ ID NO: 11186 - protein, 679 aa, Methanosarcina mazei
EDIENIESSVKVSEDIENIESSVKVSENSETTEATSIALNKTFHFWHVYVRGLKPGVHYAYRIGGPFDPSRGCRFDGDKVLIDPYSKGNNKTLWNREKACMPGDNLAFSMRSVVIDMSHYKWGNNSHVTAEKIYEMPGMGEKLYGKKRLQELNETIIYELHVGGFTRSPTSGATASGTFSGVIDKIPYLKELGITAVELMPVFDFDDATSLDGRKQYWGYDPICFFAPHSGYCVNPEYGAHMEEFRDMVRALHKAGIEVVLDVVFNHTAEGDNLGPVFSFKGIDNSIYYLLEPDEQYYSNYSGCGNTVSCNHPISQKLIVDCLKYWAKEMHVDGFRFDEGSILSLDTNGKVMKYPPVIWQIELDDALGYIKVIAEAWDAAALNQVGYFPGPRWAEWNGYYRDEIRRFVRGDPGIVRRVASRIAGSPDLYQSESRLPINSVNFVTCHDGFTLNDLVSYNHKHNEANGENNRDGIENNLSWNCGVEGETEDRRSKPCRERQIKNFAAILLLSIGVPMICMGDEVRRTQKGNNNAYCQDNETSWFDWDLVEKNHDMFRFWKLMIDFRKRHTTILRPRYFTGKENERGLKDISWHGCKLYSPGWDDPHARALSFTMGEPGDEEDIHVLMNMYWEPLEFEIPELKGISRSWYRAVDTFLPSPQEIAGAGEETQVNGNSYIVQGR

SEQ ID NO: 11187 - protein, 293 aa, Methanosarcina mazei
GEIKAVDNISFTVKKGEIFSFLGPNGAGKSTVINILTTLLPMQKGRVTIAGYDLRTEPEKVRESIGIVFQELTLDRDMTVREILEYHGRLYSMPKVQRQARVDELLSLVELEAKRDVLTRHLSGGMKRRLEIARGLMTRPRVLFMDEPTIGLDPQTRIRIWDYVKDINRQGTTIFLTTHYMDEADQLSDRINIIDHGEIIVTGKPWELKNALGEDLIYLETSDNRGASSLLEKLDTVKGVRGKSKGIIAMVNVDGTYLLPEIMDKLRNGGIKIRAVNLKKPSMDDVFVHYTGR

SEQ ID NO: 11188 - protein, 340 aa, Methanosarcina mazei
LSKVALITGITGQDGAYLAELLLEKGYIVHGIKRRSSSFNTARIDHLYKDPHERNVNFFMHYGDLTDSTNLIRIIQEVQPDEIYNLAAQSHVQVSFETPEYTANSDAIGTLRLLEAIRILGFEKKTRFYQASTSELYGKVQEVPQKETTPFYPRSPYAAAKLYAYWITVNYREAYGIFACNGILFNHESPIRGETFVTRKITMAATRIKYGMQDRLYLGNLDSKRDWGFAKDYVEAMWLMLQQEEPDDYVIATGETHSVREFIELVFKELGIDIIWQGKGEEEVGIDALTNKILVEVDPEYYRPTEVEMLIGDSSKARRKLGWQPKVRLEELVKMMVKSD

SEQ ID NO: 11189 - protein, 302 aa, Methanosarcina mazei
  unsure (1)..(302): unsure at all Xaa locations
MKAVVLVAGKGTRMEPLTSGCPKVMLQVANKPILEHILNSAIEAGIEGFVFITGYLEKQIKEYFGDGNKWGVSIEYVQQKEQLGTANAIGCAKGYVDGTFLVLNGICSXSRRTFKTLVSRTVEAVICVKEVENPADFGVLETENNRVVRIIEKPKNPPTNLANAGIYLFRESIFDFIDRTKASVRNEFEITDSIQMLIDSGTAVGYSPLEGRWIDIGYPWDLLKANEYLLKGLKSSCEGTVEPNATIKGEVVIGKGTIIRNGSYIEGPVVIGENCDIGPNCFIRPSTAIGNHIRVGNAVEIK

SEQ ID NO: 11190 - protein, 414 aa, Methanosarcina mazei
KLFGSSGIRGIANKEITPELALNVGLVLGSRKKTAVIGRDPRVSAPMIEHALIAGMTATGCAVTEIGLVSTPTLAYAAREYECGVMVTASHNPSEYVGIKLWNPDGMAFDSAQQEEIEKAIEDADFSLVPWNLIGKFEEDGNAIRAHMNMIKKLVGSSSLKVVLDCGCGAGGTITPYLLQELGCEVITLNAQPDGHFPARNPEPNDENLTMLKKAVVDFGADLGIAHDGDADRMMAVDEKGNFVSGDEMLAIFGLYECSGKKGTVVVPVDTSMMVGDSLQGSEIVRTRVGDVYVAEGIKQSGAIYGGEPSGSWIFPKISYCPDGIYAAAKLVEIVKEKKLSELREELPRYATKRGALPCANDKKAEFMEKVKAKLEPLGKVLDIDGIRVEMDNGWVLVRPSGTEAKVRITAEAR

SEQ ID NO: 11191 - protein, 617 aa, Methanosarcina mazei
MCGIVGYAGENSAASVIIESLKKLEYRGYDSAGISILGSGIDTYKSVGKIVNLEATIPDGISGNIGIGHTRWATHGRPSTINAHPHTSGNPCKISVVHNGIIENYMALKEQLTAEGYEFKSETDTEVIAHLLHKHIYGKPDGREAKCELLTGLREALKEIEGSYALAVICADEQGKLIVARKDSPLVIGLGKRENFAASDVTAFLNYTRDVIFVNDFETAVLTPTSVEIFDREGKVREKKIEKIEWDFEAAEKAGYEHFMLKEIHEQVSAIHNTLAGKVSELEGTIDLKELNMTDEEIRKLSRVQILACGTSWHAGLLGKYLFEQLAGIHCDIDICSEYRYRSPVISDGTLAIAITQSGETADTLAAVREIMSYNCPTLAITNVVGSTITREANSVLYTRAGPEIGVAATKTFSTQITLLYLLAVKFALSRGKLSPDYVKGFITGLRKIPGQIQQILNQKEAVKECAENFAHEENYFFLGRHLNYPIALEGALKLKEISYLHAEGFAAGELKHGPIALLEKGTPVVTIATRGQTYEKVLSNIKEVKARDATVIAVADNKDTEIGKYADVVLTIPQSSELLSPLLSVVVLQLLAYYTALARGCSIDKPRNLAKSVTVE

SEQ ID NO: 11192 - protein, 360 aa, Methanosarcina mazei
IMCGGAGTRLRPLTFKHPKPSIPILNKPSVRHLIEHLSREGFNEIVMTLGYMGERIEEQLGDGHMFGVHIDYVYEKEKLGTAGGVKNAEEYLKDEPFIVLGGDHVLNLDLREMYRFHEANDAPVTIGLLSIDDPREFGIADMDINNRIHRFLEKPKAGQIFSNLASTGIYICSPSIFEWIPKGKKYDFAKDLFPFMLAADKKINGVLVRGKWTDVGSSAAYRQAQRWMLDALPGTTIEGNFTTRNARIKGPLSIGNNVCIGSNSSLVGPIVIGENTTIGDNVLIGPYSVIGSNCTIENNTKILSSYLFDNVFIGKDSNLSGGVVSDETIIGEHCFLENGTVIGHKVLIGSNSTIHSGVKI

SEQ ID NO: 11193 - protein, 219 aa, Methanosarcina mazei
MKDNLPEKGAIVQRDRETYAIAPHIPGGIADPNTLRKIADVAEKYGAAALKMTSAQRIAIVGLKEEDLDNAWADLDMKPGAAVGLCVRSVKFCPGTTFCKQGKQDAVGLGLKLDEKYHGMSMPSKFKMAVSGCPNSCSEPAIKDIGVMGTAKGYTLMVGGAAAASPRLAEVVAKNLSEEEVLDAIDRIVNFYKNSGTKKRLGKFIDGVGLEEFKAQVGL

SEQ ID NO: 11194 - protein, 448 aa, Methanosarcina mazei
KDYDIIIIGTGTAGRTLADKVAHSGLKIAIIDSGEYGGISPPRGCDTKKMFTDLAGVTDSNNRLIEKGVGTNYPLKIDWPSLIEFKGKVTKECPGRIENHFVEMGIDTYHGKAYFENQNTIVAGEDKIKGEYIFLATGSKPRKLNISGEEYVTTSEEFMKTEKLPERIIFIGGGHISLEFAHVARRAMSEVTILHRSERLLRHSDVDMVNLLIKATEAAGIKILMNKPVASIEKDANGFLVRTGSKSGTESETQSFRADMVIHGAGRVPNIEELHLEKAGIKIEKGAIVVDKYMRTSNPRIYAGGDCTSESLKLNSVAALQGEVAAANILNENSLEVDYTGVPSAVHAIPVLASVGTSASKNSDKYKVIYQDRSNWYTTRKAGMEFAASKVIIDEANNRIVGAYILGPNAEEAINIFAAVIRLGLKASDIKKLVFTYPTTCSDIRYML

SEQ ID NO: 11195 - protein, 337 aa, Methanosarcina mazei
SRDFLTIDDFDTHGKTILVRVDLNSPMDPQGNILDDMRIRSHIATLKDLEDAKVVLLAHQSRPGKKDFTTMKPHANLMSKYLGKQVLYVDDIFGTYAKTRIASMENGDVILLENVRFYSEESLERTPAEQAKTYPVKKLAPFVDIFLNDAFAVSHRSQLSVVGFTEVLPTGAGRVMEKELTSLDRGIKGGERPTIFVLGGAKVDDSLHVAENVLSNGGADRVLLTGVVANVALAASGIDIGKVNLDFIKSQGYEDQIEKAKSILTKFKDKVGLPRDVALNDNKKRVELPVSELNSNSLPINDIGLETIVDFTSEIASAKTVILNGPAGISEVAEFAL

SEQ ID NO: 11196 - protein, 1335 aa, Methanosarcina mazei
LIDITSAMDTTYINTSNYDKIFSGTIPYNSTEEKFFYNMGSRGVLKENTENFLIYLAKTYGDKPELTKDWVYEDPIEFPEAAIYHPDARSLTNESQPDWFENTTDYLEWYSTSTNSNSTNSNESRHIYDKSKPTIGIWFHASDYTGDNLEVIDALIHDLEGKGCNVIAGFDTFNDIHKFYFDESGEPLVQCVISLKSFRLNYDDPDKGVQELEDLDVPVLTGLVVTNPANSTDIADSNRGIPSEEVVYKTLLPSIDGIFEYIVIGIDNYDSATGESNYEPLPSQIDWMANRSINWASLKLEENEDKKVAMIYYNYPSGKDNIVANYLNSTQSMFELLNAMNKSGYEVSGIPENSSKLMEMLQAQGINVGSWAPGVLNGMVENRTEWGLQLIPVDTYKEWFGSEIPENLRANVTAEWGEPWSEDLPQNKSVMIYENETGKYIVIPTVRFGNVWLMPQPARGTGQNNDTLYHSNVVPPTHQYIAFYLWLNHEFQPDALIHMGTHGTHEWLPGPTYGMNRTADWSPLLLQDIPNIYPYIVANVGEGITAEYRGNALIIDHLTPTLERGGLYGDLLNLSTDVEGYYDPGISSQTRAGYQNAIVNEIIALNLSVDLGIENVTVLQDYNETEFGNFVKNILHEYLEDVGNENIPYGMHILSHVPTTNITGPESDELTGMVRAMLGGSFEDNITAAFYPESSYPLGIPLNDTKVTRLVWEVVTNNTSVSQAQTAVYGITNSTVTLDLEQGLDYKDRLLNCDVEIDRILSALNGGFIPPGSGLDPVMNPDAVPTGRNYYSINSKLYPSEATWEVGKSLAIQMLEDYYNEHGEYPKKVSFSRFGVEFIADHGTLEAEVLYLLGVKPVWDEYGYVTGVEAIPEDELLPNYDTSTPGRPRIDIVYTTAGMRDAFPDKIKMIDSAVKLASSLPGVNYPNYVNQSSLTLYDSLISEGYDNETATKISTMRCFAVMDGTYDIGVSDAISASGSWDNEEDIANVYLNKMGYAYGEDFWGIQSRALLEGNLKSVEASVHSSSSNLYDSLDNDDLFQYFGGMNLATRYLSGNTPEMYISDTSNSDGAQMLGMQEYLSKDLRARYFNDKWIEGMQKSGYSGGSMMSEFVDNLFGWEVSDPDLVDDTVWQEVYETYVNDPSMKEWFKQNNPSAYQSVTARMLEAVRHDYWTPSEDVIESLSKEYEESVAENGASCCHHTCGNPLLHEFVSGKVSVPGYSEQIEAATKVETLETTEETQSSSGGSHHDHDTGNATVIPRASSSSNQTSQDSDGGYGTDTSEPDPEVQKSSDTDYVEGYEMQKDSAEEPDNSGFSFSGSDIIGILLVVVAAGGIYL

SEQ ID NO: 11197 - protein, 547 aa, Methanosarcina mazei
VELDILVSETLKARYLHEGENNWEDICERVAEAVALTDEEYLDFKDLMLRKVFLPSSPTLMNAGTEFGQLAACFVIPVEDKVEEIFDSIKAAALIQKTGGGTGFDFSKIRPEGSSNSCGDDATSGPVAVMKLFNEATEIVKQFGRRRGANMGILDISHNDILSFIRSKHVEGELSNFNISVMVPDAFMELVEADKADEVWNRQTDVTVGRIFSEIVEGIWRNGEPGILFYDRINRDNFTPALGDISATNPCGEEPLLPFEACNLGSINLSLCVIDGKVNWDFLREVAGKAIRFLDNEIDKNAYPVPEIETATKRTRKVGLGVMGLHDMLLKIGLPYDSQEALELAEKLMEQITWASIRESRKLAVEKGSFPGYEDSTWELPMRNAALTAVAPTGTISILAGCSAGIEPVFSWVYRRTQTVGREFMLVHPFFKAHFKSKLSEADYSWLLEHVYKYGTLQDVENPELVSEEEKQLFRSALDIDWKAHIDMQAAFQRHCHAGISKTINMPASAGKEDIDKALVYAWKQGLKGLTIYRTGSRQYVVLSLQK

SEQ ID NO: 11198 - protein, 365 aa, Methanosarcina mazei
KFSENVARIDTSGIRKIFEAAGSDAINLGLGQPDFDTPEHIKAAAIKAINEGFTGYTVGPGIPELREALSSKFKEENGFSVSPEEIIVTSGASEALAIALAALLNHGDEVLISNPGFVSYNALTEILSGKAVGVPLAEDLTMKPEAVLEKITPKTRAIVFNSPSNPTGTVASRADIKALAEIADDYNITIISDEVYEYFVYEGEHVSPASYSDNVITVNATSKSYAMTGWRLGYVAARKDYIGQMLKVHQYFQACANSIAQKAAYAAVAGPKDSIKAMREEFRKRRDVLVKGLNDLGMECALPKGAFYAFPKVPNSTEVASKFISNGVIVTPGTAFGSEGDGHIRISYAASMKDIEKALGIMEKV

SEQ ID NO: 11199 - protein, 673 aa, Methanosarcina mazei
LIVTEKNIAARRIAAILAPKNPKKDRVSGVDVYRYEIVSDEEKQETVVVGLSGHIVGIDFPKEYNNWQKVESKTLINADIITTPINRKIVTALKGLGKKASRVTIATDYDREGELIGVEALNIIKQVNPDVPFDRVRYSAITPKAIEAAFSNATDVDFNLADAGHSRQVIDLVWGAALTRYISLAAGRLGKMFLSVGRVQSPTLSLIVDREKERNVFVPTPYWEIYAELQNTEGKTFSAQHSTRRFLDKKEATKAFKKLGKKAELKGIEKGKKTDQPPAPFNTTGFISAANSIGLSPANAMRIAEALYTNGYISYPRTDNTVYPETLDLRAQIEIFKEGPFKEYADALLEKAELIPTRGKKETTDHPPIFPASLAKESDLKEDEWKVYELVVRRFFATFAGPSEWETMRLKLDINGEEFKANGARLVEQGWRWYYPYNAPEDRLFPELHEGDSLKVIKKDMQDKETQPPGRYGQGRLINIMEELGLGTKATRHEIISKLYSRAYIHGNPVQPTNTSFAVMDTLEKYSPTITKPDMTKLLEENMDRIAEGKIKEAAVLEESRDMLKQVFSELDKNREKIVESLQAGLREDKIIGTCSSCGNELIIRRSKRGGRFIGCNNYPNCTFSLPLPRSGQIIVTDKVCEVHGLHHIRIINSGKRPWDLGCPQCNFIEWQK

SEQ ID NO: 11200 - protein, 247 aa, Methanosarcina mazei
MAPQMGYDRAITVFSPDGRLFQVEYAREAVKRGTTAVGIKAADGVVLLVDKRITSRLVEAESIEKIFQIDDHIGAATSGLVADARSLVDRARVEAQVNRVSYDEPIGVEVISKKICDHKQTYTQYGGVRPYGTALLIAGVDDNLPRLFETDPSGALLEYKATAIGAGRNAVVEVFEAEYRQDMNMDAAILLGMDALYRAAEGKFDASTLEVGIVSLQDKKFRKLVPEEVENYVQQILEKHKETENKE

SEQ ID NO: 11201 - protein, 254 aa, Methanosarcina mazei
LNYTLDCGQVFRWERNGDWWTGVVGDQVIRLSQDQGQLIVDSNLQPEFLTRYFRLDDNLPSIYESINRDLLIDRAIRKYRGLRLIRQDPWECLISYMLSTASSIPTIQKRIYLLSRSFGQEIEPGYFSFPDPETLANVDPAELDKCKLGFRTQNIIAAAEEVASGELDLDVLFRLEYRYARERLMRLRGIGEKVADCVLLFAFDKMEAFPVDTHIRQIIQHYHIDDSYFETCKNMSCMGDWGREYFGHYCGYAQ

SEQ ID NO: 11202 - protein, 395 aa, Methanosarcina mazei
MKEIEGGICAVKGVSANGIKAGKLGLTVILAKGPAAGVFTKNKVTAAPVTLSKGVIETHHRLSGLIVNSGNANAFTGDDGFLDAMEMASVLAQKLDLEADTVAVASTGVIGRRLDVSLITEHLPEVLNGLGSSPECSREAAKAMMTTDRVVKEVAIEMDCGIRIGAIAKGSGMIEPNMGTMLCFAYTDAKVPADVLDAALRIAVDKTFNMVVVDGDTSTNDMVLLTSTCKSGVKPCMDCLDDFEEGLIYVFTELAKKMAKDGEGATKLIEARVVGAKTHEDAKLAAKAIVRSPLVKSAIFGKDPNWGRVVAAAGYSGSELEQERLALSFSGGGEEVELVNSGEISSSSDLELLKKIMANEEIVITLDLNLGKEQAIAWGCDLTYDYVRINSEYTT

SEQ ID NO: 11203 - protein, 336 aa, Methanosarcina mazei
IKAGIIGASGYTGGELLRLLVNHPNVKLELATSRSLAGKPVTSTHRHLEGFLDLNYENPDSEDIRERCDVVFLAVPHGSAMNYVPELLDGNTKVVDLSADYRLETSEFEKIYGIKHSDPRNAVYGLVELHPEVAKENFVANPGCFPTGSILAAAPLAAAGLIDIAVFDSKTGISGAGISPTQNSHYPNLAENIIPYKLTAHRHRAEIVQELTGLEGKLRNINFTPHVIPSIRGIFTTAHLFTKETLSTDDLKTIYEEFYRDRPFIRFPSGVPSLTAVRGSNFCDISFEADKENNRVVVLSAIDNLVKGASGQAIQNMNLMFGLDETCGLWMPATAP

SEQ ID NO: 11204 - protein, 617 aa, Methanosarcina mazei
MAKILGIDLGTTNSCMAVMEGGEAVVIPNAEGARTTPSVVGFSKKGEKLVGQVAKRQAISNPENTVYSIKRHMGDANYTVTLQGTQYKPQEISAMILQKLKTDAEAYLGETIKQAVITVPAYFNDAQRQATKDAGAIAGLDVLRIINEPTSASLAYGLDKGDIEQKILVYDLGGGTFDVSILELGGGVFEVKSTSGDTRLGGDDFDQRIVNYLLAEFRKIEGIDLSKDKAVLQRLTDAAEKAKIELSGVASTNINLPFLTVGADGEPKHLDIDLTRAQFQKMTEDLLEKTLVSMRQALSDAKLTPNDLDKVILVGGATRMPAVVELVENFTGKKPYKNINPDEAVAIGAAIQAGVLGGEVKDVLLLDVTPLTLGIETLGGIATPLIPRNTTIPTKKSQVFSTAADNQPSVEIHVLQGERGVASENKTLGRFTLDGIPPAPRGIPQIEVTFDIDANGILHVGAKDLGTGKEQSISIQKPGGLSDDEIDRMVKDAELHAEEDKKRKEDVETRNNAEALINAAEKTLKEAGDAATEDQKSKVTAAIDDLKKALEGKDSEDIKSKTEALQEAVYPISTAMYQKAQQQAQQAQQAEGEAGSHDAQGPDETVVDADYEVVDDE

SEQ ID NO: 11205 - protein, 355 aa, Methanosarcina mazei
KAVLGLEDGTVIKGTGFGAEGTACGELVFTTQFTGYEEALTDPSYKGQILMFTYPLIGNYGVSGERVQSDNMHAEGLVVREACKKPYHYKSSRSINKFLEDEGKPGIEGVDTRMLTIRAREHGTMRAALIAGSDDGEEAVDVARNAPQLTDEELISLVTCKEPYFIPGAEGAWKGGSKRKHAVIVDLGIKRNIINNLHKRGIDLTLVPATTKPSEIANYEPDLLFISNGPGDPEKATDAINAVKAFAGTIPVCGICFGHQIISLAMGAKTYKLKFGHRGGNQPVKDLIENKIFITSQNHGYAVDADSLDGTGLYVKYLNANDKTVEGVSHKDLDVFSVQFHPEAQAGPMDTEETF

SEQ ID NO: 11206 - protein, 1070 aa, Methanosarcina mazei
MPKREDIKKVLLIGSGPITIGQAAEFDFSGSQACRSLKEEGIKVVLVNSNPATIMTDPEMADSVYIEPLDAKIVEKIIEKERPDGIIAGIGGQTGLNITSELAEKGVFEKYGVEILGTPVEAIKNTEDRELFKETMLRIGEKVPLSRAVNSLKEAEDVVDELGLPLIVRPAYTLGGAGGGIARTKEELLEITERGLRRSRINQVLIEESVLGWAEIEYEVMRDENDTCIVICNMENIDPMGVHTGESAVVAPSQTLSDAEHQMLRSASIKIIRALKIEGGCNIQYALKEGDYRVVEVNPRVSRSSALASKATGYPIARVTAKIAIGMKLDEIINNVTKSTPASFEPALDYVITKIPRWPFDKFTTADKTLTTAMKSTGEVMAIGRTIEESLLKAFKSLDIDNQLGNKHWDEPETKTLLKTPTSERLFVIFDALEKGMSVKEIFELSSINPFFISKIKRIVDMEKRIRAEELTPELLREAKKMGFPDTRLAELTGSTRQEISDLRHKAGILATFKMVDTCAAEFEAATPYYYSTYEDSCETNATTDKKKILILGAGPIRIGQGIEFDYCTVHAVTALREEGIETHIINNNPETVSTDFDTSDKLFFEPLTLEYVMNVIEREKPDGVLVQFGGQTSVNLAIPLKQELKRRTDLNTVILGTDPDDMDLAEDREKFYILMKELGVPQPEGGYATSHKEAIEVAKRIGFPVLVRPSYVLGGRAMEIVYDEIDLERYMKEAVRVSHEHPILIDDFLEAASEIDVDAVCDQKDVIIGAIMEHIEEAGVHSGDSACVIPPQSLSPEVLDQVRDYTRKIALALKVKGLINIQMAEKCGKVYVLEANPRSSRTIPFVSKSVGIPLAKIAAKVIAGHSLKSLGYTDEPKPKHVSIKEVLLPFDKLPGADPVLGPEMKSTGEVMGIDYDFGRAYYKAELAADNVLPLTGKVFLSIRNADKTELVDVAKKLQAAGLELMGTEGTVNYLARHGVFMDVVKKVHDGSPNVIDMMRRDEVDLIINTPTSKQSRRDGSRIRRAAVDFKVPYITTMQAAIAAAAAIETMKKGEELTIKSINEYHKEME

SEQ ID NO: 11207 - protein, 274 aa, Methanosarcina mazei
  unsure (1)..(274): unsure at all Xaa locations
MAKKVALAYSGGLDTSVCIPILKEKYGYDEVVTISVDVGQPEEEIKRADAKAEKISNKHYTIDAKEEFVKDYVFPLIKANGSYEGYVMGTSIARPLIAKKVVEAARKEGAVALAHGCTGKGNDQLRFEAVFRQTDMDVIAPMREMNLTREWEIDYAKEHGIPVEVTKSKPWSVDENIWSRSIEGGRLEDPSFVPPEEIFEWTTSPEKTPEQPRIVDIGFEAGVPVSLDGEKMSGYALVKNMNEIAGENGVGRNDLIAERVLGLKAREKYXHPGA

SEQ ID NO: 11208 - protein, 381 aa, Methanosarcina mazei
MLYRKIPKNGDKLSILGFGCMRLPVIEDGTIDEERVTRQVRYAIDHGVNYIDTAWPYHMGESEPFLGRALTDGYREKIKLATKLPSWLVENREDMDRFLNTQLERLNTDHIDYYLLHSLAGEVWDKLEPLGVIDFLNKAKDDGRITNAGFSFHGPIEDFKRIVDAYPWTFCQIQYNFMDERNQAGTEGLKYAASKGLGVIVMEPLLGGNLASPVPAEVKDIWDEAETKRTPAEWALRWVWNHPEVTVVLSGMNEESHIEENLKIASEAYPNSLTDTEMQLVNRVEQKYRQLVKIGCTGCRYCMPCPSGVNIPECFEIYNNLHMFGNVEGARFKYAVRMSGVFTNTEPGGFASQCTECGQCMEKCPQNLKIPDLLKAVEEDL

SEQ ID NO: 11209 - protein, 1313 aa, Methanosarcina mazei
MKIISITWNSYIPTLLKAANDLGIELEAHYSKILEDNPEEAEKVLLACEHADAVFLYYTSTPFWEDFYEKLEPLKKRVPVICVGSDPSSLTLSSVKLEIAATCFSYIIYGGQENFANMLRYLLKEVFGCEIETKPPEKIPWDGLYHPDAEKIFSNVEEYLNWYGPLKDKTVGLLISRTSWVNNELEIEKKLIKELENLNLSIIPVFAYSLKDEELGSRGMNEVIEDYFIENGRTIIDCLVKLSPFFIASSKTEERNASCAAKGIEVLRKLDVPVFQPVTSHYMTVEEWQESMGLSTEIGWSVALPEFEGGIEPIMIGAGKKEGNYMGRFPIEERCSKFASRILKWTELRKKPVNQRKVAFILHNRPCTGVEGSVGDAANLDSLESVARILNRMQEAGYVVNPPENGKDLIETILKRKAISEFRWTPINEIVKNGGALDFVEKEEYEKFFNTLSPKVKQRVIESWGNPPGEEVDGIPAAMVYDNKIVVTGVQYENAVVCVQPKRGCAGARCDGKVCKILHDPEVPPTHQYLATYRYLENTFGADVLVHVGTHGNLEFLPGKGVGLSGDCYPDISIGTIPHLYIYNSDNPPEGTIAKRRSLACLIDHMQTVMTSGGLYENLAELDRLLGEYEQAKHDKGREHALKHLILDEIKKSNLNSEIKADDQTPFEEVVRKAHEALGKIRNTQIQSGMHIFGQMPEGEKKVEFINSILRYDDQGSVGNKVSIRRLIAELLELNLDELISDQSRISEDGKSNGQLLEEIDSLSKDLIRTFINNPEKEPARIIKEIFEGKSFEKQNIKGKSFEEQSVNKEINNPEIEPNRIIEEIFEGKGFKEQKIKGKSFEEQEIKDLSINPVLLEDAVSICNRILDLESRIDDSLEIEALLHGFNGGYIPAGPSGLIMRGRDDVLPTGRNFYSLDPKRIPTKAAWRVGQQLSGVLINKHIEDEGRYPENVGFYWMANDVMWADGEGMAQIMSLIGVEPVWLNNGQLKGFSVIPLKELGRPRIDVTVRVSGILRDNFPNCLEVIDEAIQAVASLDEPGEMNYLRKHSLQMIEEGADSRDATLRIFSSKPGTYSAGVQLAVYASAWKDEKDLADIFLYWNGYAYGKDVKGKEAHTQLASSLKTVDATFNKVVSDEYDLLGCCCYFGVHGGFTAAAKQASGRDVKVYFGDTREPQHVEIRDMADEMRRVVRAKLLNPKWIEGMKQHGYKGAQDISKRVGRVYGWEASTQKVDDWIFDDITKAFVLDEEMRRFFEENNPYALEEMSRRLLEAQSRGLWEPDPELLEELKKSYLEIESWMEELAGEGEFQGGAVDI

SEQ ID NO: 11210 - protein, 397 aa, Methanosarcina mazei
MSSKTTFEIEDKCLPPFFVKQKISIEKGDGVYVWDEEGKMYIDFTAGWGVTCIGHANPVITEALIDQGKKIIQNPNSGLTYSPARARLLSLLAEILPLNLTRVFFTNSGAEANDAAIKLARKVTGRPDIISTDQSFHGRTISTTSATGQAKHRDRYSPLMPNYRFVPYDDLEAMENSLDENVAAVILEPIQGEGGVCIPSEGYLKEVSNLCKKNGSLLIVDEIQTGFFRTGPAFVTSSYGVRADFMTMAKGIAGGFPFGAFALSENVAKKLEIGDHGGTYCGNPLGCAVSYAVIKYLIDNNISRNVEEMGCFALKRMSLWPNIYGNVIADIRGKGLLIMVEFQSEEIATNVKNECLARGLFVTQTQGNGIRIFPALNVKKEELEEGLLIIEDVVKKI

SEQ ID NO: 11211 - protein, 154 aa, Methanosarcina mazei
MKEKRDLKIQAIENGTVIDHIKAGQALNVLRILGISSAFRATISFVMNAPGAAGIKDVVKIEGKELSVEELNRIALISPKATINIIRDFKVVQKNKVVLPSYVEGVVRCINPNCISNSSEPIKSKFSVLQSEEEGVTLNCLYCEHVISENIAEN

SEQ ID NO: 11212 - protein, 307 aa, Methanosarcina mazei
MSFKNRNVISMKDFSRKEINYILDTAEKLEPVARGKKRSRLLDGKIIALLFFEPSTRTRLSFESAAQRLGGQVLNLGSVEASSVMKGENLADTIRVISKYADLIVLRHPLDGSARMAAEFASVPIINGGDGSLHHPTQTFLDLYTIRRESHLEGLKIAMAGDLKYGRTVHSLCHALSLYGAEITLVSPPELRMPQEIIRDLQKNNIRIRETDALEEIIGDVEVLYMTRVQRERFPDPEEYEKVKNKLKVTGDLLKNADPSLKILHPLPRVNEISPEVDSTPYACYFEQAFYGVPTRMALLALATGVI

SEQ ID NO: 11213 - protein, 322 aa, Methanosarcina mazei
ILGFGAIGQGVAEVFLMKKEYLESIGLEVKVVAVVDSKGATVNPEGVDLADCLVRKRRDRTVALENISGVEVIQSVAHDLVIETTPTNILTGGAGMQNMFAAFKTGKDVITSNKGPLTLKYRELMEAAKAAGSHFRFEATVGGSMPIINLVNEVLAGNKVKSIKGILNGTCNYILTRMLEERASYNDILAESMQLGIAETDPTYDVEGIDTACKLVILANAIFGIDATYNNVEVTGITKVTPEALEMAYEKGHVIKLIGEVSRERIHVAPRLVPINHPLAVGGTLNVASVETELAGEITVTGKGAGPIETASAILSDLIAIY

SEQ ID NO: 11214 - protein, 811 aa, Methanosarcina mazei
VSGMTCSACASNIERVLKKKAGVDSAVVNLELGRANVSFDPSLISPKEIGETIESIGYKVEKDSVTLSLEGMSCASCAANIEKVLNRTEGVISASVNFPLEKAVVEFDSSRVSVREIIAAVQGIGYGAFVKTEAVEYEDREQMSRDAEIRRQRNNLIIALVLGIPIGLGNMSMMFPFLSFVPDFLSNHIVLFILSTLVLLFPGRQFFVGTIRGFKYGVTDMNLLIAAGTGSAYLISVAATFLDLGPGYNSLYYDTVAFLIIFIVLGRYLEARARGQTSEAIRKLMGLRAKTSRILVNGIEKEIPVEEVAVGDIVVVRPGEKIPVDGIIVEGGSAVDESMLTGESIPVEKFPGDTVIGATLNKTGSFNFRATKVGADTALAQIIRLVETAQTTKAPIQRVADVVAGNFIVTVHIIALLAFFFWFFIGYWRYGVGESVTLGGISPFLFSLLIAITVLVISCPCAVGLATPAAIMVGTGRGAENGVLIKGGEALERAHKLDTIVFDKTGTLTAGTPKLTDLVAVSGHEEKDVLFIAATAERGSEHPLGEAIVNGAEEQGIRPGKAENFHSIPGKGVEAYFEEKRILLGTRKLMEEEGFSFKELEAEMRAFEESGKTAMLVAFGEEIIGLVAVADILKENSIEAIETLNKMDLEVVMITGDNAVTANAIAKEVGIPRVLAEVLPEDKASEIKKLQEEGKLVGMVGDGINDAPALIQSDVGIAMGAGTDVAMESAKIVLIKNDPRDVVSAIKLSRLTINKIKQNLLWAFGYNTIGIPIAAGILYPFIHRVLITPEFAAAFMALSSVSVTTNSLLMK

SEQ ID NO: 11215 - protein, 464 aa, Methanosarcina mazei
MKIVMKFGGTSVGDGKKIRHVAQLLKRYREEGNQIVVVTSALGGVTDELLENALFASTKGKVSLVKEFKTEITNKHHKAVKDAIDDPTVAKEVIQTLDLRIDELEKALVGICYLGELTSRSIDYICSYGERLAAPIVSGAIRSLGIESTEFTGGEAGIITSSDYGNARPLEKTYELVNKRLGCRLETQILVVTGFIGENEEGIITTLGRSGSDFTASILGAALKADEIWLWKEVNGIMTTDPRIVPEAKTIPQISYAEAMELSYFGANILHPRTIEPAMREHIPVRVKNTFEPKLPGTLVVAEKFQCKNVVKAVSLIKNVALINISGAEMVGAIGTVARLFAVLAKSGVNVIMISQGSSESNISFVISEAHVKTALKALHEEFNRGIVKEITSDKNVCVVAVVGAGMAGTPGVAKRVFGALGNSLINIIMISQGSSQYNISFVVRENDAFAAVKTLHDEFELYN

SEQ ID NO: 11216 - protein, 339 aa, Methanosarcina mazei
MSQFTLRERFEKALKGEAVDIIPVCSVTQTGTVELMETTGAYWPQANFNADQMATLALAGYETAGFENVRCPFDITVLAETLGCTVDEGSIDMQPYITDFPCKNEKDVKNITVPDSLLEGRRTSVVLEAVEILNEKVGETVPVVAGVVGPAGLAFMLAGIKNYITWFVKDTEVVEELMGVLTDACIEYANGLLERGAHAITLIDSEAGPDIISPKMFEESVFPLYRKFCRKVKGLKVLHMCGDATAVLNSLGDAGFDGISIEEKVSVSFAKAAIGDRVRLIGNISPSDTLLAKGPEAVLLEATACLEDGIDILAPGCGLAPHTPLENIKALVRARDDYF

SEQ ID NO: 11217 - protein, 443 aa, Methanosarcina mazei
LFGTNGVRGIANEYITPELAVNLARCLGTYMGSKGTVAIGSDTRISGQMLKSAAIAGALSTGLSVIDIGIIPTPSILYYVRDFADAGIIVTASHNPRQYNGIKFIAGDGSEFSRDAEKDIEKIYHSGEYSIVSWEKTGSFRIDPGVNEYYVRNIIKSVNAEAIRSRKFKVVTDTGCGAGSLTLPFLLRELGCQVLTLEAQLDGTFPWRNPEPLPEALTELTNLVKMTGSDLGVAQDGDADRVVFVDENGQFVNDDVLLAMIAKYMAKHEKGPLVTPVSSSQRMVDVAEEEGVKLYWTAVGSINVVRKMMEVNAVFGGEGNGGLIFPKHQYCRDGAMGCAKVLEILASGKKLSDLEKSVPHYFNEKTKVPAKNAHAIMEIVKNEASGLGHKIDTSDGVKIWHKDGWVLMRPSGTEPIFRIFAEAKNQERAEELMQEGLDMIIRA

SEQ ID NO: 11218 - protein, 803 aa, Methanosarcina mazei
MSENKSKYIRWFDETSIEDVPLVGGKNASLGEMYRELTPKGVKIPNGFSVTAEAYWHVLKAGGILEKLKQTMEGLDTSDVSELAKRGKAARDLILEAGIPDDLWQEIKSGYDRLCEQYGENTDVAVRSSATAEDLPTASFAGQQESFLNIRGYPALRDACVRCIASLFTDRAISYRVINNFDHFKVALSIGIMKMVRSDLASSGVIFTLDTETGFRDVVFITGSYGLGENIVQGQVNPDEFYVFKPTFREGYKPIIEKNLGDKEIKMIYGQGGSKTLTRNVNVPEADRRRFCLSDEEVLKLAWYAITIEDYYSNKYKKSMPMDIEWAKDGATGELFVVQARPETVQSQKSRDILETYVLEKKSNVLTKGKSIGDKIAAGKAHVIPNVSDLPSFKQGEILIADSTTPDWEPVMKIAAAIVTNQGGRTSHAAIVSRELGIPAVVGTVNATEVLKTGKEITVSCAEGEDGLVYEGILPFHKDTLSLKDTRRPKTAIMMNLGNPDEAFSLSMIPNDGIGLARQEFIISNYIKIHPMALVHPEKVKDSKVLQEIEKLTQNSDNKEEYFVDKLAQGVGTIAASFYPKDVVVRTSDFKSNEYASLLGGSYFEMEENNPMLGFRGASRYFNERYREGFALECRALKKVREEMGLKNLIIMIPFCRTVEEAQKVIAEMEKNGLRRGENELQIYVMCEIPNNVLQIDKFSEYFDGFSIGSNDLTQLTLGVDRDSEILTAEFDERDPGVTKIMAMAVKGAKQNGRHSGICGQAPSDYPEIAEFLVKQGIDSISLNPDSVMKVTLKVLETEKGLG

SEQ ID NO: 11219 - protein, 525 aa, Methanosarcina mazei
MTQARRPLMLIIFDGWGYREAKEGNAVMTARTPNLDRLEKECPWCFLKASGEAVGLPKGMMGNSEVGHLTIGAGRIVNQDLTRINISIKNGDFFKNPVFLNAISNVKANASSLHLMGLASCGGIHSYMPHLHALLKLVQEKDLKKVYIHAFLDGRDEPPKAALGDIKKLDAFCKEHGNAKIATVSGRYYAMDRDKRWDRTKLAYDALTRGVAPYTAPNAETAVSNAYSRGETDEFVKPTIITEQVITEQVITEQAEKPVATVQDNDSVIFFNFRADRARQITWAFVKDDFDGFMREKRPEVYFVCMTQYDETLEVPIAFPPIKLENVLGEVLSKHGLIQLRIAETEKYAHVTYFLNGGEEKRYKDEDRCLIPSPKIATYDLKPEMSAYEITDEVIRRIQSGKYDVIVLNFANMDMVGHTGIFEAAVKAVEAVDKCIGRIVEVLKEKGGVALITADHGNAEEMIDLKTGEPHTAHTSNPVKCIYFGNSEIKALRNGKLCDVAPTILELLGIPKPQEMTGKSLLVKD

SEQ ID NO: 11220 - protein, 235 aa, Methanosarcina mazei
  unsure (1)..(235): unsure at all Xaa locations
MMIAGIDEAGKGPVIGPMCIGGVKIEESRAHILKVLGVADSKKLTPKKREQLAAQIKKHADGFFVLEVSPSQIDELRKIMTMNEIMVVCFSKVLEQLKPDLLYADAADVNAERFATNIRKQYSKTNPDHAKEIEIISMHQADATYPVVSAASIIAKVRRDELIEELKKEWGLDFGSGYPSDPKTKEFLLNWGKEHSGEFPEIVRQSWQTVENIREELKKTGNKNXKEKLKRKIKK

SEQ ID NO: 11221 - protein, 417 aa, Methanosarcina mazei
IITGAQFGDEGKGKIVDLLAKDYDIVARFQGGNNAGHTVRVGNEVYKLHLIPSGILLNARVLIGPGVVLNPEVLAKEIAMFEKHGIQVNAEKLGVDAKTSIIMPYHIEMDGLREESREKKIGTTKRGIGYAYIDKVARDEFRMAELVDQERFLARLEELAPQKEKEIATLGGDPKIVRDPALIERYLELGKQFATYITDVSREINKALDEGKHVMAEAAQGTHLDVIHGTQKFVTSSSTIAGSACANLGVGPTRVNNVIAIVKAYITRVGEGPLPTELTGELGERLQKAGGEFGTTTGRGRRCGWFDLPLLKKAIALNGYTEISLTKLDVLTGLNPIRICTGYTFKGENLDYPPELTADLAECMPVYEDLPGWETDLTEVKAFEELPENARNYVKRLEELMEVPINYISVGPGRAQT

SEQ ID NO: 11222 - protein, 346 aa, Methanosarcina mazei
LQEINKLKAHLEQLTEPPLFIATILEVNGEIALIRQHGNNQEVLTQIPEECIGKIEPGMRVAVNGAYSIISVVSRAADVRAQVMELINSPGVDYSMIGGLDDVLQEVRESVELPLTEPQLFEEIGIEPPSGVLLHGAPGTGKTLIAKAIASHAKATFIRMSGSDLVQKFVGEGSRLVKDIFQLARDKSPSILFIDEIDAVGSMRTYDGTSGSAEVNRTMLQLLAEMDGFDPKGNVKIVAATNRIDLLDPALLRPGRFDRSIEVPLPDEKGRAEILKIHTRKMNLADDVDFEKLARVMTGMSGAEISVIVKEAGIFVLRRRGKQITMADFLKAHEKVVSTEEPKIPQ

SEQ ID NO: 11223 - protein, 461 aa, Methanosarcina mazei
  unsure (1)..(461): unsure at all Xaa locations
DITAELQKIVGGRLSVSPSELYCYSSDASQVKGMPDYVVRPKSTDEVSRIVRLAYENEIPVTARGAGTGLAGGAVPVKGGIVLDMSGMNRILEIDINNIQVQVEPGIIQDDLNEALKPYGFFFPPNPGSSAMCTIGGMIAYNASGMRCVKYGTTRHYVRDLEVVLADGTVIHTGSKMLKSAAGYDLTQLIVGSEGTLGIVTKARLKIAPLPKTRKLVITSFENAEIAGQAVVKTFSHGVIPSACEILDRVSLQVLKRYDPNLVLPSEGDVILFEVDGTESSAREAAEQIMKVCTPLSLSIRLAESEKEMADIWAARKLVGAAVSRLDPTKSRIYVGEDVGVPIKRIPELLKRAQEIAEKFNLPAMKYGHIGDGNLHFALFIDVLNKDEWDRLNKAADLIHRTAIELGGTVSSEHGIGAARAEYMKAQWGPALEVMRAIKNALDPKGILNPGKLGLXEYEKR

SEQ ID NO: 11224 - protein, 708 aa, Methanosarcina mazei
MTIVAFAEKNKAASQIASILGEGEVERITVEGLPVYEFKWKGEEWLVMGLSGHIMNYDFPEQYNKWKEVNPGVLLEIDPQKLVTRTDYAAAVKNLAKRANKIVLACDYDREGENIGFEAKTLAEKVTNVPIERARFSSLSPKEVKKAFESLINPDYNMAMAAEARQILDLKMGAAFTRFVTLSVRERARTKDILSIGPCQTPTCGFVYEREKAIRAFQAKDFWKITAIFSAESGKEGGKEGRKEGRKEGKKERGDFEGTHRAGNIHDKEKAAEIFKRLKGTKEGLVAKKTVKETKTSPPNPLNTTEFLKRASKFLGISPELALEVAEQLYLAGFTSYPRTETNKYAEDFDFKSLVFDFARQKEYKPFAESILIAPIVPKNGEKDAHDHPPIHPIRAASRGEVSSAVNIPQAPEVYNLIARHFLANLMPAAVFEKTHLHLLVNEEPFDSSGTVLKDSGWLEAYPFENKKDKLLPFVEEGQKVGVKKLSNTKSKTSPPKKLTEAELLTLMDKNGIGTKATAPTHIETNKKRGYLETKGKTISILDTGFTLMDGLSLTVPILVKPEIRAKIEALIQEVEDGKKEFEAALYEGTTLIKEMYAQLEANKKELTSSIAGTIKDEAALEDKKNYIGTCKACGHVLRIVQTDSGRFVGCTGYPDCRNSYPLPKAGALTVLRSKECKKGGVAVLKVGNKYNWAVGIGPCFTCDLEKE

SEQ ID NO: 11225 - protein, 241 aa, Methanosarcina mazei
MRLAVIEGDGIGREIIPAAVKVLDAFGLEFEKVPLELGYTRWERTGTAISNNDLETIKGCDAVLFGAITTVPDPNYKSVLLTIRKELDLYANVRPVKPLPGITGVTGRNDFDFIIVRENTEGLYSGIEEIGPELSWTKRVVTRKGSERIAEYACKLAKKRKNKLTIVHKSNVLKSDKLFLDVCRQTASANGVEYEDMLVDSMAYNLIMRPERYDIVVTTNLFGDILSDMCAALVGSLGLVP

SEQ ID NO: 11226 - protein, 280 aa, Methanosarcina mazei
MISMKKYDVVIIGAGPAGSYAAYMLAKSKINVLVIDKYSFPRYKPCAGGLTAKAFNSFDFPISKEVKYSTNSIVTSYKNQIFHNISGNKTLVKMIERKEFDDFLIKKAVDSGATFLDGMKVTEITWENAEFSIKTDSEFFRCNYLIGADGTNGIVNRTFNIVERDLYGFAVEINCPVSRDNIGKFNMTFDFGTVPNGYLWIFPKDEYVCVGAYTTNRKMKNIQKYLLDYIEKLGLVPESEKLKGHIIPYYGINYKQPDFPCVLVGDAAGFGEYWTGEGIY

SEQ ID NO: 11227 - protein, 225 aa, Methanosarcina mazei
MVSREYVKGDLPEKAAILQRDGETYAIAPHIPGGIVYPETLRKIADIAEKYGAAALKITSAQRIAIVGLKEEDLDAAWGELNLKPGAAIGLCVRSVKICPGTTFCKRGKQDSVGLGLKLDEKYHGMQLPSKFKMGVSGCQNSCSEPMIKDIGLMGTAKGFTLSVGGSAGPRPRLGSVVAKDLTEEQALDLVERIIDFYKKYPKPRRLGEVIDEIGLEKFKEEVGL

SEQ ID NO: 11228 - protein, 592 aa, Methanosarcina mazei
IAIEGMIRKATEVRPRITKAAFECLRCGYLTFVDQNSFKFEEPFAGCEGENCGKKGPFKIRIEDSTFIDAQKLQIQESPENLKGGSQPQSLEVDSEDDLTGSVTPGDRVIINGILKSRQRTLKDGKSTFYDLVLEANSIEHLDKDYDELEITAEDEEEILELSRDPEIYGKIVSSVAPSIYGYEDIKEALVLQLFSGVVKNLPDGSRIRGDIHIMLVGDPGIAKSQLLRYVVKLSPRGVFTSGRSASASGLTAAAVKDELNDGRWTIEGGALVMADMGIAAVDEMDKMKTEDKSALHEAMEQQTISIAKAGIIATLKSRCALLGAANPKYGRFDRYEGLAEQISMPPALLSRFDLIFVLLDTPDHNLDTKIANHILQSHYAGELFEQKEKLPGSQIKEDFVEAEMEVIEPVIQPEIMRKYVAYARKNVFPVMEEDARAHLINFYTDLRKTGESKNTPVPVTARQLEALVRLSEASARVRLSNTVTLEDAKRTIKIMMNCLKNVGVDPETGALDADILASGTSMSQRNKIKILRDIIKKVSEKHPGAKAPLEEVYAIAENEHGIDKIHAEENIKKMKQRGDLLSPDQNHIRLV

SEQ ID NO: 11229 - protein, 416 aa, Methanosarcina mazei
TLAVHAGAKPDPATGARSVPIYQTAAYVFKDAEEAADLFGLRKEGNIYTRLMNPTTDVFEKRIAALEGGIGALAVASGMAAITTALLTFTRPGDEIISGDKLYGGTYELFNYTFPKLGRTVKFVDVGKPEEFKNAISEKTKAIYVESIGNPGLDIPDFEKLAEIAHGAGIPFVVDNTVSPLILRPIDHGVDIVVYSATKFIGGHGTSIGGVIVDSGNFYWKPEKFPEICEPDPGYHGLKYKEAFGKAAFIAKARVQFIRDTGACISPFNSFLFTLGLETLPLRMKKHCDNALEIAKFLEKHPKVSWVSYPGLESHCSYELAKKYLKSGYGALIGFGIKGGARECKKFIEGLEIFSHLANIGDAKSLVIHPASTTHEQLSKEEQLACGVTEDFIRLSIGIEDAKDLISDIKQALSEV

SEQ ID NO: 11230 - protein, 299 aa, Methanosarcina mazei
KDVLSITDLSKEEIYELLESAMDLKEKRKAGEPTEYLKNKSLGMIFEKASTRTRVSFEVAMTDFGGHSLYLNSRDIQIGRGETIEDTARTLSGYLHGIMARVMSHETVEKLAKYSTIPVINALSDREHPCQILGDFMTIMEYKDKFEDLKFAWVGDGNNVCNSALLGSAIVGMEFAVACPKGYEPKPEFLEKAKSLGGKFTVTDDPKVAVKDADIIYTDVWVSMGDEAEQEKRLKEFATFQVNTELLGVAKPDVIVMHCLPARRGLEITDEVMDGPNSVIFEEAENRLHAQKALILKLM

SEQ ID NO: 11231 - protein, 172 aa, Methanosarcina mazei
NQKQELIAALKACGAVRYGNFTLASGKKSKYYIDIKKASTDPKTLKLIARQAAFRIKQMDVNIIAGVELGGVPLATAVSMETELPLLIVRKSVKDYGTRSRFVGDFKPEDRIVMLEDVTTSGGSVRNAIEVVRETGANVTYVISVVDREEGAIENLKEAGTELVPLVSASDL

SEQ ID NO: 11232 - protein, 524 aa, Methanosarcina mazei
SKQIMFDENARKALLNGVDKVANTVKITLGPKGRYVVLDKSTKPVVTNDGVTIAKEIELHDKFENMGAKLVKEVASKTQDNTGDGTTTATLLAQSMIREGLKNISAGANPIDVKKGIEMATENVVGYLKSKSSEVKGKEKIVQVATVSANNDEEIGNLIADAMERVGYNGVITVEDSKTMETNLDVVEGMQFDRGFVSPYMATDSEKMVCEFEDPYILITDKKINSMKQIVPVLEKVASEGRSLLIIAEDVDGDAQAALILNIIRGALRVCAVKAPGFGNERKEMLEDIAVLTGGQVISEDKGMKLEEFDDYMLGSARKVTIDNNKTIIVEGKGDKAKIKERVSLIEAQINIADVEYKKTELKKRQAKLGGGVAVIKVGAATETELKEKKMRIDDALNATKAAVEEGVVIGGGISLFRAAAILDSLKLEGDREIGVKIVQRAIEEPVRQIAENAGKEGAEVVATIRAEPRELFGYNAKKDVFEDLFEAGVIDPTKVVRSGLQNAASIAGMVLTTEALVTDFNDE

SEQ ID NO: 11233 - protein, 415 aa, Methanosarcina mazei
  unsure (1)..(415): unsure at all Xaa locations
VHYMRDMRSHLPCRSNXGNEMKDMYDVLVIGAGPAGSIAARTAAEKGLDVLLIEKRQEIGDPVRCAEGVNKAYLKKYVEIDKRWICADLSASHIYAPDGTKIEMAEELSGGEVGYVLERKVFDRALAEKAAEAGAEVRVKTRATGLIIEDDFVKGARLMHLGKEYDVRAKIVIGADGVESKVGRWAGIDTSLKPIDIETCAQYLIAGANIDQHHCEFYIGNEIAPCGYIWVFPKGDGKANVGIGVLGSKTGKFKPRPVDYLNKFLENKFPDARIVEMVFGGVPVSGSIEKTSTNGLMLIGDAARQSDPITGGGILNAMNAGKMAGEAAYAAISAGDVSLEKLEEVYEKPWRATLGHDIDMSLIVKNCFINLSDEDLNSLAHSLEKVKFERMSLLDLLQALFKADKKLLWDLRVLF

SEQ ID NO: 11234 - protein, 219 aa, Methanosarcina mazei
PFIVLNYKTYLQGTGQGAMEIAKACKAVSEESGVEIAVAPQLPDIYRVASEVALPVFSQHLDGIGAGSFTGHVFGKCIKEAGAVGTLINHSEKRLTLAEIEASLKAAKEFGLRSIICTNNVPTTAAAAVLGPDYVAIEPPELIGSGIPVSKADPEVVSGSVEAVAKINPRVKVLCGAGISKGEDLRAALDLGSQGVLLASGIVKATDPKAALEDLIRLI

SEQ ID NO: 11235 - protein, 217 aa, Methanosarcina mazei
VRFLDTTLRDGEQTPGVALTKDKKLLIARALDEMGVSIIEAGSAITSKGERESIRAVANAGLNAEICSYCRIVKSDVDRALECDVDSIHLVAPVSDLHIKTKIKKGRDAVRQIAVDVIEYAKDHGLIVELSGEDASRADPEFLKTIYADGIDAGADRLCFCDTVGLLVPERTTKIFRDLSSSLKAPLSIHCHNDFGFATANTVAAWLAGAKQAHVTV

SEQ ID NO: 11236 - protein, 540 aa, Methanosarcina mazei
  unsure (1)..(540): unsure at all Xaa locations
MAGQPIFILKEGSKRTRGRDAQNNNIMAAKAVAEAVRTTLGPKGMDKMLVDSMGDVVITNDGATILKEMDIEHPAAKMVVEVAKTQDEEVGDGTTSAAVVAGQLLSKAEDLIEQEIHPTIIASGYRLAAEKAVEVLNSLAMTVELSNRDLLVSIAETAMTGKGAESSKKLLSEIAVDAVTSVVDKNGKNSVDKDNINVVKKVGGKVEDSELIRGMIIDKERIHPNMPEKVKDAKIILLNSAIELKDTEVDAEISITSPDQLQSFLDQEEQMLKKIVQKVISSGANVVFCQKGIEELAQHYLAKAGIFAVRRVKKSDMEKLARATGGKLITNMDEITPEDLGYAALVEEKKVGGDSMTFVTGCDNPKAVTILLRGGTEHVVDSIDSALEDALRVVGVAIEDEKLVAGGGSPXVEVALRLQEYAATLEGREQLAVKAYSEALEIIPRTLAENAGLDPIDMLMDLRSQHEKGVKAAGLNVYEGKVVDMWKNFVVEPLRVKTQVINAATESAVMILRIDDVIASTRAAGPEEGGMPPGAMGGMP

SEQ ID NO: 11237 - protein, 228 aa, Methanosarcina mazei
TRIKICGIRSPEEIEIAALYGADAVGFITEVPVESPRKLDSDTAAYLVSRVPETLSSVLVIMPENADTAVGLINKIKPDIVQIHSRLPHLELEIIKEKTGIPIIKTLSVPAQGEASNAGSGNPASVSSLLEEVSLLEEADIVDSILLDTARSEKPGGTGCVHDWALSRRISEETRLPLILAGGLKPENVRGAIRAVSPYAVDTASGVETCGKKDAVKIKSFIEEVRCA

SEQ ID NO: 11238 - protein, 461 aa, Methanosarcina mazei
MSCELMLKERTGIINPMYTCQPAGAQFVGIGIKDCIPLVHGGQGCSMFVRLLFAQHFKENFDIASSSLHESAAVFGGAIRVEEAVEALVARYPQLRIIPIITTCSTETIGDDIEGIIRKVNKDIKEKHPDRDVKLIAVHTPSYSGSQVTGYDTAINAVVQALAKKDEPSGKLNVFTGWVNPGDVSEIKHILSEMQVDGNILLDTETFDSPIMPDKSAFAYGNTTIEEIADSANAIGSIALSRYEGANAATYLKNKFGVPSVVTPTPIGINNTDIFLKNISKLTGKPIPESLVIERGKAIDAIVDLAHMFFANKKVAIFGNPDLVFGLAQFCLECELEPVLLLLGDDNTLYKIDPRLEALKEKANCDIKVIWNADLWELESRVKNKSIDIDLILGHSKGRYIAIDNDIPMVRVGFPTFDRAGLWKYPAIGYKGAEWLAETIANTIFASMESKHDREWIINVW

SEQ ID NO: 11239 - protein, 282 aa, Methanosarcina mazei
SPVIRNEGFEIIDTTLRDGEQSAGVVFSVEERMNIISALDKAKVKWIEAGIPAMGKQECEDLKLMLNLPIKSNLIAWNRANLEDLKASIDCGFKFVHVSLPVSDLHIEHKLQKSRTWVLDQLKKCMEYLQSCKVTIIVGAEDASRADPEFLLQYAGIAASYGAIRIRYSDTVGCLDHFTTYRKIKEIADHSPPPVEIHAHNDFGLAVANTLAAYKAGAKFASVTVTGLGERAGNASMEETAFSLKRFYNYDCGIELEALPFLAEMVSKASERTLFPYKPLVG

SEQ ID NO: 11240 - protein, 513 aa, Methanosarcina mazei
MTQAKKPLMLIILDGWGYREAREGNAILAARTPNLDHLIEEYPWCFLEASGEAVGLPEGQMGNSEVGHLNIGAGRIVYQDLTRINFSIRKGDFFKNPAFLGAISNAKANDSSLHLMGLVSYGGVHSYMAHIHALIKLAQQEGVKKVYIHAFLDGRDVPPKAALKDIEELDAFCKENGNAKIATISGRYYAMDRDKRWDRTKLAYDALTMGVAPYKTPDAETAVSEAYKRGETDEFVKPTVITDSEGKPEAVIKDNDSIIFFNFRPDRARQLTWAFVNKDFENFPREKHPKVYYVCMAQYDETLDLPIAFPPEELENVLGEVLSKQGLAQLRIAETEKYAHVTFFLNGGQEKCYEGEDRCLIPSPKIATYDLKPEMSAYEVTEEVIGRIRSGKYDVIVLNFANMDMVGHTGIFEAAVKAVEAVDSCVGKIATVLKEVGGVAIITADHGNAEQMENPTTEEPHTAHTSNPVKCIYFGNDEVKGLKNGKLCDLAPTLLELLKIRKPEEMTGESLII

SEQ ID NO: 11241 - protein, 809 aa, Methanosarcina mazei
GWSSSEKALYNNASYPPTHQCFAFYKYMSREYKADALFTIFSSVELMPGKECGLSANDWGALLLEDMPHVHVLPMDAEGVFDRRRANMLVIDFMTPTIVPSGLYGNLSNLQQEITLFKQTSDSAVKENYRQDIINQTKNISLDNDLNVDIDSIAGDTNLTDAFIDKLADYLSELKTSYMPYGSHVLGEVPEGESLVMLIKSMLGDEYIEHVESLGGSEELSISLLNETILNGTSPYDAQIMVLGRNSTELGNDLDLSLEYLERIKQCDCEITKILDALDGTYITPGPSGDPIRNPDALPTGRNLYTFDDRLIPTKAAWNVGSQLAEETLKLKLEEDGQYPEKIAFLLWSVETTRNQGVMESEIFQLLGVEPVYNEKDRVTGLKLIDSKELGRPRIDVMVTTSGLYRDVYPSKIELIDQAIKMAAAADNDTYPNYVREHSNATYQSLIARGYNESLAYNLSVSKIFCPPPGGYTPGIQEVIPSDTWEDADEIAGLYIDRMGYVYSQEIWGEHYSDVFELNLEDVDTAVFSRTSNLYGVLDHSMVAAYFGGLSMAIESVSGTTPDMYINDLSSSAEIETLNEFLSKDLRSRYLNPNWIEGMMGNGFDGTRYMDSVFEVMRVWDVTDPDLVTDDTWNEMYDTYFKDKHNTGVTEFLKSTNPYAYQSMAATALDSIRTSYWDASDEVTQSLVKEYVESVAENGVTCCHHTCGNALLDEYVQGVMSVPGVVDEKTANEYKKLMQEATEPSQQSGESSSGSSSHHDHDTGKATVISGTSKTSNQTSSAGESTNNQTVKGSDAGYGTDTSKPAPEI

SEQ ID NO: 11242 - protein, 452 aa, Methanosarcina mazei
MKLKSINPYTEKINWAYDSFSIGECRARIEKSRTAFSLWDSLPVEEKAKHFKTAAEILRESTDTYAEIITKEMGKPVRQSKNEVQKCAQLCDYYAENSTELLKDEIVDIGTEKSYVTFEPLGVIFGIMPWNFPFWQVFRFAIPAMCAGNVCVLKHASNVPKSALEIENILLEAGFPENVFNTLLIDSKTAMQILKEELVDGISFTGSVGAGSKIGKLAGRGIKPVVLELGGSDPFIVLEDANIERAAQAAVKSRFLNAGQSCTAAKRLIVVEDIVMDFIESFEFKVKELKIGDPMDEKTDIGPLAKKEFLGSLERVLKDAKKKGAKPHVYGEEHKKGFFFRPTIIPAASTDMEVCRTEIFGPIAPVITVKDENEAVAIANSTEYGLGAKIWSGDLDRAERLAKRIKSGSVSINGMIKSDPRLPFGGTKKSGVGRELSHYGLREFVNIKTVVV

SEQ ID NO: 11243 - protein, 1317 aa, Methanosarcina mazei
  unsure (1)..(1317): unsure at all Xaa locations
SYVYVADERNGLVILKTDIQNPEPVPPKSDIPSSTYGSPSSNPNGAYSKEPVNLGTGSYFYQYQDLSIPGRGLPLTVSRSYNSMDNRSGLFGSGWTFNYNMNLTVDNNGNVTVLGGDGHTDTYILNPDGTYSRPLSVFDDLIKNSDETYTLTKKDQTKYNFSSEGKLVNIVDKNGNQINFTYTGEQLTKVTDASGRELILAYDHNGHIISITDPMGRVWSYSYDDQGNLIQCKNPIGGKLSYTYDENHWMTSITDPRGNHPMKNTYDEKGHVISQSNSLNATYTFNYDSENRKTTETDPFGKNKTYSFDEHFWELNETNQLGYTISYAYDENGNRISVTNENSKTTKLAYDANGNIIKTTNPLGYSKSMTYDSKNNLISQTDELRHKTSFEYDDNSNLIKSIDALGHETVFSYDKYGQVIGETDSNKKTATFSYNNNGDQITITDANGKTSAFTYDTVGRVTTKTDAKGNRYTFQYDALDNLLSITDPMGQTTSTNTMLLEIKLVLQMLKVDXQSILTTLXISXLKXRMQWVEXLGTNMMPLAIWFPRQTQKGHKTSYDYDPLNRQVSVTNALGKTTRNKYDAIGNKISITNAYGKSTRYSYNSLNQLVKVTNAMGKVVRYNYDAVGNLISTTDENGHKINYGYDSLNRQVSVTDALRKTTRNKYDAVGNKISITNAYGKSTRYSYNSLNQLVKVTDAMGGVVRYNYDAVGNLISTTDANGRKTNYGYDSLNRQVSITNALGKTTRNKYDAVGNKISSTDANWRLTKYSYDSLNRLVKVTDAMGGVVRYTYDAVGNLISTTDAKGHKTDYGYDSLDRQVSITDPLGRTARNKYDAVGNKISSTDEDGKTTSYGYDVLNRLTKVSYPDDQKVSYNYDAVGNRLTMKDSHGTTAYKYDKLNRLLSVLNPDGQKVSYTYNKVGNRVKMTYPDGKTTSYSYDAVNRLIGVIDSDGHITSYSYAKNGNLKTMNTPNGVKTEYSYDKANRLVELINKNTTQVVSSYKYTLDAAGNRLKVDEQLAEGVESGDSELKESQLLTTTYGYDKLYRLTKVDYPSNKTVSYKYDSMGNRISMTTNVDGIGSTISYKYDAADQLLQSGNISYSYDKKGNLIKKRVNSTQFMSYSYDEANRLKNVSEFVSNTNTPKSSYNFEYDGDGNRIIKTTINGENAQSTKYVLDINSALPQVLTESDTKNTTCYTYGTDLISMTNSENAEYYYHYDGLGSVRSLSDSKGIIKNTYLYDAFGQVQKEIGTVDNEFRFTGEQMDDETGLIYLRARYYDPSVGRFITKDVIKGRRVTTQSINRYVYTTNNPVNLVDLTGY

SEQ ID NO: 11244 - protein, 474 aa, Methanosarcina mazei
MVDRSRPLNLGKVISVRGSIVDVLFERHLPPVYTLLRAGRLRAGRESQIAIEVLTQLDAHHVRGIALTPTEGLARGMAVEDTGGPLKAPVGREILSRMFDVFGNTIDRRKPPSDIQWRSIHQAPPPLMRRSTTSEIFETGIKAIDVLVPLERGGKAGLFGGAGVGKTVLLTEMIHNVVKQHQGVSIFCGIGERCREGEELYRDMKDAGVLPHTVMVFGQMNEPPGARFRVGHTALTMAEYFRDDERRDVLLLIDNIFRFIQAGSEVSGLMGQMPSRLGYQPTLGTELSELEERISTTDAGAIMSIQAVYVPADDFTDPSAVHTFSHLSASIVLSRKRASEGLYPAIDPLQSNSKMATPGIIGERHYHLAQKIRQTLAQYSELKDIISMLGLEQLSPEDRNVVARARRLERFLTQPFFTTEQFTGIKGKTVSLSDALDGCDRILHDEFKDYSEGDLYMIGTIDEAIAKKSSREKS

SEQ ID NO: 11245 - protein, 271 aa, Methanosarcina mazei
IIDGKVLAKKIEDEVRSGVEALVSGRGITPGLATVLVGDDPASKMYVRLKHRACERVGIQAEDHFLPAETSQEELISLINTLNKDQNVHGILLQLPLPKHLFPQEAMEAIAPEKDADGFHPYNMGKLMIGDEGLVPCTPHGVIRALEEYNVPVKGKNVVIVGHSNVVGKPLAAMFLNRNATVSVCHVFTDDLKKYTLDADILVVATGVKHLIKADMVKEGAVIFDVGITKEKDGVYGDVDFENVIKKAALITPVPGGVGPLTVAMLMKHVL

SEQ ID NO: 11246 - protein, 311 aa, Methanosarcina mazei
IVKELTKKFGEFTAVDSVSFSVEPGELFGLLGPNGAGKTTIINMLTTLLLPTAGGAEIAGYDLRRDPDSIRNNIGIIFQDPSLDIGLTGRENLEFHAMMYNIRSDERKKRIQEVLDVVGLADKAEILVENYSGGMKRRLEIARGLIHYPKVLFLDEPTLGLDAQTRRSIWEYIGNLNRNYGTCVILTTHYMEEADFLCDRIAIIDHGKIIALDTPSGLKNRLLGDCVSLTIDGKVALIATALGEKEWVREVVPDGKTLDLILSDYEKNIPDIFQTASNLGVGISSINFSKPSLEDVFLRLTGSIIREQEGS

SEQ ID NO: 11247 - protein, 330 aa, Methanosarcina mazei
IAVNGYGTIGKRVADAVRAQDDMEVVGISKTKPNYEAAVAHRLGYDIYAPAANLEAFEKAGMPAAGSIEEMLEKADLVVDCTPGGIGEKNKPIYEKVGIKAIWQGGESHPIAGFSFNAESNYEQAVGRDLTRVVSCNTTALCRAISTIDRELGVNKVRASLSRRAVDPNEIKKGPVDAIVLNPVKLPSHHGPDVRSVLPHINITTAAIKVPTTLMHVHTVNMEVNKDCTAEDVKNIFGSQSRIRLVGQGITSTAEIIEFARDIGRPRHDMWELCIWPESITVTDKELYFFHAVHQESIVVPENVDAIRAMMELESDGAKSIEKTNKAIGL

SEQ ID NO: 11248 - protein, 401 aa, Methanosarcina mazei
YLTMSDVVLDNKRVLVRVDFNSPMDDNGNILDDKKIKSHLPTLQSLEHSKVVLMSHQGRPGDEDYTTLEAHAKLATELLGREVTYEDDIFSSCARNAIKSLAQGEILLLENTRFNAEEITNRPPEKQAKSQMVKKLYPLFDLFINDAFSVSHRSQCSVVGFTEVLPSVAGILMDKEITGLDKALKCREHPAIFILGGAKANDSIKAISNILKRAGADKILTTGVVATIFMMAMGVDVSEVNRKFIEDKKYMDQISIASKLLKDYSGKIIVPQDVALNSGGERQEVEVDKIKKGNLPIADIGRETIENYSKYLKEAKLCVFHGPTGIFELDNFRLGTDELLKAAAQASYSVAGGGHTLDAIDQLGLGSKFSHISMGGGASITYISGEPLPGITALKKNAFRY

SEQ ID NO: 11249 - protein, 192 aa, Methanosarcina mazei
FNFGVRTVLKALIFDMDGVLVDSMPFHAVAWKKAFFDMGMEIQDQDIYSIEGSNPKNGLPLLIRKARKEPEAYDFETITSIYRKEFKRVFKLKAFDGMRECLEVLKTRFLLSVVSGSDHLIVHEIVDQLFPGIFDIVVTGDDVKNSKPYPDPFLKAVKLLNVQREECIVIENAILGVEAAKKAKIYCIGIPT

SEQ ID NO: 11250 - protein, 1420 aa, Methanosarcina mazei
ESSGSSIPMVGIYYPGSDNESFYFEDTPTYLAWYKRGSESYRSYDPNKPTIGIWFHRTDLQNGYTGVVDAIIRNLEDKDCNVIAGFDTFDNITEYYCDENGTPLVQCMISLKSFRLNYNNPEQGIEELKNLNVSVLRGIVAEESEYVDAADSSRGIPTDQVVRKTISPDLDGIFEYIVVGKSEKNSTTGYYEYVPMPNQVDWITNRSIKWAELKLKNNSEKNVAVIYYNYPSGKDNVATASYLDGVKSLCKLLEVMQENGYDIDYVPEDSDELLDRLMLQGYNAGSWAEGMLDDLVVNRTDWGVELVPIETYHKWFETLPEELQTSVIEKWGEPWNESEDIASSPMIWENSSGRYVVLPAVRCGSVWLMAQPARGFFQDEKALYHSSETPPTHQYIAFYMWLNNEFKPDAIIHMGTHGTHEWLPGQSCGMNRTSEWSPILLGDIPNIYPYIVANVGEGQTAEYRGNALIIDHLTPTMERAGAYAELENLTRLMQEYYGLEMNTQTKVAYQAEIIEEMESLSLDEELGINATELLAYNTTEFDLFVRDVLHEYIEDIEGDSIAYGLHVLSEVPSCNSLDPQEDELTDVVRALLGSDFEVNLTNAFYQEYPEGIPENDTKVNNLIWEVIRNGTDVHEAQEMVYGQSDPLISSDLEQGLGYLDLVLEPDDSELFSLIKRIVGEELKADLKTDFYSNTTEYPDGIPENDTKPDDLLWKVVCENVDSEEAQNQVYGWNNSSVTADLDYGADYKDQILYPHWDELVYMVRSMLGSSFESRVEAAFYSNTTEYPLGIPLTDTKVDRMIREVVVMNSTPEEAELDIYGTTNDTISEDLLTGLEYKQRLLNSNVELDRILSALDGCYIPPGPGNDPVSRTDAVPTGRNFYGINPELYPSEATWKMGKLLAQELLADYYEKYGDYPHKVAFSRFGVDFIQDHGTLEAEILYLLGVKPVWDDNGIVQGVELIPEEELLPSYDSSNPGRPRIDIVYVTAGMRDAFPDKIEMIDDAVKLANLAPDGNYSNYVNESTQVFYDKLYEEYLNETGNATAAAALAENLSTMRCYAVKDGTYELGVSNLVEASGNWDNEEEIAELYMNTMGYAYGSEIWGYKSSEIFAQNLADVDASVHSSTSNLYDAFDNDDFFQYFGGLNLAVYYLTGEYPEMYVSDTRDADSAEMVTLQEYLNKNLRSTYFNDKWIEGMMGSGYSGASMFSEFVDNVWGWDVTTDLISDDVWENIYGTYIDDPEMQKWFDDNSPATFQSITGRMLEAARKGYWDCDSETLESLATAYEKSVAENGATCCHHTCGNVLLTEFVEGFVSVPGFSQAMEKATKSSELDDKNFTTPKEEEKTSHSSSSTGKAEVVSDSGNQTQAEISDGGYGMDTSKPDAQKTEDSNYVEGYEMQKESTKNESPSSGISFSGADIVGIV

SEQ ID NO: 11251 - protein, 406 aa, Methanosarcina mazei
LIESGNMKMDWARNHMPVLAIVRKKFEEEKPLKGMKVGMALHVEAKTAVLVETLAAGGAEVAITGCNPLSTQDDVSLALGTRKNINCFAKYGVESQEYYKAIDQVLDIKPDITIDDGADLIFKLHTERTDLLPNILGGCEETTTGVHRLHAMEKEGALKMPVIAVNDAMTKYLFDNRYGTGQSAWDGINRTTNLLVAGKNVVVAGYGWCGRGVAMRASGLGANVIVTEVDPVRALEARMDGYRVMKMADAAKLGEIFVTTTGNRDILTAENFKSMPDGAILANSGHFNVEIDMGALESLAKSVRTVRHNIKEYDLGDRRINVIAEGRLVNLAAGDGHPAEVMDMSFANQALCVRYIAENKLPNGVHKVPLELDTFVARMKLQSMGITIDELTTTQECYMSGWECGT

SEQ ID NO: 11252 - protein, 214 aa, Methanosarcina mazei
EISRKAAKMGADLLEIRLDLLGIRDLETAAETIRKVKSETGLPVILTNRSITEGGKWEGKEADRIELLTNLISLKDGPDAVDIELSAGREARDQVIKAAKAHGKTVIVSSHDFSRTPAFQEMKTILEEAFLAGADIAKLAVMPQSRRDVLNLLRVALDAREAGNAVCTIAMGRLGKHTRVIAPFYGSVLTYAAVNSEVSAAPGQFQVDEVKKIL

SEQ ID NO: 11253 - protein, 276 aa, Methanosarcina mazei
QVFGVFGDPIAHSLSPAMHNAAFSALGMDCIYHAFRVKPEKLEKAILGAEAMGFGGLNLTVPLKETALKLDCIKPDPLAEKIGAVNTIVFGETGEIKGYNTDGLGAKQALQNSAVEMEGSKIVVTGAGGAARSIAFQLAADGAEITIVNRTEGRAIELAKDISAASLSGNVTGKGLSGLKNLLQDANILINTTTLGMHPNVDTAIATAEDLHPDLTVFDIVYNPLETRLLREAKASGAKTVSGVLMLVYQGAEAFKLWTGIEPPVELMKKTVLEAL

SEQ ID NO: 11254 - protein, 513 aa, Methanosarcina mazei
MPYHTFKCSECIPERAMHAVIKGPGEDLTSCLPLGYLNTIPGTISERGCAFCGAKHVIGAPMKDVIHLCHGPVGCTYDTWHTKRYISDNDNFQLKYAWTTDMKEKNVVFGAEKLLKQNIIDCFKAFPHIKRMSIYQTCASALIGDDINAVAKKVMEEMPDVDIFVCNAPGFGGPSQSGGHHKINIAWVDQKVGTFEPEIKSKYVINYVGDYNIQGDAEIIVDYFQRMGIQVLSTFTGNGSYDDLRGMHLAHLNVLECARSAEYICNELRKRYGTPRLDIDGYGFEPLSASLMKVAMFFGIEKEAQDIIDEEIARWKPELDWYAKRLKGKRICLWPGGSKLWHWAHVIEEEMGVKVVSVYSKFGHQGDFEKGVARCSEGALAIDDPNELEGIEAMEILKPDCVLTGVRPGEVSKKMRIQYLNIHGYHNGPYKGFEGWVRLARDLYNAIYSPIHQLSGLNISKDEIPTDKGFVTRKMISDVNIIEDGKTPIEERPYTGECDIVTRLRGKKYPKLE

SEQ ID NO: 11255 - protein, 462 aa, Methanosarcina mazei
MSCELKQRERPGIINPIFTCQPCGAQYASVGIKDCIAIVHGGQGCVMFVRMLFAQHFKDSFEIASSSLHEDGAVFGALNRVEEAVDVLLMRYPHVKVIPIITTCSTEVIGDDIDGLIRKLNKKLLKEKYANREVHLIPIHTPSFKGSMITGYDVAVHDIVKEFAKKDKPNGKLNLITGWVNPGDVTALKHLLSEMDIDATVLFEIESFDSPLMPDKSGFAHGSTTIEDLTGTADALGTIALNKYEGGKAAEYLKNKFDVPAIIGPTPIGIRNTDTFLQNLKKMTGKPIPESLVRERGIAIDAITDLTHMFFADKKVAIYGNPDLVIGLAEFCLDMEMKPVVLLLGDDNNTYKDDPRIKEFQEKVDFDMQIIMNADLWELERRIKDKEVELDLILGHSKGRWTAIDNNIPMVRVGFPTFDRAGLYRHPVVGYEGAIWLAEQMANTLFTDMEFKKDREWILNVW

SEQ ID NO: 11256 - protein, 199 aa, Methanosarcina mazei
RGKLITLEGIDGSGKSTVAEKLQKNPEIKAFKPVFTREPTRGTLTGDAVEKAIQSDTDQFAELFLFTADHAEHLAKLIKPALENGKIVISDRYSDSRYAYQGITLKTRLENPLEWVKDLHRSWTIVPDLTFLFDIRPEISIERCGKRGEQSKFEKLEFLQGVRAIFLKLAADDPERFVVIDASRSPEYIEKEVVKKILE

SEQ ID NO: 11257 - protein, 339 aa, Methanosarcina mazei
MNEMALKERLLNALEGKEVDKVPVCSVTQTGIVELMDKVGAPWPEAHSDPEKMATLAIANYELSGLEAVRVPYCLTVLAEAMGCEVNMGTKNRQPSVTAHPYPKSLEGMEMPENLLDMGRIRTVLDSIKIIRERVGPDVPIIGGMEGPVTLASDLASVKSFMKWSVKKPDLLHQVLDFATDATIAYANSMVVAGADVISVADPVASPDLMSPDSFKNELQSRLQKFSSNVNSVTVLHICGSVSPILDYMADCGFEGLSVEEKVGSIKKAKEVLGDRARLVGNISSPFVLLPGPIDKIKEESKKAISEGVDVLAPGCGIAPMTPLSHIKAMVEARDEYYA

SEQ ID NO: 11258 - protein, 481 aa, Methanosarcina mazei
MRIDAYITEYARKTPQSIALEEGKSSISYSCLDNDINTIASLLMDFNHCRFSILAESGMLYVKVLMAVYRSANIAIPLPIEFPKFSIEKILDAAHVNNIIVTDTQYSRFGEDFFERFGTVVIISSNTSGEFLRKKIETEVNNPQLQLVLYTSGTTGTPKGVMLSNRNLVANAESIIKVLRITSRDKGALVISPHHAFGNSIINSHLVAGSSVRIGNMNFIDSIFNLIGSDISIFYGVPSTYRILLRYPDRFKKDFSRVRTAASAGGEMDRDIVNDIRELAPDLEILPMYGQTEATARLAYLPAEDVNELVDTIGKAIPGVILDVFDSEYRPAKPNITGELVATGDNIMLGYLDDEIATGMKIIDGWLHTGDLAQKLPNGYIKLLGRKDDLIKIGDHRVNPREIEKSIEENNEVSRVFVVPVHHELMGTAISLMVIPAKGTEIEKLYAFCRKSLPGYLRPREILFIDHLPISENGKISNRSI

SEQ ID NO: 11259 - protein, 472 aa, Methanosarcina mazei
INGKAVEACSGEFFDIINPATGELIDRVPKGTEDDAAIAVESASSAFNGWASTSPQQRARILYTAAGIVRQRKDELAVLLTREQGKPLAEAKNEIEGFAHVLEYYCGLASSFHGDFVPVPQNGYAFTVKKPLGVCTAIIPWNMPALIMAWKIGPAMISGNTLVLKPASNTPLTNLALASILSEAGLPPGVLNIVTGPGEVVGESLVKSPKVKKISFTGEVRTGKRIAELAAGGMKRVTLELGGSDPMLVCDDANLEAAVAGALRGRFYNCGQACTAVKRLFVFESVAERFIKKLEAGIRNLRVGNGLHENIDLGPLNNRRQWEYIKELVADAEEKDEGRIVAGGRVPEGSACSKGYFFEPTLIVDVDRKSRLLNEEVFGPVLPVVRVKDLDEAIEEANNTCYGLGASIWTKNLDRARIGCEQLNAGIIWLNQHLKVAPEVPFGGTRESGIGNENGPDALSEYLDLKTVMLKI

SEQ ID NO: 11260 - protein, 900 aa, Methanosarcina mazei
EVYYDQEINSVFEELGVSEAGLSFEEAEKRLEEYGENELKEKEKVSVLQLFISQFKSILILILITASIVSALLGELVDAIVIIFTVFLAGILSFVQEYRAEKAIELLRSLTSPEATVKRDGVEKRVPSKNLVPGDLILIQTGDRIPADARLVKEFNLKTDESSLTGESVPVQKSIEALPSETSEADRTNMVYTGTAVAYGRGSAIVTATGMNTAFGELAGLLGTIERSRTPLQESLDKFGRWIGTATLVIVAFVAMLGVFYGFPLLDMFLWGVALAVAAIPEALPAVVTVGLGLGVRRMVKRHALVRKLPSVETLGATNVICSDKTGTLTQNKMTVEKICVNDQVLKVTGAGYSPEGEFFNRDEKVSTDDPHLQILLLGAVLCNDAGLFKESDTWEIKGDPTEAALVVVAAKSGLHKVELDQKYSRLGEIPFSSERKRMTTFNKLETDSSNFPIKGLTAFSKGAPEVILGSCTKIFLDGEIKSLSPEMKQLIEGKVKEMADQALRVMALSFRLLDEELYIEKTSSKELPSERIEEDMVFSGLMGMRDPPREEVKVAIQKCEDAGIKTVMITGDHKITASAIAKELGILKANDLTLTGSELDRLEDVEFEDKVERVSVYARVYPTHKLRVIDALKKKGYVVAMTGDGVNDAPALKAADMGIAMGITGTDVSKEASSMILTDDNFASIVAAVEEGRNIFKNIRNFITYGLSAHIGEVLIVLIAILGWQILPLIAVQILWINLITDGLPPMALSVEPPDNGIMKQKPRNVEKGLITRREISASLGIGGLIALQALLVLNWALDRNFSIEKLQTLIFTLVVFSEMFNAFNWRSDRYSIFSLGLFTNRPLVYAVLTTVILQLVVIYVPFFQTAFRTVPLSLFEWGVVLSLASTTLISMELIKYFS

SEQ ID NO: 11261 - protein, 288 aa, Methanosarcina mazei
IRIAIPNKGRLYEPTISIFKDAGLPISGGAESRKLFAKTTDPDIHILFARAADIPEYVQDGAADVGITGIDLITERGAKVETLLDLKFGKASLVLAVPEDSDFQKAEDLEGRKIATEFPEITHQYFKKHGVNVEVIKVSGACEMTPHVGIADAIVDISSSGTTMMINHLKPIETVFSSTVYLIANKESLRTKEKILDIKTALESVLNAKDRRYLMMNVPESSLQAVKEVLPGMSGPTVMKVESSKLPGESILAVHAVVDADLIFTIVNKLKKVGARDVLVVPIERIMP

SEQ ID NO: 11262 - protein, 191 aa, Methanosarcina mazei
MRTGRMSRKTKETDIQLELNLDGTGIADVNTGIGFFDHMLTSFARHAEFDLKVRAEGDLYVDEHHLVEDTGIVLGKVLAEALGDMAGTARFGEARIPMDEALADVALDIGGRSYLVLKAEFASPQVGQFSTQLVKHFFETLASNAKITIHASVYGDNDHHKIEALFKAFAYAMKRAVKIEGKEVKSTKGTL

SEQ ID NO: 11263 - protein, 363 aa, Methanosarcina mazei
FKALGLSDSMLKALKKKGFEEPTPIQEKVIPLFLKGECDIIGQAQTGTGKTTAFGAPIIEKIPEKSGKVQAIVLTPTRELAIQVSEELNSLKGDKKLHIVPIYGGQSMTQQFRMLKSGVDIVVGTPGRVIDHLERKSLNLENIAYFVLDEADEMLNMGFIDDIKEILKATGPDKRMLFFSATMPKPILGIIKKHMKNYEYVAIKKEDLDVNLTEQIYFEVKESDKFEALCRIIDIEDEFYGLVFCRTKTDTSQLAQKLGDRGYAADALHGDLSQREREKILNRFRKQKINILVATDVAARGIDIMDLTHVINYSLPQDPESYVHRIGRTGRAGKQGTAITFVTSTEYRRLTYIKKTSKSAMKR

SEQ ID NO: 11264 - protein, 929 aa, Methanosarcina mazei
  unsure (1)..(929): unsure at all Xaa locations
DPFGVRDTIETAAGKATIYSLGKLEEKGYEGISLLPYSIRILLESLLRHADTEKHIITAEDVEALARWSPENISDRDIPFIPSRVIMQDFTGVPAVVDLAALRSAMQRLGGDPAKINPVIPADLVIDHSVQVDSYGTAYALEENEKKEFERNTERYSVLRWAQKAFDNFRVVPPGRGIIHQVNLEYLAPLVHLKEKDGELFAFPDTLVGTDSHTTMINGIGVLGWGVGGIEAEAVMLGQPYYMPVPQVVGFKLYGKPAPGVTATDLVLTITKMLRKEGVVGKFVEFYGPGLNSLSLPDRATISNMAPEYGATLGIFPPDAETLDYLRRTGRSKEQVDLVKKYMEAQGLFYSTHDPDPVFSTTLELDMSTVKPCLAGPKRPQDQLFLSEVPENYHEIMKQTLSERKNQGLNFPRILLTSAGXKTEERLLRNLKLLVAEEEIKESSEKSFRVTHGSVVIAAITSCTNTSNPSVLIGAGLLAKRAVEKGLHVKPFVKTSLSPGSRVATEYLKAAGLLPYLEALGFHQVGYGCTTCIGNSGPLPEKVSKEIKENDLTVAAVLSGNRNFEGRINPLVRANYLASPPLVVAYAIAGTVNINLETDPLAYDPNGRPVYLKDIWPAEKEIRAAEKNSIKPSMFEKEYSGALEGSKRWKELEAPTGTLYDWNSMSTYIQEPPYFMDFPPAPPSPADIKNARVLALFGDSITTDHISPAGAIPSDSPAGRYLISWGVSPEDFNSYGSRRGNHEVMMRGTFGNIRLRNRLVGREGGWTVYHSRKEDFPEEPCEGIPIYDAAMLYAENDTPLIVIAGKEYGTGSSRDWAAKGTFLLGVKAVIAESFERIHRSNLVGMGVLPLQFKEGENADTLGLTGKESYDILGIEYMEPQGELTVRAKDEDGNEVQFQVTLRLDSAVEVEYYLNGGILHKFLRDSVKKN

SEQ ID NO: 11265 - protein, 355 aa, Methanosarcina mazei
GITVRYKMSKNICFIDGLEGILKYREIDINQLVDLPYDAVSYLLILGDLPGDQELAEYSACLHGEREVNREVIDVIHMCNFNIDSIEALRTIVSFISQFDPDINDSSPEGNMRKATRLIAKIPTIVAAYYRIANGKEPVPPDPSLSHGANFLYMLRGNKPTQLEAEVMEKDFILSAEHELNASTFSSRVTASTLSDLYSAVVSGLCTLKGPLHGGARAEVTAMIEEIACPENAENYVLDKLSKKEKIMGFGHRVYKTYDPRGMIFKQLAKQLAEAKGDMHWYNIAEVVENTVIRELVEKKGKPIYPNVDFYSGVIYKYMDIPPQLATSIFAIGRVSGWIAHCFDQYEKKKIIRPR

SEQ ID NO: 11266 - protein, 1060 aa, Methanosarcina mazei
  unsure (1)..(1060): unsure at all Xaa locations
VKLKNLHIENIRSYKKLDFTFEDGVTVISGVNGSGKSSLLEACFMGLFGSKILSKDFVLADVIFKGAENAKINLGFEHLGQDYLIEQAFRYSSKSENASNSKCVLYANGESIVDQATRTYEEVCSLLNMDEEAYRNCAYIRQGEIDVLINAKPKDRQRMIDGLLQLGKLEEYRERAGSAKTAVRRLQRDTSNSLSGVKAEIEGIESTEPHAVLNGLRQKIKESDTILKKCNENKEAAAAQKEKLDLMITEHRERLQEIQTLKQALSKSQEDKAGCIREKEAFAREAHEQRQALLGLEEENNHIRGECGFGDLEIEALSLQKEKEEFLAREKVNVISKELALLLREEEVHTQDLRDFENEKAETEQSLMQCRADIGATNGEIEGNRKNILRIEDENKKLKEAAKETTGFTDTYEIPLFINELEEKESLLRERKNEASTKLALAFKEKETGDINLLTLDKELQNTKVAVRKSKTEIEILEEELRENEKAVLEVKEQKSEASAGLKGLGFTGEQLEDLEYLSELLLENKNRLHGREKELEATLRELDKVIRKNRQLLAEGKCPTCGQDLKGSEIACTTGESEQKREKLAAELLDIKLQQAEVEKKLNRLKDAKKLEKRISDYRPGNRKTQKXGKRPARKDNDPQTRTEEDSLKLEGLNKXKEELEAKMGKLLPDIKALQGWEAAAQKAHGESERVLQEAKAFEKKLAENTSEIESLNGKIRTSLALIENYGQRLGELNEKLKGLAERETQEKEKLKTWKLSLKPXGKKKPLAKETHDESSKHLLKTKKLGANLIQMDNIKHKISELEASIRNLAEKVGFFDREILERNERVKQLEGKLQGSRFEDLQSKRTQLEEYQANLTEKTRQTTAAKDALLKEVGMVENSLKRRNELKDELKALENRKQYLEAVYSNAEELESMYMRVRADMRNRNIGALSTLLNEMFSFMYTNNAYSHIELDPEYNLTVYRKDGTPLEPKLLSGGERAIFNLVLRCAIYRLLALGFGGDRADGLPPMILDEPTVFLDRGHINQLLKLIDMMRGIGVGQIIVVSHDESLIDSADHVFQV

SEQ ID NO: 11267 - protein, 280 aa, Methanosarcina mazei
LKIIGGPASQLLASRTARALGIEPVLSEFNRFPDGELYLRIAEETENEHVTLIQSTPTDSDLVSLLQLIDACEGAKELDVVIPYMGYARQDKKFKPGEPISARAIARCIRADRVFTINIHEKSVLEHFHGPAENLDAAKLVGEYIAGLNLENPLLLAPDSGAEGLIKHVSSGLGFDYDHLEKTRLSGDTVVIKTKNLDVTGRNVVLVDDMIATGGTMAESIKMLRSQGAADVYIACVHPVLARNAVLRLFNAGVKDILGTDTLERAESRLSVAPLIADAI

SEQ ID NO: 11268 - protein, 436 aa, Methanosarcina mazei
EISSMVISHKKAKIEEMESAWHGDLDGLLHNLYNHEYIHECVVLKTCNRVEIYVVSPSSSILFSFAKEMGASTHIIDFYGHDESLEHLLRLAGGLESMIVGEDQILGQIKELYAYSKKAGTTGKILDTAFDKAIQVGKRIRNETRINKGSVSIGSAAVDLAEEILDGLAGKSVLVIGAGEIGVLVAKALAAKDIEAIYIANRTFKKAEELAYELGGYAVKLNDVQTQLKNADVVISGTGAPHYILTREIVEKAIEERDKTRKLLLIDIANPRDIEESVAELDNVKLCNIDNLRVISEKTLKMRKEEAKKAEAIIQEEIKLLNLQYKRQRADKIISDLYKQIYDVRIREREKAVNRLCAYHTIGKIETDVLDDLTHSIANKILAEPTKVLRQAAELGNDEFLDVAARIFCLEKDKVKAEKIKSDCGIKVEKMKPDCE

SEQ ID NO: 11269 - protein, 322 aa, Methanosarcina mazei
FPDVRLRRLRKGKIRNLVRETTLSVDDLVQPIFVNETIDSAVEIPSMPGIYNIPLSEVVNEAKEIAELGIPAVIIFGVPAFKDAEGSSAYGETDVVQEAVRRIKAELGDELVVITDVCMCEYTSHGHCGIVDFETKEILNDPTIEVIGKIAVSHAKAGADMVAPSCMMDGMVEAIRQALDMNGFENIPIMSYAAKYHSCFYGPFREAAESGYSFGDRSTYQMDPANSDEAIREVTLDVAEGADIIIVKPALPYLDIIYRVKTDYGMPTAAYNVSGEYSMIKAAAANGWLDEKKAIYESLISIKRAGADIIITYFAKDAARML

SEQ ID NO: 11270 - protein, 418 aa, Methanosarcina mazei
LEKSRQMYEKAKTLIPGGVSSPVRAIKPYPFYTASANGSKIKDLDGNEYIDYCLAYGPALLGHNHPVIKEAIKAQLDKGWLYGTPTELEVNLAEKIAGYYPSIDMLRFVSTGTESTMSALRLARGFTGRNKFIKIEGGFHGAHDAVLVKAGSGATTLGEPDSLGIPADFTKYTLQAPYNDIEAMTGLVEKNRDELAAVIIEPVLGNIGPITPLPGYLEELRKLTLENDVLLIFDEVITGFRLAMGGAQEYFGIVPDMTTLGKIVGGGLPIGVFGGKREIMEMISPSGPVYQAGTFSGSPCSIAAGIAVLDYLEQEKIHEKVNSKGDYIRAVLTEIVEDEGIDYSVCGIASMFKIFFGAEPHNYQEALKCDKEGYLAFFHRMLASGIFLPPSQFETNFVSAAHSEEDIEKTLKAYTENL

SEQ ID NO: 11271 - protein, 288 aa, Methanosarcina mazei
MIIGTRGSQLALAQAETVARLLKAKGVETSLKIIKTSGDRFTDRPLHAVSSGVGAFVRELDEVMLEGKIDIAVHSMKDMPTIRPPTLPTVAVLKRDTPFDLLLTYDGTPLDELSEQSIIGTSSLRRAAQIKRYRPDLVTQDLRGNIDTRLRKLKEGKYDGILLAKAGLERMGWELEGEILSPDFFCPSPNQGTIAVVTRAETEAEAAVSRLDHTDSRIATEIERILISELGGGCTTPIGSYAEIMPDRKKLHVRAEVLSLDGEETVGINEFIPMAGGIEKARELGSSL

SEQ ID NO: 11272 - protein, 562 aa, Methanosarcina mazei
KTIEKYAYQNAVKYGKAPQPKAVMGKVMGECPQLRSDPNAVSEALKVIIPEIAKGNPETWETKLSEIAPELIEALSVKKEPDKGLKPLEGAENGKVVMRFAPNPNGPATLGSARGMVVNSEYVKMYGGKFVLRFDDTDPDIKRPLLQAYDWYLDDFKWLGVVPDQVVYASDHFPMYYDYARKLIEMGKAYVCFCKGGDFKRFKDAKQSCPHRDTSPEENLMHWEKMLAGEYEDQQAVLRIKTDIKHKDPALRDWGAFRIRKMSHPRPEIGNKYVVWPLLDFAGAIEDHELGMTHIIRGKDLIDSEKRQGYIYKYFGWKYPRTTNWGRVKIHEFGKFSTSTLRKAIEAGEYSGWDDPRLPTIRAIRRRGIQAEALKKFMIEMGVGMTDVSISMESLYAENRKIVDPIANRYFFVWNPVELEITDAEPTVAKLPLHPTDHKRGFREIAVGNKVLVCTEDVEKLEVGSIIRLKDFCNIEITSLSPLQAKLSDVSLEALKKAKAKIIHWAPLDGINVKVRGPEGDLNGIGEQGIAAELDKIVQFERFGFCRIDAVSEDEIVAYFAH

SEQ ID NO: 11273 - protein, 330 aa, Methanosarcina mazei
IAVNGYGTIGKRVADAVRAQDDMEVIGISKTKPNYEAAVAHQIGYDIYAPAANLEAFEKAGMPAAGTIEEMVEKADLVVDCTPGGIGEKNKPMYEKAGVKAIWQGGEDHSLAGFSFNAICNYEQAVGRDLVRVVSCNTTALCRAIYPIDKELGVKKARVVLARRATDPNDVKKGPINAIVPDPIKLPSHHGPDVKSVLPQINITSAALKIPTTLMHVHTVNMEVEKDCTVDDVKNIFGSQPRIRFVGQGMSSTAEIMEFARDMKRPRNDMWENCIWPESITVGDKELYFFQAVHQESIVVPENVDAIRAMMEFESDGAKSIEKTNKAIGL

SEQ ID NO: 11274 - protein, 381 aa, Methanosarcina mazei
DADIIVIGASPAGLMAARNACEKGAAVLLLEKKEEIGHPPHPANSFFKGMLDKCGEKVDPSYVLHYLKGMKIISPSGRTVEVEATGYAIDKTAFDRFYAKKIMKTGVDLRTGVKVQDIQKEGDKFTVNTSAGVFTSKLVIISDGINSKMASLVGLKTMKHPEDIAWGIELDIKSPGLGKPEMFEYYVGNHAPGWKTTYSPRGGDNAAIGAYVRRCGTDATPYLNAWVENFKKLKGLEELEVVRKLSGGDPIVTIPGEYITDGIMVVGGAAGQSGIGYAMRAGQICGDVAADAINKGDVSKSTLLAYRKTWEKEFLAEHYLGRIGLETLRKMTDREIDEMTKVFEKEDLSFIHGSSVEQAMRVFAFMLKKKPSAILKFRALF

SEQ ID NO: 11275 - protein, 542 aa, Methanosarcina mazei
SLAAQPIFILREGSKRTHGSDAQHNNIMAAKAVAEAVRTTLGPKGMDKMLVDSMGDVVITNDGATILKEMDIEHPGAKMIVEVAKTQDAEVGDGTTTAAVLAGEFLTKAEDLLESGVHPTVIASGYRLAADQATKTIDTITISASPEDTETLEKIAATAITGKGAEAQKEHLSRLAVKAVKSVAEISEDGKITVDIEDIKVEKRPGGSIKDSEIVDGVIVDKERVHPAMPEVVENAKILLLSVPIELKKTETKAEIKITNPDQMQLFLDQEEAMLKEIVDKVIKTGANVVFCQKGIDDLAQYYMTKAGIFGMRRVKKSDMDKLSRATGAKIITSLDEIEESDLGHAGLVEEKDVTGSRMTFVTGCKDSKATSILLRGGTEHVVEGIERALEDALRVVGVALEDQKIVVGGGSPEIELSLRLKEYAATLKGREQLAVMKFAESLEIIPSTLAENAGLDPIDMLVEMRSQHEKGNKRAGLNVYTGKIEDMFENNVVEPLRIKTQAINAATEAAIMVLRIDDVIASSSPAKVGGPGAIPGGEMPE

SEQ ID NO: 11276 - protein, 179 aa, Methanosarcina mazei
LKTSLINSPVIKRGEYNYFIHPISDGVPSIDPHMVEEIAEYILQITDIKKVDTILTIEAMGIPVANALSLKTGIPLTIVRKRPYFLEGEVELSQRTGYSKGALYINGLKKGDRVIIVDDVISTGGTLIALVKALKTIGVEIQDVISVIGRGTGYLQLKELGVEPKILVTIDVSEKGVEI

SEQ ID NO: 11277 - protein, 407 aa, Methanosarcina mazei
IQEIIKKYPTPFHIYDEKAILENAEKMKAVFREVPGFKEFFAVKALPNPFILKILREKGFGADCSSLPELILAEKAGITGEDIMFSSNDTPAEEFLKAKELGAYINLDDISHIDYLEKYAGLPDIVCFRYNPGPLKEGNAIIGRPEEAKYGFTRDQLFEGYRILRDRGVKRFGMHTMVASNELKADYFVETARILFELIVEISKELNIKFEFVNLGGGIGIPYRPEEEPVSFEAVAKGVKEAYEATITASGLYPLKVFLECGRVITGPYGYLITQVRHLKHTYKDYVGMDSCMANLMRPGIYGAYHHITVLGKENEAPVHKYDVTGSLCENNDKFAIDRHLPEIEIGDILAIHDTGAHGHSMGFNYNGKLRSAELLLRKDGSVVQIRRAETIEDYFATLDFEALKDF

SEQ ID NO: 11278 - protein, 573 aa, Methanosarcina mazei
  unsure (1)..(573): unsure at all Xaa locations
MARFIELAELFEELEKITSHKEIVRRIANFLXGLERKEIKDSAYLFLGSIGPAFENITLGIGDKLALKAIAGAYRVSEEEVKKRYSRTGDLGDVAFELNQGEEKSLAIDEVFGSLKEIKEASGKGSQEEKTGLLSSILQRASPKEGKYIVRIVLGKLRLGFGDQFLLEAFSIAFTGDKKYVVKIKESYSVCTDIGELAESLAEQGPKALGHFSIKLGRPVRSMLAQRVKTFEELEERIPGKKAAEEKYDGERVQIHKNGEEIKAFSRRLEDITAQYPDVIEAVRKGILAKKIVLDGEIIAYVEGGKANDSTGEFYSFQRLMKRRRKYEVQKYTEICPVAVFFFDILYLEGNSLLKKPYPERRAILEEHVKESEILHLARRIVTDNLEEIEDFFNEALEKRLEGIIIKSMGRNSAYEAGKRSWFWLKWKEEYASGMRETFDLAIIGKYYGRGKRKGSFGALLCAILNGEEQRFETFTKVGTGFTEADAKEIDSLLSEHIISEVPKNVLIKSRMLPDIFVEPSLVIEVLGSEITESPSHTAGQGEGDTGLALRFPRFLRIRHDKGPYDITTLTEV

SEQ ID NO: 11279 - protein, 532 aa, Methanosarcina mazei
  unsure (1)..(532): unsure at all Xaa locations
LVQMEKGGQPIIIIDPKKEETKGKEALSMNIAAAKAVASIVKSTLGPRGMDKMLVNPIGDITITNDGATILHDMSIEHPAAKMVAEVAESLESSAGDGTTSAVVFTGNLLEKAEDLIESGVHPTVVVKGYRLAAEKAVEILESLAISTAENEKEKLLEVAKTSITGKASEKYGRLIAELCVDAALSIRERGVVDLKDVILSKDVGGKIEDTEFVEGIVIDKVALDKEFPLRIENPAIALIDAPMEIAKTANKAKLQINAYGDLEDFVKQEEEALFEMADYIIRAGANAVFCSKGMDDKIAAYLQNRGIYATRRVKNEDMQHLVDATGGRPIRNIKELTQKELGHAGLLEQDRDGDQGKTYLRECKGAKSVSIVIKGGTEHIVDNLERAIDDALRVVKCAIEDGRIVAGGGASEVEVALELRAYAPGIGGREQMAIRAFADALEEIPRTIARNAGLDAINTIVNLRAKAYRKQTQAXTSIPGAAEDMLKKGIVDPLRVKVNSVKAGSEAAVMVLRVDDMLRAQRADMQDVKPE

SEQ ID NO: 11280 - protein, 338 aa, Methanosarcina mazei
VYISDSTIRDGSQMPGIVLSREHKLQIYEYLHEIGIEKLEAFVFNKRDRDAVDLMFDIGYEFPEITGWARASRADIDKILEVDGLEETGILMSVSDTHIFSKMKLSGREEAEEKYLDALQYAVDHGLRTRAHLEDMTRADNYGFVFPLVEKIIEIDPDCIIRVCDTVGYGMPFVSVDEPYGIPRIVQYLKKEIGAKNIETHIHDDYGFGSASSIAGFWHGANWTSVTFLGIGERAGNSEMEKILLFLRDRVEGFEKYNLEPVTRFARFMEKELGLRVPRNKAVVGKNIFAHESGIHAAGVLKNPFNYEPYPPELVGGKRLLLIGDSSGLEVIRYKIQE

SEQ ID NO: 11281 - protein, 335 aa, Methanosarcina mazei
SKTAAVIKGDGVGPELVDAMLKVTEAAGTDVEFVMCEAGAGWWEKHGGNSLIPNETWDVLDSSDACFKGPTTTPGGIGSPRSVAVSIRSKYNLYANVRPIKTFPNSSAPLGDVEMICVREGTEGLYIGEEIQLTDDVSIAIRKITRTASHKIASYAFEEAKRRGYDAVVPIHKSNILKLTCGSFLEEVEKVGQNYPDIEIWPYHIDNIAQQLIKNPQIFNKKVLLSTNLFMDVISEECSALVGSIGLIYSANIGDSFAMFEPAHGSAPKYAGQDKVNPVATVLAGAWMLDYLDEKEKSEAIFKATKRVISEGKYVTYDLGGNAKLSQMAGEIAKY

SEQ ID NO: 11282 - protein, 376 aa, Methanosarcina mazei
ESVQDRMRQLESRNSYLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVLESVEVDYDQIGGLDEQIQELQEAVELPLIEPERFARIGIDPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGVEARGKILKIHCGKMTLAGDIDFKRLAKATEGMSGADLKAIATEAGMFAVRKNKELIEMEDFLEAVDKV

SEQ ID NO: 11283 - protein, 644 aa, Methanosarcina mazei
MSRPKQMTRAVIVGHKSILKETIDALHDTNLFHVEDFVEDESGFKISKPFKNAEEVSKKLVKIRSIANYLGIESKKPVVQKSDAVLRELDSKLNELDRTISAKTESISQLENELKDMDSQKREVLPYLSIDLDFDYFRGYESLKVFAGTLKNNLEASQISSITQAYELYFDPQSKAVVLFVANNDADKVYELLQGLGFKELRVPERGGVPSELLRSIEQKEADVTRRIESLKGEIESLKTKYADFILASDEVLSIESQKAELPLRIATSENAFIIDGWTPTESYDRLVSVVNNATNGKAYITSLEVREEEEEDAPVEYNNSKSVAPMQQIMDLYSRPKYFEIDPSSAIFITFPLIYGMILGDIGYALILGSIALAIKKAIKSDAVSDMMNILIYCQIWTIFFGLIYGEFLGFPLASTHEEQGLLPFWHTVTLFHSIGGEEFTFPIHRAHMVMSMIVLSVVVGLIHLNLGYLFGFSNIAREHGMKHALLEKGSWMIIELGVLIAAVGYFGGSALMYVGAVVLVLGIVMLAMGEGIAGIVELPSLMGNALSYARIIAVGLSSIYIASTVNDIAFGMVWPDHSKIGFAAIAAIIVFILGHALNTVLSIIAPGLHALRLQYVEFFGKFYEGGGRKFNPFGYIRKYTEE

SEQ ID NO: 11284 - protein, 183 aa, Methanosarcina mazei
MGLEIVVKDIQEGASAEVSRIKAEGDAKASEIINEAKEVQKKTLGDSLAKAEEDLQNLHQQVISSANLEVKRITLNKRKDLLDKVYVQTVEKIKSMPASKKEELLKNILSKYEASGARVYSSKDSEDIVKKLTSLSYAGNLDAIGGIVLENEDGTVRLDFTYDSILKNVYERSLKQISDLLYG

SEQ ID NO: 11285 - protein, 578 aa, Methanosarcina mazei
VEVKGEIYRVSGPVVTVTGLQAKMYDLVKVGDEGLMGEVIQILGPKTIIQVYEETAGIKPGEPCYSTGSSLSVELGPGLLSSIYDGVQRPLHVLLERTGGFIGRGVTADGLDHKKLWEFKPVAKKGDSVKGGDVIGVVQETVNIEHKIMVPPDISGTISDIKSGNFTVVDTICTLTDGTELQMMQKWPVRRPRPVRTKLTPTRPLVTGMRILDGLFPVAKGGTAAIPGPFGSGKTVTQQSLAKWSDTEIVVYIGCGERGNEMADVLSEFPELEDPQTGRPLMERTVLIANTSNMPVAAREASVYTGITIAEYFRDMGLDVSLMADSTSRWAEAMREISSRLEEMPGEEGYPAYLSARLAEFYERAGVAESLCGETGSITVIGAVSPPGGDFSEPVTQNTLRIVKVFWALDAKLSQRRHFPAINWLNSYSLYKDSLNDWFADNVAPDYVPLRERAMEMLQTESELQEIVQLVGSDALPDDQQLLLEITRMLREIFLQQNAFHPVDAYSPFAQQYRILKAIMKWGDAAMEALKSGVPVPEILKLESKNVLAKVKYEEKFDESMNAVLTQMDKEFASLRGR

SEQ ID NO: 11286 - protein, 460 aa, Methanosarcina mazei
MVKEYKTITQIAGPLVFVEKTEPVGYKEIVTINMPDGTTRRGEVLDSSSDIVVIQIFEGTTGLDKECGVVFTGETLKLPASIDLLGRILSGSGEPLDGGPRIVPDQLLDINGAAMNPYARLPPKDFIQTGISTIDGTNTLVRGQKLPIFSASGLPHNEIALQIARQAAVPGSESAFAVVFAAMGITNEEAQYFMSDFEKTGALERAVVFLNLADDPAVERIVTPRMALTAAEYLAYEHGMHVLVILTDITNYAEALRQMGAARNEIPGRRGYPGYMYTDLATLYERAGIVKGAKGSVTQIPILSMPGDDITHPIPDLSGYITEGQIVVSRELHRKGIYPPINVLPSLSRLMNSGIGADKTREDHKAVSDQMYAGYAEGRDLRGLVAIVGKEALSERDVKFLEFADLFEDQFVRQGRNENRTIADTLDIGWKILAHLPENQLGRIDNKYIQKYHPAHRKGQ

SEQ ID NO: 11287 - protein, 205 aa, Methanosarcina mazei
QDVKPTRSELIELKKKIKLSESGHKLLKMKRDGLILEFFKILNEARNVRTELDAAYLNAAEKINLASAVNGMVTVKSTAFTAKESPEIQLSGHNIMGVVVPQISSTGVHKSLVERGYGIVGTNSYIDESADAYEILVEKIITAAELETTMKRLLDEIEKTKRRVNALEFKVIPDLIATMKYIRFTLEEMEREGTSRLKRVKERMK

SEQ ID NO: 11288 - protein, 374 aa, Methanosarcina mazei
MTQYKIPVLPGDGIGPEIIAEGRKVIDAAGERFGFDVEWIEYPQGADHYLETGELISEDTLKELSGYPAIYLGSIGDPRIAPGVLEKGILLTARFYFDEYVNLRPIKLLDGVWTPLKDKTSKDIDFVVVRENTEDFYVGVGGRAKKGASKDLLEVKRTLYSAKFGLDIETDSEEIGYQIGLISKEGTDRVIEYAFDLAENRRKHVSSVDKANVLSDIYGFWREEFNAISAKHPGVTTDFNFVDAVTMWFVKNPEWFDVVVTPNMFGDIITDLGAMIQGGLGLAPGGNINPTGTSMFEPIHGSAPKYKGQNKVNPIATIWAGAMLIEHLGEKEAADTIVNAIQKNILDSKVKTYDMGGKSTTSDVGDDIARIIKG

SEQ ID NO: 11289 - protein, 267 aa, Methanosarcina mazei
VKLLINALKDENSHVRLSAAEALGNIKSETAVQLLINALNDENENVQRGAAEALGNIESETAVQPLINALNDENEDVRRSAVEALGKIKSETAVQPLINALKDEDDDLRWNVAEILGKIKSDTAVKLLINALKDENSHVRLSAAEALGNIKSETAVQLLINALNDENEDVRRSAVEALGKIKSETAVQPLINALNDENEDVRRSAVEALGNIKSETAVQPLINALKDENEYVRRSAVEALGNIKSETAVQPLINALKDEDSDVRREA

SEQ ID NO: 11290 - protein, 1173 aa, Methanosarcina mazei
  unsure (1)..(1173): unsure at all Xaa locations
VYIKEIEFVNFKSFGKKVKIPFYNDFTTISGPNGSGKSNIIDGILFALGLTSSRTLRAEKLTDLIYNGDASKKPDFAQVTIRFDNSDHKLPLELDEIEVSRKVRRTKNGYYSYFYFNGKSVSLGEVHSQLEKAGITPEGYNVVMQGDVTQIISMTSVERRKIIDEIAGVAEFDERKQKALGELEVVKQQIERVDIILEEVRTQLGKLAGERDQALKYQALKTEKVKFEGYLLLSKLKDARAELQNVEKEITGKEEHLEKVQIVLNERTKELQALEETLEKLSVEIRKKGEDEQLQVKREIEETKGEISSLRRXYRAFGSELEEADSRRRKAFVEIDSTKGNVEELKEKIEAENLRKESISSELSERKTERMLLQSRIADVDAKFAATRDELMAARKKLEDAKNEKNELIRTEDRLLDTLRRKSLELREIENQIKDAEAAVATSDSDTLSVRYELEKLSENLESLIRDRDDIESSHFRIKEDIKKLENRLHGLQQEYTITETRVRASEQGRGYSRAVEMIIGAARQEDLFGINGTIAQLGRVERQYSTALEVAAGNRMQAIVVDTDADAAEAIEYLKRRKGGRATFLPLNKLREPRRLENLSYENGVIGYAIDLIQFDSGFEPAFWYVFQDTLVMENLESARRLMGKARMVTLEGELLEKSGAMVGGSISSKSGTSFAAAEKDKLLELAEKIRSLDESRNAAINKQDSIESHLFELSRKIRDCEATISRKESQLDEIAGREAKLAELLEAKQADLKAIEESRTELGTEMDRVTAEKADKEKVVSELEEQISGLEAKLADSPLPEINKKIEFVDEELRRLDGRIRDTEATLNALKLEKEYAEQKIAEAKELIREIDEKKASRMEKVNSLKIKIKECEEKLEEKKAREIELSNELIGLQQEREKVQAEHNAVKRRVSISSTTLEKAKQQVLTLKATKNALLDQEKQFVEEILKRGIEETDEVPNYETVYMRIQAIDEALRRLEPVNMRAIDEYNEVELRLSDLQGKRDTLFTEREQLLERIDQYEHLKRDAFMEAYTSINANFKEIFHELSDGMGELLLDNPDDPFAGGMTLRAQPKEKTLQRIEAMSGGEKSLTALAFIFAIQQYRPAPFYAFDEIDMFLDGWNVERVSRRVKTSGSKVQFIVVSLRKPMIQAASRTIGVTMQENNLTSITGVKL

SEQ ID NO: 11291 - protein, 183 aa, Methanosarcina mazei
MSESSIKIENVVASTKLAEEFDLTVIESKFEGAEYNKQKFPGLVYRVSDPKAAFLVFTSGKVVCTGAKNVADVHTVIGNMAKKLNSIGITTIENPQITVQNIVASADLHTILNLNAIAIGLGLENIEYEPEQFPGLVYRIDDPKVVVLIFSSGKLVVTGGKTPEDCERGVEVVRQQLDNMGLL

SEQ ID NO: 11292 - protein, 155 aa, Methanosarcina mazei
MYYDIIESPIGPILLAGNEKGLKHLDFLKGKKRIEIPADWIENKKFFREAARQLEAYFSGKLESFDLKLAPEGTDFQKSVWKALCEIPYGETRTYKEIAVSIGKPRAYRAVGLANNRNPIAIIIPCHRVIGSDGKLTGYASGLDIKEFLLKLEEN

SEQ ID NO: 11293 - protein, 198 aa, Methanosarcina mazei
MSVVSKYNRIAPIYELIDLPLEYFFFREWRKEALSGLSGKILEVGVGTGRNLKYYPASCRVIGIDKSKRMLRRAQEKAEGRKNITLYPMDAEHLEFPDNSFDYVITTFVLCTIPDPVKALKEMRRVLKPSGELIALEHVHSDYPFVDFIEHLINPVLFILLGDHTTRHTVKNIEKAGFTIKEAKKLAFKDVFRKIRAK

SEQ ID NO: 11294 - protein, 471 aa, Methanosarcina mazei
NILRRGRLEAAQDEEILRYTSSMEADRWIFDADIAVDLAHTVMLKEQGIINREDCSKILSGLLKIREEGMEKLDFSYEDIHISLESRLIDMVGEDVGGRMHSGRSRNDEVATCIRLVLREELTGLLEEIHELRQALLTLAEKHTETLMPGFTHMQHAQPTTLAHHLCAHEAALGRDFDRIQDAYSRVNLCPLGAAAFASTGFNLNRKRTQELLGFDGLLENSMDAVSTRDFLIECASGFTNLMINLSRMAEELVIWSSSEFNFIELDDMYASTSSIMPQKKNPDTAELMRGKTGVAVGALMSLITICKGLPLSYNRDLQEATPNLWRSVETVRASVRIMEGMIKTMKVRPEVLVAQSVTGFTTATELADTFVRETGIPFRTAHQIVGMLAREMEKPTLKKIDSVAEIVLGESLSSRGLKEKMVKEALNPFSNVEIRKIAGGPAPEEMRNYLSKRQTELELNRQEIATLKDI

SEQ ID NO: 11295 - protein, 176 aa, Methanosarcina mazei
MRITVSGLPGSGTTTVSKLLAEYYELELISSGEIFRRIAREKEMSLAEFGAMAEKDPSIDLAIDKNQREVIHSHEKLILESRLAGHMAKEVPNVLKIWIKAPLPVRVKRILRREKSVSFDEELERTVEREKSEALRYMNYYNIDIDDLSIYDIVIDSEKWNQYQILDILKVAIDSL

SEQ ID NO: 11296 - protein, 192 aa, Methanosarcina mazei
KKEVLRGASFAFEKGEIYGLLGRNGSGKTTLFNCINEDLRIDGGSILLEENGVQREICPDDIGYVLSTPVVPEFLTGREFLKFFLDINVKKIPDIKPIDEYFDFVKIESEDRDRLLKDYSHGMKSKMQMLISFIANPSILLLDEPLTSFDVVVADEMKTLLRQIKKDHIIIFSTHIMELALDLCDEIVILSG

SEQ ID NO: 11297 - protein, 505 aa, Methanosarcina mazei
MGEKNSSKVLTTGFGIPVGDDQNSLTAGNRGPVLMQDVHLLDKLSHFDHERIPERVVHAKGAGAGGYFEVTADVTKYTKAKFLSEIGKRTEVFVRFSTVGGEKGSADSARDPRGFAVKFYTEDGNYDLVGNNTPVFFIRDPLKFPDFIHTQKRNPATNCKDPDMFWDFLSLTPESIHQVTILFSDRGTPATYRNMNGYSSHTYKWYNEKGEYFWVQYHFKTDQGIKNLTLEEAEKIGGSDPDHATRDLYEAIKKGDYPSWTLEMQIMTPEQAEDYRFDIRDITKVWPHGDFPTMKIGKLVLNRNPTNYFAEVEQAAFSPANLVPGIGISPDKMLQGRVFSYHDTHIHRLGPNYNLIPVNAPKYSPENSYQRDGFMRVDANGGSGPNYWPNSFGGPSPDSVYLEPPFGVSGLAARTLYTHPNDDFVQAGNLYRDVMTDYDRENLVGNIVSHLSAAQKRIQLRQTALFFKADRDYGSRVAKGLELDIKEVERLANMTNEERARATER

SEQ ID NO: 11298 - protein, 756 aa, Methanosarcina mazei
KTPVAVFYASPKSGKAPLSVKFTDKSTGKPTKWKWDFGDGTSSTEKSPTHKYSKAGKYTVKLTVTNAAGSNTATKSKYIIVTETSQTSTAAFYASPKSGTAPLSVKFTDKSTGKPTKWKWDFGDGTSSTEKSPTHKYSKAGKYTVKLTVTNAAGSNTVTKSKYIIVTAKPVAVFYASPKSGKAPLSVKFTDKSTGKPTKWEWSFGDGTSSTEKNPTHKYSKAGKYTVKLTVTNAAGSNTVTKSKYIIVTETSQTSTAAFYASPKSGTAPLSVKFTDKSTGKPTKWKWDFGDGTSSTEKSPTHKYSKAGKYTVKLTVTNAAGSNTVTKSKYIIVTETSQTSTAVFYASPKSGKAPLSVKFTDKSTGKPTKWKWNFGDGTSSTEKSPTHKYSKAGKYTVKLTVTNAAGSNTVTKSKYIIVTAKPVAVFYASPKSGTAPLSVKFTDKSTGKPTKWEWNLGDGTSSTEKSPTHKYSKAGKYTVKLTVTNAAGSNTVTKSKYIIVTETSQAPVADFWGWPLSGNDPLKVTFTETSKGSPTSWKWDFGDGTSSTEKSPTHTYSAAGTYTVKLIATNAAGSSTKTKWNYVKVSGTLQAPTADFWGWPLSGNDPLKVTFTETSKGSPTSWKWDFGDGTSSTEKSPTHTYSAAGTYTVKLIATNAAGSNTKTKWNYVKVSGTSQAPVTDFWGWPLSGNDPLKVTFTETSKGSPTSWKWDFGDGTSSTEKSPTHTYSTAGTYTVKLIATNAAGSSTKTKWNYVKVT

SEQ ID NO: 11299 - protein, 248 aa, Methanosarcina mazei
VILKLGGSVITDKAANQGVVREDALMRIAKEVSEYRGKMIIVHGAGSFGHTYAKKYELGKVFDPEGAIVTHESVKKLASRVVGALNEYGVRAIAVHPMCCTVCRNGRIESMYLDNIKLMLENGLVPVLHGDVVMDLELKACVLSGDQIVPYLAKELKITRLGLGSAEDGVLDNDGKTVPEITPGTFENFKRYIRGSGSTDVTGGMLGKVQELLELSKTSCITSYIFNARKEDNIYRFLNGESMGTTIS

SEQ ID NO: 11300 - protein, 305 aa, Methanosarcina mazei
  unsure (1)..(305): unsure at all Xaa locations
MISCSAPGKIYLFGEHAVVYGETAIGCAIELRTHVRVELCDSIIIQSEIGRTGIDFEKHPYISAAIEKMREIVPIDGVHLKVNSEIPVGSGLSSSAAVTIASIGALNKMFGCGLSLEEIAKMGHEIEIQVQGTASPTDTYVSTFGGIVTIPDRRTLKTPDCGIVIGDTGVFASTKELVTNVRKLRESYPHLIEPLMVVIGRISKTAEPFFQTGDYSSIGKLMNVNQGILDALGVNTFELSKLIYSSRGAGAFGAKSTGGGGGGCMVALTAPDKCTQVAEAISGSGGKAIITKPTEQGLRLEXITQ

SEQ ID NO: 11301 - protein, 533 aa, Methanosarcina mazei
TVIQYLLDRLKQLGIRDIFGVPGDFAFPINNAICDDKELRWIGCCNELNAAYAADGYARVKGMSALSTTFGVGELSTLCGIAGSYAEYNLVFHIVGMPKMQAQKTHAIVHHSLGAGKSSIFMEMATPVVCASTMLTPENCVQEVERVIETALENHRPVYIAIPHDYVNADISSFNSPARKPVKSDPVALEEVVSIIAGKLLNAKQACVIPGFLVDRFGLKDLSMAVITASGLPYVTMALDKSVLDETNPSYLGLYMGQLINPEIRKFVESCDCILAMGTILSDVNTGKFTANLDKSRIINIMPSSVHIGYTDYINVKMLDVLEELTRRLNKRTDISGPVARRPAVPEVNAEDPITADYLYAKYAEFFKPDDIIIADSSSSFYGLIPLLLPKGAKFESQMLWGAIGWATPASFGTALAAPDRRVILITGEGSHQMTAQEISQFYRHGLKPIIFVLNNHGYLIERMLSEKVDYCYNDLVEWQYYKLPDVFGCNDWITSKVTTCGDLDKVMRELDNAKVGAYIEIITPKLSAPQLM

SEQ ID NO: 11302 - protein, 406 aa, Methanosarcina mazei
SQPCVNIGMVGHVDHGKTTLVKALSSVWTDTHSEEVKRGISIRLGYADSLFMKCPKCPSPQCYTVEKTCPNCGEKTEEHRMVSFVDAPGHETLMATMLSGAAIMDGAVLVIAANEDCPQPQTKEHLMALDIIGIKNIVIVQNKIDLVSKERLLENYRQIKEFVKGTVAENAPIIPISAQQNINIDVLIDTLETVIPTPVHKVDKPASMLIARSFDINRPGASIAEMRGGVIGGTLTEGVLHPGDELEIRPGIKVTTEGVTRWVPIRTTVSSIFAGETKVEEATPGGLLAVGTYLDPTLTKGDSLTGQIAGVPGTLPETRHQFVMELHLLERVVGVTREEKINEIKTSEPLMLNIGTATTVGVVTSARKNEAQVALKRPISAAIGSRVAISRRIDSRWRLIGVGVIK

SEQ ID NO: 11303 - protein, 343 aa, Methanosarcina mazei
MQLPRDVLVGHGVLEEIGDVCRDLKMKGNALIVTGSTTNNIAGKRVSNLLESAGCSAEMVLTCKATKEEVEKVMEKALEVETNFLIGVGSGRSIDLAKLASTRLELPFISVPTAASHDGIASSRASIVDNGRSTSAQAQAPIAVIADTEIISAAPFRFLAAGCGDIISNYTAVLDWELASRLRNEYFGAYAAALSRMAARVIIECADSIKPEHETSARLVVKALVSNGVAMSIAGSSRPASGSEHMFSHALDKIAPKPALHGEQCGVGTIMMMYLHGGNWQEIREALKKIGAPVTAEELGIEDRYIIEALLHAHSIRPERYTILGSGLNPSAAEKVARITKVI

SEQ ID NO: 11304 - protein, 328 aa, Methanosarcina mazei
MSEIRKHYFLSEYCIIAEERAKRPSDFAVADEGSGKHSSKNCFFCGGAEENTPLATAVYKKGKIYSDTPEKRVRNWDFRCFPNLYPALSPVPDSPGQKEKGLQAEPGYGFHEVIVETPLHGRRLEDFSNSEISALMQVYRDRTCSYATRENIRYVSLFKNSGEKAGASINHSHSQLLALPFCPSPLSRELKVIRNIEECPYCAIYDLEKASPRLISKNSEWIAFTPYSSMGPFEVWFLPQKHVSFLGDCSDKLLFALGDILKAILKSYGRILGNPPFNYMFYQLSESPEYHLNLRLLPRISIHAGFELGTGTYINTVPPERAASYLKE

SEQ ID NO: 11305 - protein, 376 aa, Methanosarcina mazei
VPLRKHLLDLKPCRHGGLVQETSETYGIPESEIIDFSANFNPLGNPFEHPESGLNFDEILNTGFKKLTEYPDNRYPEFREAAAKFVGLGVGPKNIIPGNGSTEIIRLVVECVVEKGDTVLLPWPTFGEYEMQCRIMGAELQYPSQDEVETLPDELLEKAKILFICNPNNPTGKLRTRKEIKALAERCTQHKTLLFVDEAFIELSDPSQSVADLTVNNNYVFVMRSLTKDFAIPGIRMGFGIASPEVAEILDTARLSWNLGTVADAVATSLLNIEGGIENPYLKKARDMIREEGEVFKAKLDSIRGFKAGEVNVNFILVDISKFMLDSTELTARMAARGVLIRDCFSLHGLGKDYIRLAVRTAEENDRLITAVGDVI

SEQ ID NO: 11306 - protein, 382 aa, Methanosarcina mazei
SKFVADVVKEIPPSGIRRFFDLVSGLEDVISLGVGEPDFITPWHIREMCIHSLEKGQTSYTSNYGLPELRDELTRTYYRRYGLDYDPSSEILITTGVSEALDIAVRTVVNPGDEVIIVQPSYVAYLPSVVLAGGKPVIVSTHRDDEFSLTAEALKPAITDKTKAIILNFPNNPTGAIMSKEGLEDIADLVVENDLFVISDEVYECLTYEGKHVPLSSLDGMKERTVMLNGFSKAYAMTGLRLGFAMGSPEIIHSMMMIHQYSMLCAPITAQIGAIEALRHGKDEMERMVREYDRRRHFIVRGFNRIGLECCNPKGAFYAFPYVGNTGLSSSEFAERLLDEKKVVAIPGDAFGEAGEGFLRCAYAASINDIRKALDRMEDFVD

SEQ ID NO: 11307 - protein, 526 aa, Methanosarcina mazei
  unsure (1)..(526): unsure at all Xaa locations
LLEIRDLSVDFPAEENTVKAVSHVFFNIREGETFGIIGESGSGNLLLVFPCLRLLPTNAIVSGTVFFHGQDLFSLRPSELRKIRGKHISLMPQNPAGALNPVLKNRLQIEEVFEERGVDKKEGMKKSLRLMKKLLLRNPEKLCDLYPHQLSGGMRQRLIACMSLSFEPELLIADEPTKGLDPEAKEGAVELFTKIKKECGKTMLLITHDLDLALEVCDRIAVMYAGEIVELDEASKVLNAPSHPYTKGLIRAQPRNGLVPLSGQSPSRISLPEGCFFHERAGTRVSSASEYTLKXKNIREDGSGVTSSPXSKRTGNEFWDSRGVQEVSFSVSRGEILGLFGKSGSGKTTIGKCIVGLERPTGGEIRVQGADILNMGKKEFRKLRPKIQMIFQHPETSLDPRMKAFENLIEPLKLHSGLKQDALLKRGEELAELTGLRPEHLARYPVQLSGGEIQRIVLARIMALSPDFIVADEPTSMLDVSVQAQILRLMQKLQRETGVSYLLISHDLEVLRKVCHRIAYLDNGTI

SEQ ID NO: 11308 - protein, 370 aa, Methanosarcina mazei
MKPTRVPNNPCFSSGPCAKHPGYSIEELKDTPFGRSHRSNLGKEKLAEAIKKTRDMLGLPDDYLVGIVPASDTGAFEMCLWSMLGCRGVDVLVWESFSKGWATDITKQLKLKDVRVFEAEYGKLPDLKKVDFKNDVVFVWNGTTSGVKVPNGDWIPENREGLTLCDATSAIFAMDIPYHKLDVITFSWQKVLGGEGAHGMLILSPRAVQRLESYTPAWPLPKIFRLTKGGKLNKKIFEGSTINTPSMLANEDWLATLKWAESVGGLKPLIQRTNDNLAVFEAFVAKNNWIHFLAETKEIRSSTSVCFKVDLSDEKLKELIKTLEKEKVAYDIGSYRDAPSGLRIWCGATVEKEDLQCLCEWIEWAYNLVK

SEQ ID NO: 11309 - protein, 203 aa, Methanosarcina mazei
LKAIIFDVDGVLIDSMNFQAEAWVKTFKEIGINITRKDIYELEGSNNKRLIKSIFEKSGKELEPWYFEKLPEKKREVLEFDRIKPYEGIQDCIKALKRHFKLALVSGSHTDTVNKVVNKYFSKCFDVIITGSDLEHGKPDPDPYLKALEKLDLTKNECMVIENAPLGITAAKRAGLYCVAVTGMLEPEKIEHADLVLENHAAL

SEQ ID NO: 11310 - protein, 447 aa, Methanosarcina mazei
MTKRNYATVNPCVMCQPMGSALAFKGIENTMVLYHGSQGCSTYMRLLLAHHFREPVDIASSSLSEKGAVYGGRENLKKGLRNVINRYNPKVIGVATTCLAETIGDDVPAIIREFKEEQEIGDDPEKDIIIIPVSTPSYGESHVSGYIKALDAVVRKFTEKTEEEKSVKIPNGKLNVIPVESLSPADVRELKEIFDVMAGDYIFLPDISETFDAPLREDLPKIAPGGTPLSEIADMPNSRASLGLGTVSKNLAVKYLEESHGVPGYDVPIPIGLSNTDLFFTELVKIIGCPIPEKYQKERGRLLDAMVDVHKYLYGVKAAVYGDPDFVFSLTTFMLELGINPVLIATGSKSRDFEAKIRQIVEKINPELEPEVLNGIDFDTLNDAVSQCNPEVLIGNSNGRYIAKSRNIPLVRVGLPIHDRVGVQRILNIGYRGAMELLDRITNTILE

SEQ ID NO: 11311 - protein, 456 aa, Methanosarcina mazei
MLDYTPCEEVTREAVTINPAKTCQPIGAVYAALGVHNCMPHSHGSQGCLSYLRMCLSRHYREAALATTSSFSEGTAVFGGAANLKEALVNLTTIYKPEVIAIHTTCVAETIGDDVGVILEDVEAEELIDPSIKICAASTPSYVGTHITGYDNMVKSFVTTFTKKSKPNGKLNIIPGFVEPGDIREIKRILSIMGISSIVFPDTTDVFDAPLTGEPGMYPKGGTPIGDIEDSANSVGTIALCRMAGGSAAKILEGRYKVPAKIGPTPIGIRNTDRFVMNAAKLANVAIPPELEDERGRLVDMMTDAHPHYHGKKVAIYGDPDILTGLTSLVMEMGMEPVVVLTGTKNSEFEKEVEELIGPEYPEADVISGGDMFTLHQIIKRKPVDLLIGNTYGKFISRAEDIPLVRVGFPIMDRANLHYFPIMGYAGAARLVERIGNILLDRKDRDSPDWLLETIE

SEQ ID NO: 11312 - protein, 477 aa, Methanosarcina mazei
  unsure (1)..(477): unsure at all Xaa locations
MQIPDHKTKIVCTIXALLPXSEEVIRKLVLAGMNVARINFSHGSFESHSEVIQRVRKVAEELDRTVAILADLPGPKIRIGKLEKEPIMLHKGNSVTLTVAETTGNETRIPVSYKQLPESVVPGSLIYLSDGFIQLRCLEVSGKDVLCEVLIGGQLYSHKGLNLPGAKILVDSVTGKDLEILGFALSKGIDTFSISFIESAEDIRNVRNFAAARGKSVYIVSKIERRQAVENIQDILKETDALMIARGDLGVEIPIQEVPSVQKELIHSAKLLGIPVITATQMLASMTDNIRPTRAEATDVANAILDGTDAVMLSEETAVGNYPVEAVEMMAKIAKTTEDWRSGTKWGLDAIIKGITARDMSVDEVITLQVHEALQKLPVAAVLTPTRSGATPRRISRFKPDTWILAFSRVPRTCGFLSLSYGVYPITVNENIESWEKETTEKAKDLGFVKSGEIVIFTQGPSSGSPGGTNMLKILTL

SEQ ID NO: 11313 - protein, 304 aa, Methanosarcina mazei
IPSEILTHLRVTREDFENALKDVQPSAIREILIEIPNVSWEDVGGLEGVKQLLKEAVEWPLKSPESYRDIGVEAPKGVLLYGPPGTGKTLLAKAIAHESEANFITAKGSDLLSKWYGESEKRIAEVFSRARQVAPSIIFLDELDSLAPIRGAAIGEPQVTARILNQLLSEMDGLEELRAVVVIGATNRPDIIDPALLRPGRFDELILVPVPDAGARKEIFRVHTAKMSLAEDVDIDKLVSMTDQYTGADIAAVCKKAGRDALREDLHAKEVKQKHFLQAIAETGPSVTPDTMKYYQAVQSGLRK

SEQ ID NO: 11314 - protein, 682 aa, Methanosarcina mazei
MELKYVPTTCPYCGTGCGFNIVVKDGRAAGIEPWHRAPVNAGKLCQKGRYAHEFIHSKDRLVKPLVRENGKLVETSWEEALALIAGKFMTFLPEEIACLSSARTSNEENYLMQKFARAVLKTSNVDHCARLCHSSTVAGLAAVFGSGAMTNSILDIEESKCIFIIGSNTLEQHPLIGRRVMLAKKKGAKIVCADPRCTPTAKQADLHLSMYSGTDVSLLNGLMHHIIENGWEDSVFISKRTKNYEEMRSVVIQEAYSLPNVSKITGVPENDLKTAAEWIAQSKPSALIYSMGITQHTVGVDNVRSTANLMLLTGNLGVAGGGVNPLRGQNNVQGACDMGCLPDVYPGYQKVADPENHRKMESIWGVSGLPKAPGLTVTELMEQLAEGTSTVKCMYVMGENFMLSDPDLNKVRKAMKQLDFLVVQDIFLSETANLADVVLPAACYAEKNGTQTNTERRVQRIRKAVDPPGDAKADWRIICELAGCMGYGPQFSYMNEAEIFEEIAKVTPQYGGMSYERLEKPDSLQWPCPDKTHLGTPILHTEKFSTSDGLAEFSGIEWKPPAEVPDVEYPFILTTGRNIWHWHTGTMTRRSKTLASEVRTGWVELHPEDAKKLGIRNRETVRVLSRRGKIEIPSMVTEDIKPGVVFIPFHFKECAANLLTNGALDPVAKIPEYKACAVKIEK

SEQ ID NO: 11315 - protein, 414 aa, Methanosarcina mazei
KIQNPRSPEIMDNRTARFLKTRFQKYYKNAEIGLPDHLPNREWAFIFFDSMPDKMMHRHKAFGSPGEALDYLYGMAPAHVYNSTAYYEYPDARKMNEKNWLGAELIFDLDADHLPDAPKNYADMLELVKKETFKLMDFLLEDFGFSEQEIELVFSGGRGYHFHVRSPKVLKLGSAERREIVNYLSGRDLDFKYFFREVAMDGEFGTGSKTFKGMKNVPFKCTLVGYDSGWGRRIALYLTDYMKAECGKRYKKDMFPELRRYEKVGDTTIKKLISLTNSENGLKDILEKGRLDFDVRNFKDIAAYFMRESVEDFLHRFGTSVDEPVTADIKRLIRVPGSLHGGSGMLVKKLALSELEKFDPLTDAVVFGERPVKVTVLKPFSVQLKGKDLRVEEGIQEVPEYAAVYLICRGVAEY

SEQ ID NO: 11316 - protein, 321 aa, Methanosarcina mazei
EIWIEKYRPVRLDQVAGQEETIERLKSYVATKNLPHLLFSGPPGVGKTASAVSIAREIFGEDLWRENFTELNASDERGIDVVRTKIKNFAKTAPMGGAEFKIIFLDEADALTSDAQSALRRTMERFSNNCRFILSCNYSSRIIEPIQSRCAVFRFRRLSDEAIRKRLEYIAKDQVLSITEDGYEALVYVSQGDMRKAVNSLQAAAFVEPNKSISRGTIYRTTATANPEDIRNLIETALRGNFRVARKELNRLLYEEGLSGEDIVGQIYRAISEMDNRMILDLGLSEKRIVELVDIIGEIDFRLTEGATEKIQLEALLAHFA

SEQ ID NO: 11317 - protein, 574 aa, Methanosarcina mazei
VKITETILRDAHQSLLATRMRTRDMLEVVEQLDQIGYFSLEMWGGATFDSCIRYLNEDPWQRLRDIKKEMKDTYAQMLLRGQNLVGYRHYSDDVVEKFVTKSYQNGIDIFRIFDAVNDVRNMEFSIKVAKGLGAHVQGYGFCLTPIKSPVHTVEKYVELAKQLEELECDSICIKDMAGLLSPNDATRIISAMKKEISIPISLHCHCTSGMAPMSYMAACEAGVDILDTALSPLAWGTSQPPTETVIAALKDTPYDTGLDLNAFEGVVKYFKMLKEKYRGILDPISEQIDTNVLIYQIPGGMLSNLVSQLKEQNALDKYDTVLGEMPRVREELGYPPLVTPTSQIVGTQAVLNVLMGERYKVIPKEVKDYVRGLYGRPPAPISPEIIGKIIGDEEPIHCRPADLLKPEYEKRKKEAEEMGIAKSEEDILTYILYPAIAPKFLKGEMEEESLAVVAPVPEVQQEHKVPTHFKVEVDEEIYEVRIEPLGGEVSISEASPKKSSAKSVKGAVCVSMQGMVLSLKVKVEDTVAEGDTIAVIEAMKMENAVHASHSGVVREIFVSEGDTVSPGDIIMSIE

SEQ ID NO: 11318 - protein, 485 aa, Methanosarcina mazei
MFKKVLIANRGEIAIRVMRACRELGISTVAVCSEADKNALFAKYADEAYLIGPAPSSQSYLNMEAILAVAKNTGAEAIHPGYGFLSENPVFAKRCEEEGIVFIGPPSHVIAEMGSKIRARNLMVKAGVPVVPGTKDAVEDPVEAVKIAEEIGYPVLIKASAGGGGIGMKVVNSSDEFATALSSTRQMAGSAFGDSSVFIEKYVEEPRHIEIQILADGYGNTIYLSDRECSIQRRHQKLIEEAPSPIMTPELRAKMGEAAVRVAKTIGYVNAGTVEFLYSKGNFYFLEVNTRLQVEHGITEMVTGIDIVREQLRIAWGKKLEFKQEDIVIDGHSIECRINAEDPLNDFAPSPGKIRGYRSAGGPGVRVDSGVHTGYTISPYYDSMISKLCVWAKTRDAAIARMERALYEYVVVGVKTNIPFHKAVMRNPVFRRGDLTTAFIEDNNIMEAVEEVVKADAEKGATLASALEAKDKKVAAITAAVHAYV

SEQ ID NO: 11319 - protein, 283 aa, Methanosarcina mazei
KVNELRSKIEKSERQLASIFKELKINRTDIDELKEKRDSLNHQVKERVAKAQELRDKRDEINKEIREYKGKRSDVNSKTQELFSGIAGLKEQRDKYNKCSHGSVESLTKAYEAELDAFFNKELPLAVEIKIFQKLNDLNKRLQAAKKANALHTQIQESYKESKGIHKRGDELHEKIQALSDESQTCHLEMLENFKSADEIRKEANTYHAQLTDKITNINSIKEKIDPLKTSIANNRKELSSYLDRLKDLQLTKEEHKVNQKHSDAREKLQKNARMSLEDLKLL

SEQ ID NO: 11320 - protein, 208 aa, Methanosarcina mazei
  unsure (1)..(208): unsure at all Xaa locations
RRYLVDNLEAYLLLKDNVREAMLRVPRHKFVPEYEQKAAYMDRPLDIGHGQTISAPHMVAMMCELLELSEGHKVLEIGTGSGYNAAVMGELVGKSGHVYTVERIEVLANFARENLKKAGYNNVTVLLEDGSMGYSXYAPYDRIAVTCAAPYIPEPLLEQLKPGGIMLIPVGDYFQELYKIKKDSKGRIHKKKKGEVIFVPLIGKHGFR

SEQ ID NO: 11321 - protein, 273 aa, Methanosarcina mazei
MLTKRIIPCLDVTLDRAGGCVVKGVEFVDLKEAGDPVELAKRYNEEGADELVFLDITASAQGRKTMIDVIERTADEVFIPLTIGGGINSIDAIRQILRAGADKVSVNTSAVKNPDFIKESSDIFGAQCIVTAIDCRRNTDIKNNPDKTILELEDGTPAWYEVVIYGGREATGIDAVQWARKAEELGSGEILLTSMDRDGTCAGYDLPITKKLSEELDIPIIASGGVGNPQHIYEGFSIGKADAALAASIFHFREYSIKEVKEYLRDREIPVRL

SEQ ID NO: 11322 - protein, 841 aa, Methanosarcina mazei
MTPAMCQYYEAKQAYPDTLIFFRMGDFYESFGEDAKTIAKELEITLTARGKDKSGERMPLAGIPYHAIDTYLPRLINKGYKVAICEQLEDPKKAKGIVKRGVVRVVTPGTAIDSSMFSDASNNYLMAVAGREIGKPGKNAENEFEIGVSFLDISTGEFLTTQFRDSENFEKLLSELARMRPSECILPSSLYENPALAERLRAQTIVQEFAPDISGAKEAGERLKNHFRVATLEGMGCENLDFAVYSAWAALEYAQTTQMRELTHINTLRTYSNSEFMILDSVTLRNLEIVKNVRDEGDENSLYRILNHTKTPMGSRALKKWLLKPLLSVEKINYRLDAVEELTAKPLLRYDLRNWLSDVRDIERLVGRVVYGNSNARDLVALKKSLEALPPVRDSLLENIESTILNDIAVGLASFSELENLAEMIDRAIVDEPPISVREGGMIKSGYNAELDELKDIASNSRQWIANFQQKERERSGIKSLKVGYNKIFGYYIEVTNANSSQVPEDYIRKQTMANAERFFTPELKEKESLILTANEKAIALEYEIFTEILQTLSAHSRELQETAERIGTLDVLTDLAEVAENNNYIRPQLTDDCKILIRDGRHPVVENTVHGGFVPNDTEMDCKENQFLLVTGPNMAGKSTYMRQTALIAIMAQVGSFVPASYASIGIIDQVFTRIGAFDDLASGQSTFMVEMVELANILNNASPRSLVLLDEIGRGTSTYDGYSIAKAVVEFLHNRGKVGVRALFATHYHQLTALEEKLKRVKNYHVAVKEEGHELVFLRKIVPGATDRSYGIQVARLAGVPEKVIERANEILKELERENVLEEVEDSKNGKKRKSKATA

SEQ ID NO: 11323 - protein, 667 aa, Methanosarcina mazei
NKIAAGEVIERPASVVKELIDNSIDAGATDIRIEVEKGGKRSILVRDNGCGMDREDALLAYKKHATSKLTRIEDLNTISTMGFRGEALSSITAVAKVEILTRPPEEITGTRIVIHGGKVLETSAAGTTPGTSVNVKDLFYNIPARQKYLKSDRTELAHITDTVMQLALANPHISFTLLSEEKPVIRNAGSSESFKSIVNLLGPDTARSMLPLEYRTEDFEIFGYISKPETTRRESDQIFLFVNTRPVTSRSINKAIREGYYTKIPKERYPVAVLSLIVNPGEVDVNVHPRKAEVRFSREKELGDAVTSAIEKVLSENALAPEIREKRDRVFQKTFDVSGSPGRLQVSEAAEIFGRKEIGKDTRIPKTGILETGLPERSKVMRNKAETYVYPVKDTERRLKRSERLLDFTTEGETQETGDKKLDNKIEQEREKEGERKKRITGIQENGIEKAGSEEQKFEGINAEKMQKSIQKPNTDSFENLRIIGQVSKLYILAERGEDLVLIDQHAAHERILYEQVLKMKKSRVQELITPVTIDLTPKEKVLMEEYIPYLEDFGFGISEFGDNTYVVTFVPEVFGRLEDPEVIHDIVSDLLASGKVKKDTGISEKICKTLACRAAIKGGAACSPRQMEELIEQLKKAENPYSCPHGRPTVITFTKGELDRMFARIQ

SEQ ID NO: 11324 - protein, 340 aa, Methanosarcina mazei
  unsure (1)..(340): unsure at all Xaa locations
DLWTLKYRAGTLKEMLGNEHAVATLSELAQSGTLPHLIFYGPENSGKTTAALALARQLYGRTWKNNFAYFNASDFFDQGKRYLVRDKRFVRFLGTDDPKKIYKSVIDIFKEIINEYAGIASLDADYKLIYIDNAESLNSDAQHALRRIMEKYSATCRFILSTTKPSKLIAPLRSRGLQIFFTYVPDSVLKTHLKKIGCAEKLQLSEGAFDAILYSAKGNVAKAVQTLQLASLVAHGSVITEEMVYEATLGRDENIDNLLSAALAGDFPRGRKLLDEMIVGKGLLGVEILEGLSEALADSGETDTDIARIIVKISEVDARLKDAANEKIQLEKLISSLSXF

SEQ ID NO: 11325 - protein, 294 aa, Methanosarcina mazei
IMELKRENVLIEALPYMQEFYDSIMVIKVGGNAMVSAQIMEDIIKDIVLLRYVGIKPVIVHGGGPEITEKMGRMGKKAEFFQGLRITDDETMEIAKMVLVGNINTKIVSLIGVCGGKGIGLTGYDGRMILGHKQAAKKVLINGIETEVDIGWVGECEVINPDILHIVLENGYIPVISPIAVDAKGNALNINADIVAGDIAAALHAKKLILMTDVSGLLRDMNDPNSHISRVTLEDIDHLIAEGVIQGGMIPKLKGAAVAVKNGVEKAHIINGSVSHSMLLELFTDRGIGTMVYK

SEQ ID NO: 11326 - protein, 422 aa, Methanosarcina mazei
MAADKPHMNLAVIGHIDHGKSTFVGRLMYDAGAVPAHVIEKYKEEAKQKGKESFAFAWVMDSLKEERERGITIDIAHKRFDTDKYYFTVVDCPGHRDFVKNMITGASQADAAVLVVAAPDGVMAQTKEHIFLSRTLGINQLIVAINKMDAVEYSEKRYKEVVEQVSGILKMIGFKPGDIPFVPTSAFYGDNVVNHSEKTPWYKGVTMMEALNNLKVPEKPSTLPLRIPVEDAYTISGIGTVPVGRVETGTMKKGDKVVFMPGGAAGEVKSIEMHHEEIPQALPGDNIGWNVRGIGKADVRRGDVCGHTDNPPKVADTFVGQIVVLQHPSAITAGYTPVFHAHTSQIACQLIELNKKLDPKSGQVKEENPTFLKAGDAAIVTIKPTKPMVIEPVKEIPQLGRFAIRDMGMTIAAGMCMSVKQK

SEQ ID NO: 11327 - protein, 1147 aa, Methanosarcina mazei
  unsure (1)..(1147): unsure at all Xaa locations
AYFTRDKIVQHHIDSFNKFIDYGLQKIIDEQKIIETDIEDTYLKLGKIRVEHPVVKEADGAIEKLYPNEARLRNLSYSGPLYLEMSVVKEGIESEPMEAKIGQLPIMVKSKICNLPGLSETEKVRYGEDPLDPGGYFIIGGTERVVMTLEDLAPNKILVEYGERYGDTIEVAKVFSQKRGYRALVIVERGRKSLLEVSFPSISGRVFFITLMRALGIVTDEDIVNAVSSDPEIIKFMLENLEEAEVETQDEAIEKIGARVAAGQAKEYQIKRANYVIDRYLFPHLGNDMKDRISKAHFLARMAESCFELALGKRSEDDKDHYANKRLKLAGDLMEDLFRVSFNRLARDIKYQLERANMRNRELNVATIVRADVLTDRLQHPLATGNWVGGRTGVSQLLDRNDYISTLSHLRRVISPLSRAQPHFEARDLHATQWGRLCPSETPEGPNCGLVKNFAEMVELSTGIEDIDGIKKILHDLNVERVVVKVPELPSKMKETLLDEFGEEIVEEYEEPSESESKFKDDEFYDYSDMDDSGSMFGDXGGDVRXLKAKVFINGELVGTHDNPAELVDELRKMRRQGFISRQVNVALNSNTREVIINSDMGRARRPLIVVENGAPRVTEEHVEKIKNKEITFDDLVKEGCIEYLDAEEEENAYIALYEADLNSKHTHMEIDPELILGISTGMVPYPEHNASPRNTMGAAMIKQCIGVATANQKLRPDTRAHVLHYPQRAMTRTRTSEAIGFDDRPAGQNFVVAILSYEGYNIEDALIFNKGSIERGLGRSHFLRTFEGEERRYPGGQEDKFEIPDSEYRGARSAEAYANLDTDGLVNPETPVGPNDVLIGKTSPPRFLEEPSDFGISVEQRRESSITMRSNETGIVDTVILTESINGTRLAKVKVRDERIPDIGDKFASRHGQKGVIGLKVPIADMPFTESGLTPDLMINPHAIPSRMTVGHVLEMIGGKVGSMEGRRVNATAFSGENEEDLREALKRHGFAHTGKEVFYDGATGKMIPADVFVGVILYQKLHHMVTSKMHARSRGPVQVLTRQPTEGRAREGGLRFGEMERDVLVGHGAAMSLKERLLDESDKVVELVCSHCGMIATYDKQRNVAFCSTCGADTDIYPVEMSYAFKLLLDEIKSLGVAPRLKLED

SEQ ID NO: 11328 - protein, 913 aa, Methanosarcina mazei
EFLQKLNVDENGLSEQEATSRLKECGDNVLEETGKESIINKYLRQFRNLFSILLTVGSILSFVGEYLDPGQGNLYIGIALAGVVIINGTFTFIQEYQAEKTMESFRQLLPPHARVLREGKVKDILASELVVGDVILLEEGDKVPADGRLVEINTLKVDNSAITGESEPQLRSLECTHPNMLECRNMVFSGTLIQSGNGKAVTFATGQNTQIGSLATLTQQTSGVDTPIRREINYFIKVISTIAISLGIVFFILAFLLQDVFLASLIFAIGIIVANVPEGLLPTVTLALSLASKRMASRNALIKQLESVETLGSTTVICTDKTGTLTQNKMAVNSIMIGFECLVIENPASTKKTTTEQDIIESTNKADMEKLTDSRTEGFCALKKPIWDPEKLPSVFIRVAGLCNNAKLRESAPGYTGDPTEGALLVFANGLEDIGKLKNDYPRLEEFPFDSLTKRMEVICRTPEGKLEVYLKGAPEVVVKMCSSSLDSRGIRKLDETEQQKLLDRHLGLAKKGERIIALAYRQIEDINEYTGDFIFLGFIGIVDPPRPEAREAIAKCHTAGIKVVMITGDHPVTAESIAKDVGLANSGNLEIITGNELATLSRADLASRLKNPSIVFARTSPVQKLKIVQLFQAEGEIVTMTGDGVNDAPAIKNADMGVAMGSGTDVAREAADMVLLDDNFATIVNAVEEGRTVFDNIKKFIAYILASNIPEILPFIAFVLFALPLPMPVQLILAIDLGTDMLPAIALGKEKGEGDIMKRPPRAREEKLLTPPLLFTAYAVKGPVEAIAGFFCYFAVLFEGGWSFGEQLANNNPLYMQSITAFFSAVIICQIANVFASRTRYQSVFSMGLFSNRTVLVGIASELLILAFIIWNPSANLIFNTSPLDLRYLLIAVPFAILLLGIDELRKYLLRR

SEQ ID NO: 11329 - protein, 339 aa, Methanosarcina mazei
MSEFTLKTRLLAALEGKPVDKVPVCSVTQTGIVELMDKVGAAWPEAHTNPELMAKLAIANYELSGLEAVRLPYCLTVLGEAMGCEINMGTKNRQPSVTASPYPKNLDGAVVPADLLQRNRIPAVLEAIKIVREKVGPDVPIIGGMEGPVTLASDLISVKSFMKWSIKKTDLFEQALDISAEAAIAYANAMVEAGADVIAIADPVASPDLMSPETFKQFLQSRLQKFSAGVNSVTVLHICGKVNAILSDMADCGFEGLSVEEKIGTAAEGKKIIGDRARLVGNISSPFTLLPGPIDKIKAEAKVALEGGIDVLAPGCGIAPMTPLENVKALVAARDEYYA

SEQ ID NO: 11330 - protein, 183 aa, Methanosarcina mazei
EYTITVENVVASTTLAEDFDLQKIESPDLSKAEYNKAKFPGLVYRTENPKAAFLIFTSGKVVCTGAKTVDNAKMAIINLASTLKSIGCEKINPEPDVHIQNIVATADLETNLNLNTIVIAFGMENVEYEPEVFPGLVYRLEDPRVVVLIFSSGKLVITGGKSPEDCEEGLRVIKKEFDNLGLL

SEQ ID NO: 11331 - protein, 456 aa, Methanosarcina mazei
RKESDSLGEVEVPADHYWGAQTQRSLIHFSIGDDYMPKEVYYAYGYVKKASALVNEAAGIIPPWKAELIARVADEVIAGKLDSEFPLYVWQTGSGTQSNMNVNEVISNRAIQLVGGSLGSKYPVHPNDDVNMSQSSNDTFPTAMHIATVLEFSNRLIPAATALEESIWAKAREWVDIIKIGRTHLQDATPLTVGQEWSGYATQLNDALAFVKQSLQGLYRLAIGGTAVGTGINTPPDFGEKVAGEISRLTGHPFVTAPNKFAAQGSLDAMVNSSAALRALAVALMKIANDLRWLGSGPRSGIHELILPSNEPGSAIMPGKVNPTQEEAMLMVCIQVIGEDNAVAFAGLQGNFELNAMCPIIINNVLHSARILGDACVKFCEYGIKEIMLDRSRIDKFVDDSLMLVTALSPVIGYDKASAITQRALDENTTLREAAVKGGFISAKDFDRIVDPKKMV

SEQ ID NO: 11332 - protein, 873 aa, Methanosarcina mazei
KFVYFFGKDVTDGKASMRDLLGGKGAGLAEMANLGIPVPPGFTITTEVCVLYLKGKKYSEEVLKQVEEAIDKLETLNNKKLGDPEDPLLVSVRSGARVSMPGMMDTVLNLGLTDKSVLGLANKVNDERFAYDCYRRFISMFGDVVLGIDFDKFESLIEDKKKELKVESDTDLDAKALKDLAERFKGVIKLEKGFEFPQDPKVQLQMAIDAVFDSWNNPRAITYRKLNEIDDSWGTAVNVQTMVYGNRGNTSGTGVAFTRNPSTGERKFFGEYLINAQGEDVVAGIRTPDFIDTLGNKIPEAYNQLVDICRKLEAHFKDMQDIEFTIQEGKLYMLQTRTGKRTAAAAVKLATDMVAEGLIDKETAVTRVKAEHIDLLLHPRIDPNAKLEVVAKGLPASPGAAVGKVVFTAEVAEEMAEKGEKTILVRTETSPEDIGGMAAAQGVITVRGGMTSHAAVVGRGMGKPCVVGCGDISIDTKSNLFMVNGYTVKEHDYVTIDGSTGSVIIGKVELIDAEINEDLKKILQWADEIRTLGVRTNADNPADAGLARELGAEGIGLCRTEHMFLGEERIPVVREMIMAEDEKSRRKALKKLLPMQKEDFLGIFRSMEGLPVTIRLLDPPLHEFLPDKEELDAKLRELEASGDSSGKINEVKKVIQRVVSLKEINPMLGHRGCRLGITYPEIYDMQVRAIMEAACELTNEGMKITPEIMIPLVGLVKELAITREEVCKMAEAVMAEKGVKIDYKVGTMIELPRAAIVADQIAQEADFFSFGTNDLTQTTFGFSRDDVSKFVPIYQKAGIIEHDPFAVLDQEGVGEIMKIGISKGRSVKPDLKMGICGEHGGEPRSIHFAYDIGLNYVSCSPYRVPIARLVAAQ

SEQ ID NO: 11333 - protein, 324 aa, Methanosarcina mazei
EREKIRAMIKARKEKQKEQSFEKEKAVCPECGSRNLVHDYERAELVCGDCGLVIDADFVDEGPEWRAFDHDQRMKRSRVGAPMTYTIHDKGLSTMIDWRNRDSYGKSISSKNRAQLYRLRKWQRRIRVSNATERNLAFALSELDRMASALGLPRTVRETAAVVYRKAVDKNLIRGRSIEGVAAAALYAACRQCSVPRTLDEIEEVSRVSRKEIGRTYRFISRELALKLMPTSPIDYVPRFCSGLNLKGEVQSKSVEILRQASEKELTSGRGPTGVAAAAIYIASILCGERRTQREVADVAGVTEVTIRNRYKELAEELDIEIIL

SEQ ID NO: 11334 - protein, 703 aa, Methanosarcina mazei
MRYFTKQSCYPNQAEAMEKIHSALLNEKTVLFEGACGTGKTLSALAPALSVGKKLNKVVIIVTNVHQQMVQFINEAREISRDNDIKTIVFKGKASMCPKNLDYEECRLKGENTYDLLDLEREISSKEKELKDAYEKYKRTKDPALYSLRTELEKELEETKKKSRALRNNSCLELYEVLKFEGNEFSNWLFSDVRSPEEILEYAEDRDMCGYELLKKELKNAELLICNFHHVLSAEIFMMLLKWLERDPEDVILIFDEAHNIEASARSHSSTMLSELTIEKALSEVGETPESDNSLMLGKETDSGGGIPLDQDYAARLYAKKLFTCLLTALRDTYAAKLKFGERNRLGKHWQDIKISDPYERFDILKARFLREAMKEGFADEEKVLTRLREIGEFGGRLEEIYAENYKKGLLAVPKRSQIRYVADFLSSYLVLSDRQNYYPILNVRRDFKSDRIAGRIELFTCIPKNVTQPLFDSIYAAVLMSATLRPFEMIKSTLGISREVEEISYSTTFPRERRLTLAVSIPPLFAKNRDSPETLESIKEALLAATVASPGNVIIYFQSYAEALRYTKLLEPELSIPIFLDETGVSAQEIRKKFFKIGEQGGKALLITYLWGTLSEGVDFRDSRGRTVIIVGIGYPALNDRIKAVESAYDEVFGCGEGWEFAVQVPTIRKVRQAMGRIVRSPDDYGVRILLDSRYQGSQVRK

SEQ ID NO: 11335 - protein, 319 aa, Methanosarcina mazei
  unsure (1)..(319): unsure at all Xaa locations
DVATTLNNLAGLYYHMGAYDKALPLYQRALEIYKEVPESEHPDVANSLNNLAELYRRMGAYDKALPLYQRALGIRENILGSQHLDVANSLNNFAVLYESMGEYDKALPLYQRALGIRENVLGFQHPSVATTLDNLAVLYYRMGAYDKALPLYQRALEIYEKVLGSDHPDVATTLNNLAELYHHTGAYEKSLPLFQRALEIVEKTLGPEHPDVATILNNLAGLHESMGEYNKALPLYQRALDTREKVLDPQHPSVATTLNNLAGLYRQMGEYEKALPLSQRALEIIEKKLEPKHPNTVTIKNNYNFLLQRXVKEMKKNDF

SEQ ID NO: 11336 - protein, 427 aa, Methanosarcina mazei
MKISVIGSGYVGSVTAACFAEVGHEVVCVDIDKKKMDQINSGIPPIYEEGLGELLQKYAGKSLTATTDYEFAIKNTDISFICVGTPSAEDGSIDLSIVRAATASIGAVLAKKEGYHVVVVKSTVVPETTEKFVLPILEETSGKIAGKNFGVAMNPEFLREGKAVYDFMHPDKIVVGAIDQKSGDLVSELYRTFKCEVTRTSLSTAEMIKYANNSLLATKISFANEIGNICKRLNVDTYEVMKAVGKDSRISPKFLNSGAGFGGSCFPKDVKALIGKAKEIGYSPVLLESVIGVNEKQPILMTEILQKKIGSLEGKKVAVLGLAFKNDTDDIRESRSIPIIAELLRLGAEVSAYDPMAIENMKRIFPTIEYSGKAKDALEGADACLVMTEWSEFKQLDSEFEVMKEKIVVDGRRIIKAKNIDYEGLCW

SEQ ID NO: 11337 - protein, 287 aa, Methanosarcina mazei
VKKALIPAAGLGTRFLPATKSMPKEMLPIIDTPVIQYVVEEAIASGIEDIIIITGRGKRAIEDYFDDSPELEMHLAKKHNTELLKLVRNVSSLVDIHYIRQKEPNGLGDAVLRAENHIGDEPFAVLLGDDIIVNNKPCTAQLIDNFEKYGRSTLAVEEVPREKLSSYGIIKGKPLSNSLYVLEDIVEKPSPENAPSNMGAIGRYVFTPEIFDCIKEAGTGVGNEIQLTDGIRVLNRSQMIYACRFKGKRFDTGDRLGYVKSIVDFALENENLREDVLEYLREILAEV

SEQ ID NO: 11338 - protein, 453 aa, Methanosarcina mazei
KIGVLGMGYVGIPSAVLFADAPCFNKVLGFQRNSKSSSYKIGMLNRGESPLKGEEPGLEDLINKVVNAGKFECTPDFSRISELDAVTLAIQTPFANPKDLEPDFSALIEGIRNVGKYLKPGMLVVLESTITPGTTEGMAKQILEEESGLKAGEDFALAHAPERVMVGRLLKNIREHDRIVGGINEASTRRAIELYSPVLTVGKVIPMSATAAEVTKTAENTFRDLQIAAINQLALYCEAMGINVYDVRTGVDSLKGEGITRAILWPGAGVGGHCLTKDTYHLERGVKIGNGQLDYPESADSIYVLARKVNDFMPVHMYNLTVAALKRVGKEMKGSNIAMLGWAFIRDSDDARNTPSEPYRDLCLKAGATVNVHDPYVVNYPGIEISDNLENVIRDVDAVVIFAGHSAYSDIKADWVKKITGKEKPVIVDGRNVIEPDEFISEGFVYKGIGRGD

SEQ ID NO: 11339 - protein, 290 aa, Methanosarcina mazei
MFEGAMPALITPFTKDDRIDREGLQRNIEFVEEGGVAGIVPCGTTGESATLSALEHEEVIDIAVECSKVPVIAGTGSNNTGEALQFTKHAADAGVDGVLLISPYYNKPNPAGLLTHFKKIAEAVDVPMVMYNIPSRTGQDMPLEVIVELAKVENIVGIKEASGNIGKVSQILENTIDEDFVVISGEDNLTLPILSVGGQGVISVAANIVPDRMSRMVNAALAGDYETARKIHFEIAPLIRALFLETNPIPVKKAAELAGLASGNLRLPLAPLSETNTQKVADELRKLGVI

SEQ ID NO: 11340 - protein, 265 aa, Methanosarcina mazei
  unsure (1)..(265): unsure at all Xaa locations
MINVAVLGACGRMGSLIVENVINSKDMQLVAAFDISYFGRDAGEFARVGKLGVQISDVKNLETVLKESKADVLIDFTAAGATVVNAPIAARAGVNLIIGTTGLTPEQRAVIDEAIQEGQVSAVISPNYSVGVNVFFKIIREAAKYLADYDIEIIEAHHNQKKDAPSGTALRAADIISEAVGGREYVYGREGIAPRGKEIGIHGVRAGDITGDHIVLFAGNSERIEIKHIAHSRQIFAKGAVRAAEWVCRQKPGIYSMDDVLGLXE

SEQ ID NO: 11341 - protein, 283 aa, Methanosarcina mazei
SELLILKPEGYPLSGMMDEYPVIENRDVFEFYAREQWNGYVARKGDYLFDRRMFPDFAYRIIDVEPAESIIGSSTSIIVTEEENGLPSSAEIKSSVKFEDVIGQELAKQKCRLIERFLEEPERFGKWAPRNILFFGPSGTGKTMLAKALANKTDVLIIPVKATQLIGEYVGEGARQIHQLYDRAEEMAPCIIFIDELDAIALDRKFQELRGDVSEIVNALLTEMDGIVERDGVCTICSTNRIYSLDSAIRSRFEEEIEFILPREEEIVEIFESNVKTFPLQVE

SEQ ID NO: 11342 - protein, 847 aa, Methanosarcina mazei
IRLFGREVDGKSVCCFVPDFEPYFYLKASGDLNAVARLIEETFTQVKKVEIVEKFEPIGYQKTKIKMLRVTTHLPREVPEIRDEILKLQEVLKAEGKWEVYETDILFRNRFLIDKDLGGMVWVSAEGEAVDPAKYLRTNGSGSSRCGKFTCDASILASGLNKVENLTLAPLKYLAFDIECLPLDGGMPSPEVSPIIMISFSFEPEYKGHKTLVLLAKPVENLNSDVWSYTDETEMLNKFFEIFCDYDPDIVIGYNHQDFDIPYITDRVKTLVSEGNSINPVVGRDGSKIGYRKFGLITRTEMKGRVVVDALPLVRRAFSLKQYTLRAVSKELLSREKLDVPPLEMEEYWLDTGEKFKKFVDYSRRDAELALELILNLRLLDKYVALAQVSGSLLQEVVDGGQTSMVETLLLKEFGLRDRVLLPKPDDGVSAERYAMSSDLKGGEVLEPKKGLLENVLILDYKSLYPTIMMAHNLCYTTVVTGDKSDGVTIRPPSGGEFVPSEVFKGIVPSILEDLLNKRTQTKKRMRGTSNENEYRVLDATQLALKILLNSFYGYSGYARARLYSLTLANAVTSFGRSNILNTREIINNTIGKIILRNKTALLLDEAGELSPQDRVVELSVAYGDTDSVFVHCKSRGDLSLEEVSLIGNRLANIVSVSLPDPMELEFESIAKRALLIAKKRYALWFFEPKNSGWEDKIKVKGMETVRRDWCELTSVTLNRVLELVLIKGDVDQAVEYVRQIVSKVRNLDPAKDSEIIESLVLTRTLTRKIESYKNKQPHLTVAENLKKRTGVVPSIGTRIPFVITAGKGLFVDRAEDPDYVREKNIPIDVDYYIKKQILPPVERILE

SEQ ID NO: 11343 - protein, 385 aa, Methanosarcina mazei
  unsure (1)..(385): unsure at all Xaa locations
NMYVPTRTLFGAGQLNNLHTQKMPGKKAMIVISNGKSARENGYLARTEKQLKLVGIETVVFDKVQPNPLKSTVIAGAAFAKEHGCDFIVALGGGSCMDAVKAIAIMATNDGDYWDYVFGGTGRGKQMEHKPLSVITITTTAGTGSETDPWAVVTHEENHEKIGYGSDYLFPVLAVVDPELMISVPPEFTAYQGFDALFHSIEGYVSNGVNLMSDMYAITAIENISKNLAKAVKNGNDLDAREKVAFGNTLSGVVECVGSCTSQHSLEHAMSAYHQELPQGAGLIMLSKAYFTHLIEKHVCDNRFVQMAQITXMKDAKEPMDFITMLVKLQEDCRVADLRMSYYGITPEEFETLAKNAKDTVGGLFLCDRTELSMEDCIAIYKTSY

SEQ ID NO: 11344 - protein, 242 aa, Methanosarcina mazei
GKVVFITGGATGIGQATAVAFAREGANVALTYHKQGAEQTARMIEELDGQALVIKCDVSQDEDVKNAIEKTIQTFGRLDYAFNNAGIEGETVITAEYPVEEWNRVIATNLTGVFLCMKYEIPQMLKQGAGAIVNCSSGAGLTGFPGIPAYVASKHGVVGLTKTAALDYAKSNIRINAVCPGMTDTPMMERYSGGTPEGYKKIIEQEPIGRMGRPEEIAIAVLWLCSDAASFVTGDAMRVDGG

SEQ ID NO: 11345 - protein, 357 aa, Methanosarcina mazei
VYKKCINMAENIQSKGYAGKDESGKLVPWSFERRPVGDNDILIDIKYCGVCHSDIHQIKGHWGPQQYPQVPGHEIVGVVAAVGKNVTKFKVGDRAGVGCMVSSCMECESCKNGEEHHCDNNATIMTYGYPEESSPTGISQGGYSQNIVVTEHFAIKIPDSIDLQEAAPLLCAGITTYSPLMRANFKKGDKVGVAGIGGLGHVAIKLAVSKGAEVYAFTTTESKKEDCLAFGATEVIVVNSPSDLQPWKGKMDYMISTIPYAYEMSSYIDCVKPYGYFTQVGQPIGGELTINNFNMIFNRVNFNGSLIGGIPETQEVVDYCAENKIYPQIQMIKPEMINEIWEKVVNKEARYRYVIDM

SEQ ID NO: 11346 - protein, 330 aa, Methanosarcina mazei
GILGATGAVGQRFVEALANHPWFEITALAASERSAGKTYKEAAGWRLDTAMPESVEDIKVVPVDPKAVDADVVFSALPADLALTVEPEFAKAGFAVASNASSYRMENDIPLVIPEVNPEHLGLLEVQQDTRGWDGYIITNPNCSTIVMTVTLKPLMQFGLETTQVATMQAISGAGFSGVAAMAIYDNIIPYIGNEEKKMETETLKLLGEFNGSEIVPADMRVSASCHRVPVIDGHTEAIWAGMRDKPTPEEVRKAFLNFDPRLKELPSEPAKPLIVRDESDRPQPRLDRNMGKGMSVSVGRIREGIRYIAMGHNTIRGAAGASVLNAELL

SEQ ID NO: 11347 - protein, 415 aa, Methanosarcina mazei
TILDIVELLLTAEIYNRYPELDVNDLPKNIRKNYWNSTEKTVPKPITATFISIEKLYGLKDIEKIVRNVPFINTDKSHFELRLSAFELAAEWFEKQEGSQKRIENNPVLAYYFEKIREDEAANYSLAKAKISPKESDREWIESKIAEIRKEDKSEDMLKLAVIIAPEDVKQKVRDLVLTGEQKNEVEKITKAIEHREYLREIGLHDIGKLLFVGPPGTGKTSVARALSERLSIPFVEVKLSMITDQYLGETAKNIDRVFLLAKKLNPCILFIDELDFVAKARTSDENAAIKRAVNTLLKAIDEISLVDHGVLLIAATNHPRMLDSAAWRRFDEIVHFPLPDLEMRTDILNIVTRHIEGDYDTGKIAELTDGYSGSDLRVVIREAVLGALLEERKILTQQDLLDAVDSFNERAGLK

SEQ ID NO: 11348 - protein, 429 aa, Methanosarcina mazei
EIPGDNTIKVWDLEKGEEMATLRGHEKVFSIAVTPNGKYAVSGSHDGTLKVWDLEKWREIRSLRAHSKSITAFAITSDGKLVVLGSLDGNLEVWNLETGEEKAAFKEHSEPITEIVITPDGKRAVSGSSDNTLKVWDLEKMEELTTLISHSNSVSKIAITPSGKYAISGSSDNTLKVWDLKKLDEETISTGHSKSVNKIVITPDGKLAVSSSYDGTLKVWDLKTKEEKVTLKGHSGPVTDFVITPDGKRIISGSSDKTLRVWDLKKGNMTLKGHKREVTSVAITSDGKYAISGSFDRTIKVWDLENGKIKVTLEGHKNYISTISIIPNKNCIVSSSHDETLKVWDLDRGIDTITLIGHSGSVSSVAITPDGKSIVSASGDGTHKIWSLENREEIATLEGHKSAPSTIVITPDGKYAVSASYDRTIKILD

SEQ ID NO: 11349 - protein, 388 aa, Methanosarcina mazei
MRDVAIIGVKNTKFGELWGRSLRDIVVEAGAGALEDAGIGGKEIDSLYVGNMSGGRFIDQEHIGALIADYSGLSKNLHVPATRVEAACASGGLALRQAIMAVASGYNDIVIAAGAEKMTDVESEEASSALAAAADREWEGMTGATFPGIYAMIARLHMHRYGTTSEQLAEVAVKNHKNGSLNPIAQYKNRITVDDVLNSIMVADPLHIFDCSPITDGASALVLAPADIAHKYTDTPIYIRATAQASDTIALHDRRDITTLDATVVAAKRAYSMAKLRPEDIDLVEVHDCFTIAEICAIEDLGFAEKGKGGIVTANGETAIGGRIPVNTSGGLKACGHPVGATGVKQAVEIVTQLRGDAGKRQIEGAEYGMTHNVGGSGATAVVHIFSR

SEQ ID NO: 11350 - protein, 348 aa, Methanosarcina mazei
IMTIGIVSYGAYVPRYRIKVEEIARVWGDDANALKSGLMVYEKSVPDIDEDAATIAVEAARYAMTRSGVDPERIGAVYTGSESHPYAVKPTSTIVSQAIGATPNMTAADFEFACKAGTAAVQACMGLVSSGMIDLGMAIGADVSQGAPGDALEYTAAAGGVACLIGKKESELAAIIEDTYSFTTDTPDFWRREGMPYPEHGGRFTGEPGYFKHVTNGAKGLLNKLGTKPEDYDYAVFHQPNGKFPTKAAKTLGFTKAQIAPGLVVPKIGNTYSGSCLMGIAATLDQAKPGDRIFATAFGSGAGSDAFSITVTDRIEEIRNRAPTVSELIKDPIYIDYARYAKHKGKIR

SEQ ID NO: 11351 - protein, 669 aa, Methanosarcina mazei
  unsure (1)..(669): unsure at all Xaa locations
WSFLTASPTLDSTSSRTARTLSRSTRAEYHSISTNNIRNCPSLETITVGHRLSSITSYSIRDCPSLDAMVFEAEGDAPSASGNWNYNCPNLVVYYCENATGFTTPSWAGKPCYPIGSPTATFRPTPFSAVHRSRYSSPIRVWVRTLCPGTSTTTLLWTALRGTPVIPTIHRVPTRPLCMSTTHGAATVSSEQTTLPXLRLTLTVGLTTSDGTSVTVTGYSGPDSDVTIPGEIDGLPVTTIGASACKALTSLTSVTIPDSVTTIDASAFYGCTNLISVTMPDSVTTIGSSAFYGCTGLASVTIPNSVTTIGSSAFYGCTGLISVTIPNSVTTIGSSAFYGCTNLTVMMFNGNAPTTVGSNWASGTNLVAYYSEGATNFTTPEWNEVPCYPALTAATAEFTSNIVYGSAPLTVKFTYTGVGANALDWYFDNDSTVDSTARNPSYTYDTPGTYSIKLNVSNPWGSDSEVKTAYITVAEPVDNFTYLSDGTSVTITGYSGPGGDVVIPSTIGNLPVTAISDSVFKSNTNITSVTIPDSVTTIGSSAFYGCTGLTSVTIPNSVTTIGNNAFNGCTGLTSMTIGNNVTKIDDRMFYGCSALISVVIPDSVTTIGDSAFYQCSNLASVTIPDSVTTIDSYAFRDCNALTSVTIPDSVTNVESRLFYGCTGLTSVTI

SEQ ID NO: 11352 - protein, 668 aa, Methanosarcina mazei
SIGKYAFSSCSALTTLAIGSGVTAISDGAFYNCPSVTTVKIGSGVTNIGASAFQGCSALTTVTIPDGVINIGTSAFRSCSALTTVAIPDSVTSIGSSAFCGCSGLTIVTIGGGVTSIGGVTSSSSFAFSDCSALTAIDVDADNSVYTSIDGVLYNKDVTTLIRCPSGKTGSVAIPNSVTTISSYVFPDCSGLTTVTIGSGVTSIDNSVFSDCSALTAIDVDNDNSMYASIDGVLYNKDITTLIQCPSGKTGSVTIPDSVTTIGDSAFYGCTALTSVTIPDSVTTIGTSAFQGCISITSVNIGNNVTSIGNSAFCDCIALTSVTIGNNVISIGSYAFQGCAALTSVTIPDSVTKIGSSAFQGCISITSVNIGSGVTSIGNSAFRQCSALTTVTIPDSVTTILDYAFQDCSRLTTVTIGSGVTNIDSSAFSGCSALTAIDVDNDNSIYASIDGVLYNKDITTLIQCPSGKTGSVTIPDSVTTIGDSAFRDCSGLTIVPIGNNVTSIGSSAFYGCTYLTSVPIGNNVTSIGSSAFYGCTSLTSVTIGNNVTSISSSAFRQCSALTTVTIPDSVTTIGDIAFSDCSGLTTVTIGNNVTSIGSSAFYGCTALTLIAIPDSVTSIGGSAFRDCTNLTSVTIGNNVTSIGSSAFRSCTALTSMTFMGNAPTMGSR

SEQ ID NO: 11353 - protein, 424 aa, Methanosarcina mazei
MRVSIDKSSIKGEVFAPPSKSYTHRAVTLAALSKESTVRHPLISADTLATVRASEMFGALVEREEDRLIIHGINGKPNVPDDVIDAANSGTTLRFMTAVAALTDGITVLTGDASLRTRPNGPLLEVLNRLGVKACSTRGNERAPLVVKGGLKGQDVSIDGSISSQFISALLITCPLAENSTILSITGKIKSRPYVDITLEMLELAGVKVHIDDSNGTRFIIPGKQKYDFKDYTVPGDFSSASYLLAAAAMTDGSEVTVKNLFPSKQGDKVIIETLKQMGADITWDKEAGNVTVKGGRQLKAITFDAGANPDLVPTVAVLAAVAKGTSRIENAEHVRYKETDRLRALATELPKLGVDLKEERDSLTITGGKLHGASVHGWDDHRIVMALSVAGIVAGNTKIDTTESASISYPEFFKDMRSLGAKI

SEQ ID NO: 11354 - protein, 245 aa, Methanosarcina mazei
MFKAAINAELLKDAVAALAVIVDEVRFKINPEGISVKAVDPANVAMGIFELGSSAFDEYNADECEIGVDLNKITDLLGIADKNDTVRMELEEENHKLLIDVGGLSYTLSLLDPSTIRAEPRVPQLELPAKVVLNGADLRRAVKAAEKISDHMLMGVSDDTFYMEAKGDTDQVRLEMGRDQLIDLKAGEACSLFSLDYLTDIVKPTNKVNEVTLSLGKDFPILIDFEIANGSGRISYLLAPRIESD

SEQ ID NO: 11355 - protein, 240 aa, Agrobacterium tumefaciens
MDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWHIIRHELADEETFMNVAKARVKQMLRPAAGLSIIQELVDLWKEPRLRPILKEIDGYRYAMLFASQNQITSDMLLQLDADMEDKLIHGIAQEYLIHARRQEQKFPRVNAAAYDGFEGHPFGMY

SEQ ID NO: 11356 - protein, 324 aa, Agrobacterium tumefaciens
MNGAGEINASRHRKENELKTCQILGAPVQSGASQPGCLMGPDAFRTAGLTQVLTELGWAVTDLGDATPTVEPELSHPNSAVKNLDALVGWTRSLSQKALEMARSCDLPVFLGGDHSMSAGTVSGVAQRTAELGKEQFVLWLDAHTDLHTLHTTASGNLHGTPVAYYTGQSGFEGLPPLAAPVNPRNVSMMGIRSVDPEERRRVAEIGVQVADMRVLDEQGVVRPLEAFLDRVSKVSGRLHVSLDVDFLDPAIAPAVGTTVPGGATFREAHLIMEMLHDSGLVTSLDLAELNPFLDERGRTARLITDLASSLFGRRVFDRVTTAF

SEQ ID NO: 11357 - protein, 242 aa, Agrobacterium tumefaciens
FDLSGRRAVITGGARGIGRAIADGFLEVGADVVCIDRGWESSDLPADNRQIVTADLSDRSDLKRGFDEAVERLGGQIDVLVNNAGIWDDTPSLHMELEMWDRIIEVNLTAAFALSRHAARLMLPRGRGRIINIGSIRSLRGGHNAAAYAASKGGIALLTQTLSNEWAPSGLRVNAIAPGAMVTVLTEKLRHDPEVVTRFIERIPARRWGSPADVAGLAIFLASDASDYVTGAIIPCDGGFLA

SEQ ID NO: 11358 - protein, 528 aa, Agrobacterium tumefaciens
FDFIVVGGGSAGAAVAARLAERADLRVLLLEAGRQQSGIRFRLPILTPFALAKEDAVWNFTTLPEPGLNGRELVWPRGRGLGGSSLINGMLWVRGDPVEYDLWAASGCTGWSYGDLLDFFKRSETYIPGDPASRGQRGAVTVTRHRPADPLSDAFLKACGNMQVSQQDDYNAGISEGAGYLQFNQRRGLRHGTDRAYLSPASRCANLTIREGAVANRILFEGKRAIGVEYRAADGLRCAIARREVVLSCGTVQSPKLLELSGIGDGEVLGRAGIVPLVHLPGVGENLRDHLNVRVGFRTRFRGTLNDVQHSYVWKVRAMLCWLARGGGPLSTIGATAHAFVRTRSDLERADVKIQMLHFSAPHNTGNISGRLDEFPGFSISTFVLRPNSTGSSHIRSGAAAEPPAIVANYLSHEEDLRSMLGAFRFINRIASDSVFDDLMVSRDNDLAGLQSDQDILEWAKTTGLTSYHPIGTCKMGTDSASVVDPRLRVIGVDGLRVVDASVMPTMPSSNTHGPTVMIGEKGAAMIL

SEQ ID NO: 11359 - protein, 243 aa, Agrobacterium tumefaciens
MLLHLIYGPTCSGKTDMAIQIAQETGWPVVALDRVQCCPQIATGSGRPLESELQSTRRIYLDSRPLTEGILDAESAHRRLIFEVDWRKSEEGLILEGGSISLLNCMAKSPFWRSGFQWHVKRLRLGDSDAFLTRAKQRVAEMFAIREDRPSLLEELAELWNYPAARPILEDIDGYRCAIRFARKHDLAISQLPNIDAGRHVELIEAIANEYLEHALSQERDFPQWPEDGAGQPVCPVTLTRIR

SEQ ID NO: 11360 - protein, 474 aa, Agrobacterium tumefaciens
HLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSI

SEQ ID NO: 11361 - protein, 284 aa, Agrobacterium tumefaciens
DSNEVLVDCQNVWKIFGARASTAVKAVARGGLSKKQVLEDFDCVVGVCDASLQVHRGEIFCIMGLSGSGKSTLIRLLNRLIEPSLGKITVKGKDIARLNAAELRELRARNIAMVFQSVALLPYRTVLENCRFSLEVRGVAKDERNRIARAALEKVGLADWTSRYPHELSGGMQQRVGLARALAADPEIILMDEPFSALDPLIRRQLQDEFRQLTKSLGKVAVFITHDLEEAIRIGDRIAIMKDGVIVQVGTAEEIVTKPADDYVSDFVAGISRIHLVKAHTVMQ

SEQ ID NO: 11362 - protein, 488 aa, Agrobacterium tumefaciens
AEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDV

SEQ ID NO: 11363 - protein, 302 aa, Agrobacterium tumefaciens
LKFEGIYTPAITPLGHDGEIDRDAFAAVLESLMEARVHGIIIGGSTGEYYAQTAQERFDLAAYARQVIGTRLPLVVGTGATRTEDSIEYAKAAKEIGADAILVSSPPYALPTERENAVHALAVDRAANLPIMLYNYPARMGVVMGEEYFSRVGKSKNVVAIKESSGDMGNLHLLARKFPQIALSCGWDDQALEFFAWGAKSWVCAGSNFLPREHVALYEACVVEKNFDKGRAIMTAMLPLMDFLECGKFVQSIKHGCEIIGLRAGSVRAPLRPLNSDEKRTLQTVVTTLKRTVAQIASGANH

SEQ ID NO: 11364 - protein, 294 aa, Agrobacterium tumefaciens
MSQAKLLCDTMSTLAESPVWDERRQVLFWCDILGKTVRSAALEPGQYREWPFPHTVSSLGLRENGDLVVACGMDIVILDPDSGRTRLLHSIPAPEGIPCRLNDGRVGPDGAFWVGTMHNVPLSEMKPYGELWRITATSAKRMQTGLTCPNGLAFSPDGSIMWQSDSVQKWIRRRNFYRVNGLFDEGVLVAQMTEETGRPDGGCLDSSGTYYSAGVSAGMLNVFAEDGGKQTAAIKMPVPHPTMPCFGGPDFSTLFVTSHRHNMSAERLEQAPFSGGVWMIPTQTKGFAPFRFEG

SEQ ID NO: 11365 - protein, 927 aa, Agrobacterium tumefaciens
TGKAMSGLNTDVIAALTAAQIAAFGASAIAGLTSDQVEALSGSQVSLLSTTQIKALSSTQVAALGSDVAALSTSQTAVLSAASIKGLTPEQIAILRPDQFSALTTAQIAALSSGQITAMGASNIASLSMAQIAAISTSSMTGLSTGQIAALSTEQISRLSSRQMAMLSSAQIAALGTEAVAALSTAQISGLSAAGISGLSKQQVATFSTAQVEALTSAQILNFSSMHIAELGTEDLAKFTTKDIAAISSSAIAGLSAEAIASLTTAQIAALNTQSINALSTAQIAALTTAQVEALTSTQVNALTSKQIAALSTDDIATFSTKDIAAINSDAIAGLSAETIASLATGQIAALNVRSIAALSTVQIVALTTAQVEALTTVQVGALSSTQLAVLSTDDIATFSTRDMAALGSSAIAGLSKDTVASLTTAQIGALSMAGISGLSTGQIAALTGDQLNVLTNTQIAALTSKQVAAFDVSDITALSTGQIAALSAAGAAGLTTDQIAALSTDQVGAMTSGQIAALSAKQIAALGTDDIATFSTGDIAALSSNAVAGLSRDTVASLTTAQIAALSSAGISGLGTGQIAGLTSEQVNVLTNAQISALTSKQVAALEVTDIASLSAAQIAAIGAAGVAGLTTDQIAALSISQVEALTSAQIAALNSKQIAALSADDLAIFTTAEMAAIGSGAISGLPASTIASLTTAQIAALGAAAVSGLTTDQIAALGTGQVDALTNAQIGALTSKQVTALSVSGIGSLSSAQIAALSTAGVAGLTTDQIAALSTSQVEALTSVQIAALSSKQIAALGADDLDIFTTAEIASIGSSAVAGLSASTIASLTTAQIAALGTAAVSGLTTDQIVALGTGQLNGLTSAQIGALTSRQVAALSATGIAALTKGQIAALDAKAVAGLGSAQAGALSVEQVEALSTRQIAAL

SEQ ID NO: 11366 - protein, 930 aa, Agrobacterium tumefaciens
ISKLSTSTIAGLTSEDVNALDSTKIKALSSSQIASLSTDNLALFSSEDLRAISVTAVKGLTLTQMAKLSSAQVSSLSSSQVTALYASQIDAMSTDQIKALNSSQVAGLSSAQVATLSSDELALFTTDEIKSISANAIAGLSAAAIAGLSTDNAAALTKSQIAAMSSTQFNALTSGSLATFSADEVKAISNKILAGLDVTKLSTGNIAALSKAQVSALSTTQFAAMSTDQIKALTSDQVAGLSSAQVATLSSDELALFSTDEIKAIGANAVAGLSAAALAALTTDNAAALTKTQIAGLSSTQLNALTSANLATFSADEIKAISTKALAGLDVTKLSTGNIAALTKTQAASLSSTQFAAMSTDQIKALTSEQVAGLSSAQVATLSSDELALFSTDEISAFSANAVAGLSTAALAALTTGNATALTKTQIAGLSSTQLNALTSGSIATFSADEVKAISTKALAGLDVTKLSTGNVAALSKAQVSALSTTQFAAMSTDQIKALTSEQVAGLSSAQVATLSSDELALFSTDEIKAIGANAVAGLSAAALAALTTDNASALTKTQIAGMSSTQINALTSANLATFSADEIKAITTKALGGLDVTKLSTGNIAALTKAQVTSLSSTQFAALSTDQIKALTSEQVSGLNSAQVATLSSDELALFTTDEIKSIAANAVAGLSAAALAALTTDNASALTKTQIASLSSTQLNALTSANLATFTADEIKAVTTKALAGLDVTKLSTGNVAALSKAQVSALSTTQFAAMSTDQIKALTSDQVAGLTSAQVATLSSDELALFSTDEIKAIGATAVSGLSAAALAALTTDNASALTKTQIAGLSSTQLNAFNSANLATFTADEVKAITAKALGGLDATKLSTGNIAALSKAQAAALSTTQFAALSTDQIKALTSEQVAGLNSAQVATLDSTELALFSTDEIKAI

SEQ ID NO: 11367 - protein, 369 aa, Agrobacterium tumefaciens
VNIAALSPYEAKLAGLSRKSRLRALAPREGIDFTSNDYLGLAEAPRLKAAIAHAIGKGVPVGAGGSRLLRGNHPEHEALESEAAAFFGAEKAIYFGSGFAANVALFSTLPLRDDIVLHDALIHASVHDGIAAGKAKAVAVPHNEVEAFQREIIRWRQAGGSGRPWIAVESLYSMDGDCAPLAALADLAERHGGFLVVDEAHATGVFGPGGRGLAAQLEGRSNVLALHTCGKALGASGALLSLPAVLADYLVNRARGFIYSTAPSPLMAAAVREALRIVADEPSRRSRLAELVGFAGEELQSQLGVTPSGSQILPVMIGDNARSLKIAARLSQGGFDVRAIRPPTVPEGTGRLRIAITLNVDESQIAAMV

SEQ ID NO: 11368 - protein, 414 aa, Agrobacterium tumefaciens
SPVWHPFTQHGLEPPMKRVVSADGAFLVDEDGNRLFDAISSWWVITHGHRHPAIMAAIRAATETLDQVIFAEFSHEPAETLARGLIELAPAGLSHVFYSDSGSTAVEVALKMALGYFHNCGEKRDRIVVMEHGYHGDTIGTMSTGERGVFNAAYEPLLFGVDRLAFPEVGSEQCTLDMFEAYCRSGRVAALLVEPLVLGAGGMKVYAANVLAGLKQIAESHGCLVIADEVMTGWGRTGTVFACEQAAISPDILCTSKGLTGGSLPLAATLCSAQIFDAHFSTDRRKTFFHSSSYTANPIACAAAVANLQVWRDEPILQRIGQVQQTLGDHIRRFADDGRFANIRQAGTIAALDLVVPAGGYLSEAGPRMRQLFRRRGFLIRPLGNVLYLMPPYCSTADDLTRAFDVIDEVAGIV

SEQ ID NO: 11369 - protein, 323 aa, Agrobacterium tumefaciens
TRSSRMAGFGHAVPARCVDNAEIEASLGLEAGWIERRTGIRSRYWAEAGDTLSGLAERAGRMALEDAKINADDIALTLLATSTPDHLLPPSAPLLAHRLGLTRSGAIDLAGACSGFLYALTLADGFVRTYGRAVLVVAANILSRRINPAERASAVLFADAAGAVVLTPCPEVKRGVLSADLVADGSGYDLIQIAAGGSSQPFSAGMIAEDALMTMRDGREVFSRAVALMTNTSQRVLHEAELTAADISRFVPHQANARMSDAVCGNLGIEREKTVRTIGSFGNSSAATIPLSLSITNAERPLAGGETLLLTAAGAGMTGGAVV

SEQ ID NO: 11370 - protein, 306 aa, Agrobacterium tumefaciens
MDIRLVGAPLQIGAGQLGCEMGPSAYRVAGLAHALEELGHRVVDTGNVMPAPLREFCHPNPAVHHLAETVAWTEALTEAAYRESADAVPIFLGGDHAISAGTVAGMARRVAETGRPFFVLWLDAHTDYHTLETTRSGNLHGTPVAYFSGRDGFSGYFPPLSHAVAEENIGMIGIRSVDPAERAALEKSGITVHDMRSIDEHGVAVILREFLARVQAANGLLHVSLDVDFLEPSIAPAVGTTVPGGATFREAHLVMEMLHDSGLVCSLDLVELNPFLDERGRTATLMVDLATSLMGKRVMDRPTRAG

SEQ ID NO: 11371 - protein, 303 aa, Agrobacterium tumefaciens
MTTDKTSPYEIHDDRFRHLIVGNAELEELYSGCRWAEGPVWFADLNCLLFSDIPNERMLRWVPDGGISVFRQPSNFTNGNTRDRQGRLVSCEHGGRRVTRTEVDGSITVLADSYGGKRLNSPNDVVVKSDGSVWFTDPTYGILSDYEGYKAEPEQKTRNVYRLDPATGKIDIAIDDFVQPNGLAFSPDETKLYVADSSYSHDISRPRHIRVFDVVDGVRLANGREFCNLDNGLPDGFRLDTAGNLWTSAGDGVHCFAPDGRLIGKIKVPQTVANLTFGGPKKNRLFITATKSLYSVYVAATGA

SEQ ID NO: 11372 - protein, 301 aa, Agrobacterium tumefaciens
MDLNRTVRKAVIPVAGNGTRFLPATKAMPKEMLTIVDRPVVQYAVDEAMQAGIEHIIFVTSRNKTAIEDYFDSAPELINTLTRSGKTVQVLQLEKMLPVAGTVSYTRQQVPLGLGHAVWCARELVGKEPFALLLPDMVSYGARGCIAGLMELYDEVGGNILGVEECLPEEVSSYGVVGVGQKVNHGFSVTEMVEKPEPSKAPSNYYLNGRYILQPEIFDILARQERGAGNEIQLTDGMKRLAEKQPFHAQKYSGRTFDCGSKQGFIAANVAFSLMRSDMEAQVLASVKELIANHESRVQAA

SEQ ID NO: 11373 - protein, 649 aa, Agrobacterium tumefaciens
MQIPPVFPKGATRTENGVEFTVYSRHASQIDLCLFDDAGEKETARLPMMRGEDDVHRLTHENAGPGTRYGFRAHGIYAPEHGLWFDPAKLLLDPYATEIDRPFRHDPSLYAFGAETGAIMPKAILSAHDPVKRQPPRFAEGGLIYELAVKSFTQLHPYVPEDIRGTVAALAHPAILAHLKKIGVDAVELMPITAWIDERHLPPLGLSNAWGYNPVGFIALDPRLCPGGVRELRDTVAALHAEGIGVILDLVFNHTGESDIEGSILSLRGLDNLTAFRHPQGKPGVLVNDTGTGNTVACDHPYIRQLIVDSLRHFVLNAGVDGFRFDLAPVLGRTAAGFDMASETLAAMHSDPVLYDRLLIAEPWDIGPGGYQLGNFPESFLEWNDRARDDMRRFWRGDAGTTGALANALSGSSPIFSRHGRLKSRSVNFLAAHDGFTLFDLVSHERKHNEKNGENNRDGHNDNHSWNNGFEGLTDDPAIVAARLADVKALLSTLFVSRGTLMLTAGDEGGRSQQGNTNAYCQDNEISWVDWSSLVPELIDHTAFLAALRKRFGVFSESGFFSGRGDVTWLAPGGEPMTVADWERPDGQAFAMVLSTPDRETGKATELAVLINRGRDIVPFTLPGDGWRSIGTDFGNPAFLPARSVVFYL

SEQ ID NO: 11374 - protein, 541 aa, Agrobacterium tumefaciens
IKTIKTTPYQDQKPGTSGLRKKVPVFAQENYAENFIQSIFDALEGFEGQTLVIGGDGRYYNREVIQKAIKMAAAAGFGKVLVGQGGILSTPAASNVIRKYKAFGGIVLSASHNPGGPTEDFGIKYNIGNGGPAPEKITDAIYARSKVIDSYKISDAADIDLDKIGSFKVDELTVDVIDPVADYAALMEELFDFGAIRSLIAGGFKVVVDSMSAVTGPYAVEILEKRLGAPKGSVRNATPLPDFGGHHPDPNLVHAKELYDDVMSPEGPDFGAASDGDGDRNMVVGKGMFVTPSDSLAIIAANAKLAPGYAAGISGIARSMPTSAAADRVAEKLGLGMYETPTGWKFFGNLMDAGKVTICGEESFGTGSNHVREKDGLWAVLYWLNIVAARKESVKDIVTKHWAEYGRNYYSRHDYEEVDSDAANTLVAILREKLATLPGTSYGNLKVAAADDFAYHDPVDQSVSKNQGIRILFEGGSRIVLRLSGTGTAGATLRLYVERYEPDAARHGIETQSALADLISVADTIAGIKAHTGRSEPTVIT

SEQ ID NO: 11375 - protein, 480 aa, Agrobacterium tumefaciens
MNVLSVSSEIYPLIKTGGLADVVGALPIALEAHGVRTRTLIPGYPAVKAAVTDPVKCFEFTDLLGEKADLLEVQHERLDLLILDAPAYYERSGGPYLGQTGKDYPDNWKRFAALSLAAARIGAGVLPGWRPDMVHAHDWQAAMTPVYMRYAETPEIPSLLTIHNIAFQGQFGANIFSKLALPAHAFGMEGIEYYNDVSFLKGGLQTATALSTVSPSYAEEILTAEFGMGLEGVIGSRAHVLHGIVNGIDADVWNPATDHLIHDNYSAANLKNRALNKKAVAEHFRIDDDGSPLFCVISRLTWQKGIDLMAEAVDEIVSLGGRLVVLGAGDVALEGALLAAASRHHGRVGVAIGYNEPLSHLMQAGCDAIIIPSRFEPCGLTQLYALRYGCIPVVARTGGLADTVIDANHAALASKAATGVQFSPVTLDGLKQAIRRTVRYYHDPKLWTQMQKLGMKSDVSWEKSAGLYAALYSQLISKGH

SEQ ID NO: 11376 - protein, 420 aa, Agrobacterium tumefaciens
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEALRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 11377 - protein, 799 aa, Agrobacterium tumefaciens
EIMAAEIIERLTYRIGKDVKVAKPHDWLTATILVVRDRIIDKWMASTRKAYADNSKRVYYLSLEFLIGRLMRDAISNIGLMHEIRDALSSLGVDLDVIAGLEPDAALGNGGLGRLAACFMESMATVDIPAYGYGIRYVHGLFRQQMADGWQVELPETWLAHGNPWEFERRESSYEIGFGGSVETIGGYEDPQRFVWKPAERVIAMAYDTPVVGWRGTRVNTLRLWSAQPIDPILLAAFNAGDHIGALRESNKAESLTRVLYPADATPAGQELRLRQEFFFSSASLQDILRRHLQQYPDFTSLPDKVSIQLNDTHPAISICEMIRLLCDVHGLEFDEAWRITQGTFSYTNHTLLPEALESWPVPLLERLLPRHMQIVYAINANTLLFARKEKKMADQQIRSISLIDEGGERRVRMGNLAFIGSHSINGVSALHTELMKETVFADLHSLYPERINNKTNGITPRRWLMQCNPGLTGLIREAIGDDFLDDAEKLIALDRFADDAGFREKFAEVKRLNKVRLANTVAQRMGIRVDPSAMFDIQIKRIHEYKRQLLNLIETVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGADNIVIFGMTAEEVSRARAEGHNPRAIIEGSAELSQALSSIASGVFSPDDRSRFSALMDGIYNSDWFMVAADFDAYADAQRKVDAIWSDQDSWNTKAVRNTARMGWFSSDRTIRQYATEIWR

SEQ ID NO: 11378 - protein, 241 aa, Agrobacterium tumefaciens
FDLSGRRALITGSSQGIGFALAQGLSEAGAEVVLNGRDEAKLKAAAAGIKGARTLAFDATDHGAVREAIDRFEAEVGAIDILVNNAGMQHRTPLEDFPADAFERLLQTNIASVFHVGQATARHMISRGRGKIINIASVQTALARPGIAPYTATKGAVGNLTKGMATDWAKYGLQCNAIAPGYFDTPLNAALVADETFSAWLEKRTPAGRWGKVEELVGACIFLSSDASSFVNGHILYVDGG

SEQ ID NO: 11379 - protein, 325 aa, Agrobacterium tumefaciens
AIVAHGAKDVRIEDRPEEKPGPGEVRLRLARGGICGSDLHYYNHGGFGAVRLREPMVLGHEVSAVIEELGEGVEGLKIGGLVAVSPSRPCRTCRFCQEGLHNQCLNMRFYGSAMPFPHIQGAFREILVADALQCVPADGLSAGEAAMAEPLAVTLHATRRAGDLLGKRVLVTGCGPIGILSILAARRAGAAEIVATDLSDFTLGKAREAGADRVINSKDEPDALAAYGANKGTFDILYECSGAAVALAGGITALRPRGIIVQLGLGGDMSLPMMAITAKELDLRGSFRFHEEFATGVELMRKGLIDVKPFITQTVDLADAISAFE

SEQ ID NO: 11380 - protein, 514 aa, Agrobacterium tumefaciens
QAGLLAFSVGKIADGEPMMAIVPAAVAVLILGLLKAWLEKVAARLSFRAARAALSQRRFEALQAVAKVSPLDLSRTASGEAAGIVAEAAEALVPYLSRFQPARMKATIVPLVFVLAILPFSWIAALVLLLAMPTIPLFMALIGWQAKAASEKQLAETGNINAFLLDRLRGLETIRTLKAVDLTAARLDADAQNLKKRTMAVLRIAFLSSAVLELFAAIGVAMTAVYIGFHLLGFLDFGAWGEKLTLAEGLFILLLAPAFFEPLRELSAVWHDRAAGEASLNALATLTAGGAAIVGEGADVVRAPSSTPGLLEMENLSFAYPNAPPVIRNFNLTVQQGERVAILGASGCGKSTILSLIAGLAEAGEGVIRIGGVTLDDATADGLRGTIGWVSQKPFFFAASMKANIGFGRLAVSEAMVEEVLHRTGLDGLTQARRHLQIGDGGNGISGGEAVRLAIARAFADPATQLVLADEPTAHLDRETAALVTDNLLQLAKGRTLIVATHDPVLAARMDRIV

SEQ ID NO: 11381 - protein, 498 aa, Agrobacterium tumefaciens
DWTVIVGSGMAGLMAAMTLAPQPVLLVTRGALGGETSSAWAQGGIAASLGPDDRAALHVADTLAAGDGLCDEDMVVGIVSSAPAVIDALERAGVRFDRDAGGNYVFGLEAAHSRRRILHAEGDGSGAAIVRALTDAVRRTPSITVLEGTEVRRLLTEDSVIAGLACAGPNGSFLLPASQVILATGGLGGLYDATTNPSGNFGQGIMLAARAGAILADMEFVQFHPTALSSPRRPLALVSEAVRGEGALLLNENGERFMAAVPGAELASRDIVARAIDREILRGGQVFLDARQALGSGFASRFPSIDLLCREAGIDPARELVPVRPAVHYHMGGVATDNKGRSSVRGLWVAGETACTGLHGANRLASNSLLEAAAMGMRAAQDIAGRPAPAARSAAAVSPNATADFSPADLAAVRPIVSRHLGIVRHAAGLAEAIRDLLPLAERNGPASDPAVVALSIAVFAALRRESRGAHFRDDFSQKDAKAMRRRLSLNDVVTVAH

SEQ ID NO: 11382 - protein, 249 aa, Agrobacterium tumefaciens
MSGTILITGATSGFGQATARRFVKEGWKVIGTGRRAERLEALAAELGQAFHGIAFDITDEDATEKALAALPDGFRDIDILVNNAGLALGTAPAPQVALKDWQTMVDTNITGLLNITHHLLPTLIKQKGIVVNLSSVAAHYPYLGGNVYGGTKAFLRQFSLGLRSDLHGKGVRVTSIEPGMCETEFTLVRTGGNQEASDNLYKGVNPITADDIANTIYWVASQPKHININSLELMPVNQSFAGFQVYRES

SEQ ID NO: 11383 - protein, 524 aa, Agrobacterium tumefaciens
YDYIVIGAGSAGCVLANRLSKDPNNRVLLLEAGGNDNYHWIHIPVGYLYCINNPRTDWCFKTAEEPGLNGRALIYPRGKVLGGCSSINGMIYMRGQARDYDVWRQLGCEGWGWSDILPYFMKSEDFYRGKSDLHSAGGEWRVEKARVRWDVLDAFQKAAGEAGIPATDDFNRGDNEGAGYFDVNQRSGWRWNTAKAFLKPALGRKNLTVLTKAHVKRLIIEECRVTAVEFHHDGVLKKMRARRETVLSAGAIGSPHILELSGVGRGDVLQAAGIDTVAEVHGVGENLQDHLQLRMVYKVSGVLTLNERASTLFGKARIGLEYALTRSGPMSMAPSQLGVFTRSSPEKETADLEYHVQPVSLDKFGDPVHTFPAITASVCNLRPESRGSVHVKGPDFAMQPEIRPNYLSTEGDRQVAIDAMRLTRRIVAQPAFSRFNPQEYRPGPSFENDNDLAKAAGDIGTTIFHPVGTLRMGSDVESVVDNRLKFRRLAGLRVADASVMPRITSGNTNSPTIMIAEKAADMIL

SEQ ID NO: 11384 - protein, 637 aa, Agrobacterium tumefaciens
LWVPPRERLEHSALFAFAAKTAPLHGLAADDYAGLLRWSIDAPDEFYDALWDELAIIGTRGEAAFKAGATIRDAEFYPGARLNYAENLLRDADERLAIIAYRDDGTRREISRRKLYDEVSRMVQALVHAGVKEGDRVGAIVTHDIEAIVSYLAVSAIGAIWSSCSPDFGPAGASDRLSQIDPKILIAVPEYGYAGKRIDVGPTIRAVAESARPEKIVLIGDSVAESLADLGCLTLADFVAPYAAGEIAFNRLPVKAPLAILYSSGTTGKPKCITHSGGGLLLQHMKEQKLQCDIRQGERFFYFTTCGWMMWNWQVSGLALGATLVTYDGNPGYPNTARLIDLIDAEGIATFGTSAKFIDACLKAGLQPRESHDLSSLRTILSTGSPLIPQSFDYIYRDWRADLHLASISGGTDICACFLGGNPLQSVHRGELQGAMLGMDIDTLDDEGRSVRGVAAELVCRNAHLSMPVKFWGDEDGSRYQAAYFDRFPGIWAHGDFAELRPSGGYVIHGRSDTTLNPGGVRIGTAEIYRQVETVPDVEEAIAVGQDIDGDQRVILFIRMKEGAVLTEELEKTIRSRIRLGATPRHVPARIIAVSAIPRTRSGKISEIAVRETIHGRPVKNTDALANPESLELFRNL

SEQ ID NO: 11385 - protein, 256 aa, Agrobacterium tumefaciens
KTVLVTGSTSGIGLAIAKRFAEAGFLVAVHGVETAAEGAQALEAVATVARHRPVYFSANLAHYDESAHLPEKVIAEFGHIDVLVNNAGIQKVAPIDEFDFADFSRIVAISLDSAFHTIHAALPGMKERGWGRIVNIASAHGLRASPFKAPYVATKHAVVGLTKSVALEVAEQGITCNAICPGYVWTPLVAAQVADQARVHGMSEDDVVKKVMLAPQPTRRFVQPEEVAEMALYLAGDMARSITGTTISIDGGWTAK

SEQ ID NO: 11386 - protein, 783 aa, Agrobacterium tumefaciens
SGVSFMAVTVTAVILTLIGLALFGFGSQLVMLGGSFYYLLSGLAFLLTAVLLFKRNRAALHVYAVFIVATLAWAVWEVGFDWWQLGPRGGVIILIGLWLLVPWVRKPLGFSSPTGLSYSPNAWPLVLSVLASFAVAGYSMAQDPHDQAGSLPQEIASAAPVYGGEVPDGDWHQYGRTPYGQRYSPLTQVNVDNVSQLKEAWRYQTGDVKLPDDVGETTYQVTPLKIGNTLYICTPHNWAIAIDAATGKEKWKYDPNVGLNPDRQHQTCRGVSYYAEPNAAAGTACAQRVYLPTSDARLIALDAATGQVCTSFADQGVLHLEQGMKYNPAGYYYSTSPPVIAAGKIIIGGAVNDNYSTQEQSGVIRAFDVNSGALIWNWDSGNPQKTEPIAAGETYTTNSPNSWSVLSYDEGLGLVYVPLGNQVPDQLGMGRSENVEKYSSSIVALDINTGKDRWVRQTVHHDLWDMDVPAQPVLLDITKDGQTVPALVGPTKQGDIYVLDRRTGEPLLPITEEPAPTGAIPEDFTSPTQPTSALSFKPEPLQEKNMWGVSMFDQLACRIRFHQLNYKGRYTPPSLNGSIIYPGNFGTFNWGSVAVDPERQVMFGMPTYLAFTSQLVPRADIPPKGQDEKGSEQGLNRNDGAPYGVFMGPFLGPLKIPCQAPPWGYVAGADLRTGDVAYKHKNGTVYDMTPLPLPFKVGVPGIGGPMITKGGVAFLGAAVDNYLRAYDLTTGKELWEARLPAGGQATPMTYSLENGKQYVVMVAGGHGSVGTKPGDYVIAYTLP

SEQ ID NO: 11387 - protein, 437 aa, Agrobacterium tumefaciens
MRIVMIGSGYVGLVSGACFADFGHDVVCVDKMPEKIEALKSGHIPIFEPGLETIVANNAKAGRLSFTTDLSAAVANADVVFIAVGTPSRRGDGHADLGYVYAAAKEIAHALDGFTVIVTKSTVPVGTGDEVERIIREENPSADFAVVSNPEFLREGAAIEDFKRPDRIVVGLSDERARPVMTEVYRPLYLNQSPLLFTTRRASELIKYAANAFLAMKITFINEMADLCEKVGANVQDVSRGIGLDGRIGSKFLHAGPGYGGSCFPKDTLALAKTAQDYDAPVRLIETTIAVNDTRKRAMGRKVINAVGGDVRGKKIAVLGLTFKPNTDDMRDSPAIAIIQTLQDGGAKVVGYDPEGMANARHLMEDIDYAAGPYEAAEGADAVVIVTEWNQFRALDLPRLKAIMKSPVLVDLRNIYRTDEVAGHGFIYAAVGRPHEG

SEQ ID NO: 11388 - protein, 499 aa, Agrobacterium tumefaciens
DVKQEAAALLDKMGVARDLYTGGDMASFSPVTGEQIASLRTVSVEGVAAVVDKADAAFRTWRNVPAPRRGELIRLLGEELRAFKTDLGRLVSLEAGKIPSEGLGEVQEMIDICDFAVGLSRQLYGLTIATERPGHRMMETWHPLGVVGVISAFNFPVAVWSWNAALALVCGNSVVWKPSEKTPLTALAVQGIFERAAARFGDAPEGLSQLLIGDRAVGEAMVDYPKVPLVSATGSTRMGRDVGPRLAKRFARAILELGGNNAGIVCPSADLDMALRAIAFGAMGTAGQRCTTLRRLFVHDSVYEELVPRLKKAYASVSVGNPLESSALVGPLVDKAAFDGMQKAIEAAKAAGGVVHGGDRVDTGAADAYYVKPALVEMPKQVGPVLEETFAPILYVMKYSDLDQAIDAHNAVAAGLSSSIFTRDIQESERFLSSEGSDCGIANVNIGTSGAEIGGAFGGEKETGGGRESGSDSWKAYMRRATNTINYSKALPLAQGVSF

SEQ ID NO: 11389 - protein, 1227 aa, Agrobacterium tumefaciens
ADGASNAGVTIQQVGNSIFQNFAPPVREQSLLRKAVTAAYRRAEEECMAPLIEAATVTADQAKAIRDTARKLIEALRAKTKGTGVEGLVQEYSLSSHEGVALMCLAEALLRIPDTATRDALIRDKIARGDWKSHIGGGRSLFVNAATWGLVITGKLTSTVNDSGLSAALTKLIARAGEPVIRRGVDMAMRMMGEQFVTGETIGEAIKRSKPLEEQGFQYSYDMLGEAATTAKDAERYYKDYENAIHAIGKASAGRGIYGGPGISIKLSALHPRYARAQAERVMAELLPRVKSLMLLSKTYDIGLNIDAEEADRLELSLDLLEELALDKDLAGWNGLGFVVQAYGRRCPFVLDYIIDLARRSGRRIMVRLVKGAYWDAEIKRAQVEGLEDFPVFTRKVHTDVSYIACARKLLDARDLVFPQFATHNAQSMATIYHLAGPDFKLGDYEFQCLHGMGEPLYSEVVGKKKLDRPCRFYAPVGTHETLLAYLVRRLLENGANSSFVNRIADPAVPVDSLLEDPVAVVKAYAVPGAQHDRIAAPADLFGPERKNSAGVDLSNETTLSALDKTLKAGAATEWKAAAPQAGGQTRPVLNPGDHSDIVGHVTEPTEADVEAAMQRAAASSWPSMPVEDRAACLERAADAMQAEMPTLLGLIMREAGKSMPNAIAEVREAIDFLRYYAAEARRNFKSDEKSLGPVVCISPWNFPLAIFIGQVAAALVAGNPVLAKPAEETPLIAAQGVRLLHEAGVPQDAVQLLPGDGKTGAALVGSPLTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDQLSVDVGPVITAEAKGIIEKHIDGMRSLGHRIEQIALAGETGKGTFVPPTIIEMKSLADLKREVFGPVLHVIRFKRDHLDRLIDEINATGYGLTFGLHTRLDDTIQHVLSRVAAGNLYVNRNIIGAVVGVQPFGGRGLSGTGPKAGGPLYLGRMTEKAPKIDRIASQQDQAAVDLARWLDENGQTVAAEAARQAAALSGLGFETELAGPVGERNVYALHPRGKILLVPATEQGLYRQLAAALSTGNSVVIDNASGLEKAIYGLPASVTSRIVWADDWEKSAPFAGALVEGDAERVVAINRKIAALPGPLVLFQAATTDALSGESQPYTLDWLVEEVSVSVNTTAAGGNASLMSIG

SEQ ID NO: 11390 - protein, 605 aa, Agrobacterium tumefaciens
  unsure (1)..(605): unsure at all Xaa locations
FISERRXMTDTQGIAPAIAQALEKRGYKDLTPVQQAMLAPELANKDALVSAQTGSGKTVAFGIALATTLLSENTRFGQASAPLALAIAPTRELAMQVKRELEWLYEFAGVSIASCVGGMDIRNERRALERGAHIVVGTPGRLCDHIKRNALDLSSIRAVVLDEADEMLDLGFREDLEFILEESPDDRRTLMFSATVPRSIAKLAESYQKNAVRIATASEQKQHVDIEYRALLVSPSDRENAIINALRFYEARNAIVFCSTRAAVNHLTARLNNRGFSVVALSGELTQNERTHALQAMRDGRARVCVATDVAARGIDLPGLELVIHADLPTNSETLLHRSGRTGRAGQKGVSAIVVPVSQRRKAERLLEGAKVSAAWVRPPSVEEIVERDGARLLADPTLSEAVTDDERDFVNKLLEQHGAEKVAAAFVRLYHSGRSAPERHFRSRARQHSQAPPRQLRNNRKQRARRDRSDFSDSAWFSLSVGRKQSAEPRWLIPMLCRFGKITRQDIGAIRMQQTETFVELAADAVDRFTSAIGKDMMLEKGIRLKQMEGKPEMTGNAREDTRPATAQRKFTKSDNAGAPRDDRKADDKPWKKKKAFGDKPKYE

SEQ ID NO: 11391 - protein, 422 aa, Agrobacterium tumefaciens
MARIVMKFGGTSVANLERIHNVARHVKREVDAGHEVAVVVSAMSGKTNELVDWVQNAAKVAGTNAASFYDAREYDAVVASGEQVTSGLLAITLQSMGINARSWQGWQIPIRTDNAHGAARILEIDGSDIVHRMGEGQVAVVAGFQGIGPDNRIATLGRGGSDTSAVAIAAAVKADRCDIYTDVDGVYTTDPRIEPKARRMKKIAFEEMLEMASLGAKVLQVRSVELAMVHKVRTFVRSSFEDPDAPGMGDLINPPGTLICDEDEIVEQEVVTGIAYAKDEAQISLRRVADRPGVSAAIFGPLAEAHINVDMIVQNISEDGSRTDMTFTVPSGDVAKALRVLDENKGQIGFDVAQNETGLAKVSVIGIGMRSHAGVAASAFKALAEKNINIKAITTSEIKISILIDGAYAELAVRTLHSAYGL

SEQ ID NO: 11392 - protein, 733 aa, Agrobacterium tumefaciens
LLKRLREMMAEHLEPQERLDQIVRQIASNMVAEVCSVYVLRSDSVLELYATEGLNKDAVHLAQLKMGQGLVGTIAASAQPLNLSDAQAHPAFRYLPETGEEIYHSFLGVPILRSGRTLGVLVVQNKASRTYREDEVEALETTAMLIAEIVASGELKKITRPGVELDLTRAVSIDGDAYGEGIGLGHVVLHDPRIVVTNLLNEDADTEIRRLADAIGSLRLSIDDMLQRRDVPTEGEHREVLETYRMFAHDQGWVRRMEEAIRNGLTAEAAVEKVQSDTKARMMRLTDPYLRERMHDFDDLANRLLRQLIGFGGHNPAQDFPLDAIVLARAMGAAELLDYPREKLRGLVLEDGAVTSHVVIVARAMGIPIIGQATGIVALAENNDPIIIDGDDGQVHLRPMSDLQRAYEEKVRLRAKRQEQFRALRNVEPITKDGQKVNLKMNAGLLVDLPQLEESGADGIGLFRTELQFMIASNMPKGEEQEAFYRSVLRQAKGKSVTFRTLDIGGDKVVSYMRGQEEENPALGWRAIRLSLDRPGLMRTQMRALLRAASGAELRMMLPMVTEVSEIRAARDLLQKEVQHLSKVQPRAAEKAAIGAMLEVPSLMWQLDELMQEVDFVSGGSNDLFQFSMAVDRGNARVSDRFDNLGKPFLRILRDIVRAGEKHHTAVTLCGEMASKPLSAMALIGLGFRSVSMSPTAIGPVKAMLLGLDAANLAEELNAALDDHNSLESAREV

SEQ ID NO: 11393 - protein, 859 aa, Agrobacterium tumefaciens
MNIDKYSERVRGFLQSAQTFALAENHQQFSPEHVLKVLLDDEQGMAASLIERAGGDAKEARLANDAALAKLPKVSGGNGGLSLTAPLAKVFSTAEDLAKKAGDSFVTVERLLQALAIESSASTSASLKKAGATAQALNQVINDIRKGRTADSANAEQGFDALKKYARDLTEEAREGRLDPVIGRDDEIRRTIQVLSRRTKNNPVLIGEPGVGKTAIAEGLALRIVNGDVPESLKDKKLMALDMGALIAGAKYRGEFEERLKAVLNEVQAENGGIILFIDEMHTLVGAGKADGAMDASNLLKPALARGELHCVGATTLDEYRKHVEKDPALARRFQPVLVDEPNVEDTISILRGLKEKYEQHHKVRISDSALVAAATLSNRYITDRFLPDKAIDLMDEAASRLRMQVDSKPEELDELDRRIIQLKIEREALKQETDQSSVDRLRKLEDELADTEEKADALTARWQAEKQKLGHAADLKKRLDEARNELAIAQRNGQFQRAGELTYGIIPGLEKELAAAEARDSSGAGSMVQEVVTPDNIAHVVSRWTGIPVDKMLEGQREKLLRMEDELAKSVVGQGEAVQAVSKAVRRSRAGLQDPNRPIGSFIFLGPTGVGKTELTKSLARFLFDDETAMVRLDMSEYMEKHSVARLIGAPPGYVGYEEGGALTEAVRRRPYQVVLFDEIEKAHPDVFNVLLQVLDDGRLTDGQGRTVDFKNTIIIMTSNLGSEFMTQMGDNDDVDSVRELVMERVRSHFRPEFLNRIDDIILFHRLRRDEMGAIVEIQLKRLVSLLADRKITLELDEDARSWLANKGYDPAYGARPLKRVIQKSVQDRLAEMILGGEIPDGSRVKVTSGTDRLLFKV

SEQ ID NO: 11394 - protein, 246 aa, Agrobacterium tumefaciens
SNRLQGKIAVITGASKGLGAAIARSFAAEGASVVVNYSSSKSAAEAVVEEIIDAGGTAIAVKADMSEPAEVEELFAATNAAFGRVDILVNNAGVYDFQPLENLSIDLFRKHMELNVFGYLLAIKEAVKYMAEGGSIVNMSSTVTIFGPENASVYTASKGAIDGLTRALSNELAPRKIRVNAIKPGVVDTDGVQAGGFLHFDFGPMIMAQTPLKRLGVPEDIIPAAIFLASDESSWTTGEFFILAGG

SEQ ID NO: 11395 - protein, 321 aa, Agrobacterium tumefaciens
EGMKAAVYDQAGPPDVLTYRDVADPIVGPDDVLIAVEAISIEGGDLINRRSTPPPGRPWIVGYAASGRVVGAGANVRDRKVGDRVTAFDMQGSHAELWAVPAIRTWLLPSGVDAASAAALPISFGTAHHCLFARGGLLRNQTVLVQAAAGGVGLAAVQLAAQAGATVIAVSSGESRLQRISSLGADHVVDRSMGNVVEAVRQNTGGKGVDLVIDPVGVTLSASLTLLAPEGRLVFVGNAGGGSLTIDLWPAMQSNQTLLGVFMGPLLERPQVRATVDEMLQMLDRREIRVMIEKTFPLSEAAAAHDFAENAKPLGRVIMEP

SEQ ID NO: 11396 - protein, 448 aa, Agrobacterium tumefaciens
YINGRFVSPDGRKTIAVSNPANGDKLAEIVCGNEEDVDQAIKAARAAFGKWSKLSGHARARYLYAIARHIQKRERFLSVLETMDNGKPVRETRDIDIPLVARHFYHHAGWAEMVEDEFHGFSPVGVCGQVIPWNFPLLMLAWKIAPALAAGNTVVLKPADLTPLTAIAFAEICHEVGLPAGVVNIVQGDGSTGAAICGHDGVDKVAFTGSTKVGRVIREQIAGSGKKLSLELGGKSPFIVFEDADLDAAVEGVVDAIWFNQGEVCCAGSRLLVQEGIAEKFYARLKKRLETLRVGDPLDKSTDVGAIVSATQVKRITDLVRKGVEEGGELWQSSNPLPPTGNYVAPGFFTDVDQASTVCQVEIFGPIAAATTFRTPDEAVSLANNTRYGLAASIWSENINVALDLAARVKAGVVWINCTNMLDAGAGFGGYRESGFGREGAREGLYEY

SEQ ID NO: 11397 - protein, 298 aa, Agrobacterium tumefaciens
SKKIGVVGSNMVDLITYVDRMPGPGETLEAPTFEMGCGGKGANQAVAAARLGAEVMMVTRVGDDVFADNTIRNLASFGVDTRHVVKVSGKSSGVAPIFVEQSGENSILIVKGANADLLPVEVDKAAADLKECGLILMQMEVPVETVYHTIEFAAQNGIETILNPAPAAANLDPERIRQVTFLVPNESELALLSGLPTDTDEDIVRAARSLIARGIRTVIVTLGARGARMITSDEIVNIEPVKVTPRDTTGAGDAFIGSFARFYAETREVVSSLKKASLYAAHSITRPGTQKAYASIDE

SEQ ID NO: 11398 - protein, 483 aa, Agrobacterium tumefaciens
FPALHEAIMTENLIELRHIGKRFGGVKALDDVSLSIRPGEIHCLAGENGSGKSTVIKIMSGVYTPEDGEILIDGKPVGKLDPVKSVHHGIQVIYQDFSLFGNLTVAENLAINTFLMEGRKTVDWRHVRELAQKALDRLGVSIDLDTDVETLPTSGKQIVAIARAVMADARLIIMDEPTTALTRHEVDALFKIVRDIQAQGIAVLFVSHKMREMLEISERLTVFRNGKKVAEGPIAEFDEPAITRAMTGQELTAHSYKWAPQEGADTPVLEVRNLSVPASVENTDLTLRPGEIVGISGLIGSGRTELALALFGMRPDFTGSVRLAGREVHPRTVQEGIACGVAYVPEDRLTEGLFLTQSIERNIIVTSIEKFVRGLFINRKKADETTREMFSAMQIVAPGPHTPVNHLSGGNAQRVVLARWLLTGAKVLILNGPTVGVDVGSKAQIHTIIRKLAEKEGLAVLMISDDVPELVQNCNRVLVMHRG

SEQ ID NO: 11399 - protein, 450 aa, Agrobacterium tumefaciens
SDVLVVFGATGDLAYKMIFPSLYAMVKRGALQTPIIGVAFDDWPREQLIARARDAVANHLDKIDEAVFEKFAAQLTYVSGDYRNEATFEKLRTALGGHQHPLYYLAIPPSLFETVVTGLNRAGIAASARLMVEKPFGRDLASAEALNEALHAVFAEDAIFRIDHFLGKEAIQNLLYFRFANAFLEPVWNRDHVESVQITMAEDFGIRGRGKFYDEVGCIRDVIQNHLINVLLLLAMEPPATSASDDLVDEKVQILKAMPPLTRDDVVRGQFRGYLDEPGVASASNRETFAAARFRVATWRWNGVPFFIRSGKNLPAHATEVVVRFKRPPIALFGDVETTPANYVRFRLGPDIAIGIGARRKAAGDGMRGEAVELGAVDDGIGDMAPYERLIGDAMAGERQLFTRQDAAELAWKIVEPILDDPAVPPVYEVGSWGPAEMAGFGPPGGWVDP

SEQ ID NO: 11400 - protein, 688 aa, Agrobacterium tumefaciens
APGAPGIDARWTSSAKNGVGTALSNTSPIWFTLSHGILNEVYYPRIDSACIRDLGLVVTRDDGYFSEEKRDCTSLTQPFESGIPAFHVTNTATDGAYRIEKQVITDPARACVLLHVSFSPLKGKMGDYRVSVLLAPHLVNAGNLNSAWIGDYEGRRVLFAVGRSRYLALVCDGPWRAASAGFVGVSDGWQQLRRHGRLIEEFQRADDGNVSLAAEIDFSDAHDTATLALGFGQTEYEAASCAVASLKSGFRRAHDAYIANWRGWQDSLCPLDRDTHHGVNSYRVSTAVLAAHRAADRPGAVVASLSIPWGASKGDDDLGGYHLIWPRDLVEAAGGFLAAGDHDEALAILDYLRQVQQPSGRWPQNLWLDGKPYWPGVQMDECAFPILLADMLHRHGHLDHAARADYMPMIRSAAAYILANGPTTGEDRWEEDAGYSPFTLAVEIAALLAAADLLDMEGDAAEATHLRQTADCWNEQIERWTFAGDQTMCAQLGISGHYVRIASPGTTDAVQLSGMTPILNQTPDRAFLPTSDVISPDALALVRFGLRAPDDPHILATVKAIDHCLRAELPQGPVWYRYTGDGYGEHADGTAFDGTGQGRPWPLLTGERAHYELAAGRRGAAEALLTTMEKSAGQSGLFPEQVWDQPDLPDRELFYGSPSGSAMPLVWAHAEHIKLLRSLADGSVFDMP

SEQ ID NO: 11401 - protein, 258 aa, Agrobacterium tumefaciens
GRLTGKRALVFGAGSSGPGFGNGKAAAVQFAREGARVACVDLCADAAEETAEIIRGEGLEAIAAAADVTELQSVSATVDRTCEAFGGIDILHNNVGVTHMGGPVELDEESFRASVDLNIGSVYRTSKAVLPVMLARGGGAIVNISSLASIRWTGYPYFAYYAMKAAVNQATVALAMQYARQGIRANCILPGMIDTPLIYKQISNQYASVEEMVAARNAAVPVGRMGDAFDIARAAVFLASDEAKFITGVCLPVDGGQS

SEQ ID NO: 11402 - protein, 387 aa, Agrobacterium tumefaciens
MSKAQIVGWAHSPFGKSALENTEQLMASVVAPAIDHAGVDVSDIDGIFVGVMNNGFSKQDFQGALVAMGDERLAYTPAVRFENACSTGSAALYSAMDFIEAGRGRIALVVGAEKMTALPTADVGEILLSACYRAEEANIPGGFAGQFGRIAQAYFQRYGDRSEELAMIAAKNHANGAVNPYAHMRKDFGFDFCNTASDKNPYVAGPLRRTDCSLISDGAAAIILADEETAATLNRAIGFRGRKHVNDIMALTRRDPLAFEGARRAWAGSLELAGATLDDLSFVETHDCFTIAELIEYEAMGLAKPGEGYRVVQDGTALKTGRLPINPSGGLKSKGHPVGATGVSMHVMAAMQLMGEAGDMQIPNSSLAGVFNMGGTAVANYVSIMER

SEQ ID NO: 11403 - protein, 483 aa, Agrobacterium tumefaciens
WSWAQMEARVDAMAHALETEFGVRKGDRILVQSSNNNQMFESMFACFRVGAVWVPTNYRQSPDEVAYLAKASGARGMICASAFPDHAKASHEASTIDFSIAIGTAEFGEDYDAIVARHMGRKVKSQAVDRDDPCWFFFTSGTTGRPKAAVLTHGQMAFVITNHLCDLMPGTGPDDASIVVAPLSHGAGIHQLVQVAHGAKTVLPAAEKLDVPAVWALIEKWRITNAFTVPTILKMLVEDPSVDRFDHSSLRYVIYAGAPMYRADQKRALAKLGPVLVQYFGLGEVTGNITVLPPSFHNAEDGPETRVGTCGFDRTGMEVQIQNDAAEEVGAGETGEICVIGPAVFAGYYDNPEANAKAFRNGWFRTGDLGHRDENGFLYITGRASDMYISGGSNIYPREIEEKILMHPDISETAVLGVPDAVWGEVGVAVCVAREGADIAAIDLKAYLEGKMARYKLPKSVVFWDAMPKSAYGKITKKMIREE

SEQ ID NO: 11404 - protein, 192 aa, Agrobacterium tumefaciens
GIVCDVADEASIEMAFAALTANGADHAVDLVAVVNSAGIGIDKLSVDTSVEEFRRIVDVNLVGSFAVARAAARYWLERDVAGSIVNISSVSGMCGNRGRSAYGASKGGVNLLTMVMANELGQSGIRVNAIAPGPVDTPLTQAVHTENVRDQWHSRVPMHRYGRTDEIASAVAFLVSDDASYINGQVLAVDGG

SEQ ID NO: 11405 - protein, 430 aa, Agrobacterium tumefaciens
SDRLRQRARNIIPGGAHTYAKGDDQYPVLSPGFIERGYGCHVWDVDGNEYIEYGMGNRAVGLGHAYADVVEAARAELYRGCNFTRPSKIEVDCASTFLDTVQTAEMVKFCKNGSDATSAAIRLARAVTGRDLIARCSDHPFFSTDDWFIGTTEMNAGIPEAIQNLVLGFSYNDLASARSLFDRFKGRIAAFILEPSRGDPPRDQFLHKLQKLCHENGALFILDEMITGFRWDAGGAQKTYDIVPDLSCFGKALGNGFSISALAGKREFMERGGIDQTDAPRVFLLSTTHGAETHAMAAAIATMKVYTHEPVVPHLVRQGNSLRAAISQIAIAHGLDSYFGIQGHSACLSYFTLDQTGKPSQAFRSLFLQETIRRGLLAPSLVVSYTHEDEDIAKTLDAIDGALVVYRKALEYGVDKFLTGRPSDVVFRRF

SEQ ID NO: 11406 - protein, 252 aa, Agrobacterium tumefaciens
MKVVLFCGGRGTRIREYSESVPKPLIPLGSQPIMRHVMQYYARYGHEDFILCLGYKAHVIKEFFLNSRPESYADCVISSPGRVELLEELPRDWRVSLIDTGIWRNIGERLWAVRHHLKGEKMFLANYSDGLTDVDLDDMIAQFEKSDKLACFLAVRPPLTYHLAEIDESGKVREFRSSETSDMWINGGYFLMRPEIFDYMREGEELVLEPFSRLISEDKLMAYKHEGFWRSMDTLRDWQTLEAMVERGDMPW

SEQ ID NO: 11407 - protein, 341 aa, Agrobacterium tumefaciens
KRALIIGVTGQDGAYLSELLLAKGYMVHGLKRRSSSFNTGRIDHLYQDPFEEDLRFRLHFGDLTDATNLCRVIQEVQPDEIYNLGAQSHVQVSFETPEYTANADALGTLRLLEAMRILNLGDRCRFYQASTSELFGGMGTVAQHEGTPFYPRSPYAAAKLYAYWMTVNYRESYGFHASNGILFNHESPIRGETFVTRKITRGVAAIERGLMSKLRLGNLDAKRDWGHARDYVEGMWRIVQQEIPEDYVLATGEAHTVREFVELAFGVVGKTIEWHGDGSDEVGYDAKTGNSIIEIDPRYFRPAEVDFLLGDPSKARRKLDWSHSTSFCDLVQEMVEADLRL

SEQ ID NO: 11408 - protein, 275 aa, Agrobacterium tumefaciens
FVKNKDGVEIYFKDWGPKDAQPIVFHHGWPLSSDDWDAQMLFFVQNGYRVVAHDRRGHGRSQQVSDGHDMDHYAADASAVAEHLDLRNAVHIGHSTGGGEVARYVAKFGQPQGRVAKAVLVSAVPPLMLKTPSNPGGLPIEVFDSFRKGVAENRAQFFLDVPAGPFYGFNRPDAKIYPGVIRNWWRQGMMGSAKAHYDGVKAFSETDQTEDLKAITVPTLVLHGDDDQVVPIADSAELSVKLLKNGTLKVYKGYPHGMLTTHADVINPDLLAFVK

SEQ ID NO: 11409 - protein, 475 aa, Agrobacterium tumefaciens
LHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVC

SEQ ID NO: 11410 - protein, 467 aa, Agrobacterium tumefaciens
MTIDIKNIAEMDRNAVLHPFTQLKDFASGKLGEPTIVETGKGIRIQDAHGKQLIDGFAGLYCVNVGYGRTEVAEAISRQAYRLAYYHSYAAHTTDELAILSDRLVRMAPGKMSKVFYGMSGSDANETQAKLVWYYNNLRGKPQKKKIISRERGYHGCSVVAGSMTGMSFYHDHMDLPRVGILHTGVPHHYWGAEAGETELEFSKRRAAELEALILREGPDTIGAFIAEPVLGTGGITPPPEGYWPAIQEVLKKYDVLLIADEVITGFGRTGSMFGSQHYGIEPDLITVAKGLTSAYFPLSGAIVGEKVYTVMEDGADRVGAFSHGYTYSGHPIGAAAANAVLDIVEKEDLPGNAQAVGSYFQEQLKAKFAQLPIVGEVRGVGLMGAIEFVADREKKTRFAPHLTVGARVSKAARNGGLIARAMPHGDILGFAPPLVTTKAEVDEIIAIAEAAVRTVMDDLVQAGEKI

SEQ ID NO: 11411 - protein, 356 aa, Agrobacterium tumefaciens
GENMRALRFHAAKDLRIEDIAEPKRPGPGQVLVRNRFVGICGTDLHEYSYGPIFIPTEPHPFTGAHGPQILGHEFGGVVEAIGDGVTSVNVGDRVSIQPLIMPRSGDYFADRGLFHLSTQLALVGLSWDGGGMAEAALVNEYNVQKIPDEMTDEEAALVEPSAVAVYACDRGGVTAGNSVLVTGAGPIGMLTLLAARAAGATQLFVSDLNDARLELARNVIRDVITINPKRDNVGDVVRSATEGKVGCDVAIECVGNEHALKACVDAVRKQGVVVQTGLHPHENPIDWFQVTFRDLEIKGSWAYPTHYWPRVIRLIASGLLPATKIVTKRITLDTAVTEGFDALLDPAGTHLKILI

SEQ ID NO: 11412 - protein, 583 aa, Agrobacterium tumefaciens
DAYRHVLGFVFNHWSHRKALVGFIIVLVVASTLAEVMVPVFSGRIVDAIAGDNGGANAGDGALRAFVIVVALGFTSVVLRWFIFNGIIRLTLKTMADVTNNGFHKVQRFSTDWHANSFAGSTVRKITRGMWALDSLNDLLLVALLPSIVMLVGATVVLGSYWPVMGLIVGLGSLIYIGVTVGLSMGYVSPAARLANAWDTRLGGALADAISCNAVVKAFGAETREETRLGHVLVKWDNRTRRTWKRGTLNGTIQSFMMVSMQAGILGTGLIMWQKGLATAGDITFVLAMFFVLQGYLRDVGQDIRNLQRAVNDMEELVLLDKMPLGVEDRPDAKRINIGKGEIVFDHVTFQYGAHATPLYEDFSVTIKPGERVGLVGHSGSGKTTFVKLIQRLYDIKAGAIRIDGQNIADVTQASLRGQIAIVQQEPILFHRTLAENIAYGRPDASRREIEQAAKQASAHDFIMSLPKGYETMVGERGVKLSGGERQRVAIARAFLADAPVLILDEATSSLDSESEVQIQQAMERLMDGRTTLVIAHRLSTVRALDRLLVFDKGRIVEEGDHQALIRLHDGIYRRLFERQALE

SEQ ID NO: 11413 - protein, 967 aa, Agrobacterium tumefaciens
  unsure (1)..(967): unsure at all Xaa locations
MALVTEFDYGTPKSNATDMVTLTIDGRQVTVPTGTSIMRASREAGIDVPKLCATDMVDAFGSCRLCLIEVEGRNGTPASCTTPVAAGLVVHTQTERLKQIRKGVMELYISDHPLDCLTCAANGDCELQDMAGAVGLRDVRYGYEGDNHVKSRTGGGDINARWMPKDESNPYFTYDPSKCIVCSRCVRACEEVQGTFALTIEGRGFESRVSPGAHEAFLDSDCVSCGACVQACPTATLTEKSVIEIGQPEHSMVTTCAYCGVGCSFKAEMRGEELVRMVPWKDGQANRGHSCVKGRFAYGYATHRDRILNPMIRENIGDPWREVSWDAAFAYVASEFRRIQGKYGRESIGGITSSRCTNEETFLVQKLVRAGFGNNNVDTCARVCHSPTGYGLGQAFGTSAGTQNFDSVEQSDVVLVIGANPTDGHPVFGSRLKKRLRQGAKLIVIDPRRIDLVRTPHVEAAFHLPLLPGTNVAVLTALAHVIVTEGLFNEAFIRERCDWSEFEDWAAFVAEPQHSPEETERFTGVPAEDCVVRPAFMPPAVMARSYYGLGVTEHSQGSTTVMAIANLAMVTGNIGRPGVGVNPLRGQNNVQGSCDMGSFPHELPGYRHISDDATRDVFEKLWGVKLNNEPGLRIPNMLDAAVDGSFKGIYIQGEDILQSDPDTKHVSAGLAAMECVVVHDLFLNETANYAHVFLPGSTFLEKDGTFTNAERRINRVRKVMSPKNGYADWEVTQKLAQAMGLTWNYTHPSEIMDEIAATTPSFASVSYAYLEEKGSVQWPCNEKFPEGSPIMHVDGFVRGKGKFIRTEYVATDERTGPRFPLLLTTGRILSQYNVGAQTRRTENVVWHEEDRLEIHPHDAEQRGVKDGDWIKLVSRSGDTTLRALITDRVAPGVVYTTFHHPGTQANVITTDFSDWATNCPEYKVTAVQVSPSNGPTEWQEEYDALARQSRRIAGKLEAAEXSGAGPV

SEQ ID NO: 11414 - protein, 237 aa, Agrobacterium tumefaciens
MTASIFSGVIPALMTPCRQDRTPDFDALVRKGKELIADGMSAVVYCGSMGDWPLLTDEQRMEGVERLVKAGIPVIVGTGAVNTASAVAHAVHAQKVGAKGLMVIPRVLSRGSVIAAQKAHFKAILSAAPEIPAVIYNSPYYGFATRADLFFALRAEHKNLVGFKEFGGPADMRYAAENITSRDDEVTLMIGVDTAVVHGFVNCGATGAITGIGNVLPKEVIHLCKLSQAAAKGDADA

SEQ ID NO: 11415 - protein, 446 aa, Agrobacterium tumefaciens
MARDPKITFIGAGSTVFMKNIIGDVLQRPALSGATIALMDINRERLEESAIVVNKLISTLGAKAKAETYTDQKKALAGADFVEVAFQIGGYEPCTVTDFEVPRKYGLRQTIADTLGVCGIMRGLRTVPHLWKICEDILAVCPNAVMLQYVNPMAINTWAIAEKYPTIRQVGLCHSVQGTAMELAHDLDIPYEEIRYRSAGINHMAFFLEFEHRQPDGSYRNLYPDLVRGYREGRAPKPGWNPRCPNKVRYEMLTRLGYFVTESSEHFAEYTPYFIKEGRDDLIEKFGIPLDEYPKRCIEQIERWKGQAAAYRSAEKIEVKQSKEYASSIINSVWTGEPSVIYGNQRNNGCITSLPSDCAAEVPCLVDHNGVQPTFIGELPPQLTALMRTNINVQELTVRALMSENRAHIFHAAMMDPHTAAELDLDQIWSLVDDLLLAHRDWLPEW

SEQ ID NO: 11416 - protein, 489 aa, Agrobacterium tumefaciens
  unsure (1)..(489): unsure at all Xaa locations
SFKIAIIGAGSVGFTKKLFTDLLCVPEFRDIEVALTDISQHNLDMIKAILEKIVEANGFPVKVTADTDRRRALEGAKYIISCVRVGGLEAYADDIRIPLKYGIDQCVGDTICAGGILYGQRNIPVILDFCKDIREVAAPGAKFLNYANPMAMNTWAAIEYGKVDTVGLCHGVQHGAEQIAEILGAESPSELDYICSGINHQTWFIDLRLNGRRIEKDELVAAFEAHPVFSQQEKLRIDVLKRFGVYSTESNGHLSEYLPWYRKRPEEIARWIDMSDWIHGETGGYLRHSTETRNWFETEFPQFLASAAKPIEPAKRSNEHASHILEALETGRVYRGHFNVKNNGVITNLPSDAIIESPGFVDRFGINMVSGITLPEACAATCMASINVQRMSVHAAVSGDIDLLKLAVLHDPLVGAVATPEEVWQMVDEMVVAQARWLPQYADAVPAAKERLAKSTVKTRDWAGAARRNVRSIEELRAEKSALKKAVXG

SEQ ID NO: 11417 - protein, 436 aa, Agrobacterium tumefaciens
DRAHLVMLRETGILDAETAAKIAGALEDIDRTIEPSELVYTGEVEDFFFLIEKELKARIGVDVAGRLHTARSRNDIDHTLFKIGLKDKIDTLTAKARVLLKALIDAAERNQSTLIVAYTHGQPAQPTTFGHYLSAAIEVLIRDIERFTEARHIVDLSPMGAAAITTSGFPIDRARVAELLGFAAPLRNSYSCIAAVDYTTATYGAIELMFLHLGRLIQDFQFWTSFEVGQIYVPNSLVQISSIMPQKRNPVPIEHLRHLASQTFGRARTMLDVMHNTPFTDMNDSEGETQSMGYEAFASAGRVLDLLASLVGQISIDPERVDQNIRRSCITITELADSLVRIEDLSFRQAHEIAATVAKSVVALKGDLPNDGYQPFLGAFSGLTGRETGIDEEKFRQIVSPEHFVAVRSRFGGPAPEPMREAFAAYRGKLGAFEAE

SEQ ID NO: 11418 - protein, 278 aa, Agrobacterium tumefaciens
GRIYCDLIFTGLEELPVLGRELFARDMEIAAGGGAFIAAAHFAHIGRPVALLARLGTDTFSRDIGEKMAQSGVDLQFLEHATDAGPQVTVATVVGQDRAFLTRRAGAARPSTLDAAFAWDKARHLHIAEFATLQEIPDLVSRAKASGLSVSLDPSWDAALIYDKGLLKACAGVDVFLPNLEEAEAITGRSEPEAAIRTLAEAFPIVALKGGAEGAWVSSAAGLHHRAAQKVPVIDTTGAGDAFNAGFLDAWLQRQDEQQCLKAGIAAGSLAVQAAGGA

SEQ ID NO: 11419 - protein, 501 aa, Agrobacterium tumefaciens
RPNILILMADQFNGTFFPDGPADFLHAPHLKALAERSVRFANTYTASPLCAPARASFMSGQLPSRTRVYDNAAEFASDIPTYAHHLRAAGYYTGLSGKMHFVGPDQLHGFEERLTTDIYPADFGWTPDYTKPGERIDWWYHNLGSVTGAGVAEITNQMEYDDEVAYHATRKLYDLSRRLDDRPWCLTVSFTHPHDPYVARRKFWDLYEDCAALDPQSKAIAFEEQDPHSKRLLEACDHEAFEITGEQIRRARRGYFANISYIDEKIGEILDVLNATRMEDTIILFLSDHGDMLGERGLWFKMCFFEGSARVPLMIAAPGWQPALIDAPVSTLDVTPTLCGLAGLDITSLKRWTDGEDLAALAAGTGGRGPVPMEYAAEGSITPLVAIRDGRYKLSVCEADPPLLYDLETDPQELTNLAHDPAFSDVLSSLSAEMGRRWQLPVFDAAVRESQARRWVVYKALRNGAYYPWDYQPLQKASERYMRNHMDLNVLEENQRFPRGE

SEQ ID NO: 11420 - protein, 477 aa, Agrobacterium tumefaciens
LFIGGDHCAAANGKRFERNNPITGDAVTSAAAASVEDATNAADAAAAAFPKWSATTPGERRRHLLAAAEALRAAGPQIIQAMMEEIGATEAWAGFNVMLASDMLVEAASLTTHITGEVIPSNRPGTMAMALRQPAGVVLSMAPWNAPVILGVRSIATPLACGNTVVMKTSELCPRTHALIIEAVASAGLPKGVLNAISNAPDDAAKIVETLIAHPAVRRVNFTGSTRVGRVIAETAGRYLKPALLELGGKAPFIVLDDADIDAAVAAAAFGAYMNQGQICMSTERIIVLDSIADTFVEAFAKKAASLTAGDPREGKTPLGSLVSAEAASRIRVLVDDAVSKGARRVAGGGGDGTMLDAIAVDGVTPAMRLYSEESFGPVVSIIRAGSIDEAVSIANESEFGLSAAVFGRDQARALSVAARIESGICHVNGPTVHDEAQLPFGGVKASGYGRFGGTAGIAEFTELRWVTLQDGPLHYP

SEQ ID NO: 11421 - protein, 725 aa, Agrobacterium tumefaciens
EGEMDATSKPAGKCPVMHGGNTASGKSVTEWWPNALNLDILHQHDTKTNPLGTSFNYREALKTLDVEALKADLRALMTDSQEWWPADWGSYVGMMARVTWHAAGSYRVTDGRGGANTGNQRFAPLNSWPDNVNTDKGRRLLWPIKKKYGNKISWADLIALAGTIAYDVAGLKTFGFAFGREDIWAPEKDTYWGDEKEWLAPSDGRYGDVSKPETLENPLAAVQMGLIYVNPEGVNGKSDPLATAAQMRETFARMGMDDEETVALTAGGHTIGKSHGNGSAANLSPDPEAAGPEYQGLGWINTKGRGIGRDTVVSGIEGAWTSEPTKWDNGFFDMLFKHEWTLTHSPAGASQWAPITIAEEDKPVDVEDASIRTIPMMTDADMALKVDPIYREISLKFKDDQDHFSDVFARAWFKLTHRDMGPKSRYVGPDVPAEDLIWQDPIPAGSTSYDVAAVKAKIAASGLSVADLVSTAWDSARTFRGSDKRGGANGARIRLAPQKDWEGNEPARLSRVLSVLEPIARETGASIADVIVLAGNYGVEQAAKAAGFDIAVPFAAGRGDASAEQTDADSFAPLEPLADGFRNWVKKDYVVSPEELLLDRAQLLGLTAPELTVLIGGLRVIGANYGGAAHGVFTDKPGALTTDFFTTLTDMAYSWVPTGNNLYEIRDRKTGAARYSATRVDLVIGSNSILRAYAEVYAQDDNREKFARDFIAAWTKVMNADRFDL

SEQ ID NO: 11422 - protein, 286 aa, Agrobacterium tumefaciens
QDPRSQYPRPPFSTPTQEMPGLVTNMTPFPDHGEKSYKGTGKLAGRKALITGGDSGIGRAVAIAFAREGADVAISYLPEEESDAEEVVALIEAEGRVAVALPGDITDEAWCRELVEKAVSDLNGLDILVINAARQQYREDIEELSTDDFDRTMKTNLYALHWIAQAAVPYLKPGASVITTASIQAYEPSAILLDYATTKAGIVAYTKALAKQLIEKGVRANAVAPGPFWTVLQPSGGQPDEKVKNFGKDSDFGRPGQPVELAPVYVLLASQDASFINGEVYGVTGG

SEQ ID NO: 11423 - protein, 654 aa, Agrobacterium tumefaciens
VAYLDKLNEQQRKAVEHGVGLADGETAGPLLIIAGAGSGKTNTLAHRVAHLIVNGADPRRILLMTFSRRAASEMSRRVERICKQVIGANSAIMTDALAWSGTFHGIGARLLRIYAEQIGLNIDFTIHDREDSADLMNLVRHELGFSKTESRFPTKGTCLAIYSRAVNSQTPLKDILRQHYPWVADWQSELKELFAAYVEAKQIQNVLDYDDLLLYWAQMVSDPILADDIGNRFDHVMVDEYQDTNRLQASVLMAMKPGGRGLTVVGDDAQSIYSFRAATVRNILDFPACFNPAADIITLDRNYRSTQPILAAANGVIDLARERFTKNLWTERQSLERPKLVTVKDETEQANFIIDQILANRETGTTLKQQAVLFRTSSHSGPLEVELTRRNIPFVKFGGLKFLDSAHVKDMLAVLRFAQNPRDRVAGFRLLQMLPGIGPKKAGNILDTIAPDPEPLLALAEIPPPPKTGDDWTAFTQLLVGLRRGPNGWPGEIGLARLWYEPHLERIHEDADTRKADLQQLEQIAGGYPSRERFLTELTLDPPDATSDQAGVPLLDEDYLSLSTIHSAKGQEWRSVFILNVVDGCIPSDLGVGTSQELEEERRLLYVAMTRAKDNLSLITPQRFFTGGQSSQGDRHVYAARTRFIPATLLQFFE

SEQ ID NO: 11424 - protein, 284 aa, Agrobacterium tumefaciens
KGIILAGGSGTRLHPMTLAVSKQILPVYDKPMIYYPLTTLMLAGIREILIISTPHDMPLFQNLLGDGSKWGLSIEYAVQPSPDGLAQAYMIGADFVAGSPSCLILGDNIYYGHGLPDLLESGTSVNDGATVFAYHVNDPERYGVVHFDSEMRALSIEEKPLKPKSNWAVTGLYFYDADVVDIAANLKPSPRGEYEITDVNRVYLDRGKLKVSIMGRGYAWLDTGTPDSLLEAGEFVRTLEKRQGFKIACPEEIAMTKGFITHADFALLAENAGKGDYGVYLRKL

SEQ ID NO: 11425 - protein, 537 aa, Agrobacterium tumefaciens
LSAWIMRDIVNSVYLKQGFDVVLEIAFAVAAIFIVKGLATFVQSYYLSKAGNSIVAEQQRKIYDRLLKQGVSFFQNLPSSELLVRVTYNAQAARSVIDTIVTSFVRDLFSLLGLIIVMFAQNFLLSAISMIIGPVAIFSVRLVLRRVRKIMEAELASLGEIVNVVQETSIGVRVIKAFSLEKLMRQRMNKAVSDVEHRANGIAKLEAATSPIMETLSGLAIAVVIAVSGYTVLEKGGSPGDLMAFITALLLAYEPAKRLARMRVQIEGGMIGVRMMFEVLDAPLTLAEKKDAQPLPKASGNVELKNVSFEYVANQPVLKDVSVLFEGGKMTALVGPSGSGKSTIINLMMRLYDPQSGSVEINGMDLRDVSFASLREHVSYVGQETFLFSGTVKHNISVGRDNATDEEIIAAAKAANAHDFIMNMPDGYDSKLGENGSGLSGGQRQRVAIARAMLRDADILILDEATSALDSESEALVRDALERLTLNKTSIVIAHRLSTINRADKIVVMDNGQVVEQGSRRELLATDGLYKRLHSIQ

SEQ ID NO: 11426 - protein, 350 aa, Agrobacterium tumefaciens
VATIAAKHADDVDVTGRFPQEAVDALRRERLLGIQVPSSLGGEGASIQEIADICARLGQACSATAMIFAMHHIKLSSLVEHGVDSTWHPGFMRRVAGEQLLLGSATTEGGIGGNLRNSICAIEVEGDSCRLEKDATVISYGSNADAILITSRAHKDAAPADQVMTVFLKNQYTLEKTHVWDTLGMRGTCSDGFLFRGEAPAAQIFPKPFAEIAAQSMLASSHLLWSAVWYGIASDAVLRAQSFVRAAARKSPGTAPPGAIRLAEVSTKLQVVKSNIIAGIKAYEDTKSDPEKLMSMAFAVAMNNVKICSSETILEIIDHAMLVCGIMGYKNGTPYSLGRHLRDAHSARLM

SEQ ID NO: 11427 - protein, 438 aa, Agrobacterium tumefaciens
TLLSSIENKSAKAGVIGLGYVGLPLAMTVAKAGFKVVGFDIDPGKITAIEAGRSYIEAVSDEVLASVRQDDGFVATSDFLRLAECDVIAICVPTPLTKYREPDLSYVEKTCRDIAAHLRKGQLVVLESTTYPGTTDGVVKTILESTGLVSGVDFFIGFSPEREDPGNRDFETSTIPKVVAGDGEAAGKLMAAFYGSVVKKIVPVSTNATAEAVKITENVFRAVNIALVNELKVVYEAMGIDIWEVIDAAKTKPFGFMPFYPGPGLGGHCIPIDPFYLTWKSREYELPTRFIELAGEINTGMPRHVVGRVAEALDIHSGKALSRSKVLVVGLAYKKNVPDIRESPSLKLLELIQERGGDAAYFDPYVAEIPKTREYSHLMGMKSISWDRETIGSFDAVLVATDHDNVDYAALSDWAPLIIDTRNVFARRDIAAKHIIKA

SEQ ID NO: 11428 - protein, 609 aa, Agrobacterium tumefaciens
  unsure (1)..(609): unsure at all Xaa locations
FTFTLVNLSHEPLKDFRIVYTSLTRTVDKPVCGNAIYLRRNANFHEFAPPSGFVLEPGKSWRFTVDGLLRPARHRTDGAKSAYVSLADGTHRAVDVGTXCWMGATASRRRCCFPKASSICPSPSSPGQLKSMAEPGEGFPVALFPMEDARAEEALAVETVLSLFRRLFAVGHVPFSLAPVHEGKPLRFKQHSGLEAEGYRIAFSNEAVTVEYSAAAGLQYGLTVLAQLLHGARIDPKFRFPASGTISDAPRYSWRGCHLDVSRQFYPTDDVLRLIDILAWLRMNRFHWHLTDDEAWRLEIKAYPLLTTVGATRGPDGPLLPQLGNGAEPVSGYYTQDNVRLVVAHAAALNVEIVPEVDIPGHSTAALVAYPELTDGQEAPDSYRSVQGYPNNALNPAIEPTYEFLGKIFDEMVELFPSRLIHIGGDEVADGSWLASPLAKALMDKEGLDGTFGIQSYFMKRIQGMLHERGRQLAGWDEVSHGGGVDPAGTLLMAWQKPEVGLELARQGYDVVMTPGQAYYLDMVQDEAWQEPGASWAGTVPPSHTYAYEAVGDFPDELKERMKGVQACIWSEHFLNRAYFNHLVFPRLPAIAEAAWTPKAQKDWLRFSA

SEQ ID NO: 11429 - protein, 254 aa, Agrobacterium tumefaciens
QLAIVTGAAGDIGRAIAAALSESHKKVVLVDIDADALSDALYKLSGPGFVAKTCDVTDPQDLARLAAEVAEFGEVATLVNNAGAARAVSLHDTTAEIWRKDNALNLEAPFLCFRAFEEALKRTQGSVINITSVNGMAVFGHPAYSAAKAGLIHLTKLIAVEYGKFGIRANAVAPGTVRTQAWEARAATNPQVFEEAKHWYPLQRIVRPEDVANAVAFLAGPQAAAISGVCLPVDCGLTAGQAPLARTFSQSEHY

SEQ ID NO: 11430 - protein, 337 aa, Agrobacterium tumefaciens
LMRQEIDEIPDAVARLLDNAKTDFLEAGSKLKARDPAVVVTIARGSSDHAAHFLKYAIELQTGLPVASLGPSLASIYQTKLRLERAAAFAVSQSGKSPDIVALAQSARKGGALTFSLVNTLPSPLGEAADHAINIQAGPEKAVAATKSFVNSIVAGLAILAEWTEDSLLARAVSALPQNFAKAIALDWSHIGEAVKGEESLYMLGRGPALAIAAEAALKCKETCELHAEAYSSAEVMHGPVSLVAPQFPVIAFAARDRAETSVTDIAASLANKGANVFVTSTKGSPAKPLPFVETNHPLTDALLLIAPFYGFIEQLSRARGFNPDAPVALKKVTETQ

SEQ ID NO: 11431 - protein, 403 aa, Agrobacterium tumefaciens
MDFEAFFTTELQSLHSEGRYRVFADIERQQGNFPRATRYNANGDRKDVTVWCSNDYLGMGQNPKVIEAMKAAIDHCGAGAGGTRNISGTNHYHVLLEQELADLHGKESALIFTSGYVSNWATLGTLGQKIPGLIIFSDALNHASMIEGIRYGRCERVIWKHNDLEDLEAKLKAADPNAPKLIAFESVYSMDGDIAPIREICDLADRYGAMTYLDEVHAVGMYGPRGGGIAEREGLMDRLTIIEGTLGKAFGVMGGYITGSTAVCDFIRSFASGFIFTTALPPSLAAGAIASIQHLKASPFERARHQDRVRKLRGLLDARGIPHMDNPSHIVPVMVGDAAKCKWISDILLDNHGVYVQPINYPTVPRKTERLRITPTPLHTDADIEQLVGALHQLWSHCALARA

SEQ ID NO: 11432 - protein, 474 aa, Agrobacterium tumefaciens
AAVNGAGKVTQVIGAVVDVAFEGELPPILNALETQNNGNRLVLEVAQHLGENVVRTIAMDSTEGLVRGQSVADTGAPIEVPVGLETLGRIMNVIGEPVDEAGPIVTAKKRAIHQDAPSYVEQSTEGQILVTGIKVVDLLAPYAKGGKIGLFGGAGVGKTVLIMELINNVAKAHGGYSVFAGVGERTREGNDLYHEMIESNVNKLGGGEGSKAALVYGQMNEPPGARARVALTGLTIAENFRDEGQDVLFFVDNIFRFTQAGSEVSALLGRIPSAVGYQPTLATDMGQMQERITTTNKGSITSVQAIYVPADDLTDPAPATSFAHLDATTVLSRSIAEKGIYPAVDPLDSTSRMLDPMIVGEEHYEVARKVQSTLQRYKSLQDIIAILGMDELSEEDKLTVARARKIERFLSQPFFVAEVFTGSPGKPVALEDTIKGFKGLVNGEYDSLPEAAFYMVGSMEEAIEKAKKLTAEAA

SEQ ID NO: 11433 - protein, 292 aa, Agrobacterium tumefaciens
MPSLKDLKNRIASVKATQKITKAMKMVAAAKLRRAQEAAEAARPYSQRMSAVLANIATAVEADVAPALMTGTGKDDVHLLVVCTAERGLCGGFNSQIARFARDQARKLISEGKTVKIITVGKKGYDSLRREFASLIIERIELRDVKKVGFENADQIAKKVISLFNAGEFDVCTLIYSEFKSVISQIPTGLQLIPAATPVVEAAETTQTAVYEYEPDAASILEDLIPRNISVQVFRALLENVAGEMGAKMSAMDNATRNAGEMINKLTLSYNRQRQAQITKELIEIISGAEAL

SEQ ID NO: 11434 - protein, 505 aa, Agrobacterium tumefaciens
RAAEISAILKDQIKNFGNEAEVSEVGQVLSVGDGIARVYGLDNVQAGEMVEFPGGIRGMALNLEADNVGVVIFGSDRSIKEGDTVKRTGAIVDVPVGPELLGRVVDALGNPIDGKGPINAAKRSRVDVKAPGIIPRKSVHEPMSTGLKAIDALIPVGRGQRELVIGDRQTGKTAIILDTILNQKAIHDNGPDGDKLYCVYVAIGQKRSTVAQFVKVLEERGALQYSIIVAATASDPAPMQYLAPFAGCAMGEYFRDNGKHALIGYDDLSKQAVAYRQMSLLLRRPPGREAYPGDVFYLHSRLLERAAKLSDEMGAGSLTALPVIETQGNDVSAFIPTNVISITDGQIFLETDLFYQGIRPAVNVGLSVSRVGSAAQIKAMKQVAGSIKGELAQYREMAAFAQFGSDLDASTQRLLNRGARLTELLKQPQFSPLKTEEQVAVIFAGVNGYLDKIPVAQVGKFEQGFLSYLRSEGKAILDTIRTEKAISDDTKGKLKGALDNFAKSF

SEQ ID NO: 11435 - protein, 180 aa, Agrobacterium tumefaciens
GTSGVAERYASSLFELALEAGTVEAVQVELDKFGALLDESDDLKRLVASPVFSAEDQFKAISAICEKAGIAGLAVNFLKVVANNRRLFAVPGMIRAYRTIAAAHRGEITAEVTSAHALDEAQETELKAALKSVTGKDVAISVTVDPSILGGLIVKVGSRQIDTSLRTKLSTLKLALKEVG

SEQ ID NO: 11436 - protein, 465 aa, Agrobacterium tumefaciens
  unsure (1)..(465): unsure at all Xaa locations
DVVVIGTGPGGYVCAVKAAQLGLKVAVIEKRATYGGTCLNVGCIPSKALLHASETFAHVAHGVDTLGIEVAAPKLNLEKMMGHKDGVVKANVDGVAFLFKKNKIDAFQGTGKVVSAGKVSVTNDKGETQEIEAKNIVIATGSDVAGIPGVKVDIDETVIVSSTGAIALSKVPEKLIVVGGGVIGLELGSVWSRLGAKVTVVEYLDNILGGMDGEVSKQSQRLLAKQGLDFKLGAKVTAVEKTAAGAKVVFEPVKGGAAETLEADVVLISTGRKPYTEGLGLAEAGVVLDSRGRVEIDGHYKTNVDGIYAIGDVVXGPMLAHKAEDEGVALAEILAGQRGHVNYDVIPAVVYTQPEIASVGNTEEELKAAGVAYKVGKFPFTANGRARAMQVTDGFVKILADKETDRVLGGHIVGFGAGEMIHEITVLMEFGGSSEDLGRTCHAHPTMSEAVKEAALATFFKPIHM

SEQ ID NO: 11437 - protein, 410 aa, Agrobacterium tumefaciens
MATEIRVPTLGESVSEATVGTWFKKVGDTVKADEPLVELETDKVTVEVPAPASGVLTEIVAQNGETVGLDALLGQIAEGAAGAATSAPAAKPAAPAAAPAPAAAVAAAPGGSAMPPAPAAGKLLAENNLSADQVDGSGKRGQVLKGDVLAAVAKGVSAPAAAPAPVAAPRPVSAEQDQVREERVKMTRLRQTIARRLKDAQNTAAMLTTYNEVDMSAVMDLRNRYKDVFEKKHGVKLGFMGFFTKAVTHALKELPAVNAEIDGTDIIYKNYCHVGMAVGTDKGLVVPVIRDADQLSIAGVEKELGRLAKAARDGSLGMADMQGGTFTITNGGVYGSLMSSPILNAPQSGILGMHKIQERPVAIGGQVVIRPMMYLALSYDHRIVDGKEAVTFLVRVKESLEDPERLVLDL

SEQ ID NO: 11438 - protein, 996 aa, Agrobacterium tumefaciens
MARQEANEQFQITSFLDGANAAYIEQLYARYEEDPSSVSPEWQSFFKALSDNPEDVKKAAKGASWKRANWPIPANGELVSALDGNWATVEKAIEKKVQAKAEAKSADTGKPVSEAEVLQATRDSVRAIMMIRAYRMRGHLHAKLDPLGIASAVEDYNELSPKSYGFEESDYDRKIFIDNVLGLEYATVREMVEILERTYCSTLGVEFMHMSNPEEKGWIQERIEGPDKGVDFTPEGKKAILSKLVEAEGYEQFLDVRFKGTKRFGLDGGESLIPALEQIIKRGGQDGLEEVVLGMAHRGRLNVLTNVMGKPHRAVFHEFKGGSFKPDDVEGSGDVKYHLGASSDREFDGNKVHLSLTANPSHLEIVNPVVMGKARAKQDQLAKTWDGDIIPLSERAKVLPLLLHGDAAFAGQGVVAEILGLSGLRGHRVAGTMHFIINNQIGFTTNPAFSRSSPYPSDVAKMIEAPIFHVNGDDPEAVVYAAKVATEYRMKFHKPVVIDMFCYRRFGHNEGDEPAFTQPKMYKVIRGHKTVARIYADRLIAEGLITEGDFEKVKADWRAHLEQEFEAGQSYKPNKADWLDGQWSGLRAADNADEQRRGKTGVPMKQLKEIGKKLSTIPEGFTAHRTIQRFMENRSQMIETGEGIDWAMAEALAFGSLVVDGHKIRLSGQDCERGTFSQRHSVLYDQETEERYIPLANLAPTQARYEVINSMLSEEAVLGFEYGYSLARPNALTLWEAQFGDFANGAQVVFDQFISSGERKWLRMSGLVCLLPHGYEGQGPEHSSARLERWLQMCAEDNMQVANVTTPANYFHILRRQMKRDFRKPLILMTPKSLLRHKRATSSLAELAGESSFHRLLWDDAEVIKDGPIKLQKDAKIRRVVMCTGKVYYDLLEEREKRGIDDVYLLRVEQLYPFPAKALINELSRFRHAEMVWCQEEPKNMGSWSFIDPYLEWVLAHIDAKYQKVRYTGRPAAASPATGLMSKHLAQLAAFLEDAL

SEQ ID NO: 11439 - protein, 299 aa, Agrobacterium tumefaciens
MSILVNKDTKILVQGLTGKTGTFHTEQALAYYGTQMVGGIHPKKGGETWTGSKGESLPIFATVAEAKEKTGADASVIYVPPAGAADAIIEAIEAEIPFITCITEGIPVMDMVRVKARLDRSKSRLLGPNCPGIMTPEECKIGIMPGSIFRKGSVGIVSRSGTLTYEAVFQTSNEGLGQTTAVGIGGDPVKGTEFIDILEMFLADDATQSIIMIGEIGGSAEEDAAQFLIDEAKKGRKKPMAGFIAGRTAPKGRTMGHAGAVVSGGKGDAESKIAAMEAAGIKVSPSPARLGKTLVEVLK

SEQ ID NO: 11440 - protein, 395 aa, Agrobacterium tumefaciens
MNIHEYQAKALLKGYGAPVAEGVAILKVEEAEAAAKQLPGPLYVVKSQIHAGGRGKGKFKELGPDAKGGVRLAKSIEEVVSHSRDMLGNTLVTAQTGDAGKQVNRLYIEDGADIARELYCSLLVDRSVGQVAFVVSTEGGMDIEAVAHDTPEKIHTIAINPEKGVSDADVAAISKALELDGVAAEDAKALFPILYKAFNEKDMALLEVNPLIVMENGHLRVLDAKMSFDGNALFRHEDVKALRDETEEDAKEIEASKWDLAYVALDGNIGCMVNGAGLAMATMDIIKLYGKEPANFCDVGGGAGKEKVAAAFKIITADPKVEGILVNIFGGIMKCDVIAEGVIAAVKEVGLQVPLVVRLEGTNVELGKKLLNESGLAITAADDLDDAAKKIVAAI

SEQ ID NO: 11441 - protein, 319 aa, Agrobacterium tumefaciens
MARKKIALIGSGMIGGTLAHLASLKELGDIVLFDIADGIPQGKGLDIAQSGPVEGFNAKLSGASDYAAIEGADVCIVTAGVARKPGMSRDDLLGINLKVMEQVGAGIKKYAPNAFVICITNPLDAMVWALQKFSGLPKNKVVGMAGVLDSARFRLFLAEEFNVSVQDVTAFVLGGHGDTMVPLARYSTVGGVPLTDLVKMGWLTAERLEQIIQRTRDGGAEIVGLLKTGSAYYAPAASAIEMAESYLKDKKRVLPAAAHLSGQYGVDDMYVGVPTIIGAGGIERVIEIELNKEEEAAFQKSVGAVAGLCEACINIAPSL

SEQ ID NO: 11442 - protein, 257 aa, Agrobacterium tumefaciens
MVELALPKNSQISEGKVWPKPDGAKNVREYRIYRWNPDDGQNPRIDTYYIDVDDCGPMVLDALLYIKNNIDPTLTLRRSCREGICGSCAMNIDGTNTLACTKGMEEIKGTVKVYPLPHMPVVKDLVPDLSNFYAQHRSIEPWLKTVSPTPAKEWKQSHEDRLKLDGLYECILCACCSTSCPSYWWNGDRYLGPAVLLQAYRWLIDSRDEATGERLDNLEDPFRLYRCHTIMNCAQACPKGLNPAKAIAEIKKMMVER

SEQ ID NO: 11443 - protein, 601 aa, Agrobacterium tumefaciens
AYTYVDHSYDVIVVGAGGAGLRATLGMAEQGFRTACITKVFPTRSHTVAAQGGIAASLTNMTPDCWQWHLYDTVKGSDWLGDVDAMQYLAMEAPKAVYELEHYGVPFSRNAEGKIYQRPFGGHMQNYGEGPPVQRTCAAADRTGHAILHTLYGQSLRNNAEFFIEYFALDLIMAPDGRCTGVVAWNLDDGTIHRFSAKMVVLATGGYGRAYFSATSAHTCTGDGGGMIARAGLPLQDMEFVQFHPTGIYGAGCLITEGARGEGGYLVNSEGERFMERYAPSAKDLASRDVVSRCMTMEIREGRGVGKNKDHIFLHLDHLDPAILHERLPGISESAKIFAGVDVTREPIPVLPTVHYNMGGIPTNYWGEVLKTDANNPERIAPGLMAVGEAGCASVHGANRLGSNSLIDLVVFGRAAAIRAAQVIDRDAPVPALDIAACDKIMERFDSLRYANGSTPTAVLRDKMQRAMQDDAAVFRTQESLESGCQRLSAIWKELPDVKVTDRSMVWNSDLVETLELHNLMANAITTVYGAEARKESRGSHAREDFVDGPFGGRDDVNWRKHTLAWVSPEGDVKLDYRPVHTDLIADGIDPKKIEPKARVY

SEQ ID NO: 11444 - protein, 301 aa, Agrobacterium tumefaciens
PFRIGTRGSPLALAQAYETRSRLMAAHGLPEEMFEIVVLSTKGDRITDRALSEIGGKGLFTEELENQLLSGELDIAVHSSKDMPTVLPEGLHLSAFLPREDMRDAFIGRTAPKLLELPQGAVVGSASLRRQALIRRLRPDLNVIVFRGLVDTRLRKLEEGQADATLLAFAGLKRLGKDNVPTEILDPKEFPPAPAQGAIGVESRIGDARMDKLLAPINDRPTYDAVTCERAFLAALDGSCRTPIAGYATCEGDNLHFSGLILTPDGQTSHGVEISGNRRDALILGKKAGEEVRAKAGSNFF

SEQ ID NO: 11445 - protein, 391 aa, Agrobacterium tumefaciens
KKVVLAYSGGLDTSIILKWLQTELGAEVVTFTADLGQGEELEPARKKAEMLGIKEIFVEDVREEFVRDFVFPMFRANAVYEGVYLLGTSIARPLISKHLIEIAKKTGADAIAHGATGKGNDQVRFELSAYALNPDIKIIAPWRDWTFKSRTDLLNFAEQHQIPVAKDKKGEAPFSVDANLLHSSSEGKVLEDPAVEAPEYVHMRTISPEAAPDKATVIKVGFRKGDACSINGVEMSPATLLATLNNYGRENGIGRLDLVENRFVGMKSRGVYETPGGTILLAAHRAIESITLDRGAAHLKDDLMPRYAELIYYGFWFSPEREMLQALIDKSQEHVEGEVTLKLYKGNVMVTGRESEKSLYSDALVTFEDDHGAYDQKDAAGFIKLNALRLR

SEQ ID NO: 11446 - protein, 893 aa, Agrobacterium tumefaciens
KSLDSFQCRSVLTVDGKDYVYFSLPKAEANGLKGVSKLPYSMKVLLENLLRFEDGQSVTKAHIIAVSEWLNNKGLTETEIAYRPARVLMQDFTGVPAVVDLAAMRDGLKALGGDPEKINPLVPVDLVIDHSVIVDEFGTPNAFARNVELEYERNGERYRFLKWGQQAFKNFRVVPPGTGICHQVNLEYLGQTVWTKEEEGETIAYPDTCVGTDSHTTMINGLGVLGWGVGGIEAEAAMLGQPVSMLLPEVIGFKLTGKVKEGVTATDLVLTVVQMLRKKGVVSKFVEFFGPGLDSMSLADRATIGNMGPEYGATCGFFPVDGETINYLTMSGRAKDRIALVEAYSKAQDMWRTGDGSDLVFTDTLELDLGDVVPSMAGPKRPEGRLPLETIAPNFATALENDYKKPGQLNSRYAVEGEAFDLGHGDVAIAAITSCTNTSNPSVLIAAGLLARNAVAKGLKSKPWVKTSLAPGSQVVAEYLDKSGLQKDLDAIGFNLVGFGCTTCIGNSGPLPPAISKTINDKGLITSGVLSGNRNFEGRISPDVQANYLASPPLVVAYALAGTVQKDLTKEPIGDDQNGNPVYLKDIWPTSKEIQEFILKYVTRELYETKYADVFKGDANWQAVQVPPGQTYAWDDQSTYVQNPPYFVGMGKKGTGLKNIKGARVLGLFGDKITTDHISPAGSIKAASPAGAYLTEHGVAVADFNQYGTRRGNHEVMMRGTFANIRIRNHMLGPNGKEGGYTIHYPSKEEMSIYDAAMKYKAEGVPLVIFAGVEYGNGSSRDWAAKGTNLLGVKAVIAQSFERIHRSNLVGMGVVPFVFEEGTTWASLDLKGDEVVEIDGLEGEIKPREKKIAKITYSDGSVKEVPLLCRIDTLDEVIYMNNGGILQTVLRDL

SEQ ID NO: 11447 - protein, 278 aa, Agrobacterium tumefaciens
DTVEFAKMNGLANKILVVDMRGRKDMVTPAAAIALNSNPATQFDQIMAIHDPRVGGTDAFIDILNCDGTKAQACGNGTRCVVQALSSETGKTSFTFQTVAGILNAVEHEDGMISVDMGLPRFRWSDIPLSEEFHDTSRIELQIGPIDAPILHSPAVMSMGNPHAIFWVDRDPMTFDLERFGPLLENHPMFPEKANITLAQVISDSALRTRTWERGAGLTLACGSAACASAVSAARTGRTGRKVTIDVASSPVRVPLTIDWREDNHVVMTGPAEWEWSG

SEQ ID NO: 11448 - protein, 238 aa, Agrobacterium tumefaciens
  unsure (1)..(238): unsure at all Xaa locations
FAVALDKIRLRLGTQNFDLDCTFPQGQVTAVVGASGSGKSTLLNLVAGFEVPDFGRVVIHGQDMAASDPSERPVSSIFQDNNLFAHLDIFTNVALGVSPGLKLRAEDRQRIEVALARVGLAGFDKRLPGTLSGGERQRAALARALVRQKPVMLLDEPFAALDPGLRAGMTALLLDLHAETKNTVIIVTHHPDDIKKLAQRVVFLDRGRVVYAGSTADFFATQNVKAVDSFLNGXSPYF

SEQ ID NO: 11449 - protein, 261 aa, Agrobacterium tumefaciens
LLEAMRHGVLNGGKRLRPFLVIESVALLGGDAEAGLHVGAALECLHCYSLVHDDLPAMDDDDLRRGQPTVHRKFDEATAILAGDSLLTLAFDIIASDDNPLAAERKAALVISLARAAGIGGMAGGQALDLAAEKKAPDEDGIITLQAMKTGALLRFACEAGAIIAGSNQAERQRLRLFGEKIGLSFQLADDLLDLTADAATMGKATGKDAARGKGTLVALRGEAWAREKLQEQVAEASELLAPYGEKAAILIAAARFIAER

SEQ ID NO: 11450 - protein, 1147 aa, Agrobacterium tumefaciens
ISKILVANRSEIAIRVFRAANELGIKTVAIWAEEDKLSLHRFKADESYQVGRGPHLAKDMGPIESYLSIEEVIRVAKLSGADAIHPGYGLLSESPEFVEACNKAGITFIGPTPDTMRQLGNKVAARNLAISVDVPVVPATNPLPDDIAEVERMAEEIGYPVMLKASWGGGGRGMRAIRKKEDLAREVTEAKREAKAAFGKDEVYLEKLVERARHVESQILGDTHGNVVHLFERDCSIQRRNQKVVERAPAPYLSEAQRQELAAYSLKIAAATNYIGAGTVEYLMDADTGKFYFIEVNPRIQVEHTVTEVVTGIDIVKAQIHILEGAAIGTAESGVPKQEDIRLNGHALQCRITTEDPEHNFIPDYGRITAYRSASGFGIRLDGGTSYTGAVITRYYDPLLVKVTAWAPEPDEAISRMDRALREFRIRGVATNLTFLEAIIGHDSFRNNTYTTRFIDSTPELFAQVKRQDRATKLLTYLADVTVNGHPETKGRAKPADKAAKPIVPYIDAPTPDGTKQLLDKLGPKGFADWMRNEKRVLVTDTTMRDGHQSLLATRVRTHDIARVASVYSKALPQLLSLECWGGATFDVSMRFLTEDPWERLSLIREGAPNLLLQMLLRGANGVGYKNYPDNVVKYFVRQAARGGVDLFRVFDCLNWVENMRVSMDAIAEENKLCEATICYTGDLLNSARPKYDLKYYTNLAVELEKAGAHIIAVKDMAGLLKPAAAKVLFKALREATGLPIHFHTHDTSGISAATVLAAVDAGVDAVDAAMDAFSGNTSQPCLGSIVEALSGSERDTGLDTEWIRRISFYWEAVRNQYAAFESDLKGPASEVYLHEMPGGQFTNLKEQARSLGLESRWHEVAQAYADANRMFGDIVKVTPSSKVVGDMALMMVSQDLTVADVENPDREVSFPDSVVSMLKGDLGQSPGGWPEALQKKALKGEKPYTVRPGSLLEDADLDAERKVIETKLERKVDDFEFASYLMYPKVFTDFALTAETYGPVSVLPTHAYFYGMEDGEELFADIERGKTLVIVNQASSGIDDKGMVTVFFEINGQPRRIKVPDRAHGASGSAVRRKAEPGNASHIGAPMPGVISRVFINQGQEVKAGDVLLSIEAMKMETALHAERDGKIAEVLVKPGDQIDAKDLLI

SEQ ID NO: 11451 - protein, 586 aa, Agrobacterium tumefaciens
LTLFQVYTRALRYLTVHKWRVAVVVIANVILAAITIAEPVLFGRIIDAISSGTNVTPILILWAGFGVFNTVAYVAVAREADRLAHGRRATLLTEAFGRIISMPLSWHHLRGTSNALHTLLRASETLFGLWLEFMRTHLATFVALVLLIPTAMAMDLRLSFVLIGLGIVYWFIGKWVMGRTKDGQASVEEHYHSVFAHVSDSISNVSVLHSYNRIEAETKALKSFTEKLLSAQYPVLDWWAFASALNRTASTVSMMIILVIGTVLVKNGELRVGDVIAFIGFANLLIGRLDQMRQFVTQIFEARAKLEDFFVLEDAVKEREEPGDARELSNVSGTVEFRNINFGFANTKQGVHDVSFTAKAGETVAIVGPTGAGKTTLINLLQRVYDPDSGQILIDGTDISTVTKNSLRNSIATVFQDAGLLNRSIRENIRLGRETATDAEVVEAAAAAAATDFIDSRINGYLTQVGERGNRLSGGERQRIAIARAILKNAPILVLDEATSALDVETEARVKAAVDALRKNRTTFIIAHRLSTVRDADLVLFLDQGRIIEKGTFDELTQRGGRFTSLLRTSGLLTEDEGQQPRPKAI

SEQ ID NO: 11452 - protein, 469 aa, Agrobacterium tumefaciens
ELSEHDIGELRFSLKNRLGEALLLTSQEDMLRYCRDWHGDVTSSAVAVIRPRSTKEVSDTVIACAELGLAIIPQGGNTGLVLGGIPDAPKHQVVLSLERMNAIRTIDSDDFSAVVEAGCILSEFKDAVQDKGMFFPLSLGAQGSCRIGGNVSTNAGGINVLRYGMTRELVLGLEVVLPDGTIWNGLSTLRKDNRGIDLKQLFIGAEGTLGIITAVAVKLYPNPEHVETALLGLNSLDDAIKLYRRARRECCDLMSAFEFMPPVAFTLAIEAIPDLKMPIAGDYPAYVLMEISGSGLVDTADLMGRFLEGVMEDGLVLDGVIASSRAQAQSLWLFREGMNEGQALRGSHMRTDISVPLSKLAAFVAEAEAELAEKLPECLAVSYGHVGDGNVHLNVLPPNGATLEEREAFIYKSKTLVNEVLDRYVGSISAEHGIGRLKRSDFESRLSDVQRRMITGLKNAFDPDLRMNP

SEQ ID NO: 11453 - protein, 648 aa, Agrobacterium tumefaciens
EEFMSAKIYPVLKSAKARTLIDNERYQKWYQESVEDPEKFWDKHGRRIDWFKPYTKVKNTSFKGRVPIKWFEDGLTNVSYNCIDRHLKTHGERTAIIWEGDNPYIDKKITYNQLYDYVCRLANVLKKHGVKKGDRVTIYMPMIPEAAYAMLACARIGAVHSVVFGGFSPEALAGRIVDCESTFVITCDEGVRGGKPIPLKENTDKAIDIAAKQYVIVNKVLVVRRTGGKTGWAPGRDIWYHQEIATVKPDCPPVKMRAEDPLFILYTSGSTGKPKGVLHTTGGYLVYTSMTHEYVFDYKDGEVFWCTADVGWVTGHSYIVYGPLANCATTLMFEGVPNFPDQGRFWEVIDKHKVNIFYTAPTALRSLMGAGDQFVQRSSRESLRLLGTVGEPINPEAWEWYYHVVGEDKSPIVDTWWQTETGGILISPLPGATDLKPGSATRPFFGVQPQLVDAEGNVLEGPADGNLCIIDSWPGQSRSVYGDHQRFVDTYFSTYKGKYFTGDGCRRDEDGYYWITGRVDDVLNVSGHRLGTAEVESALVSHHQVSEAAVVGYPHPIKGQGIYCYVTLMAGQSGDYALREELVKHVRNEIGPVATPDKIQFAPGLPKTRSGKIMRRILRKIAEDDFVALGDTSTACDPAVVEDLIANR

SEQ ID NO: 11454 - protein, 263 aa, Agrobacterium tumefaciens
ITTWNINSVRLRMPIVEQFLVRYKPDILCLQETKCPNGEFPMKPLKALGYEHVIIHGQKGYHGVAIASKIPLTEDHRQDYCGIGDARHISAIFQVGSRRVRLHNFYVPAGGDEPDRSINPKFGHKLDFIEEMKALRADGVPGTSSILVGDLNIAPLENDVWSHKQLLKIVSHTPVETEGMLDIMKKGNWLDLMRLNVPETEKIYTWWSYRAKDWEAANRGRRLDHIWSSQDLGSSLEKIEILREARGWNRPSDHVPVTAHFRF

SEQ ID NO: 11455 - protein, 393 aa, Agrobacterium tumefaciens
MTLPSIVIASAARTAVGSFNGHFANTPAHELGATVISAVLERAGVAANEVDEVILGQVLMAGEGQNPARQAAMKAGIPQEATAFGINQLCGSGLRAVALGMQQIVTGDAAIIIAGGQESMSMAPHCAHLRGGVKMGDFKMIDTMMKDGLTDAFYGYPMGITAENIARQWQLSRDEQDQFAVASQNKAEAAQNAGRFTDEIVAFTVKGRKADIVIDADEHIRHGASLETMAKLRPAFDKEGTVTAGNASGLNDGAAATLLMSEQQAAKRGIKPLARIASWATAGVDPQIMGTGPIPASRKALAKAGWSINDIGLVEANEAFAAQSCAVVRELGLNPDIVNVNGGAIAIGHPIGASGARVLNTLIFEMRRRNVSRGLATLCIGGGMGVAMCIEAL

SEQ ID NO: 11456 - protein, 241 aa, Agrobacterium tumefaciens
MSRVALISGGTSGIGAAIARALQAAGYRVAVNYAFTTDRAEAFQKETGIPAFQWDVRDYDACVDGITKVEETFGPVEVLVNNAGITRDAMFHKMSPQQWREVIDTNLTGVFNMTHPVWPGMRERGFGRIVNISSINGQKGQAGQVNYSASKAGDIGFTKALAQEGASRNITVNAICPGYIGTEMVRAIPEKVLAERIVPQIPVGRLGEPEEIARCVLFLVSDEAGFITGSTMTANGGQYFA

SEQ ID NO: 11457 - protein, 800 aa, Agrobacterium tumefaciens
  unsure (1)..(800): unsure at all Xaa locations
RIVIKIGSALLVDRKSGLKKDWLDAICEDIAALKKNGADVQVVSSGAIALGRTVLGLPSGALKLEESQAAAAVGQIALARAWSESLSRHEIVAGQILLTLSDTEERRRYLNARATINQLLKIGAIPIINENDTVATTEIRYGDNDRLAARVATMTGADLLVLLSDIDGLYTAPPHLDPDAKFLETIADITPEIEAMAGGAASELSRGGMRTKIDAGKIATAAGCGMIIASGKTLNPLKAIENGARSSWFHPPARRXRPARPGLPGNCSRPAKSMWMPGPKRRFMLGKACFPPVCGRXRAISDAAMPLPSSASKAVKWRAVLRVTMQRKRAXSSATSPTRSRRSSVMSDGRRXSIATTLXXLALPSKXNMQRRMRSMPEQAVKQSHDIDALMMTIGAQAKAASRPLSIAGTDQKNRALLAMASAIEASKEAILAANRKDLAAAESAGLAASFVDRLTLNDARIAGIAEGIRSVAALADPVGEVIAAWDRPNGLKIERVRTPLGVIGVIYESRPNVTADAGALCLKAGNAVILRGGSDSQHSSRAIHACLVQGLRIAGLPENAIQLVPVTDRAAVGALLSGLKGTVDVIVPRGGKSLVARVQSEARVPVFAHLEGICHIYVDKSADLDMAKAIVVNAKMRRTGICGAAETLLVDASAVSSHLEPVVKALLDAGCEVRGSQPVRNVVEGLEAATEEDWRTEYLDAIISVAVVDGISGAIEHIGTYSSNHTEAVIAEDPDVVARFFNELDSAILLHNASTQFADGGEFGMGAEIGIATGKMHARGPVGVEQLTSFKYRVHGTGQ

SEQ ID NO: 11458 - protein, 365 aa, Agrobacterium tumefaciens
RSLFLLPGDGIGPEAMTEVRKLIEYMNSAHNAGFTVSEGLVGGSAYDAHGVAISDADMEKALAADAILFGAVGGPKWDGVPYEHRPEAGLLRLRKDLELFANLRPAICYPALAAASSLKPELVEGLDILIVRELTAGVYFGEPKQIIDLGNGQKRGIDTQIYDTFEIERIASVAFELARSRDNRVCSMEKRNVMKSGVLWNQVVTETHAAKYKDVQLEHMLADAGGMQLVRKPKQFDVIVTDNLFGDMLSDVAAMLTGSLGMLPSASLGAPDAKTGKRKAMYEPVHGSAPDIAGKSIANPIAMIASFAMCLRYSFNMVDEATKLEAAIANVLDKGIRTADIMADGCRQVGTSDMGDAVLAEFKAL

SEQ ID NO: 11459 - protein, 436 aa, Agrobacterium tumefaciens
RRGLCPALSAPMQTGDGFLSRVAFEADISPHVMVTLCGLAERHGNGLIDITARGSLQFRGLTPESACALAKDVLALDLPLREGLAVETSPLAGRDDAEIADGRFLAEEIRKGAGALALHDKLAAKTSVVIDGGGRLAMGDLLADIRLKAIRLEGRTFWQLLVGGPESKALKAGLVEPVAAAGVVLSLLVFLAEKGPFARGRDVDQQTVTAICGERLLGWGSGGEARTPSLPLGLMMTGESRFAVGVAPAFGQIRSADLAHLCERADTFGIDALRPSLNHSLLFFGSSSACEALREAAVASGFVTTAGDARSSIAVCSGAPGCASAFLHTHDLAAFAAEECAALLDGSFTLHVSGCGKGCAHPAPSLFTLAGTSDGLAFSISGRAGDPPAGILPFEQQQTALSRLARLYEKEHKPGENAAIFFARLGREEIGAALRQ

SEQ ID NO: 11460 - protein, 1104 aa, Agrobacterium tumefaciens
MHILATTSSSLDDLIEPVDLNQPRSDVVVLSFSASDLAGLERAWGKAGETLPSLSAANLSELRHPMSVDLWIEKTAEHARVILIRILGGAERWRYGVDQLAILARRRGIKLLLLPGECSERDEKLEAASTVDKPMLASVLSFFREGGRENMGRLAAGLSVLAGGGEWPDIKADPLPKAGFYRPDLGVVGQDEACAGFPAGASVLPILFYRSMLLAEDAAPVDALFQALSARGFAPLPIFVSGLKDGEAIRFLETVLPALQPAAIIAATAFASHTDDRGETLFDRLGVPVFQAVMATTRRVGWVENARGLNPSDLAMHVVLPELDGRILTGAISFKQARTDGGVSLVNVPEADRIEQVANRIAAFLRLKSAPPRDRRIVILMPDYPGAAPGRTGYAVGLDVPQSVLEMLRDLAEAGYAVEDIPETARALLDRIESQEATVDLSTYRDFFAGLTETASSSMNATWGAAEQDDAFADGAFHFRVARFGQVFVALAPDRGRNEDRRVDYHDPALPPRHALVAFGAWMQSVVATHAIVHVGAHGTLEWLPGKTVALSRDCFPEIVTGPLPVVYPFIVSNPGEAAVAKRRIAAVTIGHVPPVLVNAGLSPEQLALEQLVDEYAQADGLDRRRRDRLAKLIVEKALETGLAAEAGVGAKDDADAALSRIDAFLCDLKDFAIKDGQHVFGRSPEGEADPLRLQSAKAEKAALLAALDGRHIAPGPSGAPARGRLDVLPTGRNLYAADPRTMPTPTAFDLGRMAGEEVLRHHLQSHGDWPKHLVFDLWGSASLRNGGEDVAQALHLMGARPIHDPATGRVTGIEVLPPASLGRPRVDVTFRISGLFRDMFPALIALLDAAAKAVARRDEAPGDNPLAEEAAALGHIPARIFGSAPGTYGAGIEEKLASGTWDEREELGQAYLDAANHAFGGADGLEIFEDAGFTELVRRADLLVHTGDDPGRDLLDGSSDVAFIGGFSAAKAVLGGIADIVALDTTDPARPRARSMTQALTRVVRARAVNPRFIAGQMRHGPRGAAEFAETVDRLVGFAETTHVVSSSLIEALYDAYFGNEEVRDFILRENPKAAEVMAARFLSARRRGLWHSRRNAVDAELE

SEQ ID NO: 11461 - protein, 330 aa, Agrobacterium tumefaciens
IRHGGNLGKARLMFRQAPEPWIDLSTGINPHSYPHSPIPASAFARLPEPGAAEELKQLAAAHFGAPSAQHVTLSPGTQMLMPLLAQIAINRGAQSGAVLSPAYAEHARTARMAGLTVTEVENIGDLSAYGYAVVVNPNNPDGRITDREALLALAGTIGRKGGLLVVDEAFIETGGAESLAVATNGEALVVLRSFGKFYGMAGVRLGFAIAHPEIAAELEARLGPWAVSGPALHIATEALADREWQSSMRLRLAEEARRMNELLEKAGLKIAGGTSLFTLVRDERSRALFGHLGRRGILVRIFDERPDDMRFGLPGSEADWQRVEEALRSF

SEQ ID NO: 11462 - protein, 333 aa, Agrobacterium tumefaciens
MLAIFCDTPGQLTAKDLPNPVRGEGEVLVRIRRIGVCGTDLHIFTGNQPYLSYPRIMGHELSGTVEEAPAGSHLSAGDVVTIIPYMSCGKCNACLKGKSNCCRNIGVLGVHRDGGMVEYLSVPQQFVLKAEGLSLDQAAMTEFLAIGAHAVRRGAVEKGQKVLIVGAGPIGMAVAVFAVLDGTEVTMIDGRTDRLDFCKDHLGVAHTVALGDGDKDRLSDITGGNFFDAVFDATGNPKAMERGFSFVGHGGSYVLVSIVASDISFNDPEFHKRETTLLGSRNATADDFERVLRALREGKVPEALITHRMTLADVPSKFAGLTDPKAGVIKGMV

SEQ ID NO: 11463 - protein, 338 aa, Agrobacterium tumefaciens
MSERKVMTVLNGKTVTPPPIWLMRQAGRYLPEYRETRKSAGSFLDLCYNPELASEVTLQPIRRFGLDAAILFSDILVIPDALHRNVSFSEGKGPAMDPIDISGIEKLDASDVMAHLSPVFETVSRLRTSLPDETTLLGFCGAPWTVATYMIAGHGTPDQAPARLFGYQEPAAMEKLLALLAEVSADYLVAQIDAGADAVQIFDSWAGVLGEKEFEEYAIKPVARIIASVRARRPSAKIIAFAKGAGYLLRDYRRKTGANAIGLDWSVPLSFARDLQKEGPVQGNLDPMLMVAGGKALQDGIDAVLQSLGQGPLIFNLGHGITPQADPENVTRLVQRVR

SEQ ID NO: 11464 - protein, 266 aa, Agrobacterium tumefaciens
VVGYPIKHSRSPIIHSYWLKKFGIAGSYTAVEVSPDDFPKFIATLKEGKPGAAVGGNATIPHKEAAYRLADHPDALAEELGAANTIWMEEGKLHATNTDGYGFVSNLDERHPGWDKTQRAVVFGAGGASRAVIQSLRDRDVAEIHVVNRTVERARELADRFGPRVFSHPQAALQEVMHGAGLFVNTTSLGMNGTEAPHLDFSHLAANAVVTDIVYVPLKTPILNMAQEQGIATVDGLGMLLHQAKPGFRRWFGRIPEVDETLRSLI

SEQ ID NO: 11465 - protein, 210 aa, Agrobacterium tumefaciens
VAGMKPDIKICGLKTPETLERVVRRGASHVGFIFFEKSPRYIEPDLAGRLAEAARGAAKVVAVTVDADNDYLDEIVDLVRPDILQLHGSESPERLLHIKALYGLPVMKAISIRDAADLAKIEPYIGIADRFLLDAKAPAGSDLPGGNGVSFDWTILRSLDESVDYMLSGGLNKDNVAEALAETRASGLDLSSGVESAPGVKDLSKIDAFF

SEQ ID NO: 11466 - protein, 461 aa, Agrobacterium tumefaciens
DYIVADINLAAFGRKELDIAETEMPGLMSCRKEFGESKPLKGARITGSLHMTIQTGVLIETLKELGAEIRWASCNIFSTQDHAAAAIAAAGIPVFAVKGESLTEYWEYTDKIFQWTDGGLSNMILDDGGDATMYILLGARAEAGEDVLSNPGSEEEEILFAQINKRLKASPGWFTKQRDALKGVTEETTTGVHRLYDLAKKGLLPFPAINVNDSVTKSKFDNKYGCKESLVDGIRRATDVMMAGKVAVVCGYGDVGKGSAASLQGAGARVKVTEIDPICALQAAMDGFEVVRLEDVVSSADIFITTTGNKDVIRIEHMREMKDMAIVGNIGHFDNEIQVASLRNLKWTNIKPQVDMIEFPKGNRIILLSEGRLLNLGNATGHPSFVMSASFTNQVLGQIELFTKPGEYKNEVYVLPKHLDEKVARLHLEKLGVRLTELSDLQADYIGISKQGPFKAEHYRY

SEQ ID NO: 11467 - protein, 536 aa, Agrobacterium tumefaciens
MNELGVHNPANGVAELGLGEASRVFYNLNESELYEHAIRNGEAELTIDGALRAVTGQHTGRSPKDKFVVRDASTENTIWWDNNKPLSPENFELLRQDMLAHAAGKTLYVQDLIGGADEENALPTRVVTELAWHSLFIRNLLIRPKRETLSGFSQKLTIINLPSFKADPARHGVRSETVIACDLTNGLVLIGGTSYAGENKKSVFTVLNYLLPAKGVMPMHCSANVGPEGDSAVFFGLSGTGKTTLSADPARTLIGDDEHGWGEHGIFNFEGGCYAKAIKLSSEAEPEIYAATNRFGTVLENVVLDESRVPDFNDNSLTENTRSAYPLHFIPNASETGIAGHPKTIIMLTADAFGVLPPIARLTPEQAMYHFLSGYTAKVAGTEKGVTEPEATFSTCFGAPFMPRHPAEYGNLLRELIGKHGVDCWLVNTGWTGGAYGIGKRMPIKATRALLTAALTGDLKNAQFRTDANFGFAVPLSLDGVDGAILDPRSTWADGAAYDAQAKKLVSMFVSNFTKFEDHVDSKVRDAAPGLLLAAE

SEQ ID NO: 11468 - protein, 260 aa, Agrobacterium tumefaciens
  unsure (1)..(260): unsure at all Xaa locations
LKARIIPCLDVKDGRVVKGVNFVDLIDAGDPVEAAKAYDAAGADELCFLDITASSDNRDTIFDVVSRTADHCFMPVTVGGGVRSVADIRKLLLCGADKVSINSAAVKDPDFVAQAADKFGNQCIVVSIDAKRVSKDGEADRWEIFTHGGRQPTGIDAVEFAIKMVERGAGELLVTSMDRDGTKSGYDIGLTRSIADQVRVPVIASGGVGTLDDLVAGVRDGHATAVLAASIFHFGTYSIGEAKSYMAEHGIAMRLDXLQE

SEQ ID NO: 11469 - protein, 194 aa, Agrobacterium tumefaciens
RKGEIIRKTNETSVSVRVDIDGTGKSKISTGVGFFDHMLDQAQPPFADRHGHRSSGDLHIDDHHTVEDTGIAIGQAIAKALGDRRGITRYASLDLAMDETMTKAAVDISGRPFLVWNVNFSAPKIGTFDTELVREFFQALAQNAGITLHILNHYGANNHHIAETCFKAVARVLRTATEIDPRQAGRVPSTKGML

SEQ ID NO: 11470 - protein, 816 aa, Agrobacterium tumefaciens
LPELPVSAVLGDIAQVLAAKKRAVLSAPPGAGKTTLVPLRLLHEDWRGDGKIILLEPRRLAARAAAGRMAELLRENVGETVGYRMRLDNRVSSKTRIEVVTEGVFARMVLDDPELSGVSTVIFDEFHERSLDGDFGLALALDVQAGLREDLRILVMSATLDVERIGALMGDAPVIQSLGRTFPIDIRYEERWQGIHVDEKVAKAITEAHASETGSILAFLPGQAEITRTASRLEGRFPDDTDIIPLYGNLSQKEQDAAIKPAPGGRRKIVLATSIAETSITIDGVRVVIDSGLQRLPVFEPATGITRLETVRVSRASADQRAGRAGRTEPGIAIRLWHQGQTAALNAFTPPQILASDLSGLALDLAHWGVHDPSALAFLDAPPEAALKESVALLKNLGALDNSGGLTRQGHLMRGLSLPPRLAAMVIASAEEGAGKKAAMLAVMLTEQGLGGNDIDLDERLRRFFSERSERAQAARKLASRLLDAIGDKTAKAETPSEVGALLLHAYPDRIALQRGARGRYVMANGRGAELAETERLAASKMLVVADITGRAAQPRVLAAAAIERADIEERMPHLIVQQEQLLFDKASGQARARKVTRLGAIILDETPLPRPDGEQAARALANGVREFGLDILPFSKETLQLRDRIGFLNASIGDPWPDVSDAALLARLEEWFVPFQNGARSLQDIRPGSLSEGILSLVPHEVARDLGRLAPTHFEAPTGQRHPIRYDASEPTLSIRVQELFGLKAHPAIAQGRLPLLLELTSPAHRPIQTTRDLPGFWTGSWKDVRADMRGRYPRHPWPEDPASALPTSRAKPRG

SEQ ID NO: 11471 - protein, 401 aa, Agrobacterium tumefaciens
MTEAYICDYIRTPIGRFGGALSPVRADDLGALPLKALMERNASVDWEAVEDVIFGCANQAGEDNRNVARMSLLLAGLPVSVTGTTINRLCGSGMDAVIAAARAIKSGEAELMIAGGVESMSRAPFVLPKAESAFSRNAEIYDTTIGWRFVNPLMKAQYGVDSMPETGDNVAVDYQVSREDQDAFAVRSQQKAADAQTNGRLAREIVPVTIPQRKGDPLVVAKDEHPRATSLEALAKLKPVNKRDGATVTAGNASGVNDGAAALIIASAEAARKYGLTPIARILGGAAAGVPPRVMGIGPAPASAKLLARLGLNQEQLDVIELNEAFASQGLATLRQLGIADDDERVNANGGAIALGHPLGMSGARIAGTAALELSLSGKRLALATMCIGVGQGIAVALERV

SEQ ID NO: 11472 - protein, 282 aa, Agrobacterium tumefaciens
MTEKTAYKVGLIGADIQLSKSPALHMREGAAHGLDYSYELVDVTARKLPQSSLPALLDELEARGFAGTNITHPFKQAVIPHLHELSDDARMLGAVNTVVFRDGRRIGHNTDWYGFYESFVRGLPDAKRDRALLVGAGGAGVAVAHAALKLDIIRLDIFDRDFPRAERLADELNARFGEGRAFAVKDPADSLPFADGLIHATPMGMPAHPGMPVAAELIEQKHWVADIVYMPLVTELLATAASKGCRTLPGGGMTVFQAVGAFRLFCGREPDAKRMTAHFTEL

SEQ ID NO: 11473 - protein, 145 aa, Agrobacterium tumefaciens
  unsure (1)..(145): unsure at all Xaa locations
ILNGPNLNLLGQRQPEIYGYETLADVEADCRAIAEAAGHELFFAQSNREYELIDWIHEARGKSAGIVINPGAFTHTSVAILDALNAFEAPVIEVHISNIHKREVFRHHSYVSTRAEGVIAGLGIEGYGVALRHLINLFSRSSXYA

SEQ ID NO: 11474 - protein, 324 aa, Agrobacterium tumefaciens
KKLDLITIGRSSVDLYGSQVGGRLEDMASFAKYIGGSPTNIAAGAARLGLNSAVITRVGDEHMGRFIREQLVREGVDVRGVKTDPERLTALVLLGIRDQNQFPLIFYRENCADMALSEDDIDPAFIADAGCICATGTHLSHPNTEAAVLKALKLARENGAKTALDIDYRPNLWGVAGHGDGESRFVESQKVTAKLQSTLHLFDLIVGTEEEFHIAGGSTDTLTALNAVRKVSNATLVCKRGPMGASVFTGDIPDSLDDGETGEGFPIEVFNVLGAGDGFMAGLFRGWLRGEDWPTTLKYANACGAFAVSRHGCTPAYPSWEELQ

SEQ ID NO: 11475 - protein, 477 aa, Agrobacterium tumefaciens
MYLGLDLGTSGVKALLMDGDQKIIGSANGSLDVSRPHHGWSEQNPADWIAATKTAVAGLKQKFAKELAAVKGIGLSGQMHGATLVDAEGKVLRPCILWNDTRSHAEAAALDADPRFRKITGNIVFPGFTAPKLAWVAKNEPDIFAKVAKVLLPKDYLRLWLTGEYISEMSDSAGTSWLDTGARKWSPELLAATGLDEKHMPSLVEGTDEAGVLRTELASEWGISGRAVVAGGAGDNAASACGMGTVKEGHAFVSLGTSGVLFAANASYLPKPESAVHAFCHALPNTWHQMGVILSATDALNWYSRLTGQSAADLTGELGETLLAPTGVTFAPYLSGERTPHNDAAIRGSFIGLSHESDRKALTQAVLEGVTFAIRDNLEALKSAGTSISRVTAIGGGSRSAYWLASIATSLGVPVDIPAEGDFGAAFGAARLGLIAATGADPVAVCSQPETARTIEPVAALGDAYEEAYRRYHALYP

SEQ ID NO: 11476 - protein, 475 aa, Agrobacterium tumefaciens
SGVRVRIAPSPTGEPHVGTAYIALFNYLFAKKHGGEFILRIEDTDATRSTLEYEQKVLEALRWTGLTWSEGPDVGGPYGPYRQSERKPMYWPYAEELLEKGHAFRCFCTPERLEQMREAQRAAGKPPKYDGLCLHLKAEEVTTRVAAGEANVVRMKIPTEGSCDFHDGVYGDVSIPWDSVDMQVLIKADGMPTYHMANVIDDHLMKITHVARGEEWLASVPKHILLYRYFGWDQPTFMHLSLMRNADKSKLSKRKNPTSISYYSALGYLPEALMNFLGLFFIQIAEGEELLTMEELAAKFDPEALSKAGAIFDIQKLDWLNGRWLREKLTPEDFIARTLEWAMENSRLTEGLKLAQSRISKLGELPNLAGFLVSSDVGLTPASFAGLKSKPEEIHEILTTVAADLEKMPDWNVEAIEAELRDIAERTGKKLRVVTPPLFVAVSGSSRSLPLFDSMALLGRSVVRQRLKVAIAVVA

SEQ ID NO: 11477 - protein, 316 aa, Agrobacterium tumefaciens
MTSKLEQLRAITTVVADTGDIEAVARLKPVDCTTNPTIVLKALGTPAFADAVKEAVAWGRKQGGQSDAVVAAVADRLAISVGAALAGLVPGRVSTEVDADLSFDTQASITKARHIIASYKERGIERERILIKLASTWEGIKAAEVLQSEGIDCNLTLLFSQAQAIACAEAKAFLISPFVGRILDWYKKSTGETYTAETDPGVVSVRSIYNYYKANGIGTVVMGASFRNVGEIEALAGCDRLTISPALLEELDKDNGKLERKLSPDNVKAEALQSLDEKAFRWAMNEDAMATEKLSEGIRLFAKDLVTLREMVRKEL

SEQ ID NO: 11478 - protein, 523 aa, Agrobacterium tumefaciens
RQNLVAVDVGTASARAGIFDPAGRLLARSIHPILMQRPRENHAEHDSTDIWNAVCIAVKAALADAGVLPQSIAAIGFDATCSLVIRDERGEPVSVSTTDDDRFDTIVWLDHRAIGEADRLTASGHRVLDFAGNSVSPEMQMPKLMWLKTHMPQSWSRMSFAFDLADFLTWKATGSAQRSNCTQTAKWNFLAQEHPGWQADYLAFAGLDDLKERAGLPETTVMPGGAIGPLSPEAAAELGLDTGCQVAAGMIDAYAGALGALGGCLAEDVGKHVALIAGTSSCLVAMSTQPMPGRSLWGPYWQAVLPGHWLVEGGQSATGALLDHIVRMHAAGGEPDTALHARIVARVTELRELEGEAFADRLHVLPDFHGNRSPLADPHAVGVVSGLTLDTSFDSLCRLYWRTAIAIALGARHVLDAMERFGYAVETLHVTGGHVKNPLLMELYADVTGKRIVVPATADAVLLGTAMTAATAGGVHASLAAAGAAMYPGNAEISGNPALAAHYERDYRRFLAMYRHRQELESL

SEQ ID NO: 11479 - protein, 532 aa, Agrobacterium tumefaciens
SVTSLSIMRLLDRKTSRIEGKVMLGGRDLLALPEEEMRKVRGKDISMIFQEPMTSLNPIFPIGKQIAEALTVHQDISSSAAKAEVIRLLEKVRIPNAASRFGDYPHQFSGGMRQRVMIAMALASKPKLLIADEPTTALDVTIQGQILDLIKQLQEEEGMSVLFITHDMGVVAEVADRTIVMFRGDVVETGTTDDIFHRGQHPYTRALLSAVPKLGSMRSRLLPARFPIIDIKTGESPPVVETKDTVSGGKTPILSVKDLTTRFDIRSGLFGRKSGAVHAVEKVSFDLAEGETLSLVGESGCGKSTTGRSITRLIEPTSGNVTLDGYEVLKLDRTTLRTMRRSVQMVFQDPFASLDPRMSVGTAIMEPFMEHRLGQKAQAREKAADLLEKVGLSPDMMKRFPHEFSGGQRQRIAIARSLMLDPKVIVADEAVSALDVSIKAQVCNLLLDLQQSLNLAFLFISHDMAVVERVSHRVAVMYLGEIVEIGPRAAVFDNPQHPYTKKLMSAVPVPDPARRQIRRNMATDEIKSPIRP

SEQ ID NO: 11480 - protein, 400 aa, Agrobacterium tumefaciens
  unsure (1)..(400): unsure at all Xaa locations
RHTVSERAAFHWQDPFLLEDQLTDDERMIRDSAEAFGKSELLPRISEAYLSETTEPELFRLMGRTGLLGVTLPEEYGAANASYVAYGLVAREVERIDSGYRSMMSVQSSLVIHPIFAYGSDEQKKKYLPGLVSGELIGCFGLTEPDAGSDPGGMKTRAEKIEGGYRLRGSKMWISNAPIADVFVVWAKSEAHDNEIRGFVLEKGMKGLSAPKIGGKLSLRASITGEIVMDGVEVGEDALLPNVSGLKGPFGCLNRARYGISWGVMGAAEDCWFRSRQYGLDRKQFGKPLAGTQLYQKKLADMQTEIALGLQASLRVGRLMDEHKMAPEMISIVKRNNCGKALDIARQARDMHGGNGIQIEYHVMRHAQNLETVNTYEGTHDVHALILGRAQTGIQAFFXG

SEQ ID NO: 11481 - protein, 834 aa, Agrobacterium tumefaciens
MSSELTRRNLLKAHAAGIAAATAGIALPAAAQPVPGGVSALQIKWSKAPCRFCGTGCGVMVGVKEGKVVATHGDMQAEVNRGLNCIKGYFLSKIMYGKDRLETPLLRKKNGVYAKDGEFEPVSWDEAFDVMAQQCKRVLKEKGPTAVGMFGSGQWTIFEGYAATKLMRAGFRSNNLDPNARHCMASAAYAFMRTFGMDEPMGCYDDFEHADAFVLWGSNMAEMHPILWTRIADRRLGFDHVRVAVLSTFTHRSMDLADIPMVFKPGTDLVILNYIANHIIKTGRVNEDFVRNHTKFVRGVTDIGYGLRPDDPVEVNAANSADPTKTEAIDFETFKEFVSEYTLEKTAAMTGVEAGFLEELAELYADPKRKVMSLWTMGFNQHVRGVWANQMVYNIHLLTGKISEPGNSPFSLTGQPSACGTAREVGTFAHRLPADMTVTNPEHRKHAEEIWRIPHGIIPEKPGYHAVQQDRMLHDGKLNFYWVQVNNNVQAGPNTKNETYLGYRNPENFIVVSDAYPTITAMSADLILPAAMWVEKEGAYGNAERRTHVWHQLVEASGEARSDLWQLVEFSKRFTTDEVWPAEILDANPAYRGKTLYEVLYKDSDVGKFPLSEINADYKNQESSDFGFYLQKGLFEEYAAFGRGHGHDLAPYDAYHEVRGMRWPVVDGKETLWRYREGYDPYVKPGEGVKFYGNKDGRAVIIAVPYEPPAESPDQEFDTWLVTGRVLEHWHSGSMTMRVPELYKAFPGARCFMNADDARKRGLNQGAEIRIVSRRGEIRSRVETRGRNRMPPGVIFVPWFDASQLINKVTLDATDPISKQTDFKKCAVKIEPVA

SEQ ID NO: 11482 - protein, 257 aa, Agrobacterium tumefaciens
MTDHSLKGKTVIIAGGAKNLGGLIARDFAAQGAGAIAIHYNSAASRADADATVAAVKAAGAEAIALQADLTTAGAVEKLFADAVAAIGRPDIAINTVGKVLKKPILETSEAEYDEMTAVNAKSAFFFLQQAGRHVSDNGKICTLVTSLLGAFTPFYASYAGTKAPVEHFTRAAAKEFGERGISVTAIGPGPMDTPFFYGQETPEAQGYHKTAAALSAFSKTGLTDIEDIVPYIRFLVTDGWWMTGQTILVNGGYTTK

SEQ ID NO: 11483 - protein, 856 aa, Agrobacterium tumefaciens
MSHIDLNRLVGALEPDLRVTLEAAASVAVRMGHRYVDIPHWLLAVVDAGIYAETFDELKIPLPVLKAEIGRSLEEAIIGDGEALSLSQNILTAAREAWILASLEAGRDRVTLCDLLLAMDEETSLRSFVRSAFPSLKAMDRGALERLRSSAENGAGVDVPSALTSSGEAGSAQAAGQNDFLRLYTHDMTTDARNGKVDPVIGRDDELRQLVDILTRRRQNNPILVGEAGVGKTAVAEALALEIASGNVPEKLRNVCLLNLDISLLQAGAGVKGEFERRLHGVIDAVKRSAEPVILFIDEAHGLVGAGGAAGQGDAANILKPALARGEVRTVAATTWSEYKKYFEKDAALTRRFQPVHVREPDEATAIRMLRGVADTFVSHHNVTVRDEAIVAAVQLSARYMPARQLPDKAVSLLDTAAAAVSLARQTLPERLRAMESERHLLSDELNWLLREPQDEDMQNRIQSIRDELERLEAGIDDLRGRYDAEMAELAALSEEQPAETGASNVSHLRPATEMRPANAERLVPTVVDREAIAAVVSRWTGIPLGKLLADQIESARTLDVRMRQRVVGQDAAITRIADAMRTARAGLSDPRRPPAVFFLVGMSGTGKTETALSLADLLYGGNSHLTTINMSEFKEEHKVSLLLGSPPGYVGFGEGGVLTEAVRRRPFGVLLLDEIDKAHPGVQDIFYQVFDKGVLRDGEGRDVDFKNTTIFMTANTGSELLSALSADPDTMPEGEALEALLMPELTKQFKPAFLGRTIILPFMPLGAEELASVVDMQIGKIRDRVLATYGTDLRLSDAARDALVARAGASEIGARAIEIMIGKDLLPPLSSFFLEKVIAGERVGKIVVDFGENGF

SEQ ID NO: 11484 - protein, 238 aa, Agrobacterium tumefaciens
FSGKSVIITGAGKGIGRACAQLMAARGAEVVAISRTQSDLDSLKSEIGGRSIRVDLADIAATRAAMAEAGPCDFLINSAGINVLESVLDMSDAGYEAVLGINLRAALVTCQEFARGRVANGGGGAIVNITSIAGHRGFQDHLCYAASKAGLEGATRVLAKELGPHGIRVNAVAPTITLTELAAEAWNDPEKSQPMMVRHPLNRFAEAEEVAQSIALLLSDDSKMISGAVLPVDGGFLA

SEQ ID NO: 11485 - protein, 530 aa, Agrobacterium tumefaciens
SYLVGVDVGTGSARAGVFDVAGKLLATAKRPISMHREDGGIAEQSSAEVWQAVCDSVRDSVSRAGIDPAEVTGIGFDATCSLVVRGPGDVTLPVGAADHPERDIIVWMDHRAVEQAERINAGKHAVLKYVGGRISPEMQTPKLLWLSENRPDIYARAEHFFDLTDFLTWKASGALDRSACTVTCKWTYLAHENRWDAEYFTKIGLGDLAEQGFRRIGESVVHPGTALGNGLTEEAAKAMGLVAGTAVAAGLIDAHAGGVGTVAAGGDASRCLGYVFGTSSCTMTTTTEPAFVPGVWGPYYSAMVPGAWLNEGGQSAAGAAIDYLVQLHPAFAEAKALADKDGKALPVWLADRALSLAASASAAVKLAEDFHMVPEFLGNRAPFADPHARAIIAGYGMETGVDSLVALYVAGLLGLGYGLRQIIETQARNGAPVETISVSGGAGAHPLARQLLADATGLPVELTECEEPVLLGSAMLGAVAAGTYPDLMAAMPAMSRIDSSAMPDPDFQKIHQARYDAFLALQNAARAIRS

SEQ ID NO: 11486 - protein, 241 aa, Agrobacterium tumefaciens
MSESLQGKIAVITGAASGIGLATTEALLEQGATVVMVDWNEKALNDLAAKLGERAIPQVTNLLDADSCNAMIPEILGKVDHIDILYCNAGTYIGGDLTETTPEAIDKMLNLNVNAVMKNVQAVVPHMSERKTGDIIVTCSIAGHFPTYWEPVYSGSKWAITSFVQGMRRQMIPHGVRVAQVSPGPVVSALLADWPEENLRKAKESGSLIDASEVADAVVYMLTRKRTVTIRDMLVLPTNFD

SEQ ID NO: 11487 - protein, 336 aa, Agrobacterium tumefaciens
MKALVLEEKGKLSLRDFDIPGGAGSGELGPKDVRIRTHTVGICGSDVHYYTHGKIGHFVVNAPMVLGHEASGTVIETGSDVTHLKIGDRVCMEPGIPDPTSRASKLGIYNVDPAVRFWATPPIHGCLTPEVIHPAAFTYKLPDNVSFAEGAMVEPFAIGMQAALRARIQPGDIAVVTGAGPIGMMVALAALAGGCAKVIVADLAQPKLDIIAAYDGIETINIRERNLAEAVSAATDGWGCDIVFECSGAAPAILGMAKLARPGGAIVLVGMPVDPVPVDIVGLQAKELRVETVFRYANVYDRAVALIASGKVDLKPLISATIPFEDSIAGFDRAVE

SEQ ID NO: 11488 - protein, 272 aa, Agrobacterium tumefaciens
EITGSFAMPAGENPTVAMIEAAYQHHGLNWRYINLEVSPENLKDAVAGARAMGWAGFNCSIPHKVAVIQHLDGLGESAEIIGAVNTIVRRGDRLIGENTDGKGFVKALRDVIDPKDKKVVLFGAGGAARAVCVEVALAGAAHITVVNRNRERGETVARLIDEKTPATATFAAWEDAFAIPEETDIVIHATSVGLYPDIDGLPDIDLKTLRPSMVVADGIHNPPRTRLIRAAEAAGSKTADGLGMLVNQGVIGIKYWTGVDVDAYVMRQALVD

SEQ ID NO: 11489 - protein, 264 aa, Agrobacterium tumefaciens
IPALGFGTFRIPGSDVLRIVPHALKVGFRHVDTAQIYGNEAEVGEAIANSGVARGDIFLTTKVWVENYGHDAFIKSVDESLKKLKTDYVDLLLLHWPNEAVSLAEQIGALNEVKEAGKVRHIGVSNFNTELMAESVKLSRAPIVTNQIEYHPYLSQDVVIAAARKAGMSVTGYFGMADGKVFNDPVLRDIGARHGKSVAQVVLRWLVQQEGVIALSKTVGEARVLENFAIFDFALSADEMAAIHALAVPGGRIVSPDGLAPVWD

SEQ ID NO: 11490 - protein, 358 aa, Agrobacterium tumefaciens
  unsure (1)..(358): unsure at all Xaa locations
YATSRPLAIEXIELAPPGPGEVLVRIRAAGLCHSDLSVNNGDRPRPMPMALGHEAAGVVEALGEGVRDLEPGDHVVMVFMPSCGHCLPCAEGRPALCEPGAAANAAGRLLGGATRLNYHGEVVHHHLGVSAFAEYAVVSRNSLVKIDRDLPFVEAALFGCAVLTGVGAVVNTARVRTGSTAVVIGLGGVGLAAVLGARAAGASKIVAVDLSQEKLALASELGATAIVNGRDEDAVEQVRELTSGGADYAFEMAGSIRALENAFRMTKRGGTTVTAGLPPPGAALPLNVVQLVGEERTLKGSYIGTCVPLRDIPRFIALYRDGRLPVNRLLSGRLKLEDINEGFDRLHDGSAVRQVIEF

SEQ ID NO: 11491 - protein, 243 aa, Agrobacterium tumefaciens
PFSDYKTALVTGASSGIGAAVVERLRRENIEVHAIARSADALKELADRTGCVAHVIDVTDRAAIADLASRVQFDILVNNAGVDRPKKFLEADEADIDLLVDVNLRAVLHICRLIVPGMVERDRGHVINISSIAGNYNFGGNSTYHAVKAGVAMLSNQLRIDAFGKRVRVTEICPGRVATDIFSHVHGNDPSVRERFIDGFELPKAEDIADAIGFAIAAPVAVNIGHMEITPTLQVMGGLQTAK

SEQ ID NO: 11492 - protein, 444 aa, Agrobacterium tumefaciens
VLIANRGEIAARIQRACHELGLKTVAICSEADRGASYVQTADSFLCIGPSAAGKSYLNKDAILLAARLTSSGAIHPGYGFLSENTAFSDAVEKAGLVFIGPGASSIATMGDKIAAKRAMIAAAVPCVPGPDTALPDDPAAVESIAQEIGYPVIVKAAGGGGGRGMRVVPDAGSLHEAIPTTREEARQAFGSPALYMEKFLQHPRHIEIQVLCDTHGHAVWLGHRDCSMQRRHQKVVEEAPAPGISPDVIRSVGQACVEACQQIGYRGVGTFEFLYENGAFYFIEMNTRLQVEHPVTEMTSGIDIVQAQIRAAQGEELVLRQQDVKCEGHAFECRINAEDPQTFLPSAGVVTGLAWPQGQGIRVDTHIHGGYRVSPYYDSLVAKLIVHAPTRSEAMAKMREALAGTSIEGISTNLPFLRALFEDDAFVCGETDIHYLEKWLKQRR

SEQ ID NO: 11493 - protein, 480 aa, Agrobacterium tumefaciens
  unsure (1)..(480): unsure at all Xaa locations
MHLNDPTLFCEKVPVAGRWIGCDDRETATIRNPATGKIVGQVPELGATETQAAITAAVIAQKAWARRTAGERAAILKAWHRLVMENRDDLGMILTLEQGKPLAEAKGEIAYGASFIEWFAXRARRINGETVPGHQADKRILVLRQPVGVVAAITPWNFPNAMITRKVGPALAAGCAVVLKPAPQTPFSAIALAILAERAGLPLELFSIVTGPAAEIGGVLTASPDIRLLTFTGSTRTGEHLYRQCAPTIKKLGLELGGNAPFIVFNDADLDAAVEGALIAKFRNNGQTCVCANRLYVQSGVYDAFAEKFARAVSGLKVGNGLEEGSILGPLIDGNAVAKVEAHIADALSKGAQIAAGGSRYALGGNFFEPTILRNVTADMQVAREETFGPLAPLFRFEDEEDVIAQANNTDFGLASYFYARDLSRVFRVAEALEYGMVGVNTGAISTAEAPFGGVKMSGLGREGSRHGIEEYTELKYVCI

SEQ ID NO: 11494 - protein, 471 aa, Agrobacterium tumefaciens
QCYIDGRFEDGEASFSSLDPATGQPWAEMPESREADIGRVVEAAHRALYEDTVWSKLTATQRGKLLYRLADLVAENAKTLAELETRDTGKIIRETSAQIAYVADYYRYYAGLADKIEGAYLPIDKPDMDVWLRREPVGVVAAIVPWNSQLFLAAVKIGPALAAGCTIVVKASEDGPAPLLEFARLVHEAGFPAGVVNVVTGFGASCGNALTTHPKVAHIAFTGGPETARHIVRNSAENLASTSLELGGKSPILVFADADLESAANAQVAGIFAATGQSCVAGSRLIIEKSVKDRFLQILAAKAEAIRIGSPLDMATEVGPLATERQRKHIVSLVSASVDAGAKVVTGGEPVEGEGYFYRPTILDCDGIRSPSLEKEFFGPVLSVVSFETEAEAISLANDTVYGLASGVFTQNLTRAHRLMKAIRAGIVWVNTYRAVSPIAPFGGFGLSGDGREGGLAAALDYTRTKTIWLR

SEQ ID NO: 11495 - protein, 379 aa, Agrobacterium tumefaciens
LMPREMLIGGGSRFRLPAVVKSLGVHRPLLVCDPVLQKLGHADALLQALAEEGIEAAVFSDVVEDPTDISIATLVKRISDGGHDSLVALGGGSAMDTAKAGAIVATSGEDLRALKVPRIVDFAVMPVIAIPTTAGTGSEVTRAAVVTDTAASEKMLILGTAALPVAAIIDYELTLTCPYRVTVDTGIDALTHALEALVNRNGNAHSEALALSALKLIGANLEKVADNPDDRDAREAMMLGATHAGLAVSNTSTALIHGLSRPVGAFFHVPHGMSNAMVLPLVTQFSLNSALPHYAAAARALGSAAATDSDQVSGAKLVEAFLGLNRRLKVPTPQEFGIDRSRYLDLVPEMVRQGLASGTPANNPRVPTVAEMTRLYELA

SEQ ID NO: 11496 - protein, 246 aa, Agrobacterium tumefaciens
RRALITGASSGLGIEFAELLAAQKMNLVLAARRKEPMEKLAEDLRRRHGVDILVEPIDLAAPGAAARLKDSLNERAIQIDILVNNAGYGLQGEFLKTPIERTTDMIQLNITALTELSYVFGRDMAARGSGEILLIASLLAFQPVPTYAAYAATKSYVLSFGEALHDELRTQGVVVTSLCPGHTETGFDAAAGAQVSPMLRLLTMKPRPVAEAGLEALAKGKASVIAGFMNKVVAFSTRLTPRSMQR

SEQ ID NO: 11497 - protein, 418 aa, Agrobacterium tumefaciens
RRIVVTGMGAVSPLGANVDISWSRLLAGQSGIRRLTDDVVGDLPAKVGGVVPSLAEDPERGFDPDRIIAPKDQRKVDRFIIFALAAAEEALVQANWKPVSNEDRLRTATIIASGIGGFPAITEAVRTVDQRGVRRLSPFTIPSFLVNLAAGQVSIRHGFKGPLGAPVTACAAGVQAIGDAARLIRSNEADIAVCGGTEACMNIVSLGGFAAARSLSTGFNETPTKASRPFDTARDGFVMGEGAGVLVIEALSHALARGATPIAELVGYGTTADAHHITSGPEDGSGARRAMEIAIAQAGIAPHEIGHLNAHATSTPVGDLGEIRAIKSVFGQRKSVAVSGTKSATGHLLGAAGGLEAIFTILALKNRIAPPTLNLNAPDTESDGIDFVANLARSLDAEYAISNGFGFGGVNASVLFRR

SEQ ID NO: 11498 - protein, 252 aa, Agrobacterium tumefaciens
IRTLIDTPLRVGESPTWDERTGDLWFVDILAPAIFCLSPSGKLQRFDMPAQIGCLGLCQSNLIVAALKTGVHLLNPQNGELELLCDPDEGRADSRLNDGKVGPDGHFWVGTRDEADVPTGNARLYRVSSSGHVERFIDGDMLTSNGLAWSPDETRMYHSDSSGLLLQVFDFDVQTGRLGPAKRLHDFQPDEGRPDGAATDSEGCYWSAGVQAGRLNRFTPDGELFEIYKMPFKGPTMPCFGGPELKTLYVTS

SEQ ID NO: 11499 - protein, 298 aa, Agrobacterium tumefaciens
LMTTFDIRQALHGISGVPVTAYDADGEISFDITAEAYARVARAGIHNIVAAGNTGEFYALTPAEILTVYEAAIKGVDGIAPVTAAIGRSQREAIAMARTAKELGASAVMSHQPVDPFAAPQSQIAYFLGLAEDSALPLVAYVRADGFAVDDMVRLSSHPNVAGIKFATTDIMLLSRAIAASDADGALYICGLAESWAPAFAAVGARGFTSGLVNVAPHFSMQVHEALMAGDFDSARKIVEKIELFERLRTRYRNGANVTVVKEAMEIMGLAVGPVRAPGLVRLDAPDRALLENLLASW

SEQ ID NO: 11500 - protein, 510 aa, Agrobacterium tumefaciens
TITLHPGAVTLADLAAIYWENGTAKLDRSFDAGIEKAAARIAEIAAGNAPVYGINTGFGKLASIKIDAADVATLQRNLILSHCCGVGVPLPENVVRLIMALKLVSLGRGASGVRLELVRLIEAMLEKGVIPVIPEKGSVGASGDLAPLAHMAAVMMGEGEAFYEGAPLPAGEALAKAGLTPVVLAAKEGLALINGTQTSTALALAGLFRAHRAAQAALITGALSTDAAMGSSAPFHPDIHSLRGHKGQIDAGAALRNLLEGSEIRVSHIEGDERVQDPYCIRCQPQVDGACLDLLRQVARTLEIEANAVTDNPLVLSDNSVVSGGNFHAEPVAFAADQTALAICEIGAIAQRRVALLVDPALSYGLPAFLSKKPGLNSGLMIAEVTSAALMSENKQMAHPASVDSTPTSANQEDHVSMACHGARRLLPMTDNLFAILGIEALSAVQGVELRGPLKTSPELQKVIAVLRVVVPSLEEDRYMAPDLKAAAELIASGALVSTISGGILPKLEA

SEQ ID NO: 11501 - protein, 242 aa, Agrobacterium tumefaciens
LKSKRALITGGTSGIGLETARQFISEGARVAVTGTNPETLDAARRELGPSALVIKADAADVDGQKVVAETIREAFGGLDVVFINAGVALLKPLEAWDEKGFDRVFNINVKGPYFLLQALLPILANPASIVLNTSVNAHIGMPNSSVYAASKAALQSFIRTLSGELIARGIRLNAVSPGPISTPLYGKLGFTETDLKNVAESIQNLVPAGRFGEPSEIAKAVVFLASDEAAYTVGSEIMIDGG

SEQ ID NO: 11502 - protein, 421 aa, Agrobacterium tumefaciens
IVGAATFFDGYTVIAIAYAMPVLVREWGLTPSQTGMILSMGYLGQLIGAILFGWLAERIGRLKVLLFTILLFVSMDVACLFAAGAGMMMAFRFVQGIGTGGEVPVASAYINELIGSKGRGRFFLLYEVMFLLGLVGAGLIGYFMVPLYGWKAMFIVGLVPAMLMIPLRWFLKESPRWLAATGRYDEANVIVKRMEESARAAGKALPEPRIIATPAKRVSDWRELFQGIYLKRTLSIWAMWFCAYMVANGTITWLPTLYRQTFNLPLETSILYGFMTSAAGVVAAVICALLIDKVGRKRWYAGALLLAPVPLAILAWLGATSPMQVLIFAGLAYAIVQTVTFSLYLYSAEIYPTRMRAIGTGAGSAWLRLGSSAGPMLVGFVMSSMGIQYVFATFAFILIIGAVVTMLFAVETKGKVLEELS

SEQ ID NO: 11503 - protein, 240 aa, Agrobacterium tumefaciens
MSSKVALVVGGAKGIGLAIAERLSEEGAKVFITSRRSEDAEKAATAIGHGAIGIAADAAIPEDMVATVEKVRKAHGRIDALVLNAGLSEPAQIAEITPEHFDRHFDVNVRGMVFGFQAALPAMTEGGSVVLVGSIADSGGYASYGTYAATKAAVRSYARTWTAELASVGIRVNVVAPGPTDTEMMAAVQPDMRAAIVAPIPMGRMARPSEVAAAALFLLSDDASYIAGAELCVDGGLRQV

SEQ ID NO: 11504 - protein, 251 aa, Agrobacterium tumefaciens
LITGASTGIGATYAERFARRGHDLVLVARDMARMEALASRLSQETGVRIDILPADLTQATDLVKVETRLRDDERIGILVNNAGTAIGGTFVDQSVDDMTRLVALNATALVRLAGAIAPRLAKAGEGAIVNIGSVVGLAPEFGMTVYGATKAFVLFLSQGLAHELGPKGVYVQAVLPATTRTEIWDHVGADVNTLNNVMEVGDLVDAALVGFDRREPVTIPPLPDAGQWEAFDLARKTMMANFGNALPGERY

SEQ ID NO: 11505 - protein, 328 aa, Agrobacterium tumefaciens
AFVVDKYKKKGPLRLADMPNPVIGANDVLVRIHATAINLLDSKVRDGEFKLFLPYRPPFILGHDLAGTVIRVGANVRQFKTGDEVFARPRDHRVGTFAEMIAVDAADLALKPTSLSMEQAASIPLVGLTAWQALIEVGKVKSGQKVFIQAGSGGVGTFAIQLAKHLGATVATTTSAANAELVKSLGADVVIDYKTQDFEQVLSGYDLVLNSQDAKTLEKSLNVLRPGGKLISISGPPDVAFARSLKLNPLLRFVVRMLSRGVLKKASRRGVDYSFLFMRAEGQQLHEIAELIDAGTIRPVVDKVFQFAQTPDALAYVETGRARGKVVV

SEQ ID NO: 11506 - protein, 279 aa, Agrobacterium tumefaciens
AQLGESPVWHEGEDALYWVDILHPAVHRFDPATGRNETCETGKLVSAVIPVTGGRLLVASQDGVEWLDFASGRLTPFVSPEAGIADNRLNDAKCGPDGAIWVGSMRIDASKPTGALYRINANGASERKEGGIIVSNGLGWSPDGRTFYFVDTVPGLIHAYDCDPATGALSQRREFARIPVADGRPDGLAVDAEGGVWCAIWDGWCVRRYLPNGKLDQVIDMPVPRPSSIAFGGPDLSTLFITSARTRLPASTLADAPLSGGLFSCRPGISGARIAMFEG

SEQ ID NO: 11507 - protein, 244 aa, Agrobacterium tumefaciens
LRGRTALVTGSSRGIGAAIAEGLAGAGAHVILHGVKPGSTAAVQQRIIASGGTAQELAGDLSEAGAGTDLIERAEAIAPVDILVINASAQINATLSALTPNDLAFQLAVNLGSTVDMLQSALPKMVARKWGRVVSIGSINQLRPKSVVTAYAATKAAQHNLIQSQARDFAGDNVLLNTLAPGLVDTDRNADRRAQDPEGWDEYVRTLNWMGRAGRPEEMVGAALFLASEACSFMTGETIFLTGG

SEQ ID NO: 11508 - protein, 703 aa, Agrobacterium tumefaciens
MARKPNSTSSITATIHDQQLIRGAGGELHQIATGDEPVLTTAQGAPVADDQNSLRIGPRGPLVVDDFHFREKIFHFDHERIPERVVHARGYGAHGYFETYDSLATHTKADLFQRAGERTPAFVRFSTVAGNKGSADLARDVRGFAVKLYTKEGNWDLVGNNIPVFFIQDAIKFPDLVHAAKQEPDRAFPQAQTAHDTFWDFISLTPESMNMVMWIMSDRTIPRSFRFMEGFGVHTFRFINAKEQSTFVKFHWKPKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPINAPKCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKL

SEQ ID NO: 11509 - protein, 396 aa, Agrobacterium tumefaciens
PRPTERAHIIRSDAEAIEVAKIVAAEIAPGAALRDRDRIWPVKELDAFSQSGLWSINVPKKFGGPEVSYATLAKVIEIVSAADSSIGQIAQNHLGVVAAIRTVSDEAQQKLLFAEVLRGTRFGNAFSEFGSKRAADFETKFVDAGDHVIVNGQKFYSSGALLAHLVPIVALDDEGRAWYAIAERDAPGLTVIDDWSSFGQRTTLSGTVILNNVKVPKTYLVPGYKGYAEPTADGAIFQIIQVAVDTGIARAAIDETVSFVRTKSRAWVDSGVDHAWDDPYTIQAVGDLTLRLHAAQALLEKAGYAIDRAIQNPNAETVAEAQVVTAEAKILATEIAIAATNKLFELAGTRSTLAEHHLDRHWRNARTHTLHDPVRWKYSILGKYFLNGEKPPLHAW

SEQ ID NO: 11510 - protein, 255 aa, Agrobacterium tumefaciens
VKLATYNVNGINGRLEVLLRWLAEAKPDVVCLQELKAPNDKFPRREIERAGYGAIWRGQKSWNGVAILARDQEPRETRRGLPGDPDDSHSRYIEAAIDGIVIGCLYLPNGNPAPGPKFDYKLRWFERLYSYAAELFELDVPVALVGDFNVMPTDLDVYKPERWRDDALFRPEVRAAYAELIAMGWTDAVRLLHPEERIYTFWKYFRNAFARDAGLRIDHFLLSPSLRERLQTCGVDKFARAWEHTSDHAPVWIEL

SEQ ID NO: 11511 - protein, 271 aa, Agrobacterium tumefaciens
MSRFTTTDGTRLFYKDWGAGQPILFAHGWPLSSDAWDQQMLFFSQNGFRVIAHDRRSHGRSDQTFDGNNMDQYADDLAELINALDLSDLILVGHSTGGGEVSHYVGRHGTARVAKVVLVGAVPPVMLKTVDNPNGTPMEVFDSIRENTAKNRSQFFFDLTVPFYGFNREGVATNDGMRENFRRIGLQGGVKGQYDCIREFSEVDYTRDLKSIDRPTLIIHGDDDQIVPIDASAHRAADLVADATLKIYSGGSHGLAETEADRFNADVLAFI

SEQ ID NO: 11512 - protein, 288 aa, Agrobacterium tumefaciens
FVAIVTCFNDDETINYEATRAQVRRQVTAGNNIMCAGTNGDFTALTHSEKIRILEEVVDEVGGKVDVIVNAGMPATFETLQLAKEFDRIGVKGIAVITPFFIACTQDGLIRHFSTVADEVNTPVYLYDIPARTQNHIEPETARKLATHGNIAGIKDSGGAQETLEAYLQVSKEVDGFEVYSGPDHLVLWALQNGAAGCISGLGNAMPDVLAGIVNGFNSGDITYAERQQSVYTAFRTDLYAHGFPPAMVKRALYLQDPSVGASRQPALLPDAEQDQKIEEILRKYGLL

SEQ ID NO: 11513 - protein, 323 aa, Agrobacterium tumefaciens
KLPGKVALFDAIPGEPEISTLDAALAAARVAKPDVVIGLGGGSVMDVAKLVAALWDGEQTLADVAGPNKVAGRRTRLAQIATTAGTGSEAGIRSLITDPIKGNKIAVESPHLIADLAVLDPELTYSVPPTVTAATGVDAMAHCVEAFTSKRSHPMIDGFARMGFHLVGKFLGRAVRDGSDREAREGLMLASYYGGICLGPVNTAAGHAIAYPLGTLLHLPHGLANAIVFPHVLAFNQPVVSAKTAEVAEALGLGAGLSQTQLQDSARGFCSDLGIEMSLAKHGAAEADLSRYAADAHAIRRLMDNNPADMSVDDVLDVYKASF

SEQ ID NO: 11514 - protein, 248 aa, Agrobacterium tumefaciens
SRVAVVAGGTSGIGLSVARHLLGIGHKVAVFGQTESAAKAARSSFEAEITSNQLLVGCCDVRNPGEVADFFRDVETLWSSTALLVYCAGISPKATDGVAKRFTSVDLDEWNDVLDVNLTGAMLCCQAALPGMVDKGFGRIVLIGSLAGRTRPMIAGAAYAASKAGLAGLARALVSEFSADGITINVAAPGRILTPMAGTAATSVNLEAVKRIPTRRLGEAEEVARLVGFLVSDEAAFINGAIIDINGG

SEQ ID NO: 11515 - protein, 360 aa, Agrobacterium tumefaciens
FFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQD

SEQ ID NO: 11516 - protein, 479 aa, Agrobacterium tumefaciens
IKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLC

SEQ ID NO: 11517 - protein, 386 aa, Agrobacterium tumefaciens
MTINPFEFRTVPSMQVAWGGAHRLGEILSGRFQARKALLITDAGLIKAGLIKPIADALAASGFNVTIFDKVVADPPEHIVADCVESARQIGVDIVIGLGGGSSLDIAKLVAVLLVSDQTLADMYGIGNVKGSRLPLVLVPTTAGTGSEVTNISIITTGETTKMGVVSPQLYADFVLLDAELTVGLPQVHTAATGIDAMVHAIEAYTSKHKKNPLSDALAREALRLLGANLIAACRNGADRKAREGMLLGATLAGQAFANSPVAAVHALAYPLGGHYHVPHGLSNALMLGPVLRFNAKAAASLYAELADVLGVPGEGDAATRSDAFVQHMETLMDESGAPRRLRDVGVTDNTLAMLASDAMKQSRLLVNNPVEVREEDALALYREAF

SEQ ID NO: 11518 - protein, 208 aa, Agrobacterium tumefaciens
MKLYYMPAACSLSPHIVANELELDIEFVRVNFKDHKTEGGQDYYDINPNGYIPALDVGNGAMLFEGPAIVQYMADLKPQSGLAPANGTFERYKLQEMLSFLSTEIHKGFIPLLYAKQAGAYLETATPKLEKRYAWIDNLLASQRFLMGENFTVADAYLFALTSWGQASWLKSYYGADIHFDDLLNLRGWYERVKERDAVKQSILEEGL

SEQ ID NO: 11519 - protein, 241 aa, Agrobacterium tumefaciens
MSELAGKRALVTGASRGIGAAIAIALAEKGADVAITYERAADRAAQVVATIEGKGRKALAIQADSMDPEAVKRSVDQAAQALGGLDILVNNAAIAIYKDVADFTVAEIDALFAVNARSPILASQAAMPYLGKGGRIVTIGSAGAERIVGPSTVYSMTKSALQSFTRGLARELGPRDITVNLIQPGSTNTEMNPAEGEFGDFQRALIPLGRYGEPEDVAAAVAFLASGAARQITGTILTVDG

SEQ ID NO: 11520 - protein, 240 aa, Agrobacterium tumefaciens
LNGKIALVTGGSRSIGASIAQRLAADGAQVAFTYRGSPAKAEEVAVAIEKTGARALAIAADAADPDAIRAAVAATVDKFGGLDILVNNAGIAFAGPIDEIAFDDYQAMLAINVTGVFVATQEAVRHMKDGGRIIHIGSSITKYAGVPGLSAYGLTKGAVAGFNRSLAHDLGPRGITVNTVHPGPTDTDMNPVDGEFAAMQISRIAAGRYGKPREIANVVAFLASPEASFVTGADIRADGG

SEQ ID NO: 11521 - protein, 336 aa, Agrobacterium tumefaciens
IMQMRKLGESGLFVSELCFGAMTFGGTDGLWGKVGRLDQEDADALVKAALEAGINLFDTANVYAHGRSEEILGRSLKNLGVSRSDVVIATKVASAMGDGPNHRGASRGHIISECRASLGRLGLDHIDLYQIHAFDSATPIEETLEALDTLVRAGDVRYIGLSNWAAWQIMKAIGITRARALAPITSLQAYYTLVGRDLEREIGPLLSSERVGLMVWSPLAGGYLTGKYSAGGNAAGGRQTELDFPPIDRIRGEPLIAVLKAVAEKHGSSPAQIAIAWLLKQKVVSTVIIGAKRVEQLQENIRSASIELDDNDMAKLDEVSRLPVEYPGWLLNDGNG

SEQ ID NO: 11522 - protein, 362 aa, Agrobacterium tumefaciens
MSDKKFRVGIIGADTHASWAGASHVPALASQAHLTLAAVATRREESARAAAEAFGAELWFADPYAMISDKTIDVITVAVKVPAHKNLVMAALHAGKAVYCEAPLGATLAETNEMAAAVGSLHTAIGLQGRHNPAVRRAAELVASGKLGRLMSARVGATTFGYGPQSPSMYDYFNKAASGASFMTITAGHVLDVIEAVLGNITEVDARTELLWPEIEIVDTGETSQREIPDHLDLIAKTASGAPVSVQVLAGVPADEASVVFEIRGSRGWLKLTGNHLAGVQVGDILLSSSVEFAAPDRPVANGVGPTAAEFWSGAAINVGEVYASLGRDLRNGTYTTPGFDHARHNSRLIAAVELAARTGER

SEQ ID NO: 11523 - protein, 468 aa, Agrobacterium tumefaciens
WIDGTFVSSSKRGRSIDPATYETIGDYPDDGGAAAQSAIEAAKRAFRGTAWRDDAELRARVLDQMASAIERNRERLIDILSLENGKLLGEAALEIDGSPSKLRYWAAMARTEAGRAKSPKPGSLSVILRQPMGVAGIIVPWNSPVILSVRSFAPALAAGCTVVVKMPGQTAQVGSVITEVLAEATDLPEGVVNMFVESGADGAALLVESPDVPTISFTGSTQTGRTIGAIGAKRMKRFGLELGGKTPMIVFDDADLEAMLPVLEKALTIFAGQFCMTGSRLLVHSSIYELVRDRLAERLRAVKVGPASDPASDMGPLIDKENVARVDSVVKDALSKGATVVVRGGPVPEGPLAKGAFFRPSMLEVFDNSLPIVQQETFGPVITIQRFSDEREAVVLANDNDYGLSASVWTRDLDRSLRVAQALEAGSVFVNDWAKVYDGTEEGGFKQSGLGRLNGVAAIEDFIEYKQV

SEQ ID NO: 11524 - protein, 249 aa, Agrobacterium tumefaciens
TLQGRRALITGGTSGAGAATVALFKDLGASVLTTARKKPADFAGAAFVEADLTTTAGVKTVVDAVQRELGGLDILVNVLGGSSAPSGGFAALTDEEWEKEFNLNFFPAVRLDRALVPGMIAQGSGVVIHVTSIQRNLPLPEATTGYASAKGALNTYSKSVSKEVSPKGVRVVRVSPGWIADPGANGLALRIAEEAGIDYAAAVQVIMNSLGGIPLGRPAKPEEVADLIAFLASDRAASITGTEHVIDGG

SEQ ID NO: 11525 - protein, 251 aa, Agrobacterium tumefaciens
MTNRLQNKIAVVTGATSGIGLATAKLFAVEGARVYITGRRKDALDKAVAEIGHGAVGVQADSASNENLDKLFAQVKAEQGRLDALVVNAGGGSMLPLGQITEEQIDHTFGRNVKAVIFTVQKALPLMGKGASIVLTGSTAGTEGTAAFSVYSASKAAVRNLARSWALDLKGTGIRVNVVSPGATRTPGLVELAGDDKEQQQGLLDYLASRIPLGRVGESEEIAKATLFLASDDASFVNGAELFADGGQAQV

SEQ ID NO: 11526 - protein, 480 aa, Agrobacterium tumefaciens
KGKRLGLFIDGRFVEPRSGKFVDSYDPTTGEAWYQFAEGGADDVDLAISSAQRAFRDPSWRRMTQTARGKLVRRLADLVLEHAEDLALLETRDNGKLIKEMRAQMRAIPDSYLYFAGMADKLQGDTIPVNKLDQLNFNMREPLGVIGMVTPWNSPLMLLTGTLAPCLAIGNTVVIKPSEHATASTLALAELIVEAGFPAGVVNVVTGGGAVTGEALTRHNGIAKFVFTGSTATGRRIAANAAANLVPCQMELGGKSPHVVFSDVDIEKTVNGVVSGVFAAAGQTCVAGSRCFVEANIYDRFIEALVERTRNIKLGDPMDDATDIGPLALESQLSKLEGYVASGVREGSRIAIGGKRPQSEELSRGWYFEPTVMADATNDMSFMRHELFGPMVGVMPFSSEEEMISLANDTNYGLASGIWTQNIDRAMRFANQIDAGTVWINTYRSAAYMSANGGFKESGYGRRGGFDVMREFSRAKNVVI

SEQ ID NO: 11527 - protein, 335 aa, Agrobacterium tumefaciens
MKAVVMTGANQPWEVQEVPVPKAEPGLVLVKIHASGMCYTDVWATQGAGGDIYPQTPGHEVVGEIIEVGAGVHTRKVGDRVGTTWVQSSCGRCSYCRQNRPLTGQTAMNCDSPRTTGFATQGGHAEYIAISAEGTVLLPDGLDYTDAAPMMCAGYTTWSGLRDAEPKPGDRIAVLGIGGLGHVAVQFSKALGFETIAITHSPDKHKLATDLGADIVVADGKELLEAGGADVLLVTTNDFDTAEKAMAGVRPDGRIVLCALDFSKPFSIPSDGKPFHMMRQRVVGSTHGGQHYLAEILDLAAKGKVKPIVETFALEQATEAYERLSTGKMRFRGVF

SEQ ID NO: 11528 - protein, 239 aa, Agrobacterium tumefaciens
KTVIVTGASRGIGKGIALRFGEAGLNVLVVSRSQVDADRVASEIGVNGSGFAADVSTEEGCKAMVDAAVTRYGGVNVLCANAGIFPAAKLGEMSAADFDHVISTNLKSTFLSVSAVLPAMTSAGAGRIIITSSITGPITGYPGWSHYGASKAGQLGFMRTAAIELAPKNITVNAVMPGNIMTEGLEGNGPDYIATMEASVPLRRLGMPADIANAALFFASEEAAYITGQSIVVDGGQIL

SEQ ID NO: 11529 - protein, 403 aa, Agrobacterium tumefaciens
ERVAKRQATFGASSVLFYEQPIEMVSAQGAYLYDAGGRKYLDVYNNVPSVGHCHPRVVEAIARQVGELNIHTRYLNRVVEAYTENLLSKFPAGLSNVVLTCTGSESNDLALRIARIGTGAEGFIVTEAAYHGNTALVTEVSPSSLRKRKPAAFVAIIPAPAARDGMSVASNFAASVEQAINELNSRGIKFAALIVDTIFSSDGIYADPAGFLKEAVDVVHRAGGLLIADEVQPGFGRTGGSLWGFERHGVTPDIVTMGKPMGNGFPMGGVVTRPDLLQRFCEETGYFNTFGGNPVAAAAGHAVLRVIEEEGLIERSATVGGYFKQSLQALQSRHSEIGDVRGAGLFIGLDFVDPATGEPDSTRATHAINQLRHNSILIGAAGKYGATLKIRPPLCFSNEDVDL

SEQ ID NO: 11530 - protein, 569 aa, Agrobacterium tumefaciens
  unsure (1)..(569): unsure at all Xaa locations
LLDKPVQMTGGKILFKGRDLRSASQKELRSIRGNRIAMIFQDPMSTLNPVLRIDTQMMEVVHAHENVSKQVARERARDALGMVGIPSPEERLSAYPHQFSGGMRQRVAIAIALLMSPDVIIADEPTTALDVTIQAQILSIVQKLAREKGTALIWVTHDLSVVAGLAEKLSVMYAGRIVEQGLTADLLRRPLHPYTNGLIASLPAHNKRGERLRQISGTTPSVANMPKGCAFHPRCSFATEICLNSPALEPTEGRLLRCFHPVMEGAPSXANRLEVRNVSKRFSRKSGVVERGAELMGLKAPNPVVGALDDVSLTVSEREVVGIVGESGCGKSTLGRVVAGLLQASEGSVLFRGKQLAEMDGKAAEDARLKVQMIFQDPSSSLNPRQRVREIIGAAPLHHKMTSARELDDYVSQQMERSGLDPSMASWFPHQFSGGQRQRIGIARALAVQPDMLICDESVAALDVSIQAQILNLFLDLREQLDLTYLFISHDLSVVEHISDRVVVMYLGRVVEEAPVAELFAHPNHPYTRALLQERPSLDPVQRRFSSIEGEIPSPLSPPSGCHFHPRCP

SEQ ID NO: 11531 - protein, 282 aa, Agrobacterium tumefaciens
RHPTPPYPEQQQEPPGKTAEMKPIPDHGEQSYVGDGKLKGRVALITGADSGIGKAVAIAFAREGADIVISYLNEDDDARDTAKWVKEAGQGALLVPGDIKSEEHCKNLVHRAVNELGAVDILVNNAAFQRTYDDIADITAEEWDETFRTNIYAPFFLSKAAAPHMKPGSSIINTTSIQSRQPSPQLLAYASTKGAISNFTAGLAEMLAEKGIRVNAVAPGPIWTPLIPSTMPAEKAAKFGENTLIGRAGQPAELAGAYVLLASDLGSYMTGAVIPVTGGEIM

SEQ ID NO: 11532 - protein, 473 aa, Agrobacterium tumefaciens
MRILAVTAEMFPFVKTGGLADATSALPQALERKGADVRTLLPLYRGLTPLVRGRKPVLVANILEQPVSVYYVVSDGHKLLLLEAASLFDRDGHPYGVKGEPFADNDLRFAVLSKVAAEIALGAIDGWQPDVVHVHDWHAALTCVYLADSTPSVASVLTLHNLAFQGQYPLERAGMLGLPSHLCTVDCLEYYDDMSFLKGGLTTASAVTTVSPTYAREILTPEMGMGMHGVLARRRGDLRGIVNGVDHDVWNPATDPYILANFTAATATRRSLNKYALLQALGLAPTQGPVFGVVSRLTWQKGIDLLPHVVPLIIERKGRLIVHGEGDTALEDSLQALAKRYPELVCAHIGYDERLAHMIQAGSDFIIQPSRFEPCGLTQLYALRYGALPIVSRTGGLAETIIDANDAAIEAGVATGFQFEPANEDDLRAALERAISAYNDRELFRRLQTQAMQANFSWDKSAAQYMALFESLV

SEQ ID NO: 11533 - protein, 305 aa, Agrobacterium tumefaciens
  unsure (1)..(305): unsure at all Xaa locations
MTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGLXEYP

SEQ ID NO: 11534 - protein, 432 aa, Agrobacterium tumefaciens
VSLNNEQSFWNQANRHLTRYGPSFESIIVERASGSYVYDANDRPILDFTSGQMSALLGHTHPDIVATVDRQMRSVAHLFSGMLSRPVVELASRLAALAPGLDRVQLLTTGAESNEAAIRMAKLVTGGHEVVAFAQSWHGMTGAAAAATYSAGRRGYGPVAAGSLVIPAPNSYRPRFAKPDGTNDWQTELDDAFALIDNQSTGSLAAFIAEPILSSGGILELPAGYLAALKLKCEERGMLLILDEAQTGVGRTGHMFAFQRDGVTPDILTLSKTLGAGLPLAAVMTTEAIEQKAFEKGYLFYTTHVSDPLLAAVGVTVLDVVEREGLLAAAIGRGARLRAGLVSLQQRFECVGDVRGRGLLMGLEIVADRQTKAPGFALGAKIMEEAMRRGLSMNIVKLPGMGGVFRIAPPLTVSDEEIDHGIEIMSDSIQAA

SEQ ID NO: 11535 - protein, 297 aa, Agrobacterium tumefaciens
PQVLAFIRKTEASYPAQANTASAAENRAYYDAMCADFRAPRPENVIVVDRSISGVACRLYGLASPVCVLYLHGGGLVVGGLDSHDDVCVEIADATGLQIISVDYRLAPEHRWPAQINDVEAVWRAVDQPVVVVGDSAGGLLAAALCLSQKGKRQPLGQVLIYPGLGGDGDAASYRENAEAPLLRASDVLTYRDFVFGGQPATDPIARPLKAPDLSDLAPAFVVTADVDPLRDDGWAYAERLAAAGVPVTLRNEAQLPHGFLRARIMSDRARRSFQAVIAAISRFASNEVPLANFPHE

SEQ ID NO: 11536 - protein, 317 aa, Agrobacterium tumefaciens
  unsure (1)..(317): unsure at all Xaa locations
MQPMDLRGLSPAPVTAFTRDGEVDYAANAKIARWLASMEGVKSLVILGHAGEGTFLTEDERLELIRVYVDAVGGSLPIIAGITGEGTRVAAAEAKKCKAAGATGALVYPNHGWLRFGFQRGAPQDRYKAIWEESGLQEILFQYPDVTKASYDLDTQLAIATQPGVVATKNGVRNMKRWYVEIPELKNANPNLQVLSCHDEWLLPTMFDVDGLLVGYGNIAPELLIDLIKAGKAQDYPQARKIFEQLLPVTRAVYHRGSHMEGTVALKLGLVHRGVLDHATIREPLKNLGEKAEQEIFAAFDAAGIGRVEELLAAAEX

SEQ ID NO: 11537 - protein, 461 aa, Agrobacterium tumefaciens
MYQFDLIVVGSGPAGRRAAIQAAKLEKKVLVIEKGSRVGGVSVHTGTIPSKTLRETALNLTGWRERGFYGRAYRVKQEIDADDLRRRLLITLDHEVEVLEHQFARNRVQHIRGTASFIDANTMKVVKSDGEVMTVTATSILLTIGTRPYRPPHIPFDGQAVLDSDEILEIKELPRSMVVVGAGVIGIEYATIFSALDTQVTVVEPRETMLEFIDKEIVEDFTYQLRDRNMKLIFGQKAEKVERDESGKCLVSLSNGRVLKAETVLFAAGRVGATDTLNLSACGLEADSRGRLKVDPETFQTSVPNIYAAGDIIGFPSLASTSMEQGRIAARHAVGAPAGEPPQFFPYGIYAVPEISTCGLTEEEVVERGIPYECGIAHFRETSRGHIMGLDSGLLKMIFSLKTRRLLGVHIVGEGATELVHIGQAVLNLKGTVEYFVENTFNYPTLAEAYKIAGLDAWNRM

SEQ ID NO: 11538 - protein, 375 aa, Agrobacterium tumefaciens
MDVRAAVAIQAGKPLEVMTVQLEGPRAGEVLIEVKATGICHTDDFTLSGADPEGLFPAILGHEGAGIVVDVGPGVTSVKKGDHVIPLYTPECRECYSCTSRKTNLCTSIRATQGQGVMPDGTSRFSIGKDKIHHYMGCSTFSNFTVLPEIALAKINPDAPFDKVCYIGCGVTTGIGAVINTAKVEIGSTAIVFGLGGIGLNVLQGLRLAGADMIIGVDINNDRKAWGEKFGMTHFVNPKEVGDDIVPYLVNMTKRNGDLIGGADYTFDCTGNTKVMRQALEASHRGWGKSVIIGVAGAGQEISTRPFQLVTGRNWMGTAFGGARGRTDVPKIVDWYMEGKIQIDPMITHTMPLEDINKGFELMHKGESIRGVVVY

SEQ ID NO: 11539 - protein, 389 aa, Agrobacterium tumefaciens
  unsure (1)..(389): unsure at all Xaa locations
TPCFLYDNSAMRQAYRDLETALSGFADIYYSVKANPLPAIISLFREEGAGAEIASVGEYRAAVKAGVAPDNIIFAGPGKSMAELREVIEGGIGEIHIESAEEIARIEAINRPVKASIRINPVPDAQAGAMRMGGKATAFGFDEEELENVLKLFANVRHIDLVGIHIYGGTQILDADMLVSQWRHAIALAGRMAQMLGKPLETIDLGGGLGIPYFAGETSLDLAKVAAAIPDLKALLKAHPLIADAHVIVEPGRFLAGPGGLYVVEVNSVKTSRGTTFVVTDGGMHHHLAASGNLGQIVKRNYPIVAPAMMQAAHDETATIVGPLCTPLDTLARNATLPKLNAGDLLAILQSGAYGASASPGGFLSHTVAKEVLVEDGAFEVIGRXESCD

SEQ ID NO: 11540 - protein, 204 aa, Agrobacterium tumefaciens
LVLRLRGEGISDLDLLTAVEQTPRSKFVPPQFAADAYSSRTIPIDCGSFMEGADMAVKILARLQLKPGQRVLEIGTGSGFMTAIIARRVERVFSLERYKTLVQQAQNCLDDLSIRNVVIRQADGSNGLVGEGTFDRIVSTAAFTTMPRFFAEQIVSGGMMIAPIILEDERCVMTRFSKTGSRFEKEELFETPYLPLGSHIARHL

SEQ ID NO: 11541 - protein, 254 aa, Agrobacterium tumefaciens
MKIATWNINGVKARIENLCQWLKDSSPDIVCLQEIKSVDEGFPRLEIEALGYHIETHGQKGFNGVALLSKVKPDEVNRGLPGDDADEQARFIEGVFSVEGGAIRVCSLYLPNGNPPDDPVKYPYKLAWMERLRRFAEDRLAMEEPLILAGDYNVIPEPFDCHDPRVWEGDALFLPKTRAAFRKLENLGFTDAARATTDAAGLYSFWDYQAGAWPKNNGIRIDHLMLSAEAADRLQSVEIEKHVRAWEKPSDHVP

SEQ ID NO: 11542 - protein, 186 aa, Agrobacterium tumefaciens
ARPSQAEAEEAVRVLLRWAGENPAREGLLDTPKRVAKAYRELFAGYELNVQDVLGTTFEEVGGYDDVVLVRDIPFFSHCEHHMVPIVGKAHVAYLPAGRVLGLSKIARVVEIFGRRLQTQENMTAQIARSIEETLKPRGVAVMIDAEHMCMSMRGVNKQGSTTLTTSFTGTFKNDPAEQVRFMTMV

SEQ ID NO: 11543 - protein, 608 aa, Agrobacterium tumefaciens
MCGIVGIVGTQPVAERLVDALKRLEYRGYDSAGVATIDNGAMDRRRAEGKLFNLEKLVSEKPLPGVVGIAHTRWATHGVPNEINAHPHFVDGVAVVHNGIIENFSELREELSAEGATFTTQTDTEVVAQLLAKYTREGLGHREAMLKMLNHVTGAYALVVMFQDDPGTLLSARSGPPLAVGYGRGEMFLGSDAIALSPFTNEITYLVDGDCAIVTRDGAEIIDFSGKPVKRERQISQATAFVVDKGNHRHFMEKEIYEQPEVISHALSHYVDFATRTVKDADKAIDFASLSGLAISACGTAYLSGLIGKYWFERYARLPVEIDVASEFRYREIPLVPTQAALFISQSGETADTLAALRYCQQEGLKIGAVVNTRESTMARESDAIFPILAGPEIGVASTKAFTCQLAVLASLAVAAGKARGTLKPGEEKQLVQQLIEMPRIMSKVLNVIQPQIEALSRDLSRFKDVLYLGRGTSFPLALEGALKLKEISYIHAEGYAAGELKHGPIALIDENMPVIVIAPHDRFFEKTVSNMQEVAARGGRIIFITDEKGAAASKLETMATITLPNVDELIAPMVFSLPIQLLAYHTAVFMGTDVDQPRNLAKSVTVE

SEQ ID NO: 11544 - protein, 445 aa, Agrobacterium tumefaciens
FSDLGLSQKVLSAIADAGYTTPTPIQAGAIPPALEKRDICGIAQTGTGKTASFVLPMLTLLEKGRARARMPRTLILEPTRELAAQVAENFEKYGKNHKLNVALLIGGVSFEDQDRKLERGADVLICTPGRLLDHCERGKLLMTGVEILVIDEADRMLDMGFIPDIERIAKMIPFTRQTLFFSATMPPEIQKLADRFLQNPTRIEVAKPSSTAKTVTQRIVAAHNKDYEKRAVLRDLVRAEEAELKNAIIFCNRKKDVADLFRSLDRHGFSVGALHGDMDQRSRTTMLQNFRDGQLTLLVASDVAARGLDIPDVSHVFNFDVPIHAEDYVHRIGRTGRAGRSGKAFTLVTKSDAKYLDAIEKLIAEKIEWLSGDLSSLPAPMESFESNSGRRGTKERSGRGRDRNRRDAPASPVENINQDAQSVVDTDIAAHGEDKVKAERRPEKT

SEQ ID NO: 11545 - protein, 431 aa, Agrobacterium tumefaciens
MIPRYSRPEMVAIWSPETKFRIWFEIEAHACDALAELGVIPKSAAQTIWEKGGSATFDVARIDEIEAVTKHDVIAFLTHLAEFVGPDSRFVHQGMTSSDVLDTTLNIQLVRAADLLLADIDRVLAALKTRAFEHKNTVRIGRSHGIHAEPTTMGLTFARFYAEMHRNRERLVNARAEIATGAISGAVGTFANIDPRVEEHVCEKLGLIPEPVSTQVIPRDRHAMFFAVLGVIASSIENVAIEIRHMQRTEVLEAEEFFSPGQKGSSAMPHKRNPVLTENLTGLARLVRMSVVPAMENVALWHERDISHSSVERAIGPDTTVTLDFALNRLAGVIEKLVIYPDNMLKNMNKFRGLVHSQRVLLALTQAGVSREDAYRLVQRNAMRVWEQGADFLEELLGDEEVRAALPEDVIREKFDLGYHTKHVDTIFTRV

SEQ ID NO: 11546 - protein, 403 aa, Agrobacterium tumefaciens
MAKIKVANPVVDLDGDEMTRIIWQLIKDKLILPYLDLDIEYYDLSVENRDATNDQVTVDAAHAIKKHGVGIKCATITPDEQRVEEFGLKQMWKSPNGTIRNILGGVIFREPIICKNVPRLVPGWTKPIVVGRHAFGDQYKATDFKFPGKGKLTIKFVGEDGTVIEKDVFDAPSAGVALAMYNLDESIREFARASMMYGLMRKWPVYLSTKNTILKAYDGRFKDIFEEVYQTEFKAKFDEVGITYEHRLIDDMVASALKWSGGYVWACKNYDGDVQSDTVAQGFGSLGLMTSVLLSPDGRTVEAEAAHGTVTRHYRQHQKGQETSTNSIASIFAWTRGLAHRAKLDDNAELAKFATTLETVCVDTVESGFMTKDLALLIGPDQPWLSTTAFLDKIDENLKTAMA

SEQ ID NO: 11547 - protein, 302 aa, Agrobacterium tumefaciens
KKILVLGGAHIDRRGMIETETAPGASNPGSWMEEAGGGGFNAARNLSRLGFEVRIIAPRGGDVTGEVVAEAARQAGVEDTPFTFLDRRTPSYTAILERDGNLVIALADMDLYKLFTPRRLKVRAVREAIIASDFLLCDANLPEDTLTALGLIARACEKPLAAIAISPAKAVKLKAALGDIDILFMNEAEARALTGETAENVRDWPNILRKAGLSGGVVTRGASEVVAFNGTEKAILHPPLIREVKDVTGAGDAMASGYLAAIAEGKTIREALRQGAAAAAITVQSSFATSQDLSKDSVEAML

SEQ ID NO: 11548 - protein, 253 aa, Agrobacterium tumefaciens
KLFDLSGQVALVTGAGSGIGQRIAMGLAQSGANVALLDRRTDDGLAQTADFIARAGRKSIQIAADVTSKQALTDAVARTQAELGALSLAVNAAGIANANPAEEMEESQFQTMMDINLKGVFLSCQAEANAMLKNGRGAIVNIASMSGVIVNRGLMQCHYNASKAGVIHMSKSMAMEWVGRGIRVNTISPGYTATPMNTRPEMVHQTKLFEEQTPMQRMAGVDEMVGPAIFLLSDAASFVTGVDLLVDGGFCCW

SEQ ID NO: 11549 - protein, 579 aa, Agrobacterium tumefaciens
  unsure (1)..(579): unsure at all Xaa locations
QELERIARQIRLRDVQAVFEAGAGHVGGEMSAIDIMTALYFRVLRIWPNDPKNPARDRFVLSKGHTACALYVTLAKRGFIPEEEISTFLQPNSRLNGHPNCNKVPGVETNTGPLGHGLPVAVGMATAAKLSGEDYHTYVMTGDGEMQEGSNWEAIMSAAQFKLNNLTLVIDHNRFQQGAAIADTNDVAPLRPKLEAFGWEVTEINGNAMAEVVPALEHRGNRPHCIVAHTNKGHGISFMQDRVDWHHKVPSKEQYEIAVKELSEALXXTRPXPPPNCMIARDAFAETLEALAAANDKVVAVCNDSVGSSKLGGFKSKFPERLVNVGIAEQNMVGVGAGLANGGQLPFVCGASCFLTGRALEQIKADLAYSNANVKLIGISSGMAYGELGPTHHSIEDFAWTRVLPNLPVIAPCDRIETAAAVKWAADYAGPCFLRLSRVGVPDLLPEGHVFELGRANLLREGSDLTLIANGTLTHRIVKAADILLSRGIKARVLNMATVRPIDEAAIIAAAKETGAILTAEEHSIFGGLGSAIAEVVVDHSPVPMKRLGVPGVFAHTGSAEWLLDEFGMAPTAIADAAQ

SEQ ID NO: 11550 - protein, 469 aa, Agrobacterium tumefaciens
MRAILSIDQGTTNSKAILVSESGELLARGSSPVGITYPQPGWVEQDPNRIWASVREAISACLAAAPSDVSVEAIAISNQRESVTIWDGETGEPLGPVLSWQCRRTAQDCADLIAKGQSERVMALTGLPIDPMFPGAKMRWLLERAPKGRKLRLGTIDSWLIHCFTGGKVHACDASNAARSQVLDLNRQVWSDELCDLFGIDINALPDLRDSSGDFGVTSGVPGIKDGTPILAAIGDSHAALFGHGAFNPGDGKVTFGTGSSVMTTLPHFIAPERGITTTVAWRLGGKPTFAFEGNILVSAASLPWMTDILGLPDVAALVELAATAEPEGPGFVPAFVGLGAPYWDTNARALFSQINFSTTRAQMARAVTDSIAFQVHDVFAAMRAQSPSGFGRLFVDGGPSQNRFLMQCVADMLEHPVIQRDAPEASALGAAYLAGLALGVWSDLNAIAALNSNGNTIATSTGESRQRL

SEQ ID NO: 11551 - protein, 257 aa, Agrobacterium tumefaciens
FEGQSVFVTGGNKGIGYGIARRFAEEGAKVAIASVDKDTHDAAKKLADETGTVTHGVILDVRDAAAVRDAYGAAEDAIGALSISVQNAGVITISKIEDLTQEQWDLNLDVNTKGAFLCCQEAIRRFRASGTKGRLVNTASGQARQGFIYTPHYAASKFGVIGLTQSLAKELAPEGITVNAICPGIIHTEMWDYNDRVWGQMLGEYKPGELMAEWVRNIPMRRAGTPAEVAALVAFLASEDAAYITAQTINVDGGLIM

SEQ ID NO: 11552 - protein, 297 aa, Agrobacterium tumefaciens
IRNLTKSYANGFQALKGVSLDIKEGEILALLGPNGAGKTTLISIVCGLVNPGEGSVLVGGHNVVKDFRQTRALIGLVPQELTTDMFETVWNTVSFSRGLHGQKKNPALIESILKSLSLWDKKDNMLRELSGGMKRRVLIAKALAHEPKVLFLDEPTAGVDVTLRRDMWNVVSELRAKGVTIILTTHYIEEAEEIADRVGVINGGELLLVEEKTALMKKLGRKQLFLELTQPVERLPDSLAPFALTLSDDRSTITYEIEGNGEQGRIADLLGALSAANIHFKDISTRQSSLEDIFVSL

SEQ ID NO: 11553 - protein, 275 aa, Agrobacterium tumefaciens
MALKSFNPTTPSQRQLVIVDRASLYKGKPVKALTQGLSSKGGRNNQGRITVRFQGGGHKRTYRLVDFKRRKFDVEGTVERLEYDPNRTAFIALVTYTDGEQAYILAPQRLAAGDKVIASDKAVDVKPGNTMPLQYIPVGSIIHNVEMKPGKGGQIARSAGTYVQLVGRDAGMAILRLNSGEQRLVHGSCLASIGAVSNSDHGNINDGKAGRSRWRGKRPHVRGVVMNPVDHPHGGGEGRTSGGRHPVTPWGKPTKGKRTRSNKSTDKFIMRSRHQ

SEQ ID NO: 11554 - protein, 1368 aa, Agrobacterium tumefaciens
VMNLFNPQVPAQHFDSIRISIASPEKILSWSYGEIKKPETINYRTFKPERDGLFCARIFGPIKDYECLCGKYKRMKYKGIICEKCGVEVTLSRVRRERMGHIELAAPVAHIWFLKSLPSRISTLLDMTLKDVERVLYFENYIVTEPGLTSLKQNQLLSEEEYMIAVDEFGEDQFTAMIGAEAIYEMLASMNLEKIAGDLRAELAETTSDLKQKKFMKRLKIVENFMESGNRPEWMIMKVVPVIPPDLRPLVPLDGGRFATSDLNDLYRRVINRNNRLKRLIELRAPGIIIRNEKRMLQESVDALFDNGRRGRVITGANKRPLKSLSDMLKGKQGRFRQNLLGKRVDYSGRSVIVTGPELKLHQCGLPKKMALELFKPFIYARLDAKGYSSTVKQAKKLVEKEKPEVWDILDEVIREHPVLLNRAPTLHRLGIQAFEPMLVEGKAIQLHPLVCTAFNADFDGDQMAVHVPLSLEAQLEARVLMMSTNNILHPANGHPIIVPSQDMVLGLYYLSIMNQNEPGEGMAFSDIGELHHALENKVVTLHAKIRGRFKTVDADGKPVSKIHETTPGRMLIGELLPKNVNVPFDTCNQEMTKKNISKMIDTVYRHCGQKDTVIFCDRIMQLGFSHACRAGISFGKDDMVIPDSKVKIVGDTEALVKEYEQQYNDGLITQGEKYNKVVDAWGKATEKVAEEMMARIKAVEFDPETGRQKPMNSIYMMSHSGARGSPNQMRQLGGMRGLMAKPSGEIIETPIISNFKEGLTVNEYFNSTHGARKGLADTALKTANSGYLTRRLVDVAQDCIVNSVDCGTDKGLTMTAIVDAGQIVASIGARILGRTALDDIDNPVTGENIVKAGTLIDEADVAIIEKAGIQSVRIRSALTCEVQIGVCGVCYGRDLARGTPVNMGEAVGVIAAQSIGEPGTQLTMRTFHLGGTANVVDQSFLEASYEGTIQIKNRNILRNSEGVLIAMGRNMSVTILDERGVERSSQRVAYGSKIFVDDGDKVKRGQRLAEWDPYTRPMMTEVEGTVHFEDLVDGLSVLEATDESTGITKRQVIDWRSTPRGSDLKPAIIIKDASGAVAKLSRGGEARFHLSVDAILSVEPGSKVSQGDVLARSPLESAKTKDITGGLPRVAELFEARRPKDHAIIAEIDGTIRLGRDYKNKRRVMIEPAEDGVEPVEYLIPKGKPFHLQEGDYIEKGEYILDGNPAPHDILAIKGVEALASYLVNEIQEVYRLQGVVINDKHIEVIVRQMLQKVEITDAGDSQYIVGDNVDRIEMEDMNDRLIEEGKKPAYGEPVLLGITKASLQTPSFISAASFQETTKVLTEAAIAGKTDTLQGLKENVIVGRLIPAGTGGTMTQIRRIATSRDD

SEQ ID NO: 11555 - protein, 1357 aa, Agrobacterium tumefaciens
SFNGRRRVRKFFGKIPEVAEMPNLIEVQKASYDQFLMVDEPKGGRPDEGLNAVFKSVFPITDFSGASMLEFVSYEFEAPKFDVEECRQRDLTYAAPLKVTLRLIVFDIDEDTGAKSIKDIKEQSVYMGDMPLMTNNGTFIVNGTERVIVSQMHRSPGVFFDHDKGKSHSSGKLLFAARVIPYRGSWLDIEFDAKDIVYARIDRRRKLPVTSLLMALGMDGEEILSTFYTKATYERSGDGWRIPFQPEALKNAKVITDMIDADTGEVVVEGGKKLTPRLIRQLVDKGLKALKATDEDLYGNYLAEDIVNYSTGEIYLEAGDEIDEKTLGLILQSGFDEIPVLNIDHVNVGAYIRNTLSADKNQNRQEALFDIYRVMRPGEPPTMDSAEAMFNSLFFDAERYDLSAVGRVKMNMRLDLDAEDTVRTLRKEDILAVVKMLVELRDGKGEIDDIDNLGNRRVRSVGELMENQYRLGLLRMERAIKERMSSIEIDTVMPQDLINAKPAAAAVREFFGSSQLSQFMDQVNPLSEITHKRRLSALGPGGLTRERAGFEVRDVHPTHYGRICPIETPEGPNIGLINSLATFARVNKYGFIESPYRKIIDGKVTTDVIYLSAMEEAKYYVAQANAELDGEGAFTEEFVVCRHSGEVMLAPRDNINLMDVSPKQLVSVAAALIPFLENDDANRALMGSNMQRQAVPLLRAEAPFVGTGMEPIVARDSGAAIAARRGGVVDQVDATRIVIRATEDLDAGKSGVDIYRLQKFQRSNQNTCVNQRPLVSVGDAISKGDIIADGPSTDLGDLALGRNALVAFMPWNGYNYEDSILMSERIVSDDVFTSIHIEEFEVMARDTKLGPEEITRDIPNVSEEALKNLDEAGIVYIGAEVQPGDILVGKITPKGESPMTPEEKLLRAIFGEKASDVRDTSMRMPPGTFGTIVEVRVFNRHGVEKDERAMAIEREEIERLAKDRDDEQAILDRNVYGRLIDMLRGHVSIAGPKGFKKGVELSNAVVSEYPRSQWWMFAVEDEKAQSELEALRGQYDESKSRLEQRFMDKVEKVQRGDEMPPGVMKMVKVFVAVKRKIQPGDKMAGRHGNKGVVSRIVPVEDMPFLEDGTHVDICLNPLGVPSRMNVGQILETHLAWACAGMGKKIGEMLEEYRKTMDISELRSELTEIYASEANDEVQRFDDDSLVKLAEEAKRGVSIATPVFDGAHEPDVAAMLKKAGLHESGQSVLYDGRTGEPFDRKVTVGYMYMIKLNHLVDDKIHARSIGPYSLVTQQPLGGKAQFGGQRFGEMEVWALEAYGAAYTLQEMLTVKSDDVAGRTKVYEAIVRGDDTFEAGIPESFNVLVKEMRSLGLSVELEN

SEQ ID NO: 11556 - protein, 346 aa, Agrobacterium tumefaciens
MAIARGYAATDASKPLTPFTFERREPNDDDVVIDIKYAGICHSDIHTVRNEWHNAVYPIVPGHEIAGVVRAVGSKVTRFKVGDHVGVGCFVDSCVGCATRDVDNEQYMPGLVQTYNSVERDGKSATQGGYSDHIVVREDYVLSIPDNLPLDASAPLLCAGITLYSPLQHWNAGPGKKVAIVGMGGLGHMGVKIGSAMGADITVLSQTLSKKEDGLKLGAKEYYATSDASTFEKLAGTFDLILCTVSAEIDWNAYLNLLKVNGTMVLLGVPEHAIPVHAFSVIPARRSLAGSMIGSIKETQEMLDFCGKHDIVSEIETIGIKDVNEAYERVLKSDVRYRFVIDMASL

SEQ ID NO: 11557 - protein, 277 aa, Agrobacterium tumefaciens
IPAVTLPSGNEVPALGLGTWNMGETRSSADDEIESIRKAIDLGMTLVDTAEMYADGRSEEVVGTAIAGRRDEVFLVSKVYPWNASARGTAEACERSLARLGTDHIDLYLLHWRGEHPLGETVAAFERLKSDGKIGNWGVSNFDTDDMEELFTVPEGKNCAANQVLYNLSRRGPEFSLLPWCQEHGVPLMAYSPIEQGRILKNHELIRIAKAYQATPAQLALAFLLDRDGVIAIPKSASVSRIVENRGATDLEITEEDWTALDAAFPPPTRKTSLEML

SEQ ID NO: 11558 - protein, 241 aa, Agrobacterium tumefaciens
KVAIITGASSGIGRATAMLFVTQGAAVVINARGEKALQEVAADIRDAGGRVHAVAGDAGVAETHSRLADAAVGVFGGLDIAINNAGAVGAMKPLAEISPEEWDHVLNVNLTSAFLGARYQIPPMLKRGGGSIVFTSSFVGTSAGIPGMSAYGTAKAALMGLVKGITADYAINGIRANALLPGGVDTPAAGDPAQKEWAAGLHAMKRIAQPEEIAQAALFLASPMASFVAGAALFADGGNAA

SEQ ID NO: 11559 - protein, 167 aa, Agrobacterium tumefaciens
VTIIVAVSENGVIGRDLDMPWKLSTDLKRFKAMTMGKPLIMGRKTFLSVGERPLPGRPHIIVSRNADYRPEGVDVVSSLDEAVKLAKTKAVELGVDEVFVAGGGEIYRQAMPFADQLSVTHVAVKLDGDTFFPEIDPAVFEKTEEKAASAGEKDNYPVLFTTYVRRA

SEQ ID NO: 11560 - protein, 406 aa, Agrobacterium tumefaciens
SADDVKAVVKACAQYKVPVIPFGTGSSLEGQVNAPNGGICIDFSRMNRIIEVNAEDLDVTVEPGVTREDLNVYLRDTGLFFPIDPGANASIGGMASTRASGTNAVRYGTMKDNVLAVTAVVANGEEIRTARRARKSSAGYDLTRLFVGAEGTLGVITSVTLRLQGIPEKITGGVCTFDSIKAACDAVIMTIQMGVPVARIELLDEVQVRACNAYSGLNYAEKPTLFVEFHGTEETAALQSQQFAEIAAECGSVDFRWTGDAAERNKLWKARHDAYWASRALAPHLDGLSTDVCVPISRLADCVVETQRDIAENGFLAPIVGHAGDGNFHVLILFDGKDAESVAKTEAFVARLNRRAIAMDGTCTGEHGIGQGKMSFLAEEAGNALDLMRAIKTSLDPDNIFNPGKL

SEQ ID NO: 11561 - protein, 658 aa, Agrobacterium tumefaciens
RDQVRPAHDYLSGLNPEQREAVETLDGPVLVLAGAGTGKTRVLTTRIAHILATGRAYPSQILAVTFTNKAAREMKERIGVLVGGAVEGMPWLGTFHSIGVKLLRRHAELIGLKSDFTILDTDDVVRLIKQLIQAEGLDDKRWPAKQFAGMIDGWKNKGLTPPDIPEGDSRAFANGKGRELYAAYQARLKTLNACDFGDLLLHPISIFRRHTDILKEYHQKFRYILVDEYQDTNTAQYMWLRLLAQRAKDEPQNVCCVGDDDQSIYGWRGAEVDNILRFDKDFPGAKVIKLERNYRSTEHILGAAGHLIAHNEGRLGKTLFTERSSPDDEKVVVHAAWDSEEEARAVGEEIEQLQRKNYKLNDMAILVRASFQMREFEDRFVTLGLNYRVIGGPRFYERLEIRDAMAYFRLVCQPADDLAFERIVNTPKRGLGDTTIRNLHDYARARDIPMLAAAADIIETDELKPKARKALFDVVQDFRRWQGLLENTEHTTLAEQILDESGYTAMWQADKTAEAPGRLENLKELIRSMESFESMRGFLEHVALVMDAEQNAELDAVSIMTLHSAKGLEFDTVFLPGWEEGLFPHQRALDEGGRSGLEEERRLAYVGITRAKKLCHIWFVSNRRIHGLWQSTLPSRFLDELPPAHVDVAASDSNYGGY

SEQ ID NO: 11562 - protein, 294 aa, Agrobacterium tumefaciens
LEAPSGASIAFRHQPSALSPARGVLMICHGLVEHAGRYRRFADVMAKQGFEVYAHDHRGHGRTKAADAPLGRFAWKDGAEKVVSDVMAIRVMVGERHPGLPVILFGHSMGGLVALNAAVNHPDAFDGLSIWNSNLNPGVMGRIAQVVLRLEKMLKGSDVPSAILPKATFRAWNAKMPEKRTHADWLSHDKAAVDAYVEDPLCQFEASVSLWQDVFDLSYRAPKLIERLPKTLPLLLVSGDQDAATNDGREIVWLAERFRHAGFSHVEHTIYKGMRHETLNEIGWQAVAADFAAW

SEQ ID NO: 11563 - protein, 373 aa, Agrobacterium tumefaciens
  unsure (1)..(373): unsure at all Xaa locations
MNIVANWSYPTAVKLGRGRIKELAEACKTLGIRKPLLVTDRGLANMAITAHALDVLEEAGLGRAIFADVDPNPNEINMEAGVKAYRDGGHDGVVAFGGGSGLDLGKMIAFMAGQTRPVWDFEDIGDWWTRADASKIAPIVAVPTTAGTGSEVGRASVITNSQTHVKKIIFHPKLLPGVVICDPELTVGMPKVITAGTGMDAFAHCLEAYSSPFFHPMSAGVALEGLRLVKEFLPRAYKDGTDIEARTNMMAAAAMGAVAFQKGLGAIHSLSHPIGAVYNTHHGMTNAVVMPAVLRFNRPAIEDKIARAAAYLGISGGFDGFYDYVLDLRRELGVPENLTAMGIKPDRIDELAAEAIKDPSCGGNPVPMDAXEY

SEQ ID NO: 11564 - protein, 447 aa, Agrobacterium tumefaciens
SPIDGSVYAEREAMSLEAARAAVSTARRAQKDWARRPLEDRVQLVLKGVARLNEMVAEVVPELAHMMGRPVRYGGEFRGFNERSNYVASIAADALAPLVIEESGNFERRIEREAHGVVFVIAPWNYPYMTAINTVAPALMAGNTVVIKHAAQTLLVGERMVRAFVEAGVPEDVFINVFLDHGTTSTLISEGLFNFVNFTGSVEGGRAIERAAAGTFTGLGLELGGKDPGYVMEDADLDAAVDTLMDGGTYNSGQCCCGIERIYVNENLYDEFVEKSVAWVSNYKLGNPLEQETTLGPMANKRFAKVVRAQIADAVSKGAKALVDPKLFPADDGESAYVAPQILVNVDHSMEFMTEETFGPAIGIMKVKNDDEAIALMNDSKYGLTASLWTQDAARAARIGREIETGTVFMNRADYLDPALCWTGVKETGRGGSLSVLGFQNLTRPKS

SEQ ID NO: 11565 - protein, 290 aa, Agrobacterium tumefaciens
MRALYYERFGETPVVASLPDPAPSDGGVVIAVKATGLCRSDWHGWMGHDTDIRLPHVPGHEFAGVISAVGRNVTRFKTGDRVTVPFVSGCGHCHECRSGNQQVCETQFQPGFTHWGSFAEYVAIDYADQNLVHLPESMSYATAAGLGCRFATSFRAVTDQGRLKGGEWLAVHGCGGVGLSAIMIGAGLGAQVVAIDIAEDKLELARQLGATATINSRSVADVAEAVRDITGGGAHVSVDALGHPQTCCNSISNLRRRGRHVQVGLMLADHAMPAIPMARVIAHELEIYGS

SEQ ID NO: 11566 - protein, 414 aa, Agrobacterium tumefaciens
AARPLNSQDFRTLGLSALGGALEFYDFIIFVFFATVIGHLFFPPEMPDWLVMIQTFGIFAAGYLVRPLGGIVLAHYGDRYGRKRVFAFSILLMALSTLGMALMPTYATIGVAAPILLIILRMLQGAAIGGEVPGAWTFVAEHVPFRRVGLACGFLTSGLSFGIMLGSLIAFAINSLFTPEDVAGYAWRIPFLLGGVFGLIAVYLRRWLEETPIYMEMKKSKSLTDKLPLGLVLKHHRRGVIISALLTWVLSAAIVVTTLMTATFLQKLYGYTPTQALAGTSFGTLFLIFGVIIAGALIDRVGSGIFFMGASIFFGIATFTFYSYAGTSLETMFVLYGVMGLSVGMAGAVPYVMVRAFPASVRFSGLSFAYNVSYAVFGGLTPIGVTTALAINPMAHAWYLVFIAFLAFAIGLYL

SEQ ID NO: 11567 - protein, 371 aa, Agrobacterium tumefaciens
VIEGTGIGATGKVQAEVCFNTALTGYEEILTDPSYLGQIVTFTFPHIGNVGTNEEDIEDLTPAARRGAVGVIFKADITDPSNFRAVKHLDAWLKARGVIGLCGIDTRALTAWIRENGAPNAVIAHDPNGVFDIEALKAEAKAWSGLVGLDLAIEATSGQSSTWTETPWVWNKGYGTLGEADAKYHVVCVDFGVKRNILRLFAGLDCKVTVVPAQTSAEDILALKPDGVFLSNGPGDPAATGEYAVPVIQNLIKSELPIFGICLGHQMLGLAVGAKTEKMHQGHHGANHPVKDFTTGKVEIVSMNHGFAVDTKSLPEGVEETHTSLFDGTNCGLRIVGKPVFSVQHHPEASPGPQDSHYLFRRFVNLLRENK

SEQ ID NO: 11568 - protein, 1145 aa, Agrobacterium tumefaciens
MPKRQDIKSILIIGAGPIVIGQACEFDYSGTQACKALKEEGYRVILVNSNPATIMTDPGLADATYVEPITPEVVAKIIAKERPDALLPTMGGQTALNTALSLKRMGVLDRYNVEMIGAKPEAIDMAEDRALFREAMARIGLETPKSMLANATEIKDADRKTHEAARTELKAKLSGAELDKALDNLENQWNLGETDRKQRYISHAMAIAAQAIDVVGLPAIIRPSFTMGGTGGGIAYNRSEFFEIIGGGLDASPTTEVLIEESVLGWKEYEMEVVRDKADNCIIICSIENIDPMGVHTGDSITVAPALTLTDKEYQMMRNASIAVLREIGVETGGSNVQFAVNPKDGRLVVIEMNPRVSRSSALASKATGFPIAKVAAKLAIGYTLDELENDITGGATPASFEPSIDYVVTKIPRFAFEKFPGASPILTTAMKSVGEVMAIGRTFAESLQKALRGMETGLTGLDEIEIPGYEEGEGSKNAIRAAIGTPTPDRLRMVAQAMRMGMSEEEVHENSKIDPWFIAQLKAIVDMEARIREHGLPQDAENLRMLKAMGFSDARLASLTSKRPKEVAELRNSLNVRPVFKRIDTCAAEFASPTAYMYSTYETPFVGAARSEAQVSDRKKVVILGGGPNRIGQGIEFDYCCCHAAFALKDAGFEAIMINCNPETVSTDYDTSDRLYFEPLTAEDVIEIMRAEQEKGELVGVIVQFGGQTPLKLAEALEKNGIPILGTAPDMIDLAEDRDRFQKLLMKLDLAQPNNGIAYSVEQARLVASEIGFPLVVRPSYVLGGRAMQIIHSEGQLQTYLLDTVPGLVPEDIKQRYPNDKTGQINTLLGKNPLLFDSYLTNAVEVDVDALCDGENVFVSGIMEHIEEAGIHSGDSACSLPSRSLSKETLDELERQTTALAKALKVGGLMNVQYAIKDGTIYVLEVNPRASRTVPFVAKTIGAPIAKIAARVMAGEKLDAAIAAYGEKPDPRNLKHIAVKEAVFPFARFPGVDILLGPEMRSTGEVIGLDTDFALAFAKSQLGAGVDLPRSGTVFVSVRDEDKEGVLSAIRILVESGFKVLATGGTQRFLAEQGINAEKINKVQEGRPHIEDAIRNRQVQLVINTTDSNKAISDSKSLRRATLMQKVPYYTTMAGAEAAALAIK

SEQ ID NO: 11569 - protein, 400 aa, Agrobacterium tumefaciens
MAFLADILSRVKPSATIAVTQKARELKAKGRDVISLGAGEPDFDTPDNIKEAAIDAIKRGETKYTPVSGIPELRKAIADKFKRENGLDYKPEQTIVGTGGKQILFNAFMATLNPGDEVVIPAPYWVSYPEMVAICGGTPVFVNATLEDNFKLKPEALEKAITPKTKWFVFNSPSNPSGAAYSHDELKALTDVLVKHPHVWVLTDDMYEHLTYGDFKFVTPVEVEPSLYDRTLTMNGVSKAYAMTGWRIGYAAGPLPLIKAMDMIQGQQTSGASSIAQWAAVEALNGTQDFIPENKKIFEGRRDLVVSMLNQAKGISCPSPEGAFYVYPSCAGLIGKTAPSGKVIETDTDFVSELLEAEGVAVVQGSAFGLGPNFRISYATSETLLEEACKRIQRFCADCR

SEQ ID NO: 11570 - protein, 272 aa, Agrobacterium tumefaciens
SMVYKASGPLVLVGAGNMGGAMLSGWLKKGVPGSKVIVIDPRPSDAMRTTIAEAGATHSESVPEGVKAGILFVAVKPQMMDAILPSLKPLLGPETVVVSIAAGTTIATFVSHFGAVAAVRAMPNTPAMVGRGVTGAYANDLVTAELKTVVDGLLKVSGPVEWVEAESDIDAVTAVSGSGPAYVFYLVECMAEAGRKAGLPADVAMRLARETVAGAGELLHQSPEEAARLRQNVTSPGGTTAAALSVLMAEDGMQPLFDRAVAAAKTRAEELA

SEQ ID NO: 11571 - protein, 309 aa, Agrobacterium tumefaciens
MKVFAGNSNRHLAEAICKYLNVPLGNATVKRFADQEIFVEISENVRGEDVFIVQSTSFPANDHLMELLIMIDAMRRSSAKRITAVLPYFGYARQDRKAGPRTPISAKLVANLITEAGADRVLTLDLHAGQIQGFFDIPTDNLFAAPILARDVKDHYDTNNVMVVSPDVGGVVRARALSKRLDCLLAIVDKRRDRPGESEVMNVIGDVSGKDCILIDDIIDSGGTLCNAAEALLKKGATSVTAYITHGVLSGGAVARVASSKLRELVITDSIQPTTGVQSAHNIRVVSTAGLLGEAINRTAQEQSVSGLF

SEQ ID NO: 11572 - protein, 495 aa, Agrobacterium tumefaciens
EAPFKLKYGNYIGGKWVEPKSGRYMDNLSPVTGHKICEVPRSDASDIEFALDAAHKAREKWGKTSITERSNILLRIAQRIEDNLDLIARAETWDNGKPLRETTNADIPLTIDHFRYFAGCIRAQEGTIGEIDNDTVAYHFHEPLGVVGQIIPWNFPILMAAWKLAPALAAGNCVVLKPAEQTPASILIVMELIEDLLPPGVLNIVNGTGLEAGKPLAQSNRIAKIAFTGSTSVGKEIMRYAADNVTNISLELGGKSPNIFFADVMNEDDAFLDKALEGFAFFALNQGEVCTCPSRALVHESIYDRFMEKAIKRVQAISQDDPLNPSTMLGAQASQEQFDKIMSYLEIGKKEGAKVLTGGDRKTLTGDLKDGYYIQPTVFEGNNKMRIFQEEIFGPVVSVTTFKTVEEALEIANDTVYGLGAGVWSRDTNIAYRAGRGIEAGRVWTNCYHVYPAGAAFGGYKQSGIGRETHKMMLDHYQQTKNLLVSYSPNKVGFF

SEQ ID NO: 11573 - protein, 186 aa, Agrobacterium tumefaciens
ILTGNTMTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 11574 - protein, 616 aa, Agrobacterium tumefaciens
IFEYFENWIKPFARKDDLRPPESTFAFIWFYISQAKAPFFAMLVLGGLTAAIEAALFWFVGRLVDILSTVKPDEGWAGLLAAHGGELVGMLVLIGVVRFIVTMITALVDQQIITPGFYNLVRWQSYMHVARQSLTFFQNDFSGRIVTKVWSGGQAAGDLVTSLMESVWFVGIYSVSMLFLIGGLDWRLAVLVVVWVAIFSLLARYFVPRIRHHSKETAEAASMLSGRMVDAYSNIQTLRLFGRDDANDRYMRQGFDIFQTSTMKFTRFITGVRASMALLSGVMITSMAALCIDLWLSGKISSGAVAFTLALVLRLNFLLGRLMTQFNGIMRNFGTVQNAAELISQPIGLVDAPDAAVLEVKKPSIRFENVSFHYGRANGVIDNLNLEIRAGEKVGIVGRSGAGKSTLVNLLLRFYDVEKGRILIDGQDIARVSQESLRAHIGMVTQDTSLLHRSIRDNIMFGRTDATEAQLIEATRRAKADDFITRLEDQRGRTGFDAHVGERGVKLSGGQRQRIAIARVMLKDAPILVLDEATSALDSEVEAAIQSNLDELMQGKTVLAIAHRLSTIAALDRLIVMDQGLIVEEGSHAELVAQGGLYSELWARQSGGFLDAEDVK

SEQ ID NO: 11575 - protein, 606 aa, Agrobacterium tumefaciens
MFGWFEKRLDPFPSSTPDVPPKTLLSFIWHYVKPAWPWLLLLGLMSMGIAIAEAMLYKFLGNIVDWLSTANRETFFADEGWHLIVMAGLVLFLLPLMGAIHTMTMHQTLAGNFGMIARWKMHRFLLRHSMNFFANEFAGRVSTKVMQTALAIREVALKVIDVFVYAISFVVSMLFMVAAADWRLVIPLLIWLGIYMAILAYFVPKLGRLAQEQADARSMMTGRIVDSYTNISTIKLFSHAGREERYAREGMNVFLGTVHRQMRKISGFNILIDLNNAVVLFSTATLGLYFWMQGSVTAGSVAIAISLAMRVNGMSQWIMWEVTSLFENIGTVYDGMSMMTKPHDIVDVPKAPELAAPQGAIHYDNVRFHYGKNKGVIDGLTLDIKPGEKVGLVGRSGAGKTTLMNLLLRFYDLEGGRITIDGQDISKVSQDSLRELIGVVTQDTSLLHRSIRDNIAYGHPEATDEQVIAAAKRANAWDFIETLVDMHGRQGLDAQVGERGVKLSGGQRQRIAIARVFLKNAPILVLDEATSALDSEVEAAIQENLFSLMEGKTVIAIAHRLSTLTEMDRLIILDKGRIVEAGSHAELAAMGGIYADLWRRQSGGFI

SEQ ID NO: 11576 - protein, 287 aa, Agrobacterium tumefaciens
DKKAVAQAWFQHLRDTIVASFETLEDELTGPLSDQEPGRFVQKDWLRDNGEGGGGKMSMMEGRVFEKVGVHTSTVYGEFSPEFRKQIPGAEEDPRFWASGLSLIAHPVNPNVPAVHMNTRMVVTTSHWFGGGADLTPVLGRRRTQQDPDTQLFHRAFEITCNRHPIADYPRYKSWCDEYFFLKHRDEPRGTGGIFFDWLHPDEEKGGWDANFTFVQDVGRAFNLVYPKIVRANFNQNWTEEDRDEQLIRRGRYVEFNLLYDRGTIFGLKTGGNVESILSSLPPVVRW

SEQ ID NO: 11577 - protein, 438 aa, Agrobacterium tumefaciens
EHMTAITMNDALERAGAGAYQRRLMGIFGLVWAADAMQVLAVGFTAASIAATFGLTVPQALQTGTAFFFGMLLGAAGFGRLADRYGRRRVLIVTVACDALFGVLSIFSPDFTILLVLRFLTGAAVGGTLPVDYAMMAEFLPAKNRGRWLVFLEGFWAVGTLIVALAAWGASLAGVADAWRYIFAVTAFPAVLGLGLRFLVPESPLYLLRTGRSEEAKAVVNRMLVVNGRAPLDAGTGLFQPDVTKGQGIFSPALRQRSMMILAIWFLVSVSYYGVFTWMPAKLAGDGFGFVRGYGFLVLVALAQIPGYAIAAYGVEKWGRKPTLIGFCLLSALGCLLFTLASAGAMIAASLLIMSFALLGTWGALYAFTPELYPTESRATGMGAAGAMARLGGLLAPSLLGYAIAQGFGVAIGIFAGLLVLAAIAATMINAETRQVAL

SEQ ID NO: 11578 - protein, 548 aa, Agrobacterium tumefaciens
MTLPHAPVHKPQAQSDWWKGAVIYQVYPRSFQDTTGDGYGDLAGVTKRLPYIASLGVDAIWLSPFFTSPMADMGYDVSDYCNVDPMFGTLADFDALMAEAHRLGLKVIIDQVISHTSDKHPWFVDSRASRINSKADWYVWANPKPDGTAPTNWLSVFGGPAWEWDGVRKQYYMHSFLASQPDLNFHNPEVQDAVLETVRFWLDRGVDGFRLDTVNHYFHDKLLRDNPPLVDDESFGLDASDVNPYGMQDHLYDKTRPENVAFLKRFRALLDDYEGRATVGEVGDGARSLKTVAAYTSGNDKLNMCYTFDLLGPDFSAKHLRGSVETFGKVVTDGWVCWAFSNHDVVRHLSRFSEGPEEQTRVAKLAICVLASLRGSICLYQGEELGLTEAELAFEDLRDPMAFVSGPPSRARRMPTPMVWETGKPNAGFSTAEKPWLPVPYVHAMQAVDCAGAQAGFGSQPLSGVLSFRKTHGALRDGDMHFIKTNLDVLAFTRQRGDEKLLFVFNLTREPVEFPVPKAMSVTDILQMPGFAPLYDAGIVKLEGLDVF

SEQ ID NO: 11579 - protein, 258 aa, Agrobacterium tumefaciens
MHRTVIVTGSTSGIGLGIAQRFAREGANIVLNGFGDDDEIEKLRLLLEAESGGRVLYHPADMTKPDEIADLIQSSHEKLGSVDVLINNAGIQHIAPIEEFPTEKWDWIIAINLTSSFHTMRAAIPLMKKAGKGRIINISSAHGLVASPFKSAYVAAKHGIMGLTKTAALELAQTGVTVNAICPGYVLTPLVEKQIPEMAKVRGISEAAVKNDVMLELQATKQFVTVDDVAAAAIFLASDAASNITGTHISVDGGWTAQ

SEQ ID NO: 11580 - protein, 835 aa, Agrobacterium tumefaciens
DVSLLQDREKALIAAQAEAEALHRQLQAVLRALPVGVLLLNADLVIEYVNPFFYQVWGEIGGEKSLVGKSYREFMEMNFDSGLYDYGDRPFDDVYEERVQRLLKADAFAPREVRSKSGKVTVISKTRLEGGKILSTYADVTDVRMRDAEISKARAELERVGEYMQGATRAMAQGLVLVEQGTIIMSNEAMARMFDVPPHLLEKGRNWAGFFAHCAGRGDFGTAAEAGETLRIWRENIAANRPFSWLVHVAGKSWLNLEATNSSGNYWLIIVTDVTEMKVREEELQRLLSRAEAADRAKSEFLANMSHEIRTPMNGVLGMAELLAKSKLDTRQKTFTDIIVKSGNALLTIINDILDFSKIEAGQMKLRSVPFDPAEAVEDVVSLLSSAALEKDIELIVRIDASVSGKVIGDAGRFRQIVTNIVGNAVKFTETGHVLVELSAQSAEASESIFSLRVEDSGIGIPVDKLETIFDKFSQVDGSATRRHEGTGLGLAITVGLVGLFDGKINVVSEVGRGSAFEVDIPFQVMERRRDVPLLSVAIDDIRVLVIDDNDVNRRILTEQLRSWGIDGHAVENGPSGIAVLQEAASLGFAIDAIILDYHMPVMNGLDVVERIRADKRFDDIAIVFLTSMDVVGDETLFTDLSVQAHLMKPARARLLRSTLFDVVRDVRLKRIRQHPLAQGTGGEKARPESRPAEKKQRAEAPATVPERSRPCLLDVLVAEDNDVNQIVFSQILQQAGLRFLIVGNGKRAVQAWEEYNPALILMDVSMPVMNGHQATQAIRAAEQAAGDSRHVPVIGVTAHTQEADRERCLEAGMDDYLSKPISPESLEDKIAQWL

SEQ ID NO: 11581 - protein, 461 aa, Agrobacterium tumefaciens
SFNELGLSEKIVASVTQLGYTTPTPIQAKAIPLLLEGRDLIGLAQTGTGKTAAFRLPIIEMLMKQADRPANRTTRTLILAPTRELVNQIGDNLRSFVKKTPLRINQVVGGASINKQQLQLEKGTDTLVATPGRLLDLIARNAISLSKVTYLVLDEADQMLDLGFIHDLRKISRMVPPKRQTLLFSATMPKAISELASNFLTDPIKVEVTPPGKAADKVEQYVHFVAGKNDKTDLLKKSLNENPDGRSIVFLRTKHGAEKLYKHLEHIGFKVASIHGNKSQGQRERALKGFKDGEIKVLVATDVAARGIDIPAVTHVFNYDLPEVPDAYVHRIGRTARAGRDGIAIAFCAPDETRLLHDIEKLMKIDIPVASGERPAGLASPTRPNNNRGGRNNNGGQPRGPREGGRHNGESRPSRNHAPRDADNDLEVTSDFKRVKQAEGDAGRPAGPRKQRRPARKPGGS

SEQ ID NO: 11582 - protein, 276 aa, Agrobacterium tumefaciens
WGFDGSSTQQAEGHSSDCVLKPVAIYPDPARTNGALVMCEVMMPDGVTPHASNSRATILEDEDAWFGFEQEYFFYQDGRPLGFPEQGYPAPQGPYYTGVGFKNVGSVAREIVEEHLDLCLEAGINHEGINAEVAKGQWEFQVFGKGSKRAADQIWIARYLLLRLCEQYGIDVEFHCKPLGDTDWNGSGMHCNFSTKFMREVGGKDYFEALMAAFAKNWQEHIDVYGPDNHLRLTGKHETAPWNKFSYGVADRGASIRVPHSFVNNGYRGYLEDRRP

SEQ ID NO: 11583 - protein, 250 aa, Agrobacterium tumefaciens
FSLENRTAIITGSGRGLGFEIAKGFAEAGAHVWLTGRNAETLQQAVDTLRKAGGKADYAAFDIADTAAGSALVRRIMDEAGHLDILVNNVGARDRRPLAEFTDDDVLELIRTDLTSSISLSRDAAEAMNANGYGRIITITSILGHIVRPGDAIYPVAKQGLTGLMRAIAVEYGARGITSNAIAPGMFATETNAALAENPDMVAFAKLRVPLERWGRPDEIAGAALFLASDAASFVNGHILTVDGGMSVRL

SEQ ID NO: 11584 - protein, 405 aa, Agrobacterium tumefaciens
MTNVVVVGSQWGDEGKGKIVDWLSERADVVVRYQGGHNAGHTLVIDGISYKLSLLPSGVVRPGKLAVIGNGVVVDPHALIAEIGRLEVQGVKVTPENLRIADNATLILSLHRELDGMREDAASNSGTKIGTTRRGIGPAYEDKVGRRAIRVMDLADMEALSAKVDRILTHHNALRRGFGATEVSHETIMEELGSIAERILPFSETVWLLLDKKRRAGARILFEGAQGSLLDIDHGTYPYVTSSNTVAGQAAAGSGMGPGSLGYILGITKAYTTRVGEGPFPTELHDEIGQFLGEKGHEFGTVTGRKRRCGWFDAALVRQSVATNGITGIALTKLDVLDGLDELKICVGYKLDGQEIDHLPASQGAQARVEPIYVTLEGWKESTVGARKWADLPAQASNMSVRSKS

SEQ ID NO: 11585 - protein, 217 aa, Agrobacterium tumefaciens
DSWKHVLSGEFASPYMQKLKEFLLAEKTAGKRIFPKGAEYFRALDLTPLDEVKVVILGQDPYHGLGQAHGLCFSVQPGVRIPPSLVNIYKELQSDLGIRPVKHGFLESWAKQGVLLLNSVLTVEEARAASHQGQGWEKFTDAVIRAVNDECDHVVFLLWGSYAQKKAAFVDQRKHLVLRSPHPSPLSAHNGFFGNGHFSKANAFLVSHGRDPIDWQL

SEQ ID NO: 11586 - protein, 337 aa, Agrobacterium tumefaciens
MGFKVAIVGATGNVGREMLNILAERGFPADEVVPLASSRSQGTEVSYGDRTLKVSNLENYDFSDTDICLMSAGGEISKKWSPKIGQQGCVVIDNSSAWRYDQDVPLIVPEVNADAISGFTRKNIIANPNCSTAQLVVALKPLHDFAKIKRVVVSTYQSVSGAGKEGMDELFQQTRAVFVADPVETKKFTKRIAFNVIPHIDVFMEDGYTKEEWKVLAETKKMLDPKIKVTCTAVRVPVFIGHSESVNIEFENEITADQARDILREAPGCLVIDKHEDGGYITPVESAGEDATYISRIREDATVENGLNIWVVSDNLRKGAALNAIQIAELLVNRGLI

SEQ ID NO: 11587 - protein, 284 aa, Agrobacterium tumefaciens
FGLSAALTTPFKTDGTVDIDAMIAHARRCLSNGCDSVTLFGTTGEGCSVGSRERQAILSSFIAAGIAPSRIVTGVLVDSIEDAADQSAEALNAGARNILLAPPSYFKNVSDDGLFAWFSAVFSKIGKDARDILVYNIPSVTMVTLSVELVGRLKAAFPGIVTGVKDSSGNWSHTERLLKEHGDLAILIGDERDLARGVRLGGQGAISGVANFLTQEVRAMAVDGKDDPRIVDLVVELLKFPVTPAVKVLVSHTTGETIWSDVRAPLVAISPEDRRQIEGAFDAL

SEQ ID NO: 11588 - protein, 288 aa, Agrobacterium tumefaciens
MAPVNIQNVQKRFGSVNVIHGIDIDIKDGEFVVLVGPSGCGKSTLLRMIAGLEELSDGEIHIGPREVSHLPARDRDIAMVFQNYALYPHMTVKDNMGFALKLKKVSADETKAKVDRAAAILGLEKLLDRYPRQLSGGQRQRVAMGRALVRDPQVFLFDEPLSNLDAKLRVQMRGEIKAMHQRIGTTTIYVTHDQVEAMTMADKIVVLHDGIIEQIGAPLELYDNPANLFVAGFIGSPAMNFIRGRVEEGVFRTIKGLSLPLPAHADIGKLGGRDLVYGVRPEHIRAAE

SEQ ID NO: 11589 - protein, 291 aa, Agrobacterium tumefaciens
VLCVGAAVLDTLFRVADMPKGEGKVLPYEVLQIAEGMASSAAYAVHRMGGRASLWGAVGDDETGTRILRDLSESGIDTSGMTVAPGARSALSTIIIDNRGERLIVPFYDHRLHEKKRACTPEDIALFDAVLVDVRWPELALDVLTVARALGKPAILDGDVAPVETLEGLAPAATHIVFSEPAATRLTGLETVKDMLPVLHARYPQTFIAVTAGPAGCWWTEADDPTVHFQTTMQVEAVDTLAAGDIFHGTFALAMAEGMQSRAAVRLSSVAAALKCTVFGGRIGAPTREET

SEQ ID NO: 11590 - protein, 339 aa, Agrobacterium tumefaciens
VPVFDGHNDVLLRLWRSGNTSPETLLIEGDTVGHIDLPRARKGGLAGGLCAIYVPSPSMEKDANGDFSTPTEADALKATLGMAALLFRAEKQSAGALKVCRTAADIRSAMAEGAFASVFHIEGAEAIGDDLDALHVLHEAGLRTLGPVWSRPNIFAYGVPFRFPSTPDIGPGLTDTGKRLVKTCNELKIMVDLSHMNEQGFWDIAKISDAPLVASHSNAYALCNHSRNLTDRQLDAIRDTGGLAGINFGVLFLRQDGVKNPNTDLNELVRHVDYIVNRIGIDHVALGSDFDGTTIPAAMKDAGDLQLLVEALRKGGYDNEALARICHGNWVRVLEKTWG

SEQ ID NO: 11591 - protein, 575 aa, Agrobacterium tumefaciens
SMKKVLIANRGEIAVRIIRACRDYGLQSVAVYADPDQDALFVRLADEAYALEGVRPAETYLDISKLIAIAKRAGADAVHPGYGFLSERAEFAQAVIDAGLIWIGPDPDVIEALGDKVMARRIATGVGAPLVAGSDGPVSSAAEVTAFAEQHGLPVAIKAAHGGGGRGLKVAWKMEEIAELYESAVREATVAFGRGECFLERFLDRPRHIEAQVIADKHGNVLVLGTRDCSLQRRNQKLIEEAPAPFLSDEQRQKIHDAAKAICAAAGYSGAGTVEFLLGVDGTISFLEVNTRLQVEHPVTEETTGIDLVIEQFRIAEGHKLRVLETPEPRGHSMEFRINAEDPGRGFLPTPGLISVFDAPSGPGIRMDSGVISGSSIPGVFDSLMAKLIVTGVDRDQVLRRARRALREFRIEGIATVLPFHRAAIETEDFIGTDGFKVHTRWIETDFAAMPDAMERPAPADDPSITRTYLEIDGKRVSVGLPSILLSSLGTVSGGNASAPSAAVEKKEGEMTAPVSGTLQSFKVKDGETVSEGDLLAVMEAMKMETQIVATRAGKVRLIVKEGDYLQAGATLIDI

SEQ ID NO: 11592 - protein, 705 aa, Agrobacterium tumefaciens
CPAGQRGVSVIRREGNSMPAETKTTCPYCGVGCGVIATVNDSGVVSVKGDPDHPANFGRLCSKGSALAETIDLDGRLLHPEIAGRRAAWDEALDLVASRFSDAIAEHGPDSVAFYVSGQLLTEDYYLANKLMKGFIGSANIDTNSRLCMSSSVAGHRRAFGADTVPGTYEDMELADLVILTGSNLAWCHPVLYQRLAAAKAARPGMKVVVIDPRRTMSADIADMHLAIRPDGDVALFTGLLAHLFASSAIDRGYVENHTAGFEAATQAASEHSLPEIAEATGLTIAELIPFYELFERTEKTVTCYSQGVNQSESGTDKVNAIINCHLATGRIGRPGMGPFSLTGQPNAMGGREVGGLANMLAAHMSIENADDRDRVQRFWASPAIAQKPGLKAVDMFRAVADGRIKALWIMATNPVVSMPDAGAVEVTIKACPFVVVSDVMANTDTARHAHVLLPSLGWGEKDGTVTNSERRISRQRSFLDAPGEAKADWWQMAEVARRMGFDAAFAYQQPSEIFAEHAALSGFENAGRRDFDIGGIERDSYETMAPVQWPKAGAGEAEVTRFFANGRFYHADGKARFIATALPETDRTSADYPLTLNTGRIRDQWHTMTRTGKSARLTAHIAEPFAEIHPRDAQALGIKSADLVELESPHGKVLLRALVSERQARGSVFAPMHWNDQFASRARIDVVVAPVTDPHSGQPASKNV

SEQ ID NO: 11593 - protein, 447 aa, Agrobacterium tumefaciens
LPVFWGLEGKRVVLTGGSDGAAWKAELLLACGAQLDLYCEESGLSESLATLVAKSPMLTWHDRCWDADIFKGAELALADCEAEEEAGRFYHAARAAGVPVNVIDKPEFCQFQFGSIVNRSPVVVSISTDGAAPILAQAIRRRIETLLPLSLKDWGALAQTIRERVNLRLAPGAARRSFWEKFVDRAFTERLDEGSEERLLKDVATRTGLAESGRGFVTLVGAGPGDAELLTLKAVRALQAADVILFDDLVSAEVLELARREAKRMLVGKRGGRESCKQEDINDMMIRFAKAGRRVVRLKSGDPMIFGRAGEEIAALEAENIPVEVVPGITAASAMASRLGVSLTHRDHAQSVRFVTGHSRQGKLPENIDWQSLSNPSVTTVFYMGGRTAADIQSCLLAHGMPASTPVVVMISVSRVNEQRWCGSLAQLVAAVERLGVNEPVLIGVGD

SEQ ID NO: 11594 - protein, 499 aa, Agrobacterium tumefaciens
MSDEAIHDIFVIGGGINGCGIARDAVGRGYSVALAEMNDFASGTSSAATKLIHGGLRYLEHYEFRLVREALMEREVLWAMAPHIIWPMRFVLPFQKGGVRPAWLVRLGLFLYDHLGGRKLLPATRSLDLRRDPAGKPLKPIFARAFEYSDGWVDDARLVVLNARDAADRGAVILNRTQVVSARREGAFWRVETKNAAGESKTYRARMLVNAAGPWVDKVLAATFGKNNVHNVRLVQGSHIIVRKKFADPRAYFFQNPDGRIIFAIPYEQDFTLIGTTDRDYTADPRAVKISDEEISYLCNAASEYFAEPVKPADIVWTYSGVRPLFDDGASKAQEATRDYVLKTEGAEGEAPLLNIFGGKLTTYRRLAEHALEKIGDALGEKGTPWTAGSHLPGGNFGAEAYAEEVKALRSRYPFLDRRHAERLVRCYGTDAVAIIGAAADTTALGRHFGGTLYEAEVRWLMAREWALTAEDILWRRTKQGLFLTPEEVLGLTDYIDDI

SEQ ID NO: 11595 - protein, 496 aa, Agrobacterium tumefaciens
MGGYILAIDQGTTSTRSMVFDRDMRVIGVGQREFPQHFPASGWVEHDAEDIWKSVLETIRLALADAGIAASDIAAIGITNQRETTVLWDRNTGEAVHRAVVWQDRRAAPVCEDLKRRGLEPLFSKKTGLLLDPYFSGTKLKWLLDSVSGLREKAVKGEICFGTVDSFLIYRLTGGRRHVTDATNASRTLIYNIEDNAWDDELLSILNIPRAMLPEVLDCAADFGVTDKALLGAEIPILGVAGDQQAAVIGNACFEPGMMKSTYGTGCFALLNTGTDRVASTNRLLTTIAYRLDGVTTYALEGSIFIAGAAVQWLRDELGFISVASEVSALAEKADPKQRVYLVPAFTGLGAPYWDAEARGAIFGLTRGTGPAEFARAALESVAYQTFDLLDAMRKDWAGDNGKTVLRVDGGMVASDWTMQRLADILAAPVDRPVFLETTILGAAWLAASRAGIWPDRKAFADHWRRDRRFSPDMEESERKNAIAGWRDSVGRCLSK

SEQ ID NO: 11596 - protein, 288 aa, Agrobacterium tumefaciens
FTGHGGKQLRYAIFRATRSIARGTVVLLHGRNECIEKYFETVADLTAMGFWVATFDTRGQGGSERLLKKPGVGHVRRFSDYQRDISLFLEQVVLPDTRLPFFMIAHSTGALAALAAAPGLSNRIDRLALCSPFIELDSQQSVPRSVIRLVATALSLVGLGRVQLGRDQRERDFDGNPLTSDARRFARNLTLHRQFPELFIGAPTARWVYEALKTMGRVTRQDHLTNITVPTLILAPMLDTITPYKAQEELSRNFRAAQLLPITGARHELLHERDVFRKQALAAIDAFF

SEQ ID NO: 11597 - protein, 539 aa, Agrobacterium tumefaciens
FDAVVIGGGINGIAAYRDLALQGLRVLLVERNDFSSGCSAAPSRMIHGGLRYLENGEFGLVAESLRERDALLTLAPHMVQPLPTTIPIFSMFSGLFNAAATFFGSGGKPASRGALAIKAGLTLYDFVTRKNRLLPRHEFRGAGKTLKRWPGLTPDIRYSATYYDAWISQPERLALELLIDTSADAPQSIALNYAELVRNGDEYHIRAEETDETLPIRPRIIVNATGAWIDETIGTLSAGPAAEKQKPTVSGTKGSHLIIANDGLLKALNGHMIFFENADNRVCILFPYLGRVLAGSTDIKVDRPERVRCEPDERDYILDAIRQVFPDITVDHSDIVFSFSGIRPLPRSDAAFTGRISRSHFIHRVAGDPPQLCMIGGKWTTFRAFGEQVSDEVLAFLGRKRLTGTMNRPIGGGRNFPTGAGRLPALLSEQFSIDRRRAQHLALAYGSRAFELMGFCRGRPDDAPLSQKSPITAAEILWLIRCEHVRHLTDLILRRTTLAIAGLIDADLIDAILGVAARELGWTPTRAAVERQQLTQELE

SEQ ID NO: 11598 - protein, 489 aa, Agrobacterium tumefaciens
LGLDVGNTVIKAVLFDTAGRQIAQHAIDGHSTYPQPGYVERDLEELWRNGCEAIRQLLVKSAVDPNSIAGVGCAGHGNGLYLLDKEQQPLLGIQSLDSRAADMAAELDRKSGDLLQARCLQRPWPAQTPTLLAWVKRHALDLYAQTSTVLFCKDFINFRLTGCLANDISDLSGAGLLALPEVLLDRELLSLYGLEDAFAFFPRCVESADIVGQVTREAAGLTGLSEGTPVIGGFFDVVSSAMGSGVINPGEASVIAGTWSINSGVCGQTGRQPRCLHGHDFGRDRYVNIESSATSAANLEWYVHRVRADHGDHAFERCNELVGSVTPRADDPFFHPFIFGSRLGAEFRGGFYGLAGWHGEGHMVRALFEGVCFEHRRHIGVLREAGLPVESAVMSGGGSRSQHWPQIMADVLEIPLRVAEARETGALGAALGAAVATGLYPNYEEAVAAMTRVQNSYQPDTARVSHYRRRYGLYQELTGQLRSFWSALR

SEQ ID NO: 11599 - protein, 281 aa, Agrobacterium tumefaciens
TLDQSGTFHLAGRNIRRLGYGAMQLAGKGVFGPPKDREEAIAVVREAVDSGVNHIDTSDFYGPHITNQIIREALHPYADDLLIVTKVGATRGEDASWNAAFSKEELTQAVHDNLRNLGKEVLDVVNLRAMFDVHGPAEGSLAAPLEVLADLQRQGLIRHIGVSNVTPRQITEAGEIVEIVCVQNQYNLAHRQDDALIDTLAAQGIAYVPFFPLGGFSPLQSTVLSDVATQLDASPLQVALAWLLKRSSNILVIPGTSSRAHLRQNLAAASLDLPDSAMTAL

SEQ ID NO: 11600 - protein, 392 aa, Agrobacterium tumefaciens
GAVKPPVFLTSTFVFKSAEDGRDFFDYVSGRKEPPAGKGAGLVYSRFNHPNSEIVEDRLAVYERTESCALFSSGMSAISTTLFAFVRPGDTVLHSQPLYGGTETLLAKTFHNFGVSAVGFADGVSEASVMAAAETAMAKGRVSVILIETPANPTNSIVDVAMMRRVADVIGEKQGHRPIIACDNTLLGPVFQQPIEHGADISLYSLTKYVGGHSDLIAGAALGRKDVMKQVKALRGAIGTQLDPHSCWMLGRSLETLQIRMERANSNAKIVAEFLKAHPKVEKIHYLPFSDPASAVGKVFAAQCSGAGSTFSFDIVGGQPASFKFLNALTIFKLAVSLGGTESLASHPATMTHSGVPADVRQRIGVLDSTIRLSIGIEHPDDLIADLTLALD

SEQ ID NO: 11601 - protein, 460 aa, Agrobacterium tumefaciens
VSVTRREHDLLGTKEIPADVYWGVHTARAVENFKITGVTIGHNPYLVRGLAYVKEAAARANHELGLLDKERMEAIAEACREIRAGALHEQFVVDEIQGGAGTSTNMNANEVISNRALELLGHEKGDYSRLHPNDHVNLSQSTNDAYPTAINVGLIEAIDDLAVSMGVLKDAFDRKAQEFAGFIKIGRTQLQDAVPMTLGQEFRTFVVMLGEDQARLIESAALLHEINLGATAIGTGLNAPRGYAELACQHLAKLTGRPLVTAADLIEATQDPGAFVHLSGVLKRVAVKLSKTCNDLRLLSSGPRAGIGEITLPSVQAGSSIMPGKINPVIPEVVNQVAYAVIGNDITITMAAEAGQLQLNAFEPIIVRALSQSISQLSAACRTLAERCVEGIVANPGIMAQRVEESIGLATALNPLIGYYAATEVAKEALASGRTVPQVVLERGYLTETQLQQALSPRHL

SEQ ID NO: 11602 - protein, 478 aa, Agrobacterium tumefaciens
MHSGKTAPAEREVFVEEDLGYHKALKPRQIQMIAIGGAIGTGLFLGAGGRLAQAGPALVFVYALCGFFAFLVLRALGELIMHRPSSGSFVSYAREFYGEKMAFAAGWMYWLNWAMTSVADVTAVALYMNFFKQYVPWLAGIDQWVFAMTALVVVLAMNMLSVKVFGELEFWFSLIKVLALAIFLVVGVYFVIFGTPIEGHVTGFSLITDNGGFFPNGILPAFVIIQGVVFAYASIELIGTAAGETEDPRKVMPRAIRAVVLRLVVFYVGSVLLFTLLLPYTAYKAGESPFVTFFGSIGVEGADVIMNLVVLTAVLSSLNAGLYSTGRILHSMAVSGSAPAALAKMNKNGVPYGGIAVTAVVTVLGVALNAVVPSSAFEIALNLSALGIICAWAVIVLCQLKLWQLSQRGEIVRPDFRMFGAPYTGILTLIFLFGVLVLMAFDYPVGSWTIASLIVIIPALVIGWYLLRDRIYRLAAER

SEQ ID NO: 11603 - protein, 287 aa, Agrobacterium tumefaciens
KKIRKAVFPVAGLGTRFLPATKAVPKEMLTVVDKPVIQYVVDEAAEAGIEHFVFVTGRGKAVIEDYFDIQFELEQMLRERNKNAELTLLAGLLPKAGTASFTRQQVPLGLGHAVWCARDIVGDEPFAVLLPDMIMHSQKSCLKGMVELYDQTQGNVIAVQECAPDQTHKYGIVGVGNAVGEGFKITEMVEKPAKGTAPSNFYINGRYILQPEIFDILENQERGAGNEIQLTDGMLTLAKSQEFSGYHFRGQTFDCGAKDGFILANVAFALERGDIRPAIEEPIKALI

SEQ ID NO: 11604 - protein, 339 aa, Agrobacterium tumefaciens
PHSPANHPRVTFGKVGVLLVNLGTPDGTDYWPMRRYLAEFLSDKRVIEWSRLYWYPILYGIVLNKRPQKVGKAYEEIWNHERNESYLRTYTRSQGELMAAALKDFPNVVVDWAMRYGQPSIASRIDALKEQGCEKILLFPLYPQYAASTTATVNDKAFEHLMKLRWQPAIRTVPPYHDDPAYIEGLAASVKNHLATLDWEPEMLITSFHGIPQSYFKKGDPYYCHCQKTARLLREALGRTEKNFMITFQSRFGPEEWLQPYTDKTVEKLASEGIKRIAVMNPGFVSDCLETLEEIAGEAGEIFLHNGGEKFTHIPCLNDSTEGMNVLEKVVRRELQGWV

SEQ ID NO: 11605 - protein, 525 aa, Agrobacterium tumefaciens
MLSVSAITLSAGAALADYELNILHINDFHSRIESINKFDSTCSAEEEGKNECFGGAARLLTAINQTRDALKAGGKNVLLLNAGDNFQGSLFYTTYKGTVEAEVLNAMKFDAMTVGNHEFDDSEDGLAGFLDKVQFPVVTANVVATAASKIGDRVKPSIVLEVGGQKIGIVGAVANDTAELATPGPNITIAEDVAKIGEQVQKLKQDGVNKIIALTHVGYPRDLEFIAKIPDVDVVVGGHSHTLLSNTDQKAEGPYPTLVDNPGGYKVPVVQAGQYSKYLGDLKVVFDDNGVVKESKGDPILIDSTFKPDEATLKRIDELKAPIEALKSKVVGTSEGPIEGDRKVCRVKECSMGNLVADATLARVKDQGVTIAFANSGGLRSSIDGGDVSMGEVLTVLPFQNTVATFQLKGEDIRAALENGVSQIDDVAGRFMQVSGMKYSFDRSKPAGSRIVSVDVKEGDGFVPLDPTKTYTVAANNYVRTGGDGFKVFATNAINAYDFGPNLEDAVAAYITANSPYKPYTDGRI

SEQ ID NO: 11606 - protein, 471 aa, Agrobacterium tumefaciens
MKRNRKVKILATLGPASSEEAMIEKLHLAGADLFRINMSHASHDVMRTLIQRIRSVESRNGRPIGILADLQGPKLRVGKFAETKVDLVPGQTFTLDNNDTPGDNTRVFLPHPEILEAVKPGHRLLIDDGKLHLRAEKSDGKSIVTTVVSGTRISDRKGISLPDTLLGVGVLTDKDRVDLDAVLETNEVDWVALSFVQRPEDLAEVRKISRGRVGLMSKIEKPQAVERIEEIIELSDALMVARGDLGVEMPLEAVPGIQKQLTRACRRAGKPVVVATQMLESMITAPVPTRAEVSDVATAVFEGADAIMLSAESASGDYPIEAVSTMASIASTVEQDPYYSNIIYAQRPQPEATGADAISLAARQIAETLKLAAIVTYTSSGTTGLRAARERPQVPIIALSPIIQTARRLSVVWGLHCVVTGDASDLDDMVNRACRIVVSEGFGKPGDRIIISAGVPLGTPGATNMVRIAYI

SEQ ID NO: 11607 - protein, 568 aa, Agrobacterium tumefaciens
YLRRYRGLMAAALFALVLSSATTLALPLAVRRIIDHGFQTPDGGMINSYFAMLLAIAVVLALASAMRYYYVMTIGERVVADLRRDVFAHLTTLSQQFFDSNRSGELTSRLTADTVQIRSAFGSSASVALRNIIMCCGAVAMMIYTSPGLSGLALLAIPFIVFPLIAFGRSVRARSRTTQDTLANSAAYASETIAASRTVQSFNAEVLANARYGASVEAAYQGARAAIGARSVLTAVAIALVFGSVVGILWYGAQNVLAGSMTAGTLGQFVLYSVIAASGLGQLSEVWGELAQAGGAAERLSELLNERSPVAEPAAPVAMPQPPRGEAEFDNVDFVYPLATGRPIVSGLSLKVAAGETVAIVGPSGAGKSTVFSLLMRFYDPQQGRITIDGVDIRNVSLADLRARLSIVPQDVAIFASSIHDNIAFGRPEATREDVRAAAIAAQADGFIERLGDGYDTQVGERGVTLSGGQRQRIAIARAILRDAPILLLDEATSALDAESETLVQKALDELMKTRTTIVIAHRLATVLKADRILVMDEGRIIEEGTHQSLIRQNGLYARLARLQFQTG

SEQ ID NO: 11608 - protein, 372 aa, Agrobacterium tumefaciens
  unsure (1)..(372): unsure at all Xaa locations
QMTERLEDIAIKMVADGKGLLAADESTGTIKKRFDSINLESTETARRDYREMLFRSDDAMKKYISGVILYEETLFQKAADGTPFVDIIKAAGSLPGIKVDIGAKPMAFHPHEFITEGLDGLYERLRKYHEAGARFAKWRGVITIGEQRPSWGSIKANSQSLARYAALCQQADIVPIVEPEVLMDGEPGTHDIDRCAEVTQWVLQTVFADLFDARVNLEGMILKPNMIIDGKNARKASVEEVAEKTVKVLKATVPTAVPGIAFLSGGQSSEEATAHLSAMNAGYDLPWSLTYSYGRALQDTALKTWGGKSENVAAGQRAFTHRAAMNSLAAKGNWKQELEKAAXAIAHRQIVQLKPPRWAAFSLRPQKQRRRP

SEQ ID NO: 11609 - protein, 394 aa, Agrobacterium tumefaciens
AFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAIL

SEQ ID NO: 11610 - protein, 325 aa, Agrobacterium tumefaciens
KVAINGFGRIGRNVLRAIVESGRTDIEVVAINDLGPVETNAHLLRYDSIHGKFPADVKVEGDTIIVGGGKPIKVTAVRDPATLPHKELGVDIALECTGIFTARDKAAAHLTAGAKRVIVSAPADGADLTVVFGVNDDQLTKDHLVISNASCTTNCLVPVVKVLDDVIGIDHGFMTTIHSYTGDQPTLDTMHKDLYRARAAALSMIPTSTGAAKAVGLVLPHLKGKLDGTSIRVPTPNVSVVDFKFIAKRDTTVEEVNEAIKSASNGKLKGILGYTEEPLVSRDFNHDSHSSIFAIDQTKVMEGNFVRVLSWYDNEWGFSNRMSDT

SEQ ID NO: 11611 - protein, 651 aa, Agrobacterium tumefaciens
SRDKHNRMANAIRFLAMDAVEKANSGHPGLPMGAADVATVLFTRYLKFDPKAPLWADRDRFVLSAGHGSMLLYSLLYLTGYEDMTIDEIKRFRQFGSKTAGHPEYGHATGIETTTGPLGQGIANAVGMAIAERKLEEEFGSDLQSHFTYVLCGDGCLMEGISHEAIALAGHLKLNKLVLFWDDNNITIDGEVGLSDSTDQIARFQAVHWNTIRVDGHDPDAIAAAIEAAQKSDRPTFIACKTVIGFGAPNKQGTHKVHGNPLGAEEIAAARKSLNWEAEAFVIPEDVLDAWRLAGLRSTKTRQDWEARLEATETAKKAEFKRRFAGDLPGNFDSSIDAFKKKIIENNPTVATRKASEDSLEVINGILPEMVGGSADLTPSNNTKTSQMKSITPTDFSGRYLHYGIREHGMAAAMNGIALHGGLIPYAGGFLIFSDYCRPSIRLAALMGIRVVHVLTHDSIGVGEDGPTHQPVEQIAALRAIPNLLVFRPADETETAECWQLALEQKHRPSALALTRQNLTPSRKEYEEKNLSAYGAYELVSASDAKVSIFASGSEVEVALKAAATLKDKGVSARVVSVPCFELFKEQPETYRNAIIGKAPVKIAVEAAIRQGWDYFIGNDGAFVGMHSFGASAPAKDLFKHFGITAEAVVA

SEQ ID NO: 11612 - protein, 632 aa, Agrobacterium tumefaciens
MNPNFRNFALWAVIALLLIALFSMFQTSPTQTGSREIPYSQFIRDVDSGRVRDVTVTGNRVLGTYTENGTAFQTYSPVIDDSLMERLQSKNVTIVARPESDGSSGFLSYLGTLLPMFLILGVWLFFMRQMQGGSRGAMGFGKSKAKLLTEAHGRVTFDDVAGVDEAKQDLEEIVEFLRDPQKFQRLGGKIPRGVLLVGPPGTGKTLLARSVAGEANVPFFTISGSDFVEMFVGVGASRVRDMFEQAKKNAPCIIFIDEIDAVGRHRGAGLGGGNDEREQTLNQLLVEMDGFEANEGIILIAATNRPDVLDPALLRPGRFDRQVVVPNPDIVGRERILKVHVRNVPLAPNVDLKILARGTPGFSGADLMNLVNEAALMAARRNKRVVTMQEFEDAKDKIMMGAERRSSAMTEAEKKLTAYHEAGHAITALKVAVADPLHKATIIPRGRALGMVMQLPEGDRYSMSYKWMVSRLVIMMGGRVAEELTFGKENITSGASSDIEQATKLARAMVTQWGFSDALGQVAYGENQQEVFLGHSVSQSKNVSEATAQTIDTEVRRLIDEAYTEARRILTDNHDGFVAIAEGLLEYETLTGEEIKALLRGEKPARDLGDDSPGSRGSAVPKAGAKKDGPSE

SEQ ID NO: 11613 - protein, 443 aa, Agrobacterium tumefaciens
RRYFGTDGIRGQSNVFPMTPDLAMRVGIAVGTIFRRGHHRHRVVIGKDTRLSGYMLENALVAGFTAAGLDVFLLGPIPTPAVAMLTRSLRADIGVMISASHNPFSDNGIKLFGPDGYKLSDELELEIEDLLDKDIYAQLAKPAEIGRAKRVDGDIYRYIEFVKRTLPRDVTLSGLRIAIDCANGAAYKVAPAALWELGAEVVTIGNEPNGININLECGSTHPEALQKKLHEVRADIGIALDGDADRVIIVDERGEIVDGDQLMAVIADSWAADNTLRGGGIVATVMSNLGLERFLGDKGLTLARTKVGDRYVVEHMRNHNFNVGGEQSGHIVLSDYGTTGDGLVAALQVLAKVKRSGLTVSEVCRKFEPVPQLLKNVRISGGKPLENPIVLQAIADAESALANNGRLVIRPSGTEPLIRVMAEGDDSAKVEKIVNDLVGVISS

SEQ ID NO: 11614 - protein, 380 aa, Agrobacterium tumefaciens
MKPDLRPGNTHFSSGPCSKRPGWSLDALSDAPLGRSHRAKVGKAKLKQAIDLTREILNVPADYRIGIVPASDTGAVEMALWSLLGERGVDMLAWESFGAGWVTDVVKQLKLKDVRKFEADYGLLPNLAEVDFDRDVVFTWNGTTSGVRVANADFIPADRKGLTICDATSAAFAQDMDFTKLDVVTFSWQKVLGGEGGHGVIILSPRAVERLLSYSPAWPLPKIFRMVSGGKLIEGIFTGETINTPSMLCVEDYIDALLWAKNLGGLKALIGRADANAKVIYDFIEKNNWIANLAVKPETRSNTSVCLKIVDPEVQALDAAAQADFAKGIVALLEKENVALDIGAYRDAPSGLRIWAGATIETADMEAVMPWLAWAYQTQK

SEQ ID NO: 11615 - protein, 2712 aa, Agrobacterium tumefaciens
  unsure (1)..(2712): unsure at all Xaa locations
MRGETLSERLRAFLAGKLPAYMVPREFVIMERLPLSANGKVDRQALPAPGGRARQTVAPATENESALLAIWHELLSSDSAGVEDNFFEAGGDSLTIMQLLSRIRQEFSVHLTLAQLFGATTVKAQSELLGSLSPSLPDEAETGISPIVAPTSVNDLSDDDVDKMLEQLLSGQKDQXTXTQWIFPDXPRRKSGSFCSAXWLDSRHPEKKNFRLSHAQERIWFVEQMQPGTGAYSIPVAIRLEGPLDRDRLRICFDIVVQRHESLRTVFEVQDGEPFQVIVSQTTADFSFHEPGDDEAARDVAIGRFAQEPFNLSQGPLFRVGLFSVAPDEHTLVMVIHHIISDYASLQILIDEVYRLYSAAEAPAIGQLPALDIQYRDYAEWQRNGTAALSGQIDYWREQLRDAPLLLQLPFDFARPVTQSFQGARHKFRLGPALSSAVKDLAKSRKLTTFMVLLAAYQILLARLSRSDDICIGTTASNRNRAQTRNLIGLFVNNLVLRTRLQPNDTFDTLLDRVRDTTLEALSNQDVPFEQVVDALNVERDIGHNALFQSTFVLHNASGAAFDLGDIKVTPIALDSGASRFDLSLDMHEGRGNEGFSGVFEFNTELFLPETVSRFSAYFLRLLGGLVSNPGGRIAEIDLLDKTEHAAIATANRTTIAFPLRDFASLLEETAQVRGSSVAVRCGDRQYSHGDLNEAANRVASGLRDRIGNSKPHPRIAICLPRSENLVIAILAVLKLGGHYVPLDPGHPAERRALILEDCKPDIILISEGEDTAYPCGCMAIEPLLRATGSFGNPHRETLPDDLAYIIYTSGSTGRPKGVPIRQKSLVNLLTSMARRPGMSAEDRFLAVTTPAFDIATLELLMPLMVGGLLIIAEADDIYDDMALSELIRNHSATMMQATPATWRLMADADWKAPAGFRMLCGGEALEPGLARRLLAAGGELWNLYGPTETTIWSTCTRICAEHLELPALPVGEPIANTQLHLLDDALMPVPAGVVGELYIGGEGLSPGYFNRDDLTSRAFVEGPAAGSNGGGERSRLYRTGDLMRRSAAGHLLYVGRADFQVKLRGFRIELSEIEAILAAQPSIEQAVVALFQDEEGSGTLVAYCRRGTSPVDEDALRAALASQLPSYMLPAAYVWMDRFPLNANGKIDRKRLERPKQIVSSTAYTAPLEGTEQIVAAIWRELLGAEKIGRDDNFFTVGGHSLLATRMLARLRASFAIDLPLRTFFERPRLADFAGAVDALVAMTERRPEAVSSALSKREHTGPTPLSHAQNRQWALAQLEPDSPLYNIPFALKIRGALDFEILSHALELTAQRQDTLRSRFVSVDGKPFVETDPEMIFKIVPEEIGDRELEAALLDCARRPFDLAVAPLLRIHAFRTGPQDHVLLFLLHHIIGDALSAEILLNDVATFYASLSKKEAPPNGALPLQYSDFAIWQREQDTTNEVDYWRRTLAGAPPLLELPTDFVRPAIQGFSGESIRFSLNADLLARLRQLCDQQGATLFMGMLTAFSTLLQRVSGMRDIVIGTPVSERFHPDLENVIGMFANTLAIRLQTQGGENFNEALKAARDTALSAFANQTAPFEKVVDALSLPRTWSHNPLFQAMLVSTVETRRGAISLAGMEWDRLALPDTSSRVDLTLFIHETAEELSCRLEYRSDLFRRATMESLGEALVALLEKIVERPELPLDRQSLVSGNHQKRLRQWNETDAEFQPQRRCLHDFVTASAETSPQAIAVTDQDRSLSYAELDWRADRLASGLVAAGIGRGKRVGIRLERSVELVVAILAVLRTGAAYVPLDPRYPADRIEFIAADADLALILVTTENDISTIGQNFRCMTPGMVENLAGGAVPTPVTSGADLAYLIYTSGSTGRPKGVAIEHRNAVAFMQWCMHAFTKDQLSGVLASTSICFDLSIFEIFATLAAGGRIFMVDDLFAFPSAPFAGEVTLVNTVPTPMSELLKLGPLPQNVKTVCLAGEPLPRELVARIYANDQVECLYNLYGPSEDTTYSTVAPVPPSGEWFGIGVPIANTRAYVLDGEMNEVPVGVPGELFLSGSGLARGYWNRPGQTAERFLPNPFADCSQHRVMYQTGDIVRRRDDGGLDYMGRADRQLKLNGFRIEPGEIEAVLLQQEGVHEAVAGLWRDAANHPRLAMWIAGDPALEITKLVATLRQRLPEHFIPVLATRLDALPRLPNGKLDRSALPDPAAYGERATETASLLNDQEDVLAQIWQGLLGCGDIRRNDNFFSLGGDSILAIQLVSQARQKGLKMTPRDVFLHPTLASLAEVTHVESTVTVGTGHADDEATLGAIQHWLLDQDLPDLAHWNQGLILKLTRSLDPDRLEKAISRLLEEHQSLRARFLRKNGQWQQKFAPLSAMPPMQQLAATDENDVTDFARKLHAGFDLGAGPLFGAILATLPDGSGRLILAAHHLIVDGVSWRMIVADIERHYLEASTIRSGAVAAGSWNSRLSRSALFDGEEEYWRGVCEEDVRALPLDNESGSNTQSDAVTYRQTIDAETTRQLLRDVPECFSIASNEVLVAALYLTLRQWSGQPRLRLEMESHGRLNLFEDIDVSETVGWLTALYPVLFDTPDDATPDRLLLDVKDTLRRIPNNGVGFGVLKYLRNKAEHLDYGKPQLRFNYLGQMDAMFAIDSLFAPSGITSGPMYGAANPRDTILEINAMVVRGELQLQWVYGAQLHSEDTIRTLADHFRDNLETLIQH

SEQ ID NO: 11616 - protein, 505 aa, Agrobacterium tumefaciens
QSTSSARRLPATARDRKSQRRPSNEYSNNSGTATHPATDPVTAIVTGFNLKTPGSKRAAAYNRDFLSDKSSIGLPFTMQTKEALYPIVATHAEGAYLQDVDNNRYVDILMGLGTNLFGHNPSFIRTAIEAQLTKGFALGPQSDLAGETAELFCCITGKDRVTFSNTGTEAVQTAMRIARAATGRDKIVLFTGSYHGHSDPALHKATKLEYIRRGALLRSHPAWLVALKPLLKRMVLTKAVPGFSGVAPSSARDIVLLEYGNPRSIDYIRRHGDSLAGVLVEPVQSRNPELQPREFLHELRSVTEKTGSALIFDEMITGFRVAPGGAQSHFGIDADIATYGKIAGGGLPLSLIAGKGRFMDFVDGGAWAYGDSSFPKVAPTFFAGTYCRHPLALAAAKAVATRLLEDGPTLQEGLNARTQAFVERLNGALKGAGLPVAFMSFGSFFAISAARSRISPQAVTMLSFLLLTSGVHLRAGDRGGFLSTAHSDDDIAFVHDAVLQSLTAL

SEQ ID NO: 11617 - protein, 246 aa, Agrobacterium tumefaciens
KETPMKRLEGKVAIVTGAGRGIGRATAKLLATEGAKVAVLSLTPANVDAVVADIEAAGGTALGIAIDVSDADAIKPAIDTVVATWGGIDILVNNAFDPSVVQSSVLDLSVEQLQRNFDTGPIAFLRMMQAAYPHLKTSGEGRIINFGSMAGVTGMVPYAPYNMAKEAIRALTRVAAREWGADKITVNNVLPIADTWGAAAANIPAPANALARHGSPEDDIAPVVLFLASKDAQFITGYSLTPDGGM

SEQ ID NO: 11618 - protein, 165 aa, Agrobacterium tumefaciens
RRNIVFVGLMGAGKSAVGRMVAQQLKVPFIDTDVEIERVSRMTISELFATYGEEEFRALETRVIKRLMRGGPKVVSTGGGAFINDTTRGHIRRGGISLWLKADLEVLWERVNKRDHRPLLKTENPKATLAALMEKRYPIYAEADVTIESRDVRKEIIATEVLTAL

SEQ ID NO: 11619 - protein, 351 aa, Agrobacterium tumefaciens
RLVHVPLGERAYDILIGPGLIGRAGGEISARLKGRRAAIITDEHVAPLYLEGLMDGLQTDGIEAVSLTLPAGEKTKSFEHLVTVCDAVLSARVERNDAVIALGGGVIGDLAGFAAGIVRRGVRFVQIPTSLLSQVDSSVGGKTGINTRHGKNLVGVFHQPDLVLADTAVLDTLSPREFRAGYAEVVKYGLIDKPDFFFWLEKNWDDIRTGGPARIEAIATSCQAKADVVVADEKENGVRALLNLGHTFGHALEAATNYDSKRLVHGEGVAIGMVLAHQFSARLNLASPDDAARVEAHLKAVGLPTTMKDIPGELPPVETLMAAIAQDKKVKGGKLTFILTHGIGQSFVADD

SEQ ID NO: 11620 - protein, 274 aa, Agrobacterium tumefaciens
GKSGRRMRRFWPANGEDTMKPLEIDVFLCRSDNFGVLLHDPESGATAAIDAPEEGPILRALDGHGWKLTHIFTTHHHQDHVEANLVLKDKFRCEVHGPYDEAIAIPGLDRSQADGDEFEFAGRRVQVIATPGHTAGHICYYLPDDGLLFAADTLFAMGCGRLFERPAADMWHSFQKLMALPDDTRVYFGHEYTLSNARFALTVDPDNAVLRERAARVETARQANEFTIPTTIGLEKQTNPYMRVADAGIRRHLGLEGAADADVFAEIRTRKDNF

SEQ ID NO: 11621 - protein, 351 aa, Agrobacterium tumefaciens
MSAELNQPVPRPGILDIAAYVPGKEHVDGVAKVYKLSSNETPLGPSPKAIEAFSAAASHLEIYPDGQAIALRQAIADVHGLNIANILCGNGSDELLGLLCHVYLGAGDEAIITEHGFLVYKIQIMGAGATPVTVKEKDCVVDVDAILAAVTPKTKMVFLANPGNPTGTYVPVAEIRRLQAGLPKHVVLVLDAAYAEYVRKNDYEAGLELVSGNRNVVMTRTFSKVYGLAALRVGWMYAPVDIIDALNRVRGPFNMSAPAIAAGAAAIRDQAFVQKAVAHNALWMEKLVTTFTGLGLTVTPSVANFILIHFPDQDGKRATDADEFLSRRGYILRAVRGYGFPNALRMTVGSE

SEQ ID NO: 11622 - protein, 166 aa, Agrobacterium tumefaciens
EPLYTAEQIAERNRDMAKHIAGGPTKDLLVIAVLKGSFIFAADLIRALHDSGLAPEVEFITLSSYGAGTVSQGVRIVKDIDSDVKDRDVLLIDDILESGRTLRFAKELLYERGARNVTIAVLLDKKVKRKEDLEADYVGFECPDYFVVGYGMDVAYAFRELPFVGV

SEQ ID NO: 11623 - protein, 415 aa, Agrobacterium tumefaciens
VNHFGYIDGVLHAENVPVPEIAKAVGTPFYVYSTATLERHYKVFSGAFADVDAMVCYAMKANSNQAVLKTLAKLGAGIDVVSGGELRRALAAGVPASRIMFSGVGKTVAEMDYALEAGIYCFNIESEPELEVLNLRAVKAGKRAHVSFRINPDVDARTHAKISTGKKENKFGISYERARAVYAHAATLPGIEVTGIDMHIGSQITELQPFEDAFRLLRELVEVLRTDGHAISHVDIGGGLGIPYRDDNNPPPLPDAYAHIVKNELKSLNCKIVTEPGRLIVGNAGILVTEVIYVKDGGDKTFVIVDGAMNDLIRPTLYEAYHGIRPVVQPSENAPRIKADIVGPVCETGDYLALDREMAAPQPGDLIAVSSAGAYGAVQAGTYNSRLLVPEVLVKGDRFHVIRPRGTYEELIALD

SEQ ID NO: 11624 - protein, 453 aa, Agrobacterium tumefaciens
NQMWGGRFASGPSAIMEEINASIGFDKKLYAQDIRGSIAHATMLAEKGIISQEDKEKIVHGLNTILSEIEAGTFEFSRKLEDIHMNIEARLATLIGTAAGRLHTARSRNDQVALDFRLWVKEELQKTEGMLTALIAAFLDRAEENADTVMPGFTHLQTAQPVTFGHHCMAYVEMFGRDRARVRHAIEHLDESPIGAAALAGTGYPIDRHMTAKALGFREPTRNSIDTVSDRDFALEFLSIASICATHLSRLAEEIVIWSTPQFGFIRLSDAFSTGSSIMPQKKNPDAAELVRAKTGRINGSLVALLTVMKGLPLAYSKDMQEDKEQVFDSAESLELAIAAMTGMIRDLEVRKDRMRAAAGSGYSTATDLADWLVREAGLPFRDAHHVTGNAVALAEKKGCDLADLSLEELQAIHPDITNGIFDVLSVEASVASRTSFGGTAPSEVRKQIAWWR

SEQ ID NO: 11625 - protein, 288 aa, Agrobacterium tumefaciens
KNIGVIGAGQMGCGIAHVSAIAGYRVHIYDLSKEGIEAGLATINGNLARQVTNNKLSDDARKQALALISGSTDVNDLAPMDIVIEAATENEEIKRKIYAQVCPVLKPEALLATNTSSLSITRLASATDRPEQFMGIHFMNPVPVMKLVELVRGIATNEKTFDAAKAYVRTLEKAITVAEDFPAFIVNRILLPMINEAIYTLYEGVGSVEAIDTAMRLGANHPMGPLQLADFIGLDTCLSIMQVLHDGLSDSKYRPCPLLVKYVEAGWLGRKSGRGFYDYRGETPVPTR

SEQ ID NO: 11626 - protein, 267 aa, Agrobacterium tumefaciens
IIITGCSSGIGAYCAGALQRDGWRVFATVRRIVDMAALENQGIETLIMDYTKPETIAALVDTVAARTGGRIDALFNNGAYGQPGAVEDLPVEALRAQFETNVFGWHDLTRRVIPFMRKRGSGRIVHCSSILGLVPYRYRGAYTASKFAIEGLGVTLRMELQGSGIHVSLIEPGPITSKFTATALAHVKDKIDLENSAHAAEYKRQLARMDGSGPVNRHKLGPEAVYAVLKHALTAARPKPHYPVTVPAKQGLLLKRLLPAGLFYRLL

SEQ ID NO: 11627 - protein, 269 aa, Agrobacterium tumefaciens
RFAPSPNGPLHLGHALSAFLNHDMAQDNGGRFLLRIEDIDQTRCTPELEQAIYDDLDWLGLDWEKPVRRQSDHFDAYRVSLDRLIDAGLAYPAFLSRGETKTIVRAFEADGGLWPRDPDGAPLYPSMDRERPDAERAALLASGRHHAWRLDMEKAIRAVGSSLFWQESGDGETGRIEALPGLWGDVVLSRSDAPSSYHLSVVVDDALQGITHVVRGMDLFHATAIHRLLQHLLDLPQPTYHHHRLLLGADGRKLSKSEGSTGLSTLRAE

SEQ ID NO: 11628 - protein, 666 aa, Agrobacterium tumefaciens
MIKKILIANRGEIACRVIKTAKKMGIATVAVYSDADANALHVKMADEAVHIGPAPSSQSYIVIDKILEAIQKTGADAVHPGYGFLSENAAFAQALEKAGVVFIGPPVGAIEAMGDKITSKKLAAKAGVSTVPGHMGLIEDADEAVKIASQIGYPVMIKASAGGGGKGMRIAFNEAEAREGFQSSKNEAKSSFGDDRIFIEKFVTQPRHIEIQVLGDKHGTILYLGERECSIQRRNQKVIEEAPSPFLDEATRHAMGEQAVALARAVGYHSAGTVEFIVDGERNFYFLEMNTRLQVEHPVTELVTGIDLVEQMIRVASGEKLSLAQGDVKLNGWAIESRLYAEDPYRNFLPSIGRLTRYRPPGEGAQDSGTVIRNDTGVFEGGEISMYYDPMIAKLCSWGKDRETAIDAMGEALDRFEVEGIGHNLPFLSAVMQHERFRSGRLTTGFIAEEFPEGFSGIEPDETAARKLSAIAAIVNQRLQSRAVEISGTIGNHRRIVGHDWVVSFGAFRHGISVETVADGTAVRFEDGMALTIDTGWRPGQSLGLFTVAGEVIAAKVDLAGAAVRLRWRGMDILARVRSPRVAELALLMPEKLPPDTSKLLLCPMPGVITGISVGEGEEVEAGQALATVEAMKMENILRAEKRGRVVRVAAKPGDSLAVDEVILEF

SEQ ID NO: 11629 - protein, 495 aa, Agrobacterium tumefaciens
NNIFDLFVIGGGINGCGIARDAVGRGYSVALAEKGDFASGTSSAATKLIHGGLRYLEHYEFRLVREALMEREILWAMAPHVIWPMRFILPVQKGGVRPSWMVRLGLFLYDNLGGRKLLPPTRTLDLRKDPAGKPLKPVFAKAFEYSDGWVDDARFVVLNARDAADRGATIMNRTRVVSARREGRLWLIETLDEKTGRPAMHKARMLVNAAGPWVDNVLSGVFGRNDVHNVRLVQGSHIIVRRKFSDPRAYFFQNPDNRIIFAIPYEQDFTLIGTTDRDYKGDPAKVRISEEEISYLCNAASDYFSEPVRPEDIVWTYSGVRPLFDDGASKAQEATRDYVLKVEQAEGEAPLLNIFGGKLTTYRRLAEHALEKIGAAIGEKGKPWTAGSHLPGGDFGVQRFDAQVKTLLSRYPFLDERHAYRLVKNYGTKAANLLGAATDISGLGRHFGGTVYECEVRWLVENEWAFSAEDILWRRTKQGLRLSKDEAAALDEFVA

SEQ ID NO: 11630 - protein, 569 aa, Agrobacterium tumefaciens
  unsure (1)..(569): unsure at all Xaa locations
KKLINDPSTVVRDMLEGIVALSPETILLQDENVVIRSGLPEAEKRKVAVLSGGGSGHEPAHAGYVGTGMLTVAVAGDVFTSPSTDAVLAGIRAAAGPAGALVIVKNYTGDRLNFGLAAELARAEGIPVEIVVVADDVALKDTVPAERRRGIAGTVLVHKLAGAAAEKGLPLQEVARIARDAAAKLSSMGVSLGSCTLPAVGKPGFVLGETEIEVGLGIHGEQGVQRMPIASADALVQLVIETIEADGKLAGGNRVALLVNGLGATPPMELAIVARSAVARLEAKGIVVERAWAGTFLSALDMPGFSLSVMQVDDAALSLIDAPTEAGAWPRGGAVNRKRVLPSANAEKTVVATNKMTAAGERLRSGAERSARALIAAEPRLTQLDSVAGDGDLGASMVRGGEAILALPKESFGDVSDGLMAMANAMRKAIGGSSGPFYATGLMRASRQLAGIDEPAAQQMAEAFVAAVAAVSELGGAKPGDRTMIDALYPAAKTFRDKLVTGASAEEAWQSAVAAGEVGAEATASMKPRLGRASYLGERAVGHPDGGAVAVGIWLKAIEAAISXKSDRA

SEQ ID NO: 11631 - protein, 243 aa, Agrobacterium tumefaciens
MELKHKTALVTGACGGIGRAVVAALVAQGARVIAFDRDIEAVTALAKGFGSACDPVAVDLGDAAALQAVMRDIAGRFKVIDILVNNAGVLSPHKLAATTLEEWHRLMAVNLDAALLLTQAVVPAMKENRWGRLINISSYAWKSGGLTAGTAYSVSKSALVGLTYSSARELASFGITANAVAPAYVVSPMIMEQLSEEDRQRQLAAIPVGRFCQPEEVAHAVRFLASPLSGFMTGTVVDMNGGL

SEQ ID NO: 11632 - protein, 413 aa, Agrobacterium tumefaciens
MSVAVSPLAPKSYPDMPALRGVRMATAAAGIKYKNRTDVLLMVFDKPASVAGVFTKSKCPSAPVDFCRANLGSGAARAVVVNSGNANAFTGVKGKAATELTAKSAAAAVGCSEGEIFLASTGVIGEPLDASKFAGVLGDMNVRAEADFWQEAAKAIMTTDTYPKVSTRTAEIGGVIVTINGISKGAGMIAPDMATMLSFVVTDADIEPAALQSLLSAGVGPTFNSVTVDSDTSTSDTLMLFATGAAAEDGQVKVTSADDERLSSFRAALNDLLKDLALQVVRDGEGARKMVEVTVTGAENDAAAKKIALSIANSPLVKTAVAGEDANWGRVVMAVGKSGEMADRDRLAIWFGGVRVAVNGERDPDYSEAETTAVMRLEDITVKVDIGLGQGTATVWTCDLTKEYVAINGDYRS

SEQ ID NO: 11633 - protein, 475 aa, Agrobacterium tumefaciens
YPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 11634 - protein, 277 aa, Agrobacterium tumefaciens
MGFVKTTDGTEIFYKDWGPKDAQPIMFHHGWPLSSDDWDAQMLFFLSKGFRVVAHDRRGHGRSAQVADGHDMDHYAADAFAVVEALDLKNVVHIGHSTGGGEVARYVAKHGEPAGRVAKAVLVSAVPPLMLKTEANPEGLPMEVFDGFRSALAANRAQFFRDVPSGPFYGFNRDGASVQEGVIQNWWRQGMMGGAKAHYDGVKAFSETDQTEDLKNISVPTLVLHGEDDQIVPIADSAHKSVKLLKNGTLKTYPGFSHGMLTVNADVLNADLLAFIK

SEQ ID NO: 11635 - protein, 656 aa, Agrobacterium tumefaciens
KILIANRGEIACRIIRTAASMGIRTVAVYSDADRDAMHVALADEAIAIGPAPARASYLDGEKIIAAAKASGAEAIHPGYGFLSENAGFAEACASAGLVFIGPPPEAIRAMGGKSEAKALMATAGVPIVPGYHGDEQAEKRLASEADKIGYPVLLKASAGGGGKGMRVVRQKHDFAAELAGAKREALAAFGNDRMLIEKYLERPRHVEVQVFADGHGNCVSLFERDCSIQRRHQKVIEEAPAPGLPDDLRQRMYDAATAAARAIDYRGAGTIEFLLDPSGFYFMEMNTRLQVEHPVTEYITGLDLVEWQLRVANGEALPKDWADLRINGHAIEARIYAEDPAHDFLPSIGTISHLVFPDEGPHLRIDSGIRAGDAITVHYDPMIAKLIVWDHDRPAAVRRLKVALEKLAICGVTSNATFLARLAGLETFAAADLDTGFIARNEADLFAPQAVGDNEIALAALGFLLSRKNASTNPQAQADPHSPWNTANAFRLNAPARETLHFTMQNRPIDLGVAHEADSFSLEMGGHTIRAYGDLSDNGRFRATINDRTWKGYFFAESDSYALFLHGEHYRISQPDPVDIADSSGHTGGLEAPMPGVIRAVLSQSGAAVETGDALVVMEAMKMEHTIRAPAKGIVTAVNCAEGDMVVAGAVLVDFE

SEQ ID NO: 11636 - protein, 373 aa, Agrobacterium tumefaciens
LGPEIAALRDSASAFADDKIAPLATEIDRNDRFPRQLWPQMGELGLHGITVSEEFGGADMGYLAHCVAMEEISRASASIGLSYGAHSNLCINQIHRWGTDEQKHRYLPKLVSGDHVGSLAMSETEAGSDVVSMRLKAERKGDRYVLNGAKMWITNGHEADTLVVYAKTDMSAGARGITAFLIEKGFKGFRPAQKLDKLGMRGSPTSELVFEDCEVPEENILGRLNDGVTVLMSGLDYERAVLAAGPVGIMQAAIDLVLPYVRERKQFGKAIGEFQLVQGKLADIYSAMNASRAYVYAVARACDNGRITRQDAAGAILFAAERATQVALDAIQLLGGSGYVNESPAGRLLRDAKLYEIGAGTSEIRRMLIGREL

SEQ ID NO: 11637 - protein, 382 aa, Agrobacterium tumefaciens
DPVVIVGAARTAMGGFQGEFKSVAAPDLGAAAIRAAVERAAIPVSDIDDVLMGCVLTAGQGQAPARQAAIAAGVPNSVGATTINKMCGSGMKAIMLGHDQIAAGSSSIVLAGGMESMSNAPYLLDRARNGYRLGHGKVIDHMFLDGLEDAYDKGRLMGTFAEDCAEAYQFTRAMQDDYALTSLERARRAIAEGAFQAEIAPVGDVAVDEQPGKAKPEKIPQLKPAFRDGGTVTAANSSSISDGAAALVLMRRSEAERRGRSPLATIIGQASHADAPAGYPTAPIGAIKKLFEKNGWAAKDVDLFEINEAFAVVAMAAMRDLDLPHEKVNVHGGACALGHPIGASGARIVVTLLAALQRHGLKRGVAAVCIGGGEATALGIER

SEQ ID NO: 11638 - protein, 373 aa, Agrobacterium tumefaciens
LNEAQQQIRDMARDFARERLSPGAAARDRESRFPKDELKEMGELGFLGMLVSEDYGGSETGAVAYALALEEIAAGDGACSTIMSVHNSVGCVPILKFGTEEQKQRFLPKLAAGEWIGGFALTEPQAGSDASNLKTRARRDGDRYVLDGAKQFITSGKNGDVIIVFAVTDAAAGKKGITAFIVPTDTPGYEVIRVEEKLGLHSSDTCQIAFTEMAVPVDLRLGEEGQGYRIALANLEGGRIGIAAQAVGMAQAAFEAARDYARERKAFGQAIIEHQAVAFRLADMATRITAARQLVLHAAALKEAGEPCLSEASMAKLFASEMAERVCSDAIQIHGGYGYMADYPVERIYRDVRICQIYEGTSDVQRMVIARNL

SEQ ID NO: 11639 - protein, 409 aa, Agrobacterium tumefaciens
ISETPHLSLHVPEPAVRPGGEPDFSNVKIPKAGTVPRPEVDAAPESMRDLAYSIIRVLNHQGEAVGPWAGLLSDEDLLVGLKNMMRLRAFDARMLMAQRQGKTSFYMQHLGEEAVSCAFRKALSKGDMNFPTYRQAGLLIADDYPLVTMMNQIYSNELDPLHGRQLPVLYSSKEHGFFTVSGNLATQYVQAVGWAMASAIKGDTKIAAAWIGDGSTAESDFHSALVFASTYKAPVILNIVNNQWAISTFQGIARGGSGTFAARGLGFGIPALRVDGNDYLAVYAVARWAVERARRNLGPTLIEYVTYRVGAHSTSDDPSAYRPKTESEAWPLGDPVLRLKKHLILRGVWSEERHRQAEAEIADEVLEAQREAESHGTLHEGKKPPKKDIFEGVYAEMPPHLARQRQKAG

SEQ ID NO: 11640 - protein, 333 aa, Agrobacterium tumefaciens
MTMIEAVRSAMDVSMERSDDVVVFGEDVGYFGGVFRATQGLQGKYGKTRCFDAPISESGIVGTAIGMAAYGLRPCVEIQFADYMYPAYDQITQEAARIRYRSNGDFTCPIVLRMPTGGGIFGGQTHSQSPEALFTHVCGLKVVVPSNPYDAKGLLIASIEDPDPVMFLEPKRLYNGPFDGHHDRPVTPWSKHEMGEVPEGHYTIPIGKAEIRRPGNDVTVIAYGTMVHVALAAAEETGVDAEIIDLRSLLPLDLDTIVKSVSKTGRCVMVHEATLTSGFGAEVVSLVQEHCFYHLEAPVVRVAGWDTPYPHAQEWDYFPGPARVGRALVDVME

SEQ ID NO: 11641 - protein, 425 aa, Agrobacterium tumefaciens
MAEFVITMPDVGEGVAEAELVEWNVKPGDIVHEDMVLAAVMTDKATVEIPSPVAGIITWLAVTVGNTVPVKAPLVRIETDVAAAAPNGSAPEAEAPSRMTEEEAPADMTEAPPPVETQPAARQTEEAPSAPVAEPHHKPLASPAVRQRADDLDIDLIKVKGTGPDGHITHADLDGFLTVRARPERPEPMTPHDSAVEEVKVTGLRRKIAEKMVLSVSRIPHITYVEEIDVTELEDLRATMNGNRRSGQPKLTILPFLMRALVKAVADHPGMNAIFDDEKGVVSHYEAVHIGIATQTPAGLTVPVVRHAETLGLWDCAEEVARVAEAARTGTAHREELMGSTITISSLGALGGVVSTPIINHPEVAIIGVNKIMTRPVWDGNRFVPRKMMNLSSSFDHRVVDGWDAAVFIQAVKALLEKPALIFIE

SEQ ID NO: 11642 - protein, 500 aa, Agrobacterium tumefaciens
TPKPVVLTILDGWGLNEDTSSNAPVLANTPTMDRLFATCPNATLTTFGPNVGLPTGQMGNSEVGHTNIGAGRIVAMDLGQIDLAIEDGSFFRNAAMLDFAATVKAAGGVAHLMCVVSDGGVHGHILHGQAAVKLMVSHGLKVVVHAITDGRDVAPQSAEDFVAALVASLPQGASIGTVIGRYYAMDRDNRWERVEKAYDAMVLGKGEHARDAVSAVAQSYANKVTDEFILPTVIDGYEGFKAGDGLFCLNFRADRAREILLAIGADDFDGFAREKPVLSALLGMVEYSTRHSDFMTTAYPKRDIVNTLGAWVAKQGLTQFRLAETEKYPHVTFFLNGGKEEPEVGEDRFMPKSPKVATYDLQPEMSAAEVTEKFVEVIGKGYDLIVTNYANPDMVGHTGDLQAAIKACEAVDRGLGAVVAALEKVGGAMLVIADHGNCETMVDPVTGGPHTAHTTNPVPVILFGGPEGAKVHDGILADVAPTLLQLMNVPLPPEMTGKSL

SEQ ID NO: 11643 - protein, 251 aa, Agrobacterium tumefaciens
LITGASDGIGAVYAERLAGRGHDLILVARRAEKLKALAAQLEKDHGIAVEVLSADLSSAEDLEKVEVRLREDQRITGLVNNAGIAGEGAITALDPAYVTTMINLNILAVTRLAAAIAPRLAAAGKGTIINMTSVTALMPAAFTAVYPATKAFVLAFTEALQAQLSPSGVRVQAVLPGITRTAIWEEERLDAIPAAMVMDVHDMVDAALAGLDLGEALTIPSLPDTVDLENFLAARAALRPNLSHALAASRY

SEQ ID NO: 11644 - protein, 273 aa, Agrobacterium tumefaciens
MTTITTRDGTHIFYKDWGPKDGQPIIFSHGWPLSADTWDAQMVFFANNGFRTIAHDRRSHGRSDQVWHNNTMDQYADDLAELIEQLDLHDIILVGHSTGGGEVTRYIGRHGTARVAKIALIGAVPPLMLKTESNTIGMPIDVFDGIRKSTYDNRSQFFKDLTIPFYGYNREGAVISEGIREEFWRQGMMGGLKGQLDSIRAFSESDFHQDLKAFDKPTLVLHGDDDQIVPVGASALSTVKIVKHATLKIYEGADHGLTQTHQDRFNADLLTFI

SEQ ID NO: 11645 - protein, 376 aa, Agrobacterium tumefaciens
AALRERQRELPFDIFALIKEAKIGTLRVPEAKGGPGGSIADYIEVLMILGEADSNIPHALRSHFNFTENLALAPIELEDRRHLEQVLAGKLFAGASTEQGTKRPGEITTRLSADGDRYRLNGRKWYATGTAFADFGTFSAIGDDEQPIGVLIPLDRTGITILDDWDSMGQRMTASGGVLLENVEVLPHELTTRKLGSQIGRHSSAMRQLHLAASAAGAVQGALNDGVEYVLRQARTTLHSSAETANQDPFVQKMLGEISAGAFAVKTLIREAARTLDRTAATFATGDEEVIEAALLEGSLATARTQIIASQLSLTVATNLYELGGGSATSSERNFDRHWRNIRTVYNHNPLAHKARVIGDYYLNGTTTHLREGRVF

SEQ ID NO: 11646 - protein, 590 aa, Agrobacterium tumefaciens
  unsure (1)..(590): unsure at all Xaa locations
LIEVHDLSVSFGSAQPVKGVSFDVSPGEMLAIVGESGSGKSLTALGLIGLLPSHAKTGGRVQLEGRDLLPLSERQWRGIRGRDIGMIFQEPMTSLNPVLTVGEQIIEVLRIHEKIDRRQARKRAIELLDLVNIPDAARRVDDYPHQLSGGMRQRVMIAIGVACNPKLLIADEATTALDVTIQAQILQLLDNLRRDLNMAVILITHDLGIVAQWADRVMVMYAGRKVEEGLPEPVFSNPYHPYTRGLLAASPRAEDGQHYRDGPLIEIPAPSSPPPASAAAPSGHAVRAPVVSAGSSCRHXGRFRKAATPPVPSYSRHHRRYPMTLLSVHSLSTHYTGGRGTVRAVDDVSLDIEAGETVALVGESGCGKSSLGKSLMRLVEPSSGRITFKGADVTAMTSSQLRGIRRRIQMIFQDPFASLNPRQTVRTILTAPLKVHGIGDRARQREIVEAIVAQVGLPPDALDRYPHEFSGGQRQRIGIARALVLEPELVVCDEPVSALDLSIQAQILNLLVEMKKRLSLSYLFVSHDLSVVRYFSDRVLVMYLGKIVESAPTAELWASPKHPYTRALLAAVPDPARRKQAAPISGDLPS

SEQ ID NO: 11647 - protein, 363 aa, Agrobacterium tumefaciens
LAEDFSQTAADHDKSGEFAAGNFEALFKSGLLGLVTAVKDGGWGEGMETAHAVITAIAKGDPSTALILAMHYSVHAAIRRGKWPAALSAKVLVANNREPALLNNAQAEPGVGSPAHGGLPETTARIEGDVWVVNGRKSFVTGLPGLKWAIVLAVTTEETPRLIQLLVPLDAAGIAQEKAWEATGMYATASHDLVLEDVRVPLADIVAEQPADEPLRRDEADGYNFFALLASVYHGVALSARDDLLRHLTGHAPVSLGAPLSSIPRIQEGLGQIEVLLAANRRLLLSVARDIDAGERVGTDALAVRHVVIDNAVTVTDLALELGGNRGLRRDYNLERHHRDAITARAHAPQSHMIRTILGRQSI

SEQ ID NO: 11648 - protein, 438 aa, Agrobacterium tumefaciens
LDRAHLVHPVSSFRGHEKLGVRVLKSASGATVTDMTGHQLIDGFAGLWCVNAGYGHDSIVEAAAKQMRELPYATAYFDIGSEPAIRLASELADRAPGDLNHVYFTLGGSDAVDSTIRFIRYYWHAKGQPQRDQFISIEQGYHGSTTAGSGLTALPAFHAGFGVPYDWQHKIPSHYAYRNPAGSDPAAIIASSLQILKDKIEAIGPDRVAAFYAEPIQGSGGVLVPPPGWIKAMRELCSSYGILFVADEVITGFGRTGPLFACADEDIVPDFITAAKGLTSGYVPMGAVFMADHVYDTIADFAGEAAIGHGYTYSAHPVSAAVGLEVLKLYEGGLLENGRRAGQRLMAGLEGLRNHPLVGDVRGRGMLAAIELVTDKDKKTPLPAAAAPARKVFDRAWENGLIVRAFANGILGYAPPLCCTDGEIDAIVERTLKTLDQT

SEQ ID NO: 11649 - protein, 474 aa, Agrobacterium tumefaciens
LKDKELFRQTGLIGGAWKAAASGKVVDVIDPATQAVIGTVPDMGGAETRAAIEAANAAFGPWKKKTHAERAALLEKWFALMIENIDDLRLILTIEQGKPLDEAKGEIRYGASFVKWFAEEARRIGGGTIPSPTPDRRIVVLKEPVGVCGIITPWNFPNAMITRKVAPALATGCTVVIKPSEFTPYSALALGVLAERAGIPAGVINIVTGMPTEIGNEIMANETVRKISFTGSTRVGSLLMRGAADSVKRLSLELGGNAPFIVFDDADLDLAIEGAIVSKFRNGGQTCVCANRILVQSSVYDAFAKKLADRVDAMRVGPGTEAGVSIGPMINKPAIAKIRAHIDDAVAKGATIITRPRDLPEGPQYTAPVVLTGATTAMQLASEETFGPVAPLFRFETEEEALAIANGTPFGLAAYFYTESLKRAWRVGEALEFGMVGLNTGAISTEVAPFGGVKQSGLGREGAQVGIEEYLETK

SEQ ID NO: 11650 - protein, 343 aa, Agrobacterium tumefaciens
LKTHRIALIPGDGIGQSVTDAAWQVLNAVAKTSGFVLEGTEFPWSCAFYKETGAMMPKDGIETLRGFDAIMLGAVGWPAEVPDSVSLHGLLLPIRKAFVQYANIRPHRLLSGVQGPLKADGFDILCIRENTEGEYSGAGGRVHQGTEDEVAVETSIFTRKGVERILRFGFEQAQKRRGKLASITKSNAQKYSMVFWDEVTHKLAAEYPDVEVSSYHIDAMAARMVMAPESLDVVVASNLFGDILTDLGAAIQGGLGFAASANINPDRSAPSMFEPVHGSAPDIAHLGIANPIAAIWSGAMMFEHLGEKDAAAKIMAALETATGRGIGTVPGKDKTDTITAAVL

SEQ ID NO: 11651 - protein, 453 aa, Agrobacterium tumefaciens
  unsure (1)..(453): unsure at all Xaa locations
ICRLPQGECRAGRXSGADRQGRPEKQQLGWRRPRERTKILQRWADLIEQEAETLAKIEALSSTRPVGQLIAGDIAVTAEQIRFFAEFADKEGGDLVPTDDASLGMIMTEPYGVVGAITPWNFPVSMAGWKLGPALAAGNAVVLKPSEMTPFSSIFMAELAIKAGLPAGLINVVLGDGPVTGNAITGHPEISKVSFTGSTAAGAAIMANVARTGIKPMTLELGGKSPQLVFADADIEKAAAAIAGNILSNAGQACVAGSRIIVEESAADALSAAIIARMKTVKPGPTWDEATQYSPIISEVQRQRIDGIVQAAVAHGGECLTGGAIMDGPGYFYQPTLIANVDQTSPAVTEEIFGPVLTLQTFRTEEEALALADHPTYGLAAGLFSRDVSRVLRLSRAIQAGTIWVNRYGRSRDHILPTGGYKRSGIGKDLGRDAYLANRKSKSVLIGLXQGNS

SEQ ID NO: 11652 - protein, 788 aa, Agrobacterium tumefaciens
VIIAAGLFFAIGGWQLVALGGSPYFIIAGLSLIVSGLLILLRKPAGALLFGLVFILTGVWAVWEAGLHFWPLISRLLAIGVGATVVALSYPLLRRAAGKTPAYGSSFAVAAVLAIASGAGFAGMFVAHPTVAFNGEPAALTPVKPETEQKNWEHYGNTSGGSRFVALDEITRDNSRTSKSPGPTTPADTPISPGANGAEDQQTPLQVGDTVFLCTPHNNVIALDADTGTEKWKAEINSKSSVWMRCRGLAYFDAKAPLKQPTAPGSTPVTAAVVAEGALCQRRILMNTINAELIALDADTGAFCPDFGTNGRVDLKIGMGDAPDPQYVLTSAPTLAGTTVVVGGRIADNVQVDMPGGVMRGFDWSRASFAGLLTPANPDITKLPPPGQTYTRSTPNVWASMSYDPDLNTVFMPVGSPSVDLYGATRTPLDHKYGASMLALDATTGREKWVYQTVHNDLWDFDVPMQPSFVDFPKADGTSVPALVFGTKAGQLYVLDRATGQPLTKVEEVSVKAANIPNEPYAPTQPRSVGMPQIGAQTLTEADMWGATPFDQLLCRIAFKGMRYEGLYTAPGTDLSLAFPGSLGGMNWGGLSTDPTTNTIFVNDMRLGLWIEMKEAAPTKAVASGGESVNTGMGVVPMKGTPYAVNKNRFLSALGIPCQAPPYGTMTAIDMKTQQIKWQVPVGTVEDTGPLGIKMGLPIPIGMPTLGGTLATQGGLVFIAGTQDYYLRAFDTATGKEVWKARLPVGSQGGPMSYKSPKTGKQYVVISAGGARQSPDRGDYVIAYALPN

SEQ ID NO: 11653 - protein, 119 aa, Agrobacterium tumefaciens
LMFRITKEFHFSASHQLKSLPSDHQCNRLHGHNYIVEVELSGEELNEHGFVRDYHELAPLKRYIDDHFDHRHLNDVLGHDQVTAECLAKHFYDWCKTSLPETSAVRVSETTKTWAEYRP

SEQ ID NO: 11654 - protein, 167 aa, Agrobacterium tumefaciens
LDVARALIGAEFRVGKAGGIIVETEAYHPDDPASHAFNGQTPRNRAMFGPAGHLYVYRSYGIHWCANFVCAPGSAVLLRAIEPLTGIDMMKLRRGTDKLKLLCSGPGKLCQAMAITGEMDGAPLNAPPFLLRLPKEAAAISTGRRIGISRAVDYPWRFGLEGSAFVS

SEQ ID NO: 11655 - protein, 256 aa, Agrobacterium tumefaciens
VTLAYRKVALVTGAGSGIGRAAALHLAAAGFSVGLLGRTESELQTVAAEIEAASGSSRLLLADVSDEAAMRHAVATLVDDFGRLDVVVANAGVNGVWAPIDELKPSDWDDTIRINLRGTYLTVHASVPHLKAAGGGSIVIVSSINGTRTFTSPGATAYSVTKAGQLAMAQQLALELGRHRIRVNAVCPGEIETAINENTDIRGRERTEVPVRFPAGDIPVTGGVAGTSEDVAELIGFLASDASRHITGTPVWIDGG

SEQ ID NO: 11656 - protein, 438 aa, Agrobacterium tumefaciens
PSRSNSTSLDSYWMPFTANRQFKANPRLLTSAEGMYYTSNDGRQVLDGTAGLWCVNAGHGRQQIASAVKHQLSTLDYAPSFQMGHPVAFEFAERLAEIAPGPEGGKLDRVFYTGSGSESVDTALKIAIAYQRAIGQGTRSRLIGRERGYHGVGFGGISVGGLVNNRRVFPQIPADHLRHTHDLARNSFVKGQPEHGAELADDLERLVALHGAETIAACIVEPVAGSTGVLVPPKGYLERLRAICDKHGILLIFDEVITGFGRMGSSFASNYFGVTPDIVTTAKGLTNGAIPMGAVFTSRKVHDALMHGPENQIELFHGYTYSGHPVACAAGIATLDIYRDEGLFTRAAELQDAWHDAIHSLKSAANVIDIRTIGFIAGIELQSREGAVGARAYDVFVDCFERGLLIRVTGDIIALSPPLIAEKSHFDDIVSILGDALN

SEQ ID NO: 11657 - protein, 395 aa, Agrobacterium tumefaciens
MDTGDRADFQRNLLDGMQAMTRENRWRDVTGRVAAYDAAAEKIETVEVERPNLYATRAFSLSNWRLIAANWLSSNVLSYSLAFIGFVVAARFCHLRNAAHDGAASMKSGISKIAGIVCLSAMMLFAGLSLSRAASIPTDAWAAYKGAFLDPGGRIIDTGNSNISHSEGQGYGMWLAVLADNLSDFELIWSFTRTELLVRDDGLSAWKWDPRTRPHVTDINNATDGDILIAYALALAAGQWNRQDYAEASAAIASVILKKTVVQRGGRTLLLPAASGFWRGRSGRWGRWSIRPYLIFEAFPVLNLVAPSPLWKAVADDGVAQIGAFAFSDRKLPADWVSVKTKPQPASGFQPEFGYNAVRIPLYLARANMGAPELLSRLKDGMTLESGAAGTFRSE

SEQ ID NO: 11658 - protein, 403 aa, Agrobacterium tumefaciens
LVIESGEGIYVTDSSGKRYIEAMAGLWSVALGFGEQRLVDAATKQMQKLPYYHTFSYKTHGPSVDLAELLIELSPVPMSKVHFTSSGSEANDLVAKMVWYRSNALGKKDKKKIIGRIKGYHGVTIASASITGLPRNHESFDLPLDRMLHTACPSYVHFGKDGESEAEFTARILGELEELILREGPETVAAFWGEPVMGAGGVLLPPEGYWEGVQAILKKYDILLVVDEVICGFGRTGKMFACETYDIKPDVLVVSKQISSSYMPLSAIIMNDSFYQPIADESDRIGSFGHGYTASGHPVATAVGLENLKIIQERDLVGNVARLEGKFLDHLKALADHPLIHSSRGIGLLGALEVKPWDGTKPGDTTLALAAAIESEGVITRPIGESICFCPPLIITAEQLDEL

SEQ ID NO: 11659 - protein, 448 aa, Agrobacterium tumefaciens
MIDSTAVAAGHAKQPFYKHLYFQVLVAIIAGIALGHFYPTFGEQLKPLGDSFIRPVKMIIAPVIFLTVATGIAGMNDMKKVGRVAGKAMIYFLASPTLALIVGLIVANTVQPGAGMNIDPATLDAKAVATYADKAHEQTITGFLMNIIPTTIVGAFASGDILQVLFFSVLFGIALGIVGEKGKPVTDFMHAMMYPIFKLVAILMKAAPIGAFGAMAFTIGKYGISSVTNLAMLIGTFYITSALFVFVVLGAVCRYNGFSIVALIRYIKEELLLVLGTSSSEAALPGLMSKMEKAGCKRSVVGLVIPTGYSFNLDGTNIYMTLAALFIAQATGIHLSFGEQILLLLVAMLSSKGAAGITGAGFITLAATLSVVPSVPVAGMALILGIDRFMSECRALTNFVGNAVATIVVARWEGELDQEQLARVLSGKEEFTSIADVDALPASVQPAE

SEQ ID NO: 11660 - protein, 335 aa, Agrobacterium tumefaciens
DIRVETQDVAPPGPGEVLLAMAAGGICGSDLHYYQDGGFGPVRVREPIICGHEASGHIAALGAGVSGLAIGQLVAVNPSQPCGHCQFCLKGQPIHCLDMRFMGSAMRLPHEQGMFRDRLVVPAKQCATFSDATSPAEAACTEPLAVCLHAVAQAGDLAGAKVLVTGAGPIGLLTIAAARQAGAGIIVATDLTDAALERAPAMGADRTINVAKDADALLPYQDNKGYFDVIFDCSAAGPALRSAFACVRPRGTIVQVGVTGDVTIPLNALVGKEIVWRGSQRFHDEFAIAAGLISSRKIDVRPIISHSFPLGDAKAAFEQAGDRSAACKVQLTFSA

SEQ ID NO: 11661 - protein, 215 aa, Agrobacterium tumefaciens
TQIFSQEFAAFLFDMDGTLVNSIAVVERVWREWAVANGIEPNAFLQRIHGMRASEVIRREAVPGLDVDAEADMILRAEMDDVEGIIPIPGAADFLASLPAGKWAIVTSAVRELAEKRLAAAGITPPPVMICADDVVNGKPDPEGYRKAAERLGVAPESCVVFEDAPAGIQAGERMGAAVVVINVTHSHPIETPHLAIGSYGELDVVIDGNGGLKL

SEQ ID NO: 11662 - protein, 307 aa, Agrobacterium tumefaciens
GTDEETADAATRAMMHGTRLGVDSHGVRLLAHYVTALEGGRLNRRPQISRVSGFGAVETIDADHAHGARATYAAMENAMALAEKFGIGAVAIRNSSHFGPAGAYALEAARQGYIGLAFCNSDSFVRLHDGAMRFHGTNPIAVGVPAADDMPWLLDMATSAVPYNRVLLYRSLGQQLPQGVASDGDGVDTRDPNAVEMLAPVGGEFGFKGAALAGVVEIFSAVLTGMRLSFDLAPMGGPDFSTPRGLGAFVLALKPEAFLERDVFDESMKRYLEVLRGSPAREDCKVMAPGDREWAVAAKREREGAPV

SEQ ID NO: 11663 - protein, 353 aa, Agrobacterium tumefaciens
LVVDLDVVRDNFNAFRHSLPNSAIYYAVKANPAPEILKLLASLGSNFDCASVAEIQMALDAGATSDRISFGNTIKKERDVARAHALGIDLFAVDSHEEVEKVARAAPGARVFCRVLTDGEGAEWPLSRKFGCVPQMAVDVLVYAHQMGLESYGVSFHVGSQMMNLDAWDAALADAKRVFASLAKQGIHLQMVNMGGGFPTKYLRDVPAAEEYGQAIDTALRKHFGNQIPKTIIEPGRGMVGNAGVIKAEVVLVSKKSDNDNHRWVFLDIGKFGGLAETMDEAIRYPIRTERDQDEMQPCVLAGPTCDSADVLYEKNMYPLPVSLTIGDEVLIEGTGAYTTTYSAVAFNGFEPL

SEQ ID NO: 11664 - protein, 368 aa, Agrobacterium tumefaciens
DETHAFEAVVPPLVQTSLFTFSSYDEMVSTYRGEKVRPVYTRGLNPTVRMFEEMLARLEGAEDALGFASGMSAISSTVLSFVSPGDRIVAVRHVYPDAFRLFGTFMQRMNVEVVYVDGRDEAAVEKAMPGAKLFYMESPTSWVMEAHDVGALAAIGKRHGAVTVIDNSWASPVFQQPISLGVDLVVHSASKYLGGHSDVVSGVVAGSKAMIDRIREETYPYLGGKMSPFDAWLLIRGLRTLPLRMKAHQASALDIATRLQALDVVEKVCHPGLANRLPPGLHGTSGLFSFIFKEGVDVRAFADRLQLFKLGVSWGGHESLIVPGEVVLEQKAQPNSAHTFGISARSVRLHVGLEGTEALWNDLEPAIK

SEQ ID NO: 11665 - protein, 310 aa, Agrobacterium tumefaciens
VTAGEILVEIMATTVGDGFLEPQTLIGPFPSGAPAIFIDQVARCGGTAGIIAAVGDDDFGRLNIERLRRDGVDVSAITTIADRPTGSAFVRYRENGARDFVFNIAHSAASETRMTDEAQALIEKAGHVHIMGSAFAIAGIGAIILEAVKSVKARGGSVSFDPNIRKELAQGDEGRRLIDDLLAVTDLLLPSGEELQAASGLDDEEAAIEKLLAAGIGEIVLKRGANGASHFSRAHGRIDAPGLEVEEIDPTGAGDCFGATYLTCRRLGMRPGKALVYANASGAHNVTKRGPMEGAASLAELDAFMAAQLS

SEQ ID NO: 11666 - protein, 256 aa, Agrobacterium tumefaciens
MRLNNKVALITGAARGIGLGFAQAFAAEGAKVIIADIDIARATTSAAAIGPAAKAVKLDVTDLAQIDAVVKAVDEEFGGIDILVNNAAIFDMAPINGITEESYERVFDINLKGPMFMMKAVSNVMIARARGGKIINMASQAGRRGEALVTLYCASKAAIISATQSAALALVKHGINVNAIAPGVVDGEHWEVVDAHFAKWEGLKPGEKKAAVAKSVPIGRFATPDDIKGLAVFLASADSDYILAQTYNVDGGNWMS

SEQ ID NO: 11667 - protein, 311 aa, Agrobacterium tumefaciens
MHAIQFVEKGRAVLAELPVADLPPGHALVRVKASGLCHTDIDVLHARYGDGAFPVIPGHEYAGEVAAVASDVTVFKAGDRVVVDPNLPCGTCASCRKGLTNLCSTLKAYGVSHNGGFAEFSVVRADHLHGIGSMPYHVAALAEPLACVVNGMQSAGIGESGVVPENALVFGAGPIGLLLALSLKSRGIATVTMADINESRLAFAQDLGLQTAVSGSEALSRQRKEFDFVADATGIAPVAEAMIPLVADGGTALFFGVCAPDARISVAPFEIFRRQLKLVGSHSLNRNIPQALAILETDGEVMARLVSHRLP

SEQ ID NO: 11668 - protein, 243 aa, Agrobacterium tumefaciens
FSLEGRKALVTGANTGLGQAIAVGLAAAGAEVVCAARRAPDETLDIIAKDGGNASALLIDFADPLAAKDSFTDAGFDILVNNAGIIRRADSVEFSELDWDEVMDVNLKALFFTTQAFAKELLAKGRSGKVVNIASLLSFQGGIRVPSYTAAKHGVAGLTKLLANEWAAKGINVNAIAPGYIETNNTEALRADAARNKAILERIPAGRWGHSEDIAGAAVFLSSAAADYVHGAILNVDGGWLAR

SEQ ID NO: 11669 - protein, 296 aa, Agrobacterium tumefaciens
MNPEQIKTALGSGLLSFPVTHFDAEGRFAADSYREHVEWLAGYKAPVLFAAGGTGEFFSLKPDEIPTIVAAAKEVAGETAIVSGCGYGTEIAVDIARSVEKVGADGILLLPHYLIDAPQEGLYAHIKKVCQSVGIGVMVYNRDNSVLQADTLARLCDECPNLVGFKDGTGDIGLVRQITAKMGDRLMYLGGMPTAELFAEAYLGAGFTTYSSAVFNFVPGLANEFYAALRAGERATCERILVDFFYPFMAIRNRAKGYAVSAVKAGVRLQGFNAGPVRAPLKDLTNEEIGMLEALI

SEQ ID NO: 11670 - protein, 312 aa, Agrobacterium tumefaciens
MALATRATGGAGRRKPVRARAATGLHLVSCHKTQLLGFTIRNAASWTIHPQGCEDLTAAGLTIIAPHDSPNTDGFNPESCRNVMISGVRFSVGDDCIAVKAGKRGPDGEDDHLAETRGISVRHCLMQRGHGGLVIGSEMSGGVHDVTVEDCDMIGTDRGLRLKTRRGRGGMVGNITMRRVLLDGVQTALSANAHYHCDADGHDDWVQSRNPAPVNDGTPFVDGITVEDVEIRNLAHAAGVFLGLPEAPSATSLSATSPSSRHDPSAVATPPIMADRVRPMRHEAIVFEQADVVCDDPALLNDAPVSISSYFD

SEQ ID NO: 11671 - protein, 499 aa, Agrobacterium tumefaciens
KARVSVHRDFRIGRIDDRLYSAFIEHMGRAIYGGIYEPGHPQADANGFRKDVLKFVQDLKIPAIRYPGGNFVSAYRWEDGIGPRDQRPIRLDLAWRSKETNQIGINEFADWAQMAGIEMMLAVNLGSRGLDDARNFLEYVNFPGGTALSDLRRSHGTEKPHGVKMWCLGNEMDGPWQIGHKTAVEYGRLANETAKAFKGFDPTIEAIVCGSSNDGMPTYPEWEREVLEECYENVDHISLHKYFGNNSRDTLNYFGKIEETGRYIQTIAGVIDYVKAKKRAKNDVSICFDEWNVWYHIREDDGKRIKSWDWPEAPALLEETYNFEDALFVAGLLNEFIRRSDRVRIACIAQLVNVIAPIRAEKNGPAWRQTIYYPYQFASLYGRGVALNVAVDCPTYDCNAADDVKYLDVAGVYDEAEGMVTLFVLNRHLTEAADINVGLTGFSSATLDLHLAMAGYDLRVGNGPDQPDRVVPVPGSGVGVEDGALKGSVSALSYHVLRL

SEQ ID NO: 11672 - protein, 250 aa, Agrobacterium tumefaciens
LSNKVALITGSSRGIGRAAALAFAKEGAGLIGVHYGANPDAAQATIREIEALGSKAIALKADLRDGKAATDNLWDQFKQASIAFTGTPSLDILVNNAGIAPATPLKDMTEAAFDELMTINFKAPFFLIQAVADHLRDNGRIINISTGFTRIAAPTHPAYAASKGALETLTLALAPEFGRRGITVNSVLPGVTETDMNAGWLAAPEARAGAEALSVFSRIGRAEDIADVITFLASDDARWTTGQMIDATGG

SEQ ID NO: 11673 - protein, 295 aa, Agrobacterium tumefaciens
RAFVIGNIALDETYSIAALPQAGASIFGEQASRSLGGKGCNQAIVLARCGVETTLVAAVGTDDRAIAIGKSLTREHLTPKLIPVDSATSDISIILTTPDGENSIITTRSAAAALDRDAALDALGDTVSGDLVILQGNLSEETTLVILNAARSKGLTTAFNPSPLQPWFASILPLIDIAVLNRIEAEALTGESGAGAGAFLLRAGVGLVIITLGGQGCVLVSANGAIEVAAAPATIVDTTGAGDCFTGVALASAIRRGVAIDARALEDASRAAAITVGRRGTQDAFPSHEEMMAIL

SEQ ID NO: 11674 - protein, 225 aa, Agrobacterium tumefaciens
VALISGASRGIGDHIGAALLQQGWLVSLGMRTPVLPSWAVGREKDVHLFSYDANDAAETRWTEDALRHFGRIDAIVANAGIMIPKTVIEANDDDIDAMLSVNVKAPRRLVKAAWNALCESGRGRVIILASLSGKRVKSASAGSYSLSKFAAVALAHAIRQAGFEKGVRATAVCPGFVATDMAAALSERPAEQMTQPTDLGRIIAMLLSLPNEASVAEFAINCQLE

SEQ ID NO: 11675 - protein, 242 aa, Agrobacterium tumefaciens
FTNRTIVVAGAGRDIGRACAIRFAQEGANVVLTYNGAAEGAATAVAEIEKLGRSALAIKADLTNAAEVEAAISAAADKFGEIHGLVHVAGGLIARKTIAEMDEAFWHQVLDVNLTSLFLTAKTALPKMAKGGAIVTFSSQAGRDGGGPGALAYATSKGAVMTFTRGLAKEVGPKIRVNAVCPGMISTTFHDTFTKPEVRERVAGATSLKREGSSEDVAGLVAFLASDDAAYVTGACYDINGG

SEQ ID NO: 11676 - protein, 250 aa, Agrobacterium tumefaciens
MTPNVRPLVAGNWKMNGTRASLDQIKAMAEGVKGALSEKVDALICPPSTLLYVATALCDDSPLLIGAQDCHQNDTGAHTGDISAEMIADCFGTHVIVGHSERRTDHAETDHLVRAKASAAHQVDLIAIVCIGETADERKAGQTLDILKRQLAGSLPDEATAENTVIAYEPVWAIGTGLTPTTQDVREAHAFMRDELVKRFGDAGKTMRILYGGSVKPANALELMGVENVDGALIGGASLKAADFLSIYAA

SEQ ID NO: 11677 - protein, 472 aa, Agrobacterium tumefaciens
RKTSKKARLMTATRTETDTFGPIEVQADRYWGAQAQRSLGNFKIGWEKQPASVVRALGIVKQAAARANMALAGLDPKVGDAIIAAAQEVIDGKLTEHFPLVVWQTGSGTQSNMNANEVISNRAIEMLGGEMGTKKPVHPNDHVNMSQSSNDTYPTAMHIACVEEIVHHLLPALKHLHTALEAKVKQFEKIIKIGRTHTQDATPLTLGQEFSGYAAQVASAIANIELTLPALSKLAQGGTAVGTGLNAPVGFAEKVAEEISEITGLSFVTAPNKFEALASHDSMVFSHGAINAAAAALFKIANDIRFLGSGPRAGLGELSLPENEPGSSIMPGKVNPTQSEALTQVCAHIFGNNAALSFAGSQGHFELNVYNPMMAYNFLQSVQLLGDAAVSFTDNCVVGIEAREDNIRKGVENSLMLVTALNGKLGYDICAKIAKTAHKNGTTLREEAVGGGYLTNEEFDQYVRPENMIGPK

SEQ ID NO: 11678 - protein, 448 aa, Agrobacterium tumefaciens
QNWTPGSWRQKPIQQVPEYPDAAALAATEATLATYPPLVFAGEARRLKKQLANVAEGNAFLLQGGDCAESFLEHGADNIRDFFRAFLQMAVVLTYGAQLPVVKVGRIAGQFAKPRSSNVEVLDGVTLPSYRGDIINGIEFNEASRIPSPERQLDAYRQSAATLNLLRAFAMGGYANLENVHQWMLGFIKDSPQADRYRKLADRISETMNFMQAIGISAENNPSLRETDFFTSHEALLLGYEEALTRIDSTSGDWYATSGHMIWIGDRTRQLDHAHVEYFRGIKNPIGLKCGPSLTPDNLIELIDALNPANEAGRLTLICRFGHDKVADSLPKLIRAVEKEGRKVVWSCDPMHGNTITLNHYKTRPFERILSEVESFFQIHRAEGTHPGGIHIEMTGKDVTECTGGARAVTADSLSDRYHTHCDPRLNADQALELAFLLSERMKSGRDE

SEQ ID NO: 11679 - protein, 127 aa, Agrobacterium tumefaciens
FQMIDKVESVDMATRTLKAQSVVPDHSPVFEGHFPGMPLVPGVLLIETMAQASGMMVLAFSDFASMPFLMSVDGAKMRTFVEPGAVLDIEAVLEHDGSGFAVTKAKITSAGKKVCDAQLKCAPCRSA

SEQ ID NO: 11680 - protein, 411 aa, Agrobacterium tumefaciens
VAVTGMGIITSLGQGLADNWAALTSGKSGIHKITRFPTEGLSTRISGTVDFIDIPVPNSVERSYAFARETTIEALAQAGISGDFDGPLFLAAPPIEPEWSARFELADRSPPAAKPGDAYERFMTALRQRPDPAFQEAALFGAISERLSDRFGTRGLPVTLSTACASGATAIQLGVEAIRQGRTERALTVATDGSVSAEALIRFSLLSALSTQNDPPEKASKPFSKDRDGFVIAEGAATLVLESLEAAVARGAKVLGIIKGAGEKADSFHRTRSSPDGGPAIATIRAALADAGVAESDIGYINAHGTSTPENDKMEYGSMLAVFGEGLKNIPLSSNKSMIGHTLTAAGAVEAVFSLQTMLTGTLPPTINYNNPDPTITLDVVPNVKRDAQVGAVLSNSFGFGGQNASLVMTR

SEQ ID NO: 11681 - protein, 327 aa, Agrobacterium tumefaciens
DLPEPDAPGPGEVTLRVKAVALNHIDVWGWRGMAFAKRKMPLTIGAEASGVVEAIGPGVSNVLPGQLVSVYGARTCGLCKPCREGRDNLCEHVQGVHGFHLDGFAQEKINIPARQLVPAPHGIDAVAAALAPVTFGTVEHMLFDNAKLEPGETILIHAGGSGIGTAAIQLAKKMGCTVITTVGSDDKIERAKALGADHVINYRTDRFEGVVRKLTKKKGVDVVFEHVGKDTFVASMFSLKRGGRLVTCGSTSGVSTEINLMMLFQQQLKLLGSFGCRMENMANAMQKMARGIVHPVIDTEVTFDDIDRALERMETRQVFGKIVLRMD

SEQ ID NO: 11682 - protein, 430 aa, Agrobacterium tumefaciens
LRIGIAGLGTVGASLVRILQQRSNELAITCGRAIEIIAVSARDRSRDRGIDLKGITWFDTPEQMASEADIDVFVELVGGASGQAENAVRAALSRGLHVVTANKALLAKHGVELATIAEDKGALLNFEAAVAGGIPVIKALRESLTGNHVSRIYGIMNGTCNYILTKMEKEGLSFEVCLKEAQRLGYAEADPAFDIEGNDTAHKLSILTTLAFGNKIAADDIYLEGITNISIEDIQAAAELGYRIKLLGVAQVTDSGIEQRVHPTMVPLDSVIAQVDGVTNAVAIESDILGELLMVGPGAGGNATASAVLGDIADIAKSRPGTQQVPVLGRPAKSLTEYRRAKMKSHEGGYFIRLTVKDQAGVFASIATRMADNNISLESIVQRQRVHVEGAPQTIILVTHATMEDAIRKAVKAIKNEKYLVSEPQVIRIE

SEQ ID NO: 11683 - protein, 359 aa, Agrobacterium tumefaciens
VNPPIVRGSTVLFPDAETLSTEDQKYTYGTHGTPTTDALCNLVNELEGSFGTILVPSGLAAITVPFLAYLGAGDHALIVDSVYFPTRRFCNTMLKKLGVEVEYYDPAIGAGIEALIRPNTKLVHLEAPGSNTFEIQDVRLITDIAHRHDCVVTMDNTWATPLYFKPLDFGVDVSIHAATKYPSGHSDVLMGFVSANEKYWKALYQANTNLGICVTPDDAYQILRGMRTMGIRLEHHQKSALDIAQWLEGRDDVVRVLHPALPSFAGHELWKRDFKGASGVFSFVLKAEEGKYKQTASAFLDALTFFGLGYSWGGYESLAVSVSLVDRTIAKGPSEGPVIRLQIGLEDVADLKKDLEAGF

SEQ ID NO: 11684 - protein, 335 aa, Agrobacterium tumefaciens
PMKLATIRRRDPGPRDVEIEIEFCGVCHSDIHTARSEWPGSLYPCVPGHEIVGRVGRVGAQVTRFKTGDRVGVGCIVDSCRECASCAEGLEQYCENGMTGTYNSPDKAMGGGAHTLGGYSAHVVVDDRYVLNIPEGLDPAAAAPLLCAGITTYSPLRHWNAGPGKRVGVVGLGGLGHMAVKLANAMGATVVMITTSPGKAEDAKKLGAHEVIISRDAEQMKKATSSLDLIIDAVAADHDIDAYLALLKRDGALVQVGAPEKPLSVMAFSLIPGRKTFAGSMIGGIPETQEMLDFCAEKGIAGEIEMIDIDQINDAYERMIKSDVRYRFVIDMKSL

SEQ ID NO: 11685 - protein, 738 aa, Agrobacterium tumefaciens
MSCCAPGTEGSLELGEPLNPPSSEELLLASRDLGQGLRQTDLSVPGVYCGACITTIETALGRLGQVERARVNLSSKRVAVVWKEEVNGVRTDPADIARAILATGYRIHLFASGQDASYALRSQLIRAVALCGFASANIMLLSVSVWSGADAATRDMFHWISAMIAAPALIYGGRFFYQSAWNALKHGRTNMDVPIALAITLSYAVSLWETIHHGEHAWFDATVSLLFFLLIGRTLDHIMRDKARSAIAGLARLSPRGATVIDADGVRDYRPLADIEPGMSIAIAAGDRVAVDAVVVCGSSDLDMSIVNGESAPRRVVAGDSLQAGTLNLTGSLVARVTASAKDSFLSEVIGLMEAAEGGRARYRRIADRAASYYSPVVHLLALVTFLGWGIFGGDWKQAMLIAIAVLIITCPCALGLAVPVVQVVAAGRLFRRGIMVKEGSAMERLSEIDTVLFDKTGTLTVGKPRLVETADVKPAIMAIAAGLAAHSRHPLSKALHAAYNGALPAYEAVREIPGSGVEAETEAGTYRLGNRRFACPDETRINNGDARSEVVLSLDGRHLASFGFEDNPRAGAIAALRSLSVRGLAQEIVSGDRAAAVSAMAQRLGIGNWRADLSPKDKAARCAALAGEGHRVLMVGDGINDAPALAAAHVSMAPATAADIGRQAADFVFMQEDLDAVPFAIETSQRAGNLIRQNFALAIGYNIIAVPIAIAGYATPMIAAIAMSTSSLIVVANALRL

SEQ ID NO: 11686 - protein, 464 aa, Agrobacterium tumefaciens
IGLIGLGVMGSNLALNIAEKGNKIAVFNRTPEVTRKFYADAGELQGQIIPCETIEEFVAAIRPPRPIIIMIKAGDPVDQQMEILKPHLANGDIMIDAGNANFRDTIRRFDNLKDSGLTFIGMGVSGGEEGARHGPSIMVGGTEDSWKRVEKVLTSISAKYNDDPCVAWLGNDGAGHFVKTIHNGIEYADMQMIAEIYGILRDGLKMSAVEIADVFAEWNKGRLNSYLIEITEKVLRAADPITGKPMVDLILDKAGQKGTGKWSVIEAQNMGVAATAIEAAVAARILSSQKDEREAAEKIFGLPTLAAAPADKKAFIADLESALLAAKVGAYAQGFAIMSAASKEFNWNLPMPTIARIWRAGCIIRSEFLDEITSAFTKDPHVANLIVTPAFSAIVKDTDAPLRRVVSYAVLSGLPVSALASALGYFDAYRRGRGSANLIQAQRDFFGAHGFERTDGVDKPHGPW

SEQ ID NO: 11687 - protein, 342 aa, Agrobacterium tumefaciens
MVWQPAENRYASMKYNHCGKTGLKLPAISLGLWHNFGNDTPHQTKQAICRRAFDLGITHFDLANNYGPPPGSAETAFGEILKTDFRGYRDEMIISSKAGYNMWPGPYGEWGSRKYLISSCDQSLKRMGLDYVDIFYSHRFDPNTPLEETCGALDQIVRSGKALYVGISSYNSKRTREAAAILKDLGTPCIIHQPSYSMINRWIEEDGLVDTLEELGIGSIVFSPLAQGMLTTKYLGGVPDGSRASQSKSLNPAFLNERNVENIRALNSIAERRGQTLAQMAIAWVLRGGRITSALIGASRVEQVEDCVKALDNAEFSTEELAEIDRYAKDADINLWAKSAER

SEQ ID NO: 11688 - protein, 217 aa, Agrobacterium tumefaciens
MSLRINDIAPDFTAETTQGPVRFHDWIGDGWAVLFSHPKNFTPVCTTELGAMGGLQPEFEKRGVKIIGISVDPVESHEKWKADIRTATGFNVDYPLIGDKDLKVAKLYDMLPAGAGDSSEGRTPADNATVRSVFVIGPDKKIKLVLTYPMTTGRNFDEILRAIDSIQLTSKHQVATPANWKQGEDVIITAAVSNEDAIARFGSYDTVLPYLRKTKQP

SEQ ID NO: 11689 - protein, 120 aa, Agrobacterium tumefaciens
MLKFTAEHEWLKFEGDIATVGITSHAAEQLGDLVFVELPEVGATFAKDGDAATVESVKAASDVYCPLDGEVVEINQAIVDDPSLVNSDPQGAGWFFKLKLSNAADAETLLDEAAYKELIA

SEQ ID NO: 11690 - protein, 551 aa, Agrobacterium tumefaciens
MYRYDEFDHAFVEGRVAQFRDQVERRLSGELAEDAFKPLRLMNGVYLQLHAYMLRVAIPYGTLNSQQMRMLAHIARKYDRGYGHFTTRQNIQYNWPRLSDTPDILSELASVEMHALQTSGNCIRNVTADHFAGAAADEVADPRPYAEILRQWSSVHPEFSFLPRKFKIAVTGAERDRAAIQVHDIGLHLKKNDKGEIGFAVYVGGGQGRTPMIAKKIRDFLPEEDLLSYTTAVMRVYNLHGRRDNKYKARIKILVHETGAEELARQVEVEFAELKNTELKLPDADIAAITAYFAPPALKDRPEGWESLARWKRADEGFARFVEQNVAPHKHPDYGMVTISLKPIGGIPGDATDEQMELVADIAAEYAFDEIRISHEQNIILPHVALADLEPVYRALVGAGLATANAGLITDIIACPGLDYCALANARSIPVAQEISTRFGAPERQAEIGELKIKISGCINACGHHHVGHIGLLGVEKKGAELYQITLGGSGDENTSIGEIIGRGFEPEKVTDAVETIVDTYLGLRLSKEETFLEAYRRVGPQPFKDALYGS

SEQ ID NO: 11691 - protein, 471 aa, Agrobacterium tumefaciens
  unsure (1)..(471): unsure at all Xaa locations
SAAGDRLSTFPAFFRVEGRQVAVFGNGDEAFAKVRLLANTNAHIVAYADHPEADFARYISENSIDHRALAFASPLVDDATLVFAATGDEALDREIVSVARTKKIPANAVDQPEFCDFFTPALVARAPVAIAIGTEGAGPVLAQMIRARIDQMLSPSLGKLARLAVQYRDAAEENVPKGALRRNFWRRFFSGAVADAVALGDTSSARHAADRLLQSPERSEGRVWLVGAGPGAEDLLTLRAQRVLMEADVIVYDALVPQAIVDMGRRDAERLSVGKRKGCHSKSQNDINRLLVRLGLEGKRVVRLKSGDPLVYGRAGEEMAALREAGVAYEIVPGITSAFAAAADFELPLTLRGVASSLIFTTGHDLMGDVLPDWARLAVSGATIAVYMGRSVAASVAKRLIDAGLGVETTVAVIENASRADRRLLHGTLNDLPDLEYRDELIGPVMVIIGDAVAGRXFRQIRGACACSQAG

SEQ ID NO: 11692 - protein, 474 aa, Agrobacterium tumefaciens
MAQSYDVIIIGSGPGGYIAAIRAAQLGMKVAVVEREHLAGICSNWGCIPTKALLRTADVMHTATHAKDYGLTLEGSIKPDVKAIVARSRGIAARMNNGVGFLFKKNKVDIIWGEAKITKPGEIVVGKSTKPVVQPQGPVPKNTLGEGTYTAKHIIVATGARPRALPGIEPDGKLIWTYFEAMKPEELPKSLLVMGSGAIGIEFASFYRTMGVDVTVVEIMSQVMPVEDAEISAFAKKQLEKQGIKIHLETKVSKVEKAANSVTATLEKKDGSSEKIIADRMISAVGVVANVEGIGLEAAGVKTDRGFIIIDGYGKTNVPGIYAIGDVAGPPLLAHKAEHEAVICVEKIAGLPNVHPMDKLKIPGCTYCNPQVASVGLTEAKAKEQGRDIRVGRFSFAANGKAVALGEDQGMVKTIFDKKTGELLGAHMVGAEVTELIQGFVVAMNLETTEEDLMHTIFPHPTISESMKESVLDA

SEQ ID NO: 11693 - protein, 452 aa, Agrobacterium tumefaciens
MPINITMPALSPTMEEGNLTKWLVKEGDKVAPGDVIAEIETDKATMEVEAVDEGTVAKLVVPAGTEAVKVNALIAILAAEGEDVAEAAKGGDAVPAKAEAPKPEAAKAEAPKEEAAPVKAEKPVADQAAASSTPAPVAKSGERIFASPLARRLAKEAGLDLSAVSGSGPHGRIVKTDVEKAAASGGAKAAPAAAASAGAPAPALAKGQSDEAVLKLFEQGSYELVPHDGMRKVIAKRLVESKQTVPHFYVSVDCELDTLLALRAQLNAAAPEKDGKPVYKLSVNDMVIKALALALRDVPDANVSWTESAMVKHKHADVGVAVSIPGGLITPIIRKAEEKSLSTISNEMKDYGKRAKERKLKPEEYQGGTTAVSNMGMMGVKSFSAVINPPHATILAVGAGEQRAVVKNGEIKIANVMTVTLSTDHRCVDGALGAELIGAFKRYIENPMGMLV

SEQ ID NO: 11694 - protein, 473 aa, Agrobacterium tumefaciens
MPVEILMPALSPTMEEGTLSKWLKKEGDKVTSGDVIAEIETDKATMEVEAVDEGVIGKLLIDAGTEGVKVNTPIAVLIQEGESADDISSSAKKEEPKAEAANSGSDAAGGKTREAAEEPSAAKEAAKVPAAPKIEVAADPDIPEGTEMVMTTVREALRDAMAEEMRADEKVFVMGEEVAEYQGAYKITQGLLQEFGERRVIDTPITEHGFAGIGVGAAMTGLKPIVEFMTFNFAMQAIDQIVNSAAKTLYMSGGQMGAPMVFRGPSGAAARVGAQHSQCYAAWYSHIPGLKVVMPYTAADAKGLLKAAIRDPNPVIFLENEILYGQSFEVPKLDDFVLPIGKARIHRKGKDATIVSFGIGMTYAIKAVAELEKLGIDVELIDLRTIRPMDLPTVIESVKKTGRLVTVEEGFPQSSVGDFIANQVMRAAFDYLDAPILTIAGKDVPMPYAANLEKLALPNVDEVVQAVKTVCYK

SEQ ID NO: 11695 - protein, 347 aa, Agrobacterium tumefaciens
MAPRKPATVSGRKTTAKAATEFTGKNSPDFSKDEELHAYREMLLIRRFEEKAGQLYGMGFIGGFCHLYIGQEAVVVGMQMSQKEGDQVITAYRDHGHMLALGMSARGVMAELTGRKGGLSKGKGGSMHMFSKEKHFYGGHGIVGAQVSLGTGLAFANRYRGNDNVSVTYFGDGAANQGQVYESFNMAALWKLPIIYIVENNRYAMGTSTARATAQSNYSLRGQSFGIPGVQVDGMDVRAVKAAADQALEHCRSGKGPIILEMLTYRYRGHSMSDPAKYRSKDEVQKMRSEHDPIEQVKARLLDHGWASEDELKAIDKDVRDIVADSADFAQNDPEPDVSELYTDILL

SEQ ID NO: 11696 - protein, 423 aa, Agrobacterium tumefaciens
MTAITDIIAREILDSRGNPTVEVDVYLEDGSMGRAAVPSGASTGAHEAVELRDGGKRYLGKGVEKAVEAVNTEIFDAIGGFDAENQIQIDQMMIALDGTPNKSRLGANAILGVSLAIAKAAAEASGLPLYRYVGGPNAHLLPVPMMNIINGGAHADNPIDFQEFMILPVGAENIREAVRMGSEVFHTLKKELSAQGHNTNVGDEGGFAPGLESAPAALDFIMKSIEKAGYRPGEDMYVGLDCASTEFFKDGKYVLEGEGRTLEPGAMAEYLAELVNKYPIISVEDGMAEDDWEGWKTLTDLVGNKCQLVGDDLFVTNSARLRDGIKMGVANSILVKVNQIGSLSETLDAVETAHKAGYTAVMSHRSGETEDSTIADLAVATNCGQIKTGSLARSDRLAKYNQLIRIEEMLGPQAAYAGRSILR

SEQ ID NO: 11697 - protein, 576 aa, Agrobacterium tumefaciens
DPLGPYPQKLNERLLHWCRSAPERTWMADRQGREPWRRVSYAEALDKIRRIGQFLLDHDLSVERPLLVLSENSIEHALMVLAAQHVGIASAAITPAYATSADLTKLADIRGQITPGMVFAEDATPFRRALGEVFDDGTPLVGLRNLPEDRSNTFHFETLLETEPTEAVDRAFDAVGPDTVAKFLFTSGTTGSPKAVIQTQRMLCSNQEMIADCYGYFREEPPVVVDWAPWNHTAAGNKVFNLVLYNGGTYYIDRGKPSPAQIGQTLDNLRDISPTWYFNVPAGHEMLVQAMRKDEALCRSFFRDLKMLMYAGAGMAQHTWDALTELSMATVGHAVLMGAGLGSTETAPFSLFCTEPQDKPGNIGIPAQGVTMKLVPFDGRYELRLKGPNITPGYWRNGELTAAAFDEEGFYRIGDTVKFAVADDPRRGFYFDGRMAENFKLQTGTWVAVGPLRAQLVNMFAGLIRDAVITGENRAELGALVVPFIPALRELVRGSQHLSDAEIIRHPSVRAQIVAKLSAHQKQASGSASRVMRILVMEDALRFEKGEVTDKGSINQRAVLLHRKELVESLYGDTPQ

SEQ ID NO: 11698 - protein, 257 aa, Agrobacterium tumefaciens
MNIEGAGALVTGAASGLGAAVARMLAARGAAVTIFDRNGEAGKKLAAEIGGKAVQGDVTSDADAQAAIKVAASAKGGLRILVNCAGIGTAGRILGREGPQPLGDFEQVIRVNLIGTFNMMRLAAAHMAEREQDEGQDSRQDNGVIVNTASVAAFEGQIGQAAYAASKGGIVSLALPAARELARFRIRVNTVAPGIFLTPLLQGLPQEVQESLAGQIPHPSRLGDPAEFADTVRFLIENDYMNGEVIRLDGAIRMQPR

SEQ ID NO: 11699 - protein, 416 aa, Agrobacterium tumefaciens
DDALVVAILNEAARFAETVLEPLNTPADREGCTVVDGRVRVPTGFADAFRRHAGDGWLAMDVPERFGGQALPLVLQAACAPLFERGCVALMMASGSTRAACHLLAETAEGAVADEWVPRLAAGEWAATICISEPDAGSDLARLRSRAVFREGAWRIEGRKIWISFGDHDMAMRIGHCLLARTGEETGTRGLSLFLVPDEIDGERNGVTVERIEEKMGLHGSPTCALRFDGARGLLLGEEGRGLAQLFAMIELMRLQTGCQGLGLASAAIDIAETYAQERQQGGDPAKPAVAIAHHPDIRRQLQEARLRTETLRAATLELATVMDLARMEPKEELRGDLQALSRWLLPLVKNFGADAGFTVSNQAIQILGGAGYTREWPLEQYLRDARVMTIYEGTTGMQAIDLLTRRLWREGGKGL

SEQ ID NO: 11700 - protein, 338 aa, Agrobacterium tumefaciens
VIHAAKDLRVEDVAGQPLAADEVRVAVAVGGICGSDLHYYNHGGFGTVRVREPMALGHEFAGTVVEVGSSVSHLVPGMRVAVNPSLPCGTCRYCAQGRQNQCLDMRFMGSAMRSPHVQGGFREVVTVHSTQPVQIADGLSMGEAAMAEPLAVCLHAARQAGSLLGKTVLITGAGPIGMLSLLVARLAGAAHIVVTDVADAPLDLARRIGADEAVNILRDADMLEKYRFEKGVFDVLFEASGNQAALLPALDLLRPGGIIVQLGLGGDFTIPMNLIVAKELQLRGTFRFHEEFAQAVNMMGRGLIDVKPLISATLPFDQAREAFDLAGDRAKSMKVQLA

SEQ ID NO: 11701 - protein, 265 aa, Agrobacterium tumefaciens
RSASARCEEGIMSNQIIFDLGGRTALVTGSSRGLGRAMAEGLAVAGARILINGTDPSRVAQTVQEFRNVGHDAEAVAFDVTSESEIIEAFARLDEQGIDVDILVNNAGIQFRKPMIELETADWQRVIDTNLTSAFMIGREAAKRMIPRGYGKIVNIGSLTSELARATVAPYTVAKGGIKMLTRAMAAEWAQYGIQANAIGPGYMLTDMNQALIDNPEFDAWVKARTPAKRWGKPQELVGTAVFLSASASDYVNGQIIYVDGGMLS

SEQ ID NO: 11702 - protein, 429 aa, Agrobacterium tumefaciens
MTEKSATVTLGEKQVELPVREGTIGPSVVDIATLYKHTGSFTYDPGFTSTASCESKITYIDGDEGVLLHRGFPIEQLAEQGDFLETCYLLLYGELPTAAQKKDFDTRVTRHTMVHEQMSRFFTGYRRDAHPMAVMCGTVGALSAFYHDSTDITDPHQRMVASLRMIAKMPTIAAMAYKYHIGQPFVYPKNDLDYASNFLHMCFAVPCEDYKVDPVLARAMDRIFILHADHEQNASTSTVRLAGSSGANPFACIAAGIACLWGPAHGGANEAALNMLNEIGSVDRIPEYIARAKDKNDPFRLMGFGHRVYKNYDPRAKIMQKTMYEVLEATGNSDDPIMQVALELEKIALSDPYFVEKKLYPNVDFYSGITLKALGFPTTMFTVLFALARTVGWIAQWNEMIEDPQQRIGRPRQLYTGAGKRDYVPVSKR

SEQ ID NO: 11703 - protein, 138 aa, Agrobacterium tumefaciens
ADILEVMKLLPHRYPFLLIDKIIEIDGDSSAIGIKNVTVNEPHFTGHFPDRPIMPGVLIVEAMAQTAGAICARNQGEGGHLVYFMTIDNARFRRPVVPGDRLEIHVVKQRQRGNVFKFHCEAKVEGALVAEADVGAMM

SEQ ID NO: 11704 - protein, 750 aa, Agrobacterium tumefaciens
LEKALHQALTFANERHHEYATLEHLLLALIDDADAAAVMAACNVDLDALRKTVSDYVDNELTNLVTGYDEDSKPTSGFQRVIQRAVIHVQSSGREEVTGANVLVAIFAERESHAAYFLQEQEMTRYDAVNYISHGIGKRPGTSQTRAPRGADEPESESKPSRGNPEEDGSSAKKQQDALKAYCVNLNDKARNGKIDPLIGRHDEVNRTIQILCRRSKNNPLYVGDPGVGKTAIAEGLAKRIVEGKVPEALANDTIFSLDMGTLLAGTRYRGDFEERLKQVVKELEEFPGAVLFIDEIHTVIGAGATSGGAMDASNLLKPALSSGAIRCIGSTTYKEYRQFFEKDRALVRRFQKIDVNEPSIDDAIAIMKGLKPYFEDYHHLRYSNEAIKAAVELSARYISDRKLPDKAIDVIDETGAAQMLLPASKRRKLITEREIEATIATMARIPPKTVSKDDEMVLANLEKELRSVVYGQDIAIEALATAIKLARAGLREPNKPIGSYVFSGPTGVGKTEVAKQLAASLGVEMLRFDMSEYMERHTVSRLLGAPPGYVGFDQGGLLTDGVDQHPHSVVLLDEIEKAHPDIYNILLQVMDHGSLTDHNGKKIDFRNVILIMTTNAGASEMAKSAIGFGSSRRTGEDEEAINRLFTPEFRNRLDAIIPFSPLPTAVIHKVVQKFVMQLETQLSERNVTFDLHEDAISWLAEKGYDEKMGARPLSRVIQEHIKKPLANEILFGKLKKGGVVSVTVGKKDD

SEQ ID NO: 11705 - protein, 226 aa, Agrobacterium tumefaciens
KVAIVTAGGSGMGAAVAKRLAADGYRLAILSSSGKGEALAKELGGIGVTGSNQSNDDLQRLTDQTLEKFGRIDVLVNSAGHGPRASILDITDEQWHTGLDVYLMNVIRPTRIVAPIMVKQKAGAIVNISTAWAFEPSSMFPTSAVFRAGLASYSKIFADTYAADNVRMNNVLPGWIDSLPATEERRDSVPMQRYGKSEEIAATVAFLASEGAGYITGQNIRVDGGL

SEQ ID NO: 11706 - protein, 133 aa, Agrobacterium tumefaciens
IIVINGPNLNMLGKREPGIYGGKTLKDIENDCVNAGADLGFSVEFRQSNHEGVLVDWLHEAGERAAGVVINPGAYSHTSIALHDAIRAISTPVVEVHISNIHAREEFRHKSMVSPAAKGMICGFGPYGYVMAL

SEQ ID NO: 11707 - protein, 442 aa, Agrobacterium tumefaciens
MVSKILIANRGEIALRVLRAAKELGIPTVAVHSTADADAMHVRLADESVCIGPPPSRDSYLNIHQIVAACEITGADAVHPGYGFLSENAKFADILDAHGITFIGPTAEHIRIMGDKITAKQTAQELGIPVVPGSDGEVKPENALEIARTIGFPVLIKATAGGGGRGMKVAKTEADLEDAVATARSEAAAAFGNDAVYMEKYLGKPRHIEVQVFGDGEGNAVHLGERDCSLQRRHQKVLEEANSPALTVEQRMKIGEICADAMRKLKYRGAGTIEFLYENGEFYFIEMNTRLQVEHPVTEAITGMDLVQEQIRVASGQGLSVTQADIEFHGHAIECRINAEDPRTFVPSPGTLTYFHTPGGLGVRVDSGAYQGYKIPPYYDSMIGKLIVHGRDRDECIRRLRRALDEFVVDGIKTTLPLFQDLLQNEDILNGDYDIHWLEKYL

SEQ ID NO: 11708 - protein, 302 aa, Agrobacterium tumefaciens
RHLLGIKGLSHQDITLLLDKADEAVKISRQREKKTSTLRGLTQINLFFEASTRTQSSFELAGKRLGADVMNMSVGNSSVKKGETLIDTAMTLNAMRPDVLVVRHSSAGAAALLAQKVACSVVNAGDGQHEHPTQALLDALTIRRAKGELSGITVAICGDVLHSRVARSNIILLNQMGARVRVVAPATLLPSGIRDMSVEVFNDMKEGLKNADVVMMLRLQRERMSGSFVPSVREYFHYYGLDAEKLKAAKEDALVMHPGPMNRGVEIASEVADGPQSVIESQVEMGVAVRMAVMETLLVSQN

SEQ ID NO: 11709 - protein, 687 aa, Agrobacterium tumefaciens
MAKLKVDGKEIEVPDHFTLLQACEEAGAEVPRFCFHERLSVAGNCRMCLIEVKGGPPKPAASCAMGVRDVRGGPNGELPEVFTNTPMVKKAREGVMEFLLINHPLDCPICDQGGECDLQDQAMAFGIAGSRYAENKRAVEDKYIGPLVKTVMNRCIHCTRCVRFTTEVAGIAELGLIGRGEDAEITTYLEQAMTSELQGNVVDLCPVGALTSKPFAFTARPWELNKTETIDVMDALGSAIRVDTRGREVMRVMPRVNEAINEEWISDKSRFIWDGLKTQRLDRPYVRKDGRLQPATWGEAFGAIKQAVAATSGSKIGAIAGDLSSVEEMFALKSLLASLGSANVDCRQDGAALDPSLGRASYIFNSTIEGIEHADALLIVGSNPRFEAAVLNARIRKRWRRGGFPIGVIGEAGELRYNYEYLGSGAETLSDLANGSHSFIDKLKSAKNPLIIIGQGALARADGAAVLAAAAKLAVSVGAVTEEWNGFSVLHTAAARVGGLDIGFVPGEGAVAAAEMVTSMDVLFLLGADEIDLSNKGAKFTVYIGSHGDQGAMNADVILPGAAYTEKSGIWVNTEGRVQVGNRAGFAPGEAREDWAILRALSDVLGKKLPFDSLSALRGQLYVAHPHLAETDEIVAGKATDIEALAGKTGSLTKSAFASPVKDFYLTNPIARASAVMAECSALARNN

SEQ ID NO: 11710 - protein, 805 aa, Agrobacterium tumefaciens
MTNITSAASGGTYPVLPLRDIVVFPHMIVPLFVGREKSIRALEEVMGSDKQIMLVTQINASDDDPAPEAIHKVGTVANVLQLLKLPDGTVKVLVEGKGRAQIDSYTGREDFYEASATPLQEPAEDPVEIEALSRSVVSEFESYVKLNKKISPEVVGAAGQIDDYSKLADTVASHLSIKITEKQEMLETVSVKQRLEKALGFMEGEISVLQVEKRIRSRVKRQMEKTQREYYLNEQMKAIQKELGDGEDGRDEMAELEERIAKTKLSKEAKEKADAEMKKLRQMSPMSAEATVVRNYLDWLLGLPWGKKSKIKTDLNAAETILDQDHFGLDKVKERIVEYLAVQARATKIRGPILCLVGPPGVGKTSLAKSIAKATGREYVRMALGGVRDEAEIRGHRRTYIGSMPGKIVQSMKKAKKANPLFLLDEIDKMGMDFRGDPSSALLEVLDPEQNSTFMDHYLEVEYDLSDVMFVTTANTLNIPGPLMDRMEVIRIAGYTEDEKREIAKRHLLPKAIKEHALRPEEFSVSDDALMAISQQYTREAGVRNFERELMKLARKAVTEIIKGKSTSVAVTAANIEDYLGIPRFRHGEAEREDQVGVVTGLAWTEVGGELLTIEGVMMPGKGRMTVTGNLKEVMKESISAAASYVRSRAVDFGIEPPRFDKSDIHVHVPEGATPKDGPSAGVAMATAIVSIMTGIPVSKDVAMTGEITLRGRVLPIGGLKEKLLAALRGGIKKVLIPEENAKDLAEIPDNVKNEMEIIPVSRMGEVIKHALIRQPEPIEWDGSIETPVIATVEGVDDGNQTIAH

SEQ ID NO: 11711 - protein, 252 aa, Agrobacterium tumefaciens
MSGIFSGQVVVVTGGSTGIGFSVAKLFLEGGASTVYVTGRNSANLDAAVAKLGKGAIGFVSDVAKLSDLEQLKSRLEADGRKVDVLVANAGIAENNDLGETHEALYDRIFDINVKGVFYTVQTLLPVLRDGGSIVLTGSIVGNKGMERLSAYNASKAAVRSFARSFANDLKGRGIRVNTVSPGVTRTPIMENGLKMDDEKIAGFKAYLKDAAPIGRMADPDEIAEAVLFLASSKASYITGVELSVDGGLAQI

SEQ ID NO: 11712 - protein, 418 aa, Agrobacterium tumefaciens
TLAVHAGAQPDPTTGARATPIYQTTAYAFRDADHAAALFGLKEFGNIYTRIMNPTQAVLEERVAALEGGTAALAVASGHAAQLLVFHTLMQSGDNFVAARQLYGGSINQFGHAFKGFDWQVRWADAADPASFEAQINERTRAIFIESLANPGGTFVDIAAIADVAHRHGLPLIVDNTMASPYLLRPLEHGADIVLHSLTKFLGGHGNSMGGIIVDGGTFDWSATDRFPALSQPRPEYSGVLLHQTFGNFAFAIACRVLGLRDLGPAISPFNAFLILTGIETLPLRVQRHSDNALAVAKWLKAHPKVGWVHYAGLEDSDNHAIQQHYSPKGAGSVFTFGVKGGYAAGKALVEGLQLFSHLANIGDTRSLVIHPASTTHAQLTPEQQTAAGAGPDVVRLSIGIEDVKDIIADLEQSFAKV

SEQ ID NO: 11713 - protein, 267 aa, Agrobacterium tumefaciens
IWGIPFDAATSNRPGARFGPQAIRRASAIFDNDPQYPFARDLFAHMPTIDYGDCLLDYGNHWKTPDTIEKEARRIISKTDYLLTLGGDHFITWPLLKAHVAKHGRLALVQFDAHQDTWFDDGKRIDHGSFVARAVRDGLIDPDRSIQIGIRTHAPDDFGIRILHGYEVEDMRASDIASLIVKHTGGMPAYLTFDIDCLDPAFAPGTGTPVAGGPTSAKILSVLRGLGQLDIRGSDVVEVAPAYDHADITAIAGATVAMYMLGLRAER

SEQ ID NO: 11714 - protein, 305 aa, Agrobacterium tumefaciens
KIFIDGEHGTTGLQIRTRLAGRRDIELLSIPETERRNAAMREDLLNNADISILCLPDDASKEAVSMVAGNNNVRIIDTSTAYRVHQDWAYGFAEMDRDQGEKVRSARFVANPGCYPTGAIGLIRPLRASGILPDGYPVSVNAVSGYTGGGKQMIAQMEDQSRDDAISANNFLYGLTLKHKHVPEMTIHGQLDRAPLFAPSVGRFPQGMIVQVPLFAADLAEGTTIETIHAALTAHYAGQDIVSVVPLAESKGISRIDAEELAGKDTMKLFVFGTPGGEHINLVALLDNLGKGASGAAVQNMELML

SEQ ID NO: 11715 - protein, 273 aa, Agrobacterium tumefaciens
VVSADWVEKQLGTAGFRVVDASWYLPAHKRNGAEEYAAGHLPGAVFFDQDKIADHTTGLPHSLPSPEFFAQEAGELGLSENDTIVVYDGPGFFSAPRVWWMLRVMGVRKAYVLDGGLDGWKREGRPLETGTPEIEPATFTPDFNDKRVTSLSTMRGIVDSGEKQIADARGAGRFTGDEAEPRAGMRSGHMPGARSLPAMAFSDNGHFKDLTAIRKMVTDAGIDLSKPVVTSCGSGVTAAVVTLALESLGHHDNSLYDGSWSEWGGLEDTPVVT

SEQ ID NO: 11716 - protein, 810 aa, Agrobacterium tumefaciens
IAIDGMTCASCVGRVEKAIARVPGVLKASVNLATERADISFSGPPDVPAVIAAVRHAGYGVEEKTVELDIEGMTCASCVGRVEKALKAVSGVSDASVNLATERAAIRVAGNAASAATLAEAIKRAGYQAKEIVADKAGDAEQDRRAADMRSLKISLAVAVVLTLPVFVLEMGSHLVPAIHDFVMETVGMRKSWYLQFVLTTLVLFGPGLRFFKKGIPALMRLAPDMNSLVVLGTAAAWGFSVVATFLPEILPRGTANVYYEAAAVIVTLILLGRFLEARAKGRTSEAIKRLVGLQAKSARVLRDGETIDVPLQDVRTGDVIVVRPGEKVPVDGLVLNGSSYVDESMITGEPVPVTKTEGSEVVGGTVNRNGSFTFRATKVGSDTLIAQIIRMVEEAQADKLPIQALVDKVTNWFVPAVMLAALVTFAVWFVFGPDPALTFALVNAVAVLIIACPCAMGLATPTSIMVGTGRAAEMGVLFRRGDALQTLRDADVIAVDKTGTLTLGKPKLVHFNTTQGFDADEVLRLVASLENRSEHPIAEAIVEAAKHGGLTLAEAEAFEATPGFGVAATVDGRRVEAGADRFMVKLGYDVGAFATDAERMGREGQSPLYAAVDGRLAAIIAVADPIKQTTPEAIAALHALGLKVTMITGDNRRTAEAIARRLGIDEVVAEVLPDGKVEAVKRLAAGGRRVAFVGDGINDAPALAAADVGLAIGTGTDVAIESADVVLMSGDLRGVANAIALSKATIRNIRQNLFWAFAYNAALVPVAAGILYPVNGVLLSPVLAAGAMALSSVFVLTNALRLKSFRAPL

SEQ ID NO: 11717 - protein, 322 aa, Agrobacterium tumefaciens
IRSIVRGFGAALPKRVMTNSEIEGVVETSDEWIVQRTGIRQRYIAGEGETTASLGEAAARAALDNAGLTPADIDLIILATSTPDNTFPATAVNIQNRLGMTHGFAFDMQAVCSGFVYAVATADLYIRGGMAKRVLVIGAETFSRILDWKDRTTCVLFGDGAGALVIEAGEGEGTSSDRGILTSQLRSDGSHKDKLYVDGGPSTTGTVGHLRMEGREVFKHAVGMITDVIEQAFEATGTTADDLDWLVPHQANKRIIDGSAKKLNIDPEKVVITVDKHGNTSAASIPLALAVAASDGRIKKGDLVMLEAMGGGFTWGAVLLRW

SEQ ID NO: 11718 - protein, 322 aa, Agrobacterium tumefaciens
RMRRNRKADWTRRLVQENRLTVDDLIWPVFIVPGSNIVEPIPAMPGVNRMSVDRLVEAAKEAADLGIPAIATFPNIEMELRDETGSNALEANNLINQATIAVKKAVPNIGMITDVALDPFTSHGHDGILRGDEIVNDETVEQVVTAAILQAEAGSDIISPSEMMDGRIGAIRRGLDAAGHQNVGIMAYATKFSSGYYGPYREAISTAGLLKGDKNSYYISPANGMEAIRDAALDVEEGADMLMVKPGLPYLDICWRLKENFGLPTFAYQVSGEYTQIKAAAMNGWIDGERVMMETLLCFKRAGCDGILTYFAIEAARKLAKH

SEQ ID NO: 11719 - protein, 357 aa, Agrobacterium tumefaciens
MSQSGKNGLTYSDAGVDIDAGNLMVEKIKPAVRSTRRPGADGEIGGFGGLFDLKAAGFTDPVLVAANDGVGTKLKIAIDADYHDTVGIDLVAMCVNDLVVQGAEPLFFLDYFATGKLDPDQGAAIVSGIAAGCRESGCALIGGETAEMPGMYSDGDYDLAGFAVGAAERGQLLPAGDIAEGDVILGLSSSGVHSNGFSLVRKIVSLSGLEWSAPAPFADGKKLGEALLTPTRIYVKPLLKAIRETGALKALAHITGGGFPENIPRVLPKHLAAEIDLAAIKVPAVFSWLAKTGGVEAHEMLRTFNCGVGMIVVVSAENATKVTEALTAEGETVFPLGRMVAREDGAHGTIYKGTLGL

SEQ ID NO: 11720 - protein, 705 aa, Agrobacterium tumefaciens
LRPRFPLKKPPPRPKSVLAIRSCPHDCPSACALEVDINADGRIGRVRGANANTYTAGVICAKVARYSERIYHPGRLLTPKRRKGAKGAGDWQEISWEAALDEVADAFVKAEARHGAEAIWPYFYAGTMGQVQRDSIERLRHAKKYSGFFGSICTNMAWTGYVMGTGALRGPDPREIGKADVVVIWGTNAVATQVNVMTHAVKARKERGAKIVVVDIYDNPTMKQADMRIVVRPGTDAALACAVMHIAFRDGYADRNYMARFADDPAGLEAHLKSKTPQWASEITGLSVEEIEAFARLVGTTKKTFFRLGYGFARQRNGAVAMHAALSIATVLGSWQYEGGGAFHNNGDIFRLNKAELMGTAYADPDVRQLDQSQIGRVLTGDAEALRHGGPVTALLIQNTNPVNVAPEQRLVKQGFLRDDLFVAVHEQFMTETAEVADIVMPATMFLEHDDIYRAGGQNHILLGPKLVEPPETVRTNLFVIEELAKRLGVDHMPGFGLSAREHVDRMLKVSGWGDFESLAEEKWIDAQPPFEMAHYLEGFGYGDGKFRFSPDWATGPSPNKPPKNIGVMGPVSEFPKFPDQVDVIEVADADHPFRLATSPARNFLNSTFAETKTSVQKEGRPELMVCPEDAARNDIADGDIVRIGNTRGEVRLHAKIVEGARPGVLIAEGLWPNKAHLDGEGINVLTGADAVAPYGGAAFHDNKV

SEQ ID NO: 11721 - protein, 237 aa, Agrobacterium tumefaciens
KTVLITGAARRLGRAIASDLAAHGFAIAVHANESMAQAEEFANEIRQKGGRATAVQADLTQSAPTMALVEKAAAALGPIGVVVNNASVFLADTAETPDPAVFDAHFAVHVRAPSLIAAAFVEQLPAEKSGLIVNIIDQRVLALTPRFYSYTLSKSTLWTATRTMAQSFAPRVRVNAIGPGPTFKSERQAPQDFQAQIDGLILKRGPAPDEFGRTIRFLYDTPSITGQMIALDGGQHL

SEQ ID NO: 11722 - protein, 140 aa, Agrobacterium tumefaciens
MAIERTFSMIKPDATKRNLTGAITKVFEDNGLRIVASKRVWMSKREAEGFYAVHKERPFFGELVEGMTSGPTIVQVLEGENAILKNREIMGATNPAQAAEGTIRKSFALSIGENSVHGSDAPETAAQEIAYWFAETEIVG

SEQ ID NO: 11723 - protein, 420 aa, Agrobacterium tumefaciens
LAMRRVVITGTGMVSPLGCGTEVTWERLLAGQNGARLVTEFEVEDLPAKIACRIPVGDGSNGTFNADDWMEPKEQRKVDPFILYGMAAADMALADANWHPETDDDQIATGVLIGSGIGGLEGIVEAGYTLRDKGPRRISPFFIPGRLINLVSGQVSIRHKLRGPNHSVVTACSTGAHAIGDAARLIALGDAEVMVAGGAESPVCRISLAGFAACKALSTQHNDDPQKASRPYDRDRDGFVMGEGAGIVVLEELEHAKARGAKIYAEVVGYGLSGDAFHITAPSEDGDGAYRCMSMALKRAGLTPDDIDYINAHGTSTMADTIELGAVERLVGESAPKISMSSTKSATGHLLGAAGAIEAIFATLAIRDNIVPPTLNLDNPDVETKIDLVPHKARKRQVNVALSNSFGFGGTNASLVLRRY

SEQ ID NO: 11724 - protein, 78 aa, Agrobacterium tumefaciens
MSDIAERVKKIVIDHLGVDADKVVEGASFIDDLGADSLDTVELVMAFEEEFGVEIPDDAADSILTVGDAVKFIEKAQA

SEQ ID NO: 11725 - protein, 245 aa, Agrobacterium tumefaciens
MLDLTGRKALVTGATGGIGEEIARLLHKQGATVGLHGTRVEKLEALAAELGDRVKIFPANLADRAEVKALGEKAEAELEGVDILVNNAGITKDGLFVRMSDEDWDNVIEVNLTAMFRLTRELTHPMMRRRFGRIINITSIVGVTGNPGQANYCASKAGMIGFSKSLAQEIATRNVTVNCVAPGFIESAMTGKLNDKQKDAIMGAIPMKRMGTGAEVASAVLYLASNEAAYMTGQTLHVNGGMAMI

SEQ ID NO: 11726 - protein, 309 aa, Agrobacterium tumefaciens
MGIAFTFPGQGSQAVGMGKELADTYPEARAVFQEVDDALDQKLSDIMWNGPEETLTLTANAQPALMAVSMAVMRVLEARGLKLSDTVSYVAGHSLGEYSALCAAGTFSIADTARLLRIRGNAMQAAVPVGEGAMAAIIGLEHDAVSAICEEAGILGVCQIANDNGGGQLVISGSKTAVEKAAAIASEKGAKRAIMLPVSAPFHSALMAPAAEAMREALAKVEKHNPVVPVVANVRAAPVSDANEIAALLVEQVTGQVRWRETVEWFAANNVTQLYEIGSGKVLTGLARRIDKTVNGVAVNGAADIDQLL

SEQ ID NO: 11727 - protein, 346 aa, Agrobacterium tumefaciens
MKQKLLGRTGISVSEICLGTMTWGTQNTEAEAHAQMDYAIENGVNFFDTAELYPTTPVSAETQGRTEDYIGAWFEKTGKRDQVVLATKVAGSGRDYIRGGRDIDAASIREAVDTSLTRLKTDYIDLYQIHWPNRGTYHFRGAWGFDASGQDTKRTLAEITEKLETLGELVKAGKIRAIGLSNESAWGTQKYIDIAEANGLPRVATIQNEYNLLYRSFDLDMAEVAHHEDVGLLAYSPLAAGLLTGKYQNGARPAGSRGTINKDLGGRLQPHQEAPVKAYLDLAAAHGVDPAQLAIAFCLTRPFMASAIIGATTMEQLKVDIAAVDVALSEDLLKGIAAIHRQYPMP

SEQ ID NO: 11728 - protein, 220 aa, Agrobacterium tumefaciens
LKGRIALVTGASRGIGYFTALELAKAGAHVIACARTVGGLEELDDAIKAVGGTATLVPFDLADMKAIDALGANIYERWGKLDILVANAGVLGVISPVGHIEAKVFERVMNINVTATWRLIRSVEPLLLKSDAGRALILSSGVAHSCRPFWGVYATSKAAVEALARTWAAETQKSPLRINSINPGATRTAMRAQAMPGEDPATVPHPSEVAAAILPLASPD

SEQ ID NO: 11729 - protein, 481 aa, Agrobacterium tumefaciens
LAYRTFVHMHRLSLRFHLERKTGGLSRVIERGTKGIETIVRFTILNTAPTFIEFLLTAIIFWASYGFSYVLVTVVTVWAYIWFTVRASNWRIGIRRAMNDSDTDANTKAIDSLLNFETVKYFGNEEMEARRFDVAMERYEKSAISIWTSLGWLNFGQGVIFGIGSTIMMVMSALAVQRGEQTIGDFVFVNALLLQLSVPLNFIGFVYREIRQGLTDIEQMFDLLEVEAEVTDRPDAKPLAAGPGAISFRDVHFAYDPERPILKGVSFDVPAGKTVAIVGPSGAGKSTISRLLYRFYDIQEGAVTIDGQDIRDVTQKSLRSMIGMVPQDTVLFNDTLAYNIRYGRPSATDEELKAAADAAQISAFIGKLPDGYATMVGERGLKLSGGEKQRVAIARTILKAPPILILDEATSALDTHTEQEIQSALDIVSKNRTTLVIAHRLSTVIHADEIIVLKEGLIAERGTHASLMAHDGLYASMWSRQ

SEQ ID NO: 11730 - protein, 216 aa, Agrobacterium tumefaciens
LSGVRLAIEGRFELAVGMVLLAAFLDGVDGRVARMMKATSKFGEQMDSLADIVNFGVAPALVVYIYLLDQARSIGWIGALIYVIAAGLRLARFNVMIERPVKAPWQSEFFVGVPAPMGAMLVLLPVYLGFLGVEPDKPFAYVAAAYTVLIGYLLISRLPVWSGKSSTRIRRDLVLPMILVVVLYVAMLMSFTWEVLVLTVAAYLVFIPISARLWHR

SEQ ID NO: 11731 - protein, 393 aa, Agrobacterium tumefaciens
RQTMPWLIIAAGSLIAVMTFGPRSAMGFFQLPMLADTGWDRSTFGLAMALQNLFWGLGQPFFGAIADKYGTGRVLVLSGILYAAGLVCMSFGTSPFWLHFGGGVLVGLGIAAGSFSVILSAFARHVTPQQRSLAFGIGTAAGSAGMFLFAPISQGLISAYGWSDSLVWLAAMMVLVPLLAWPMRGNSSSGSQSQAQFQQTVGEALKEALGHKSYLLLTTGFFVCGFQVAFITAHFPAYLGDIGIEPRYAVIAMALIGFFNIIGSLAAGVIAQRYSKPYLLAYIYIARSVVVTAFLLLPQSPLSVILFASFMGILWLSTVPPTNALVAIMFGTRHLGMLGGVVFLTHQIGSFLGVWLGGFLYDRFGTYDIVWWLGVGMGIFAAIVHWPIQERPA

SEQ ID NO: 11732 - protein, 307 aa, Agrobacterium tumefaciens
  unsure (1)..(307): unsure at all Xaa locations
MFKGSIPALITPFTDNGSVDEKAFAAHVEWQIAEGSNGLVPVGTTGESPTLSHDEHKRVVELCIEVAAKRVPVIAGAGSNNTDEAIELALHAQEAGADALLVVTPYYNKPTQKGLFAHFSAVAEAVKLPIVIYNIPPRSVVDMSPETMGALVKAHKNIIGVKDATGKLDRVSEQRISCGKDFVQLSGEDGTALGFNAHGGVGCISVTANVAPRLCSEFQAAMLAGDYAKALEYQDRLMPLHRAIFMEPGVCGTKYALSKTRGGNRRVRSPLMSTLEPATEAAIDAALKHAGLMNXDTPEKLERRAMD

SEQ ID NO: 11733 - protein, 344 aa, Agrobacterium tumefaciens
EAIERSRGLKVEARIGANESGFGPAPSVLLAMRDAAAETWMYSDPENFELKEALAIHHGVARGNIAIGSGVDGLLGEIARLIVEPGTPVVTSFGGYPTFNYHVNGFGGKLVTTPYVDDHENLDGLLDLVIRENAPLVYFANPDNPMGSWWEASEVVAFARALPETCLLILDEAYCETGPISAVPAIDALIGQPNILRMRTFSKAYGLAGARVGYAIGTLGNVEAFDKIRNHFGMARISVAGALAALKDQAYLHEVVGKISDARDRISAIARNNGLSPLPSATNFVTIDCHRDGAYARAIVDGLMDHGVFIRMPGVAPLNRCIRVSAGTADKLDLFEQALPKVLK

SEQ ID NO: 11734 - protein, 443 aa, Agrobacterium tumefaciens
MSNLAAIDAAHHLHPFSDMGKLNAAGTRIIERAEGVFIYDSTGKKYLDAFAGLWCVNIGYGRREIADVVQRQMNELPYYNAFFGTTTPPATLLAQKIASRAGPKMNHVFFTNSGSEATDTWFRMARVYWKALGHPTKTRVIARRNGYHGSTVAGASLGGMKWMHEQGNLPIEGIAHIGQPYWYAEGGDLSPAEFGLKVARELDAKIDELGEENVAAFVAEPIQGAGGVIVPPETYWPEIARICKARNILLVSDEVICGFGRLGSWFGYQHFGVEPDLAPVAKGLSSGYLPIGGVIVSDRVAEVMLSEVGDFNHGFTYSGHPVCAAAALENLRIIEDEGLVERVRDDIGPYFSEGWKSLADHELVGEAVNVGLMGGLQLTADKATRRRFAKPDDIGTAVRNHCLANGLVMRATGDRMLASPALTVSRSEVDEIIETLRQGLNHL

SEQ ID NO: 11735 - protein, 261 aa, Agrobacterium tumefaciens
MDFGISGKRALVLASSRGLGLGIATALAKEGANVLLVGRSGEKLAENCKAINALGKGKADWVWGDLADDNFVESMVQAVEDKLGGIDILVNNTGGPTPGLAQEMTVDKLDTFFQSMVLRVITLTNALLPQMKEQGFGRILTVASSGVFEPIPNLALSNTLRGALVGWSKTLSSEVASFGITSNLLLPGRIHTDRIDELDGANAKRLGKSIEEVREASVKGIPAGRLGTVEEFAAAGAFLCSVPASYITGTMLRVDGGAAKS

SEQ ID NO: 11736 - protein, 267 aa, Agrobacterium tumefaciens
ILVIGSTGTIGTPLVKALVARGESVKAASRSGKPTNGAEGVRFDYTDHATFADAFDGVDRLFLMLAGGRLDTIDALTPVVEEAARRKVKIVFLSVLGVDADDSIPYRQIELKIIASGTPYVILRPNWFADNFHSYWKAGIEHGQIAVPGGEGKSSFIDVRDIADSAAAALTSDAFNGKAFNLTGPQAFGYAEAAALISQAIGKPVSYSAVSDDVFIGILTGAGVPQDYASFLASIFYPVREGWTAVVTGDAETLTGHAPRSLETYIA

SEQ ID NO: 11737 - protein, 450 aa, Agrobacterium tumefaciens
YHFRPPFGWMNDPNGFGRFEGRPHLFYQHYSHGLRWNTMHWGHAVSSDYLRWRHLPIFLFPSEDLTTRPDKRGGAYSGSTIPLVEGSGIRVFFTEQVQDRIPEQQIQLTATSSDLIMAGQADVILAHRPDGQGLTPDFRDPYVFRGPDGLWKMLLGSQSDGGGVILLYETLDPTAASGWTYVGKLWVETRYKTTAIECPCLLPLDGPANARSTRWVLIYGLMHSEDPETGRKNLTMADVGWFDGKVFTKEFGQELDFGTDNYAFQAFLDGDSIIGIGWLANWADANPEIDFPTSMTLPRRIHYANGELLTPPIGAAESLRSHILDRTRLAAGERVTFINGAVEILIELASSDAAFELALDHPTVTLGLVSDETGLWIRHEDGRDGASPHYIAKGARASRIRIFLDYGSIEVFANRGRYVGTKRIEGFEPVRSALLRADPGAVVHATSWAL

SEQ ID NO: 11738 - protein, 838 aa, Agrobacterium tumefaciens
VSVPVEGMTCASCVRRVETAAAKVPGVASSSVNFATKKLTVEPAEGFSARTLGAAIKKVGYDIAPERQEFAVDGLHGEAEAERLKAVLNAVATTVNVKVDAAAGKVAVETIGGRRERDALVETAKLAGFALKTPKPHGHSAHHDHGQHHAHHQGHSQMTAAGESGGHDHMQHAGEEGALKRDLTIAAILTAPLFVLEMGGHIYEPMHHWLMGIIETQNLYYIYFVLATAVIFGPGLRFLKAGFPALLRGAPEMNSLVALGVTAAYLYSVVATFAPDLLPAEAQFVYYEAATVIVTLILTGRLLEARASGRTGDAIRKLMSLQAKTARVERDGATIDISPDDLVAGDIIVIRPGERLAVDGEVVEGSSYVDESMISGEPVPVEKTVGATVVGGTINKTGAFKFKATKVGADTMLSQIIRMVEEAQGSKLPIQLLVDRVTALFVPVVIAIAVLTFIVWAIFGPEPAYTFALVNAVAVLIIACPCAMGLATPTSIMVGTGRAAELGVLFRKGQALQELRSAQIVVVDKTGTVTKGRPELTDLVVAEGFADNEVLALVAAVEGRSEHPIAEAIVRAAEEKNVATPAGLAPTTVENFESVTGYGIAATVNGRKVEVGADRYMAKLGHSVDIFAEAAARLGDEGKTPLYAAIDGRLAAAIAVADPLKPSSVTAIKALQAMGIEVAMVTGDNERTANAIARQVGISRVVAEVLPEGKVKAIHEMRAGGKVLAFVGDGINDAPALAEADIGIAVGTGTDVAIESADVVLVGGDLLGAVNAIEMSRATMRNIKENLFWAFGYNVALIPVAAGVLYPAFGITLSPMIGAGAMALSSVFVLANALRLKR

SEQ ID NO: 11739 - protein, 288 aa, Agrobacterium tumefaciens
FKGLSAFPITPADEAGRVDIEAFSALIARLDAAEVDSVGILGSTGIYMYLTREERRRAIEAAATILRGRRTLMAGIGALRTDEAVALAKDAEAAGADALLLAPVSYTPLTQEEAYHHFAAVAGATALPLAIYNNPTTTRFTFSDELLVRLAYIPNIRAIKMPLPADADYAGELARLRPKLSDDFAIGYSGDWGCTDATLAGGDTWYSVVAGLLPVPALQLMRAAQAGNAEEAKRLDATFQPLWALFKEFGSIRVIYAAANILSLTVSEPPRPILPLTSAERQRVEEAL

SEQ ID NO: 11740 - protein, 264 aa, Agrobacterium tumefaciens
IPALGFGTFRIPEDDVRRILPEALKLGFRHVDTAQIYKNEGAVGEVIAQSGISRHDIFLTTKVWVDRYRHDDFLASVDESLAKLKTDYFDLLLLHWPKSDVPLAERMGALNAVRKAGKARNIGISNFNVALTEEAVKLSDTPLATNQIEYHPYLDQTKVISAARKHGMSVTAYYLMADGKVPNDPVLKDIGAKHGKTAAQVTLRWAVQQPDIVALSKTATESRLKENFDIFDFALSEEEMQAIHALAKPNGRIVSPGHLAPDWD

SEQ ID NO: 11741 - protein, 237 aa, Agrobacterium tumefaciens
NKVVLITGASSGIGEGIARELAGAGAKLVLGARRMDRLQSLAEELRRKGAEVVIHTLDVTDRQSVEAFAEAGRKALGQIDVIVNNAGIMPLSLMSSLKVDEWDRMIEVNIKGVLYGVAAVLPEMTARASGHIINIASIGALAVSPTAAVYCATKFAVRAISDGLRQENRDLRVTCIHPGVVESELAHTITDPAAAELMQSYRAIALKPDAIGRAVRYAIEQPDDVDVNEIVIRPTAA

SEQ ID NO: 11742 - protein, 778 aa, Agrobacterium tumefaciens
IFSVGGMDCGSCAAKIETALSRLPGVGDVKVSVARERLNLSLAENKTPVEKIEDTLRKLGFKPALLPQEKTAREKTPEQNHDHDHATCGGHHHDHDHSGHDHAAHDHSGHDHQSCKGHDHDHSDHDHSGHDHSGHDHAGQSHAAAPAAASQSAEIGHAHGADEKGAWWRSAKARNTFTGTVLVAIAYAAELTFPAWGSYAFIVATLATLFPIARNAFNAARFGAVFTIEMLMTIAAIGAIIIGEAEEAAIVVLLFSVGELLEGFAAARARSGIKALGSLLPKTALVEENGSLRQIAADQVRIGQVVVARPGDRIAADGVVMEGQSSVDESPMTGESIPVAKEKGARVFAGSINHDGSLRIRVDRAPEDNTIARIITLVEEAQDARAPTERFIQSFSRYYMPLIVAISALTIVVPPLVGLGDWDTWIYRGLALLLIGCPCALVISVPAAIASSLSAAARHGMLVKGGAVIEMLARTETVAFDKTGTLTLGEPVVTDVVALDGNEAELIAQAATIENESSHPLARAIVSHANKAGVIPLPGSEIKAISGRGMQGNVGGKRLFIGAPRFATDVGTVSNELAERISALESEGKTVAVVMAEGVASGLFAMRDEPRKDAAEGIKALKDMGISSLMLSGDNARTARAIGNKLGLEARGELLPQNKVEEIRKLAEKKTVVMVGDGINDAPALAAASVGVAIGSGTDVAMEAADAALMRNNVGDAARLIGLSRATMSNIRQNVTIALGLKAVFLVTTVTGVSGLWLAVFADTGATVLVTANAMRLL

SEQ ID NO: 11743 - protein, 549 aa, Agrobacterium tumefaciens
MQADYVIVGSGSAGSAIAYRLSEDGRYSVIVIEAGGSDFGPFIQMPAALAWPMSMKRYNWGYLSEPEPNLDNRRITAPRGKVIGGSSSINGLVYVRGHAEDFNRWEELGAQGWAYADVLPYFKRMEHSHGGEEGWRGTDGPLHVQRGPVSNPLFHAFIQAGAQAGFELTDDYNGSKQEGFGLMEQTIHNGRRWSAANAYLKPALKRGNVTLVNGFARKVIIENGRAVGVEIERRGRVETVKANREVIVSASSFNSPKLLMLSGIGPAAHLKDMGIEVKADRPGVGANLQDHMEFYFQQVSTKPVSLYSWLPWFWQGVAGAQWLLSKGGLGASNQFEACAFLRSAPGLKQPDIQYHFLPVAISYDGKAAAKSHGFQAHVGYNLSKSRGNVTLRSADPHDDPVIRFNYMSHPEDWEKFRHCVRLTREIFGQKAFDDFRGPEIQPGENIETDEQIDAFLREHLESAYHPCGTCRMGDRNDPMAVVDPECRVIGVEGLRVADSSIFPHVTYGNLNGPSIMTGEKAADHILGKTPLPRSNQEPWVNPRAAVSDR

SEQ ID NO: 11744 - protein, 459 aa, Agrobacterium tumefaciens
PATGEMIAKLHAATPAIVERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYVSTGKVDAPY

SEQ ID NO: 11745 - protein, 881 aa, Agrobacterium tumefaciens
VYTFGNGAAEGGAGDVAILGGKGANLAEMASLGLPVPPGLTIIADACALYHKNGRDLPEELKLQVMAGLHGMEIVTGKTFGGSHSPLLISVRSGARASMPGMMDTVLNLGLNDRTVEALGHDAGDARFAWDSYRRFIQMYGDVVMGLDHEMFEEILEDEKGRLGHEYDTDMSAVEWQHVVSLYKKLIEDELGEAFPQDCHVQLWGAIGAVFASWTNHRAVTYRHLHNIPGDWGTAVNVQAMVFGNLGSSSATGVAFTRNPSTGEAELYGEFLVNAQGEDVVAGIRTPQSITEAARLVSGSDKPSMEKLMPEAFSEFLAICKRLETHYRDMQDLEFTIERGKLWMLQTRSGKRTTRAAMKIAVDMVEAGLISQEEAVCRIEPSSLDQLLHPTIDPGISRPIIGSGLPASPGAATGEIVFTSEEAVAAEAEGRRVILVRIETSPEDIHGMHAAEGILTTRGGMTSHAAVVARGMGIPCVTGAGSMRVDMRNKVLIGVGCMLKRGDVITIDGSSGRVLKGEVPMTQPELSGDFGKLMQWADNLRRMTVRTNADTPADARAARAFGAEGIGLCRTEHMFFEGDRIHVMREMILAESEKGRRAALDQLLPMQRSDFTELFQIMHGLPVTIRLLDPPLHEFLPKSDGEIVEVAAAMGMPQTVFRQRLDALHEFNPMLGHRGCRLAISYPEIAEMQARAIFEAAVAAARITGAPVVPEIMVPLVGLRSELDYVKAVIDTVAAEVAEETGMSIEYLTGTMIELPRAALRAHVIAEAAEFFSFGTNDLTQTTFGISRDDAARFINTYQRKGIIERDPFISLDFDGVGELIRIAAERGRQTRPELKLGICGEHGGDPASIHFCEDADLDYVSCSPFRVPIARLAAAQATLA

SEQ ID NO: 11746 - protein, 1154 aa, Agrobacterium tumefaciens
MKFNKLRVVGFKSFVEPSEFIIEPGLTGVVGPNGCGKSNLVEALRWVMGENSYKNMRASGMDDVIFSGSGNRPARNTAEVGLYLDNSDRTAPAAFNDADEIQVTRRIERENGSVYRINGKEARAKDVQLLFADASTGARSPSMVGQGRIGELINAKPQARRQLLEEAAGISGLHSRRHEAELRLRAAETNLERLEDVTAQLESQIESLKRQARQANRFKMLSADIRAREATLLHIRWVEAKEAEGEAESALNQATNIVAEKAQGQMEAAKQQGIASLKLPELREDEARVAAALQRLQIARTQLDDEANRLLRRRDELARRLSQLGEDIVREERLVADNAQILARLDEEEAELLDILSDSGRHADEMREAFEAAAVKLAESEAVFTSITAERAEAAAGRQQLERAIRDLSDRKLRLERQSQEASAEIDTIDEKLSGLPDPAERREAVEAAEIAVEDALIVAEEAEAAVAEARSAEALARGPLETAKNRLNALDTEARTITKMLATSAAANGSFTPVAEEMTVERGYEAALGAALGDDLESPLDASAPAYWGGNGNGADDPGLPQGAKPLLDYAQAPDALRRALAQIGVVADVSEARRLLPSLKAGQRLVTREGALFRWDGHIASADAPGAAALRLSQKNRLAEIEAELDEARSILEEAEDQLAAKTEDIRSSELRLSEVRDRSRLATRQLAEAREALTSAERASGDLLRRRDVVSEAQNQIGAQIDEIAVQEENARIEMEDAPDLSVLDLRLRESQLEVATDRGLLAEARARHEGVSREAESRQRRIQAIGQERSTWASRAASAADHIATLREREEEAREEIAELDIAPEEFDEKRRNLLNELQKTEDARRAAADRLAEAENLQRAADRVAATALSELAEAREKRGRAEERLVSAREKRLETEHRIRETLNTEPHMAFRLTGLGPDQPKPDIRDVERDLDRLKIERERLGAVNLRAEEEQAELSGKLEALIKERDDIIDAVRKLRAGIQSLNREGRERLIAAFDVVNSQFQRLFTHLFGGGTAELQLIESDDPLEAGLEILARPPGKKPQTMTLLSGGEQALTAMALIFAVFLTNPAPICVLDEVDAPLDDHNVERYCNLMDEMVASTETRFVIITHNPITMARMNRLFGVTMAEQGVSQLVSVDLQTAEQLREA

SEQ ID NO: 11747 - protein, 188 aa, Agrobacterium tumefaciens
FDLIIFDCDGVLVDSEIIAAQVESRLLTEAGYPISVEEMGERFAGMTWKNILLQVESEASIPLSASLLDKSEKLLDMRLERDVKIIDGVKFALSRLTTPRCICSNSSSHRLDMMLTKVGLKPYFAPHIYSAKDLGADRVKPKPDIFLHGAAQFGVSPDRVVVVEDSVHGIHGARAAGMRVIGFTGASH

SEQ ID NO: 11748 - protein, 403 aa, Agrobacterium tumefaciens
NVTRLSSGLTVVTERMPHLESVALGVWIKSGSRNETTAEHGIAHLLEHMAFKGTARRTARQIAEEIENVGGEVNAATSTETTSYYARVLKDHVPLAVDILADILTESLFDEDELEREKNVILQEIGAATDTPDDVIFDNFSGVAYRDQTIGRPILGTPDTVQSFTSGEIRHYLARNYTTDRIFVVAAGAVDHESFVKQVEERFASLPLVPAAPPVMEKAIYTGGEIRETRDLMDAQVLLGFEGKAYHARDFYCSQILANILGGGMSSRLFQEVREARGLCYSVYAFHWGFSDTGIFGVHAATGGNDLPELIPVIVDELRKSSETIHQDEINRARAQIRAQLLMGQESPAARAGQIARQMMLYGRPIPNEEMMTRLEDITRERLTDLAGRLFFDTVPTLSAIGP

SEQ ID NO: 11749 - protein, 192 aa, Agrobacterium tumefaciens
ATMLPFLPHAVVFDMDGLLIESETLYRDSFLAASEEGGHGMKVETYQKVCGSPWDVITGTIFADYGADFPMATFRDAWLRHLGLMMADGVALKPGVVEILDLLDRLDIRRAIATSSRHDSVTRHLGPYDLLRRFDTIVARGDYTEPKPAPMPYLTAARRLRLDPGRCLALEDSYSGVRSATSAGMMTIMVPD

SEQ ID NO: 11750 - protein, 261 aa, Agrobacterium tumefaciens
GLMAGKRGLIMGVANNRSIAWGIAKACADAGAELALTWQGDALKKRVEPLAQELGAFMAGHCDVTDLETIDSVFASLEQHWGKIDFVVHAIAFSDKDELTGRYLDTSRDNFNRTMDISVFSLAAVAKRAEPIMNDGGSIITLTYYGAEKVMPNYNVMGVAKAALEASVRYLAVDLGNRGIRVNAVSAGPIKTLAASGIGDFRYILKWNEYNAPLKRTVTIEEVGKSALYLLSDLSTAVTGEIHHVDSGYHTIGMKAVDAPD

SEQ ID NO: 11751 - protein, 172 aa, Agrobacterium tumefaciens
HGQTDWNAIRRLQGQKDIPLNDFGRQQAVGNGRILARLLGERATDFDYVASPLGRTRETMELMRGAMGLDPLAYRTDDRLIEVSFGDWEGQTLPDLKKEFPDRVKARKANKWDFIPPGQDAESYEILSWRIGAWLSSVEVPTICVCHGGVIRSIFRLVSGMDKDEASRTQIP

SEQ ID NO: 11752 - protein, 371 aa, Agrobacterium tumefaciens
  unsure (1)..(371): unsure at all Xaa locations
MSHNSFGHLFRVTTWGESHGPSLGCVVDGCPPGIRFTLAEVQHWMDKRKPGQSRFVTQRREDDIVKVLSGVMLDEDGETMTTTGTPISMLIENTDQRSKDYGEIARRFRPGHADFTYDLKYGIRDYRGGGRSSARETAARVAAGAIARKVVPSLNVRGALVQIGKHKINRDNWDWDQVDQNPFFCPDPEMVPVWEEYLDGIRKSGSSIGAVVEVVAEGVPAGIGAPIYAKLDQDIASSLMSINAVKGVEIGEGFASAELSGEENADQMRMGNDGKPIFLSNHAGGILGGIATGEPVIARFAIKPTSSILTERLSIDTDGNNVDVRTKGRHDPCVGIRAVPIGEAMIACTVADHYLRDRGQTADXNKGISPW

SEQ ID NO: 11753 - protein, 634 aa, Agrobacterium tumefaciens
EKAERLTGMPQTPLLDRVNFPSDLKEIDDRDLPELARELRDEMIDAVSKTGGHLGAGLGVVELTIAIHKVFNTPEDRLIFDVGHQCYPHKILTGRRDRIRTLRQEDGLSGFTRRAESEYDDFGAGHSSTSISAGLGMAVAAGLDGSDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDEKIIGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILQIGKGRIIKEGTKVALLSFGTRLAECLAAAEDLDAAGLSTTVADARFAKPLDLDLIRQLAAHHEVLVTIEEGSVGGFGAHVLHFMASAGLLDHGPKVRTLTLPDQWVEQAKPETMYANAGLDRAGIVSTVFNALG

SEQ ID NO: 11754 - protein, 586 aa, Agrobacterium tumefaciens
YSAPVDDIAFTLKHVAGLEDALSQGVLGDLSEDLVDAILEEAGRFATGEVAPLADIGDRQGAKLADGKVTTPDGWADLYRRWAEAGWNSLTAPEEFGGQNLPHMLNVAALEMWNSGSMAFALAPTLTMGAVEAIVTHGSNDLKRIYLPKLVSGEWTGTMNLTEPHAGSDLGVLKTRAERNGDGTYRIFGQKIFITWGEHDAADNIIHLVLARLPDAPTGTRGISLFLVPKFLPDENGAPGSRNDLFCHSLEHKLGIHGSPTCTMIFGDGKFGDEKGALGWLIGEENKGLACMFTMMNNARLAVGMQGVAICEAATQKAIEYAKERTQGKAPGWQGSGMSPIIEHPDIARTLLTMKALTQGSRAISFSCAHAIDMAHATEDASQRAHWQERAALLTPIAKSFSTDAGVDVASMGIQVHGGMGFIEETGAARYLRDARIAPIYEGTNGIQAIDLVLRKLPLSEGAQVRGFIAELREIAARTAASNRDDLGETARYLEASLNDLETTTDWLLSRIKAGETETALAGATAYQRLFGLALTGAYLAKGALVSVDDGRSGHRAALCRFTAENLLAETAALKDRVISGAASLA

SEQ ID NO: 11755 - protein, 474 aa, Agrobacterium tumefaciens
PMTAIPSSDILDRFTAIVGEKNAVRDLAEMAPRLVENRGLYRGASPLLLKPGSVEEVAAILKLASETGTPIVPQTGNTGLVGGQTPRADGTDIILSLERMNRIRDIDPVANIIVADAGCILDDIHKAASSVERMFPLSLGSQGSCRIGGNLATNAGGTAVLAYGNMRQLCLGLEVVLPTGEIWNGLRRLKKDNTGYDLRDLFIGSEGTLGVITGAVLKLFPKPLGHQVAFAGLASTEDALKLFEMASNLCGTALTGFELMPRIGVEFTARHIPGVRDPLGQPHDWYALIDISTSDSAETADTMMQSLLERGFEAGLVEDAVIASSEAQRQALWHMRESMSDAQKPEGGSIKHDVSVPVSKIPEFMTTAEKAVLAAIPGARICAFGHLGDGNIHYNISQPVGADKAEFLGRWRDMNEIVHGIVLSLGGSISAEHGIGQLKRDELAAIRPGIEMELMHRIKHAFDPAGIMNPGKVL

SEQ ID NO: 11756 - protein, 181 aa, Agrobacterium tumefaciens
IASMLREGAGKKGMVFFPFVFSLFMFVLTANLLGMFPYFFTVTSQIIVTFALACLVIGTVIVYGFYKHGLHFFGIFAPSGVPKALLPLVASIEMISFLSRPISLSVRLFANMLAGHITLKVFAGFVASMGALGALGVGGAVLPLIMTVAMTALEFLVAFLQAYVFAVLTCMYLNDAVHGGH

SEQ ID NO: 11757 - protein, 240 aa, Agrobacterium tumefaciens
LVTGGGSGIGASLVEAFAMQGAKVSFIDIAEQPSIALVERLAATVPHPVHYFRADLSDIDAIKRTVDMAASATGGIKVLVNNAAWDDRHDIDSVTEAYWDANQAVNLKQMFFTVQAALPHLRQAKDASIVNFSSISFLLNMGELPSYAAAKAGIIGLTKSLAGRLGPENIRVNTLLPGMIVTERQKELWLTDEGITATTARQCLKRTLVAADLSGPCLFLASSASSAITAQSIIVDGGLL

SEQ ID NO: 11758 - protein, 500 aa, Agrobacterium tumefaciens
LTITSRQQGAEQGSVISVTGGKVSDVRPAASNAGTIVEVRDLFFATPARLKFLKTERAEAAAITEVVKRMAIAFPHIRFVLSGTDRSTLEIPSTGDDHLARMAQILGAEFKDNAIEIDAGREDVTLTGFAGVPTFNRGNSSHQYVFVNGRPVQDKLLLSAIRGAYAETVPHGRYPVAVLSITLDPAFVDVNVHPAKSDVRFRDPGLIRGLIVGAIRQALTRDGDRAATTGASQMMNAFRPGYSPSGLRPSPSATWSAATSPSRPLAVSGDMQFAEAAQSRFSDITMPTARAEPREAYEASQSPSPEPVLYPLGAARAQLHENYIIAQTENGLVIVDQHAAHERLVFEEMRNALHSRRPPSQVLLIPEIIDLPEEDCDRLMDHAAGFDALGLVIERFGPGAIAVRETPAMLGEVNVQGLVRQLADEIAEWDAASTLANKLEYVAATMACHGSVRSGRRMRPEEMNALLRQMENTPGSGQCNHGRPTYIELKLSDIERLFGR

SEQ ID NO: 11759 - protein, 98 aa, Agrobacterium tumefaciens
MTSTNFRPLHDRVVVRRVESEAKTKGGIIIPDTAKEKPQEGEIVAVGSGARDEAGKVVALDVKVGDRVLFGKWSGTEVKLDGEDLLIMKEADIMGIIG

SEQ ID NO: 11760 - protein, 544 aa, Agrobacterium tumefaciens
MAAKEVKFGRSAREKMLKGVDILADAVKVTLGPKGRNVVIDKSFGAPRITKDGVSVAKEIELEDKFENMGAQLVREVASKTNDIAGDGTTTATVLAQAIVREGAKAVAAGMNPMDLKRGIDLAVAEVVKDLQAKAKKINTSEEVAQVGTISANGERQIGLDIAEAMQRVGNEGVITVEEAKTAETELEVVEGMQFDRGYLSPYFVTNPEKMVADLEDAYILLHEKKLSNLQAMLPVLEAVVQTGKPLVIIAEDVEGEALATLVVNKLRGGLKIAAVKAPGFGDRRKAMLEDIAILTGGTVISEDLGIKLESVTLDMLGKSKKVSISKENTTIVDGAGQKSDIEGRVAQIKAQIEETTSDYDREKLQERLAKLAGGVAVIRVGGSTEVEVKEKKDRIDDALNATRAAVQEGIVPGGGVALLRSSTKITVKGVNDDQEAGINIVRKALQSLVRQIAENAGDEASIVVGKILDKNEDNYGYNAQTGEYGDLIALGIVDPVKVVRTALQNAASVASLLITTEAMIAELPKKESAMPQMPGGGMGGMDF

SEQ ID NO: 11761 - protein, 459 aa, Agrobacterium tumefaciens
RDRIIADLKDILPEDCLVHEPRELVPFETDAFVSYRRLPLAVALPKTTEEVAAVMRYCHRYGIPVVPRGAGTSLSGGAIPQEDAVVIGLSKMSAILDLDFYNRTARVQAGVTNLSISDAAGAEGFFYAPDPSSQLACTIGGNIGMNSGGAHCLKYGVTTNNLLGVKMVLVDGTVLELGGNHLDAAGYDLLALVCGSEGQLGIVTEATVRLIARPEGARPVLFGFETSEEAGSCVADIIGAGIIPVAIEFMDKPAIEICEAFAKAGYPLDVGALLIIEVEGSEAEMDAMLADIVTIARKHGVKTVKECQSAMEAAAIWKGRKSAFGATGRIADYICMDGTVPLSQLSYVLKKTSEITDRLGLRVANVFHAGDGNMHPLILFNANDPDDAARAEEAGNEILKLCVDAGGCLTGEHGVGIEKRDLMRHQYGEADLAQQMAVRAAFDEGWLMNPSKVFPLEGR

SEQ ID NO: 11762 - protein, 410 aa, Agrobacterium tumefaciens
MIELTITPPGHPLSGKVEPPGSKSITNRALLLAGLAKGKSHLSGALKSDDTLYMAEALREMGVKVTEPDATTFVVEGTGVLQQPEKPLFLGNAGTATRFLTAAGALVDGAVIIDGDEHMRKRPILPLVQALRALGVEADAPTGCPPVTVRGKGMGFPKGSVTIDANLSSQYVSALLMAAACGDKPVDIILKGEEIGAKGYIDLTTSAMEAFGAKVERVSNAIWRVHPTGYTATDFHIEPDASAATYLWGAELLTGGAIDIGTPADKFTQPDAKAYEVMAQFPHLPAEIDGSQMQDAIPTIAVIAAFNETPVRFVGIANLRVKECDRIRAVSLGLNEIREGLAHEEGDDLIVHADPSLAGQTVDASIDTFADHRIAMSFALAALKIGGIAIQNPACVAKTYPGYWKALASL

SEQ ID NO: 11763 - protein, 309 aa, Agrobacterium tumefaciens
MERVNQLILSRAGSDVQMIPEVANHLISSGGKRLRPMLTLASASMFGYEGDNHIKLATSVEFMHTATLLHDDVVDESDLRRGKSTARTIWGNQASVLVGDFLLGQAFRMMVDVGSLDALDVLSTAASVIAEGEVLQLSVAKNMETTEDDYLQVIRAKTAALFAAAAEVGPIVAKTDKASRSALKSYGMNLGLAFQLVDDVLDYGGKSADLGKNTGDDFREGKITLPVILSYRRGTQDERAFWRNAIEKGESSDENLEKALGLITKYNGLGDTIGRATHYGTIARDALAPLPQSPWKNALLEVIDFCIER

SEQ ID NO: 11764 - protein, 261 aa, Agrobacterium tumefaciens
DGYHLLETLVTFTAAGDMIRIRDAATDSFSISGPFGDLLSAGDSGDNLVTRARDILRDALASTGQPARPVDIHLEKNLPVASGIGGGSADAAATLRGLLRHWDAAIAPEKLKSLALKLGADVPMCLASRPLIARGIGEDIEALTDLPELSMVLANPLKAVSTPEIFRRLQNKVNPHLPTPSTIGWATTGWMDFLAQSRNDLQPPAQALLPEIGEITGLLSEEGATLVRMSGSGATCFGIFHSFDAAKNAETSLRKKRPGWY

SEQ ID NO: 11765 - protein, 336 aa, Agrobacterium tumefaciens
MKAAVVRAFGKPLTIEEVAIPDPGPGEILINYKATGVCHTDLHAATGDWPVKPNPPFIPGHEGAGYVAKIGAGVTGIKEGDRAGTPWLYTACGCCIPCRTGWETLCPSQKNSGYSVNGSFAEYGLADPKFVGRLPDNLDFGPAAPVLCAGVTVYKGLKETEVRPGEWVVISGIGGLGHMAVQYAKAMGMHVVAADIFDDKLALAKKLGADVVVNGRAPDAVEQVQKATGGVHGALVTAVSPKAMEQAYGFLRSKGTMALVGLPPGFISIPVFDTVLKRITVRGSIVGTRQDLEEALTFAGEGKVAAHFSWDKLENINDIFHRMEEGKIDGRIVVDL

SEQ ID NO: 11766 - protein, 486 aa, Agrobacterium tumefaciens
DALTFDDVLLQPGHSEVMPGQTNIATRIARDIDLNLPILSSAMDTVTEGRLAIAMAQAGGIGVIHRNLTPIEQAEEVRQVKKFESGMVVNPVTIGPDATLAEAQALMKAHGISGIPVVENGGAGGHKNGRLVGILTNRDVRFASDPQQKIYELMTRENLVTVKESSVDQQEARRLLHKHRIEKLLVVDGKGNCVGLITVKDIEKSQLNPNATKDAQGRLRAAAAISVGADAIERAERLIDAGVDLLVVDTAHGHSQRVLDAVAQVKKMSNSVRIIAGNVATADGTKALIDAGADAVKVGIGPGSICTTRIVAGVGVPQLAAVMAAVEAASLADIPVIADGGIKFSGDLAKAIAAGASAVMIGSLLAGTDESPGEVFLYQGRSFKAYRGMGSVGAMARGSADRYFQAEVRDTLKLVPEGIEGQVPYKGPVSGVLHQLAGGLKAAMGYVGGSNIKEFQERATFVRISSAGLRESHAHDVTITRESPNY

SEQ ID NO: 11767 - protein, 478 aa, Agrobacterium tumefaciens
DCVVFGGTGDLAERKLLPALYHRQVEGQFTEPTRIIGASRSVMTHEEYRKFAQDALKEHLKAGEYDDAQVTLFLNRLFYVPVDAKSGNGWDVLKKLLDEGKERIRAFYLAVAPGIFGDIADKIREHKLITRSTRIVVEKPIGRDLASAQELNDTIGHVFKEEQIFRIDHYLGKETVQNLMALRFANALYEPLWNSAHIDHVQITVAEAVGLEGRAGYYDKAGALRDMVQNHILQLLCLVAMEPPASMKSEAVRDEKLKVLRSLKPIDTSNVEKLTVRGQYRAGASAGGPVKGYLEELEGGVSNTETFVAIKAEIANWRWAGVPFYIRTGKRLATRVSEIVVTFKQIPHSIFDDAAGKIEANKLVIRLQPDEGVKQSLLIKDPGPGGMRLRQVSLDMSFAEAFNVRSPDAYERLLMDTIRSNQTLFMRRDEVEAAWDWIDPILKSWEELGQSVQGYTAGTWGPSGSIALIERDGRTWHD

SEQ ID NO: 11768 - protein, 509 aa, Agrobacterium tumefaciens
TSMTASVTSALTPNKDWWRGAVIYQIYPRSYQDSNGDGIGDLKGITDRLHHIAGLGADAIWISPFFTSPMKDFGYDVSNYVDVDPMFGTLADFDGLIAEAHRLGIRVMIDLVLSHTSDQHPWFVESRASRNNPKSDWYVWSEAKPDGTPPNNWLSIFGGSGWQWDPTRMQYYMHNFLTSQPDLNLHNPEVQEELLNITRFWLKRGVDGFRLDTINFYFHDLELRDNPALAPERRNASTAPAVNPYNFQEHLYDKNRPENIAFLKRFRAVLDEFPDIAAVGEVGDSQRGLEIVGEYTSGDDKMQMCYAFEFLAPDALTPQRVADVQADFARAAPEGWACWAFSNHDVVRHVSRWGEHVEDKDAFAKLLSALLMTQRGSVCIYEGEELGLTEADIAFEDLQDPYGIQFWPEFKGRDGCRTPMVWDAGHAQAGFSTSDKIWLPIPAEHKQRAVSAQQGNEASVLEHYRRFLAFRKQHPAFAKGGIEFQPLEGDVLSYTRKLGNETILCLFNL

SEQ ID NO: 11769 - protein, 298 aa, Agrobacterium tumefaciens
MAVVIDGKAKAASVTEAVRKSAEALEAEKGVKPGLAVVIVGNDPASHAYVNSKSKMAKQCGFNSIQHTLPEETTQAALLKLVGELNTDASIHGILVQLPLPKHFNSDEIIQSILPEKDVDGLSVLNAGKLATGDLATGLISCTPAGAMLLVRGIHGDDLSGLNAVVIGRSNLFGKPMGQLLLNANATVTMAHSRTKDLVTVCKTADILVAAVGRAAMVKGDWVKPGATVIDVGINRIAAPEKGEGKSKLVGDVAFDEASAVAAAITPVPGGVGPMTIAMLMANTVIAAHRALGKTAPK

SEQ ID NO: 11770 - protein, 368 aa, Agrobacterium tumefaciens
EVVRVEPDICYVCPIEPGEPIGIHDTVIRKGAFRVSPDESWCGRTINALGEPIDGQGPLASGIVRRSISNNAPPSMTRKRVETPFKTGVRAIDIFSPLCLGQRLGIFAGSGVGKSTLLSMLAKADAFDKVVIALVGERGREVREFIEDTMGDNMSKSVAVVATSDESPMLRKMAPLSAVTIAEHFRDQGDNVLLIIDSVTRFAHAIREVAVASGEPPVARGYPASVFTELPRLLERAGPGAEGTGTITAIVSILVDGDNHNDPIADSTRGILDGHIVLDRSLAEEGRYPPINPLASISRLAKKAWTPDQEKLVSRLKALVHRFEETRDLRLIGGYRPGTDPDLDMAVKQVPIIYETLKQLPDEPAAQD

SEQ ID NO: 11771 - protein, 411 aa, Agrobacterium tumefaciens
FLTTKREVSEDVNATVRDIINDVRHRGDAALAHYSQKFDGIDFTRVSMRVTADEIDAAFSAVDRAVIEALELAARRIEKHHARQMPKDDIYEDDIGVGLGSRWTAIEAVGLYVPGGTASYPSSVLMNAVPAKVAGVERIVMVVPANGGAVNPAVLAAARIAGVEEIYRIGGAQAVAALAYGTETIAPVAKIVGPGNAYVAAAKRQVFGTVGIDMIAGPSEVLVIADKDNDPDWLAADLLAQAEHDRGAQSILITDNADLGKAVGAAVERQLKLLSRSETAAASWADFGAIILVEKLTDAIPLANRIAAEHLELAVDDPDALMAHIRNAGAIFVGRHTPEVIGDYVGGSNHVLPTARSARFSSGLSVLDFVKRTSILRLGPEQLRQLAPAAITLAHSEGLDAHARSVSIRLN

SEQ ID NO: 11772 - protein, 715 aa, Agrobacterium tumefaciens
ETDADGIALVTWDMPEKSMNVFTAEVLEELNAIVDATVADGAVKGVVFTSGKSSFSGGADLSMLKSMFALYNDEKAKSPDAAAAKLFELVGRMTGLFRKIETNGKPWVSAINGTCMGGAFELSLACHGRVASSAKSLKIALPEVKVGIFPGAGGTQRVSRLTDAQSALQMMTTGQSLTGARAKAMGLVHQVVEPDQLVATAKQMIKDGLKPVAPWDEKGFKAPGGGIWTPAAAQLWPAAPAILRRESAGNYPAALAILKCVYEGLQLPFDTALKVEQRYFTEILRSKEAFGMIRSLFISMQELNKGARRPAGQPKTEFKKVGVVGAGFMGAAVAYVTAAAGIPVTLVDRDQDAADKGKGHCEESVKAAIGKGRLTQEEGKALLDLVTPTSDYATLADADLVIEAVFEDRDVKKAVIEAVEAVLPEGAIFASNTSTLPITGLAKNSKRPADFIGIHFFSPVEKMMLTEVILGKETGDKALAVALDYVAKIRKTPIVVNDTRGFFVNRCVLRYMAESYDMLIEGVPAAMIENAAKFAGMPVGPLALNDEVAIDLSYKILKATVADLGEKAVDPRHMELVKKLVEGDGRFGRKNAKGFYDYPPKPAKKSLWPGLKDLYPQQKPEDVDMDVLKQRFLVTVALEAARTVEEGIVTDPREADVGSILGFGFAPYTGGALSYIDGMGVKNFVALAEKLSEAYGPRFQPTPLLKDMAAKGETF

SEQ ID NO: 11773 - protein, 401 aa, Agrobacterium tumefaciens
TDVYIYDHVRTPRGRGKKDGSLHEVPSVRLAAKTLEAIRDRNGLDTSAVDDIIMGCVDPVMDAGAVIPKAAAFEAGYSNRAPGMQISRFCASGLDAINFAAGKVKAGSDDIVIAGGVESMSRVGMGMSGGAWYMDPSVNFPAFFMPQGVSADLIATKYGFSRDDVDAYAVESQKRAAHAWENGYFNKSVIPVKDQNGLTILDRDEHMRPGTDMQALASLNPSFQMPGEMGGFEAVGIMAHPEVERINYVHHAGNSSGIVDGAAAVLVGSKAGGEAMGVKPRARIKAFANIGSDPALMLTGPVDVTEKLLKKTGMSIADIDLFELNEAFAAVVLRYMQAFDISHDRMNVNGGAIAMGHPLGATGAMILGTVLDELERRDLNTALVTLCIGAGMGTATVIERV

SEQ ID NO: 11774 - protein, 327 aa, Agrobacterium tumefaciens
  unsure (1)..(327): unsure at all Xaa locations
MSGLFSSVGRKGLFLIDPEKAHGLSVAALKSGFLPTCMVPHDPRLQQTVAGLVFPNPLGMAAGYDKNAEVPGPLLRLGFGFTEIGTVTPRAQSGNPKPRIFRLVEDEGVINRLGFNNEGHAAALERLTQARLRGIVGVNIGANKDSEDRIADYVQGIEAFYAVASYFTVNISSPNTPGLRDLQARESLAALLTAVLERRKTEAERLGKRIPIFLKIAPDLTEEGLDDVAEEALAHDLDGLIVSNTTLSREGLRPGPHRGEAGGLSGKPLFELSTTVLAKMRRRVGANLPIIGVGGVSSAETALEKVRAGARSRAALFLHGLXRSGPA

SEQ ID NO: 11775 - protein, 384 aa, Agrobacterium tumefaciens
TQLVHGGTLRSPYGETSEAIYLTQGFVYENSEAAEARFKGETDGFIYARYASPTNDMFEKRMCLLEGAEDARALASGMAAVTAAIMCQLRAGDHIVAARALFGSCRWVVETLAPKYGIECTLIDGRDLDNWEKAIQPNTKLFFLESPTNPTLEVVDIAGVAKLANQIGAKVVVDNVFATPLFQKPLELGAHIVVYSATKHIDGQGRCLGGVILSDKKWIEEELQDYFRHTGPAMSPFNAWTLLKGIETLPLRVKQQTENAAKIADFLADSGKVAKVIYPGRADHPQADIIARQMSGGSTLVAFELKGGKDAAFKLQNALEIVKISNNLGDAKSLITHPGTTTHKNLSDEARAELGISGGTLRLSCGIEDTDDLLEDLAKGLAAV

SEQ ID NO: 11776 - protein, 299 aa, Agrobacterium tumefaciens
KHFLDLSAVGPQDLRTILDDARARKVATKAGTAEKPLAGKMLAMIFEKPSTRTRVSFDVGMRQLGGETLFLSGTEMQLGRAETIGDTAKVLSRYVDAIMIRTTDHSRLLELAEHATVPVINGLTDDTHPCQIMADIMTFEEHRGPVKGKTIAWTGDGNNVLHSFVEGSARFGYRMTMAVPMGSEPHDKFMNWARNNGGEIALYHDADKAVAGADCVVTDTWVSMNQEHKARGHNIFQPYQVNEALMAKAQKDALFMHCLPAHRGEEVTDAVIDGPQSVVFDEAENRLHAQKSVIAWCMG

SEQ ID NO: 11777 - protein, 384 aa, Agrobacterium tumefaciens
LFDTFARAPLRFERGEGVWLFTESGERYLDFAAGVAVNSLGHAHPHLVEAIKTQAEKVWHVSNLYEVPGQEKLAKRLTEATFADKVFFTNSGAEALECAIKTARRYHYSKGHPEKFRIITFEGAFHGRTLATIAAGGQQKYLEGFGPKVEGFDQVPFGDVDALKAAITAETAALLIEPIQGEGGIRAPAKEFLQLLRSLCDEHDLLLIFDEVQTGVGRTGKFFAYEQTGVAPDIMAVAKGIGGGFPLGACLATADAASGMTAGVHGTTYGGNPLAMAVGNAVLDVVLADGFLEKVRDVALVFRQGLASLKDRYPDVIEEIRGEGLLLGIKARVPSGELLQAMRAEHLLGVPAGDNVIRLLPPLVTTAEEAREGLARVEAAAASL

SEQ ID NO: 11778 - protein, 533 aa, Agrobacterium tumefaciens
SLIDLLEKSCKQFADRKAFSSMGKSLTYRELDADTRAVAAWLQSRGLEKGDRVAVMMPNILQNPVAVYGILRAGMVVVNVNPLYTPRELEHQLKDSGAKALFVLENFAHVAQQAVPKTAVRHVVVAAMGDLLGLKGHIVNLVVRKVKKLVPAHAIPGSISFKAMLKEGQGVSLKPVGLTAQDIAFLQYTGGTTGVSKGAVLTHANLLANKAQISLWLDAAFNGRKDRPEVLNFICALPLYHIFALTVNSLMGIALGGHNLLIANPRDIPGFVKELSHYQPHIFPGLTTLFNALMNNEEFRKLDLSSLIFVLGGGMAVQRPVAERWVSVVGCPITEGYGLSETSPVATVNRLDAAEFSGTIGLPISSTEIDIRDEDGNSLPTGEVGEICIRGPQVMAGYWQRPDETAKAITADGFFRSGDMGFMDERGYTKIVDRKKDMILVSGFNVYPNEVEEVAASHPGVLECAAIGVPDEHSGETVKLFVVKKDQSLTEAELKAFCAKNLTNYKRPKIIEFRTDLPKSNVGKILRRELRNL

SEQ ID NO: 11779 - protein, 515 aa, Agrobacterium tumefaciens
DLRAAFAADDQRFSRFSVKFDDLLMDYSKCAVNEEIVTLLEQLAREGGVEAKREEMFSGKAINFTEDRAVLHTALRNRSNTPVLVDDKDVMPDVNGVLAAMGKFADAIRSGSLKGATGKKITDVVNIGIGGSDLGPVMATLALAPFHDGPRAHFVSNIDGAHIADTLKLLDPETSLFIIASKTFTTIETMTNAATARRFIAEKLGEGAVKHHFAAVSTALDKVAAFGIESDRIFGFWDWVGGRYSIWSAIGLPLMIAIGPDNFGKFLDGAHAMDRHFREAPIRENLPMLLGLIGFYNRNVLDYPTRAILPYDQRLSRFPAYLQQLDMESNGKGVTIDGTPVEGQSGPVVWGEPGTNGQHAFYQLIHQGTSVIPAEFMIAANGFEPELRHQHQLLIANCLAQSEALMKGRTLAEAKAQLTSKGMEDSQADFIAPHRVFTGNRPSITFVYDKLTPFALGRLIALYEHRVFVEGVLFRINSFDQWGVELGKELATGLLPVVEGKESAAGHDSSTQGLV

SEQ ID NO: 11780 - protein, 306 aa, Agrobacterium tumefaciens
  unsure (1)..(306): unsure at all Xaa locations
MILCCGEALIDMLPRQTTLGEAGFAPYAGGAVFNTAIALGRLGVPSAFFTGLSDDMMGDILRETLRASKVDFSYCATLSRPTTIAFVKLVDGHATYAFYDENTAGRMITEAELPALGADCEALHFGAISLIPEPCGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKSFGAWRESRCGHCLAGWRKSAFRAXN

SEQ ID NO: 11781 - protein, 284 aa, Agrobacterium tumefaciens
QARLLAQALPFMQKYENKTIVVKYGGHAMGDSTLGKAFAEDIALLKQSGINPIVVHGGGPQIGAMLSKMGIESKFEGGLRVTDAKTVEIVEMVLAGSINKEIVALINQTGEWAIGLCGKDGNMVFAEKAKKTVIDPDSNIERVLDLGFVGEVVEVDRTLLDLLAKSEMIPVIAPVAPGRDGATYNINADTFAGAIAGALHATRLLFLTDVPGVLDKNKELIKELTVSEARALIKDGTISGGMIPKVETCIDAIKAGVQGVVILNGKTPHSVLLEIFTEGAGTLI

SEQ ID NO: 11782 - protein, 295 aa, Agrobacterium tumefaciens
MITVFGSINMDLVATAKRLPKPGETVTGDTFSTAAGGKGANQALAARRAGVTVKMAGATGDDTFAAPALTLLRDAGTDLSLVKTAPGPTGTAVILIGEGGENMISVIPAANGEVSAFDATKVVGEMDAGDILMLQFEIPAAAIEAALTAAKAKRITTVINTAPLTADGPRLAGLADIVIANETEFELLIGKNGLSSGERESELKALHDRTGQTLIVTLGADGVIAMRNGKVFSASGLKIEPVDTVGAGDTFCGYLAASLDQGMDFEKALKRAAVAGSLACTRAGAQPSIPQAAEV

SEQ ID NO: 11783 - protein, 279 aa, Agrobacterium tumefaciens
EIVDLIYREAAKTGVDPWTVRIACETLATTNRVVIAGEVRVPDTLLKKDKDGKVVKDAAGHPVINPSKFKSAARKAIRDIGYEQDGFHWKTAKIDVLLHPQSADIAQGVDNASDKQGDEGAGDQGIMFGYACKETPDLMPAPIYYSHRILQLLATARKSGEGEAAKLGPDAKSQVTVRYVDGKASEAVSIVLSTQHLDASWDSKKVREVVEPYIREALGELKIADDCQWYINPTGKFVIGGPDGDAGLTGRKIIVDTYGGAAPHGGGAFSGKDTTKVDR

SEQ ID NO: 11784 - protein, 888 aa, Agrobacterium tumefaciens
ESRATATPMMEQYIEIKANNPGSLLFYRMGDFYELFFDDAVEASRALGITLTKRGQHMGHDIPMCGVPVHAADDYLQKLILRGYRVAVCEQIEDPAEAKKRGSKSVVKRDVVRLVTPGTLTEEKLLSPTESNYLMALARIRGSAEAQFALAWIDISTGVFRLAETTLTRLLADIWRIDPRELIVADSLFHDEELRPVFDVLGRVAVPQPAILFDSAVAEGRIARYFNVSTLDGFGTFSRVEMAAAAAAVAYVEKTQIAERPPLGAPERESAASTLFIDPATRANLELVKTLSGDRDGSLLHALNRTVTGGGARLLAERLMSPLTDPERINARLDAVAYLIDDVSLCDGLRDALKHVADMPRALSRLALERGGPRDLGAIRQGLVSAEKIAVILDGGLLPDELAKALRDLKALPGALEAMLGSMLADDLPLLKRDGGFLREGANPELDEVRALRDQSRRVIAGLQLQYADETGIKSLKIKHNNVLGYFIEVTAGNADVMMATDEAKARFIHRQTMAGAMRFTTTELADLESRIANAAAEALTMELEAFERMVEAVVQQAEAIKAGALALAVIDVASSLAYLATEQAYCRPIVDASMTFSIKGGRHPVVEQALRRQSAGPFIANNCDLSAVNGGKNGAIWLLTGPNMGGKSTFLRQNALIAILAQIGSFVPAEAAHIGVVDRLFSRVGASDDLARGRSTFMVEMVETAAILNQATDRSLVILDEIGRGTATFDGLSIAWAAVEHLHEVNRCRGLFATHFHELTVLSEKLGRLSNATMRVKEWEGDVIFLHEVGPGAADRSYGIQVARLAGLPASVVERAREVLTKLEDADRKNPASQLIDDLPLFQIAVRREETRKAGPSKVEEALKSFNPDEMTPREALDALYALKKEL

SEQ ID NO: 11785 - protein, 430 aa, Agrobacterium tumefaciens
  unsure (1)..(430): unsure at all Xaa locations
RVGWVLVREGVVLALPSDDLPAPAQLLKAALKPFARSKAKRAQRSDRLAVAVERLGPSYVKMGQFLATRPDVVGADFADDLASLQDRMAFFPAAAAKANIEGSLGRSISELYREFGDPIAAASIAQVHPAMVDTPKGPRKVAVKVIRPGVRQRFQNDLEAMYLIADLQQRFVRSARRLRPVEVTRTLEQTTKIEMDLRLEAAALSELAENTRQDPGFRVPEVDWERTGRDVVTMEWIDGVKMSDIEGLKAAGHDLNKLADTLIQSFLRHTLRDGFFHADMHPGNLFVDAKGEIVAVDMGIAGRLGKKERRFLAEILYGFITRDYMRVAEVHFEAGYVPGHHDKASFAQAIRAIGEPIHGQPAETISMGKLLTCCSKXPSLFDMETRPELVMLQKTMVVVEGVSRMLNPRFNMWKAADPVVGGWIRDNLGP

SEQ ID NO: 11786 - protein, 230 aa, Agrobacterium tumefaciens
MPTLYHSPMSTASRFVRLILAEYGFQTDLVEEQPWERRREFLALNPAGTLPVYLDDNMRSLSGPYVLAEFLDETHGVLKRDRRLLAEDPFQRAEIRRLTEWFLQKMENDVTRPLVRERVYKLQMTAAQGGGPPDSKLLRTARNNIRQHIKYLEWLAGSRTWLAGDRLSYADLAAAAGVSVLDYLGEINWLEAPIAKEWYQRVKSRPSFRPFLSERIPRLAPSSHYADLDF

SEQ ID NO: 11787 - protein, 359 aa, Agrobacterium tumefaciens
MTELDTLKSQLMSEIAAAADEPAIEAVRVSALGKKGSVSELLKTLGSMTPEERQTRGAAINQLKTEITDLIGERKNALKDAAIAARLKAETVDVSLPVRQSPTERGRIHPISQIVDEITAIFADMGFSIAEGPDIETDYYNFTALNFPEGHPAREMHDTFFFQPDEKGERKVLRTHTSPVQIRTMESQKPPIRIVIPGKTYRQDSDATHSPMFHQVEGLVIDKKAHVGNLRWVLEEFCKTFFEVDSVVMRFRPSFFPFTEPSFEVDIQCDRSGPIVKFGEGKDWMEILGCGMVHPNVLRAGGLDPDEYQGFAWGMGLDRIAMLKYGMPDLRDFFNADVRWMNHYGFRPLDMPTLFGGLS

SEQ ID NO: 11788 - protein, 480 aa, Agrobacterium tumefaciens
IGHFINGKHVPGASGRTSNVYNPATGEVQATVALASDAELRAAVESAKAAQPKWAATNPQRRARVFFKFVELLNRDLNELAVLLSSEHGKTVEDSKGDIIRGLEVCEFVCGIPHLQKGEFTEGAGPAIDMYSIRQPVGIGAGITPFNFPGMIPMWMFAPAIACGNAFILKPSERDPSLPIRLAELMIEAGLPAGMLNVVNGDKGAVDAILTDPDIGAVSFVGSTPIARYVYGTAAMNGKRAQCFGGAKNHMIIMPDADLDQAVNALMGAGYGSAGERCMAVSVAVPVGEDTANRLVEKLIPQIESLRIGPYTDDKADMGPLVTKEAQTRVRGLIDSGVEQGAKLLVDGRDFKLQGYEDGYFVGGCLFDHVTPDMDIYKTEIFGPVLSVVRAKNYEDALELPMKHEYGNGVAIYTRDGDAARDFASRINIGMIGINVPIPVPLAYHSFGGWKASSFGDLNQHGTDSIKFWTKTKTITSRWP

SEQ ID NO: 11789 - protein, 170 aa, Agrobacterium tumefaciens
  unsure (1)..(170): unsure at all Xaa locations
MGVSGSGKSTVAEGLAEKLGIAFIEGDKLHPKSNVDKMSEGIPLTDDDRWPWLDLIGAELRNGSEGKGVLVSCSALKKIYRDRLREATGGPLAFVYLDGSLELLSRRMGERKGHFMPLSLLQTQLATLEVPTGEPGVVTVSIDSTPEEIVANALAGLKTLKFXSTSGLNG

SEQ ID NO: 11790 - protein, 265 aa, Agrobacterium tumefaciens
KLVVVGAAGRMGQALIRLIHQTPGVQLHAAVAREGSAFVGRDAGEIAGLGPIGIEITSDPLQAFLHAEGVIDFTSPATSITFAGLAAQARIVHVVGTTGCSPQDEEKFKAASRHARIVKSGNMSLGVNLLSVLTQQAAQALDAQNWDIEILEMHHKHKVDAPSGTALLLGEAAAAGRKVDLTAASVRVRDGHTGAREAGTIGFATLRGGSVIGEHSVIFAGEGERVELSHYAGDRSIFARGAITAAVWAFDKKPGFYSMLDVLGL

SEQ ID NO: 11791 - protein, 255 aa, Agrobacterium tumefaciens
DAPLLKVRDVSKYYGDRAGCRNVSFELYPGEVLAIVGESGSGKTTLLNCISTRLMPTAGSVEYRMRDGSVRDLYHMGEAERRFLMRTDWGFVHQNPADGLRMAVSAGANVGERLMAVGNRHYGNIRQSASEWLERVEIGTDRIDDQPRAFSGGMRQRLQIARNLVTSPRLVFMDEPTGGLDVSVQARLLDLVRGLVNDLGLAVVVVTHDLAVARLLSHRMMVMKGGDVIEHGLTDRVLDDPREPYTQLLVSSILQ

SEQ ID NO: 11792 - protein, 330 aa, Agrobacterium tumefaciens
KIMKFSIAEAEDLVSSIFERNGVLPQNARSVAKALVASEAAGQGGHGFRRIPVYVRQARVGKVDGQARPVVRRVKPGVLSIDANHGYAYPAIDCALEELPEMARQQGIALAAIHRSHHAGVMALTVERFAEMGLVALMFANAPASMAPWGGHTPLYGTNPIAFAAPIGGADPLVIDLALSKVARGKIMAARQKGETIPGDWALDRNGRPTTDPEEAIAGTMVPAGEAKGAALALMVEIMAAAVTGGNFAFQASSLLDDKGAPPSLGHTIIAIDPVSSGGAAFTERLALIAGEIEKQENVRLPGRRSQGIRKQALESGIAIESDILAEIQS

SEQ ID NO: 11793 - protein, 404 aa, Agrobacterium tumefaciens
MRRVVVTGLGIVSSIGGDAAEVTASLRQAKSGISFSPDFAEHGFKCQVWGKPSLDPTDLVDRRAMRFLSQGGAWNHVAMKQAIADSGLEESDISGNERTGIIMGSGGPSTRTIVEAADITLKNNSPKRIGPFAVPKAMSSTASATLATWFKIHGVNYSISSACSTSAHCIGNAAEMIQWGKQDVMFAGGHEDLDWSMSNLFDAMGAMSSKYNETPGVASRAYDVNRDGFVIAGGAGVLVLEELEHAKARGAKIYAEIVGYGATSDGYDMVAPSGEGAIRCMRQALATVKGDIDYINTHGTSTPVGDSKEIGAIREVFGDKIPHIQSTKSLTGHSLGAAGVQESIYGLLMMQERFIGESAHISELDPEFAGVPIVRSRIDDAKIDTILSNSFGFGGTNATLVFQR

SEQ ID NO: 11794 - protein, 257 aa, Agrobacterium tumefaciens
GIMQGKRGLIMGVANNHSIAWGISKALAAQGAELAFTYQGEALGKRVKPLAAELGSDFIVPCDVEDIASVDALFATIREKWGALDFVVHAIGFSDKNELKGLYANTTRENFSRTMVISCFSFTEIAKRAAELMTNGGSMLTLTYNGSQRVIPNYNVMGVAKAALEASVRYLAADYGPRDIRVNAISAGPVRTLAGAGISDARAIYAWNQKNAPLRRTADIDDIGGSALYLLSSLSRGVTGECHYVDCGYNITSTPTL

SEQ ID NO: 11795 - protein, 573 aa, Agrobacterium tumefaciens
QRAWLAGFLAGLHSRTAIGLETSVAAAAPKSAASVLNILVGTQTGNAEALAMDIAAAARTQGMQPVVTALDDVSMDSLGSMKRVIVVTSTYGEGEMPDNAQLFWEALAADSAPRLDEMNFAVLALGDTGYDGFCQAGKLIDTRFEQLGGRRMKARIDCDIDFEDAAAAWIGEALPLALAVDGGKEAAVTMPDIAAQPTRAKSGWSRKNPYPATVGVNRRLSGSGSSKEIRHYEFDLRESGLDYEAGDALGVVPLNNPKLAGALLGHFGAVGDSQVAGLDRPVGDALLNIYEISTPSRELVAEIGKRAGHEELSHILANGDKEQLAAFLWSKDILDLLNLGGKPLFELAEFVTFLKPLQHRAYSISSSPLLAKDSVHLTIASVRYRAEGRERGGVCSTYLADRVEAGQSAGIFVSPNKAFRVPQDDNAPVIMVGPGTGIAPFRAFLQERQARGARGKNWLFFGDQHRQSDFIYENELGDMSRDGVLTRLDLAFSRDQAEKIYVQTRMRQNGKALYQWLEEGGYFYVCGDATRMAKDVDDALHSIISDEAGISAEAASDYVNRLKREKRYLRDVY

SEQ ID NO: 11796 - protein, 206 aa, Agrobacterium tumefaciens
TTMPTEETALPGREEALAVPETHFVNGRPLKGPYPDGLEIIYLGMGCFWGAERLFWKTPGVWVTAVGYAGGFTRNPTYHETTTGQTGHAEVVKVVYDPAVISLSGLLKIFFEEHDPTQGMRQGNDVGTTYRSAIYATTEGQLQQAQKARDAFQQALDEAGHGHAITTEIGPLETFYYAEDYHQQYLAKNPGGYCGLRGTGVSCNIG

SEQ ID NO: 11797 - protein, 629 aa, Agrobacterium tumefaciens
MAKVIGIDLGTTNSCVAVMDGKDTKVIENAEGARTTPSMVAFSDDGERLVGQPAKRQAVTNPTNTLFAVKRLIGRRYEDPTVEKDKALVPFEIVKGDNGDAWVKAQDKNYSPSQISAMILQKMKETAESYLGEKVEKAVITVPAYFNDAQRQATKDAGRIAGLDVLRIINEPTAAALAYGLDKKEGKTIAVYDLGGGTFDISVLEIGDGVFEVKSTNGDTFLGGEDFDMRLVEYLAGEFKKDQGIDLKNDKLALQRLKEAAEKAKIELSSSQQTEINLPFITADASGPKHLTLKLTRAKFESLVDDLVQRTVAPCKAALKDAGVTAAEIDEVVLVGGMSRMPKVQEVVKQLFGKEPHKGVNPDEVVAMGAAIQAGVLQGDVKDVLLLDVTPLSLGIETLGGVFTRLIDRNTTIPTKKSQTFSTAEDNQSAVTIRVSQGEREMAQDNKLLGQFDLVGLPPSPRGVPQIEVTFDIDANGIVQVSAKDKGTGKEQQIRIQASGGLSDADIEKMVKDAEANAEADKKRRAGVEAKNQAESLIHSTEKSVKEYGDKVSETDRKAIEDAIASLKTAVEAAEPDADDIQAKTQTLMEVSMKLGQAIYEAQQAEAGDASAEGKDDVVDADYEEIKDD

SEQ ID NO: 11798 - protein, 821 aa, Agrobacterium tumefaciens
QQRPGSSQSQQRSGSSAPQQRQADRPRGNVLHDLSAGEMEARRRALMEAQARDVVEAKQRAEDEARRKVEEEQRIAAEKMEAANRAAEEAAAAKVAASQPAAEVRAEPASERPAAAAAPAPRTDARPQSAAAAPRSAPATPDAAAPRGRRTGGDDEDDRGAVRRGSSLPARGKVVAPAPAKPAARLKTEEERRRGKLTVTSNLEEDGTPRGRSMASMRRRQEKFRRSQMQETREKVLREVILPETITIQELSQRMSERAVDVIKFLMKEGQMLKPGDVIDADLAELIAVEFGHTVKRVSESDVEEGIFNQTDDEGEMVSRPPVVTIMGHVDHGKTSLLDAIRQANVVSGEAGGITQHIGAYQVEKNGHKITFIDTPGHAAFTAMRARGAQATDIAVLVVAADDSVMPQTIESINHAKAAGVPIVVAINKIDKHEANPDKVRQQLLQHEVFVESMGGEVLDVEVSAKNKLNLDKLLEAILLQAEILDLKADPSRTAEGTVIEAELDRGRGAVATVLVQKGTLKPGQIIVAGDQWGRVRALVNDKGDHVKEAGPAMPVEILGLSGTPSAGDRFAVVENESRAREISEYRQRLARDKAVARQTGQRGSLEQMMSQLQTSGLKEFPLVIKADVQGSVEAIIASLDKLGTDEVRARVVHSGAGAITESDISLAEASNAAIIGFNVRANAQARTASERAGIEIRYYNIIYDLVDDVKAAMSGLLSPERRETFLGNAEILEVFNITKVGKVAGCRVVEGKVERGAGVRLVRDNVVIHEGKLKTLKRFKDEVNEVPVGQECGMAFENYEDIRAGDTIECFRVEHITRTL

SEQ ID NO: 11799 - protein, 313 aa, Agrobacterium tumefaciens
KFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPR

SEQ ID NO: 11800 - protein, 714 aa, Agrobacterium tumefaciens
QPVAASQKPVDTGLDYHALNAMLNLYDENGKIQLDKDRLAARQYFLQHVNQNTVFFHNLREKLDYLVTEGYYEQEVLDQYSFNFVRDLYDEAYSRKFRFPTFLGAFKYYTSYTLKTFDGKRYLERYEDRVCMVALALARGDEQLARDLMDEIISGRFQPATPTFLNAGKKSRGELVSCFLLRVEDNMESIGRSINSALQLSKRGGGVALSLTNIREFGAPIKQIENQSSGVIPVMKLLEDSFSYANQLGARQGAGAVYLHAHHPDIMRFLDTKRENADEKIRIKTLSLGVVIPDITFELARNNEDMYLFSPYDVERVYGVPLTEISVTEKYHEMVADSRIRKKKIKAREFFQVIAEIQFESGYPYIMFEDTVNRANPVAGRISMSNLCSEILQVSEASEFNADLSYSHMGKDISCNLGSLNIASAMDSADFGKTIETSIRALTAVSDMSHISSVPSVEKGNDASHAIGLGQMNLHGYLARERIFYGSEEGIDFTNIYFYTVTYHAIRASNRLAVERGQSFKGFENSKYASGDYFDKYTDREWLPATEKVRDLFEKAGIAIPTQEDWTALKQDVMASGLYNQNLQAVPPTGSISYINHSTSSIHPIVSKIEIRKEGKIGRVYYPASYLSNDNLEYYQDAYEIGPEKIIDTYAAATQHVDQGLSLTLFFRDTATTRDINRAQIYAWRRGIKTIYYIRLRQMALEGTQVQGCVSCTL

SEQ ID NO: 11801 - protein, 253 aa, Agrobacterium tumefaciens
MAKEPILTARNLVKRYGRVTALDNADFDLYPGEILAVIGDNGAGKSSLIKAISGAVTPDEGEIRLEGQPVQFRSPIEARKAGIETVYQNLALSPALSIADNMFLGREIRKPGIQGSLFRALDRPAMEKFAREKLSELGLMTIQNINQAVETLSGGQRQGVAVARAAAFGSKVVILDEPTAALGVKESRRVLELILDVRSRGLPIVLISHNMPHVFEVADRIHIHRLGKRLCVINPKDYSMSDAVAFMTGPRKR

SEQ ID NO: 11802 - protein, 163 aa, Agrobacterium tumefaciens
  unsure (1)..(163): unsure at all Xaa locations
MTEDSSLTLERPPVVIIRGARKTDLPELNEMITLLASYHGDAAAITPAKLERDLFGPLPWVHGLVAEADDALIGYALLLPLYRAQEGRRGLELHHLFVRDGHRGHGTGQHLVSRARDIAKRLGCDYLSVSATTGNVAAHRFYENMDFAPRPVTGMRYMQSIAX

SEQ ID NO: 11803 - protein, 403 aa, Mesorhizobium loti
MAKIKVANPVVELDGDEMTRIIWQFIKDKLIHPYLDLKLEYYDLGIEHRDATNDQVTIDSANAIKKYGVGVKCATITPDEQRVEEFKLKKMWKSPNGTIRNILGGTIFREPIIMKNVPRLVPGWTKPIIVGRHAFGDQYRATDFRFPGKGKLTIKFVGEDGKVIEHDVFDAPGAGVAMAMYNLDESIREFARASLNYGLLRNYPVYLSTKNTILKAYDGRFKDIFQEVYEAEFEADFKSKKLWYEHRLIDDMVASSLKWSGGYVWACKNYDGDVQSDTVAQGFGSLGLMTSVLMTPDGKTVEAEAAHGTVTRHYRQHQKGEETSTNSIASIFAWTRGLAHRAKLDDNAELKRFAETLEKVCIQTVESGFMTKDLSLLIGPDQPWLSTTGFLDKIDENLQKAMA

SEQ ID NO: 11804 - protein, 173 aa, Mesorhizobium loti
MTDKVQTKTSDIVIRPGRIDDAETIHAALLKLGAHIGAHQEITSTSDDLRRYGFGDKPAFSTLIAEVGGEFAGLCLYFPIFSTWMGRPGVYVQDLYVEDRFRGRKIGERLLRRVAAECRKEGGVYLRLSVDTDNEGAKAFYERLGIAWSSYEQTQKIIGDAFFAFADAPEEQE

SEQ ID NO: 11805 - protein, 461 aa, Mesorhizobium loti
MSKTQTADQITEARRESHLFYLSSLRRPLIDRAEGIYMWTQDGRRFIDGSSGPMVANIGHSNRNVLDAMKRQMDRATFAYRLHFENEPAEELARELAKKLPEGMDRIFFVSGGSEATESCIKLARQWAVATGQASRWKVITRFPSYHGGTLGSLSITGDDALAETFEPMMRVMPTVPAPTAWRDRDNLSMEQRGVRYADMLEEKILAEGPESVVAFIMEPIGGAATAALVAPDSYYARTREICDHYGILLIHDEVMCGAGRTGKFLGGDHWNCKPDIVALSKGLGSGYAPLGALAAPMRLVQPLLASGGFQHGHTYAGNPLACAAGLAVLGEMDRLDLIANAAAMGDVLMDGLKGLAKRFPFIADVRGKGLLTGAEMVADPETLRPIEQGKKATQRLLDLAYERGLIIYGRRVKGGVDGDNFMVAPPMIVTSEQVGEIISIIGDSLEVLASELDLPVEGRG

SEQ ID NO: 11806 - protein, 334 aa, Mesorhizobium loti
MLISILSWLLAVLFLLAVLGIACLALATLWIAMKAQALVPPVGKFIEIDGNRIHYVDVGEGRPIVFLHGLGAQLHHFRRTLFGHFGPGYRLIALDRPGSGYSTRASGTTGRLPEQAALVRRFIEKLQLERPLVVGHSLGGAVTLTLAVEHPEAISGIALLAPLTHLETRARQRFDLLYIPSRVQRWIMAYTVAIPLSLRYARPTMEFIFAPQAFPTDYMVEGGGWLGLRPVHFQATSADVVAVEEDLGRIEQRYGEIVMPAGILFGTADRVIDIRIHGEPMRGKIAGLDFEPVDGVGHMPQFVEPKRVIGFIERIAVRAFPSPQPHDNFNEPTG

SEQ ID NO: 11807 - protein, 500 aa, Mesorhizobium loti
MTITIDTNASWRDIARVSEGESLALSQAAWERIAFAHQIVAAIVEKGIRAYGVNTGVGALASKVVAPALQKKLSRNIIRSHACGVGDLVPRRGVRAIIAAQVANFAHGRSGVSPAIVRNLLTFIERDCVPDVPSRGSAGYLTHNAHVALVLIGEGSATVAGRPMSGLEALAEMGLEPLELGAKEGLSLVNGTACATGLTSIAVLRAERLLGWADAAAALTLEAAGAQMPAFGEQILAMRPSPGIQDVGRSLRGWLHGSELIALAHGSRTQDALSLRAVPHVHGAAREVLDRSSELVDRELAAVTDNPAVFGSLSDPQVVSEAHAVAPALGQAADGLTIALAQVAGMSERRIDRLVNPLVNNLPAFLADEDGANSGFMIAQYTATSLSNVNRRLAAPAATDGGVTSGLQEDFLAHPTVAANKLLAVIDNAEYILAIELMAAAQAHDFLARRGARAPGTDTIYQLVRENIAHYSDDRPLSRDMEALRTFIREMDVPACPQHS

SEQ ID NO: 11808 - protein, 146 aa, Mesorhizobium loti
MRYLHTMVRVADVDASLDFYCNKLGLKEVRRYENEQGRFTLIFLAASEDEQSGINDKAPLIELTYNWDPEDYKGGRNFGHLAYEVDDIYATCQHLMDNGVTINRPPRDGNMAFIRSPDGISIELLQKGPAKAKAEPWASMANTGSW

SEQ ID NO: 11809 - protein, 447 aa, Mesorhizobium loti
MFQKILIANRGEIALRVLRACKELGIQTVVVHSTADADAMHVRLADESVCIGPPPSRDSYLNIHQIVAACEITGADAVHPGYGFLSENAKFADILAAHNITFIGPSGDHIRIMGDKIEAKRTAKRLGIPVVPGSDGAVTEEKEAKRIAAEIGYPVIIKASAGGGGRGMKVAHSEADLEVALQTARSEAGAAFGDDAVYIEKYLQKPRHIEVQVFGDGFGRGVHFGERDCSLQRRHQKVWEEANSPALNAEERSRIGGICAKAIADLGYSGAGTIEFLYENGEFYFIEMNTRLQVEHPVTEAITGIDLVHEQIRVASGGGLSVKQEDIKFNGHAIECRINAEDPRTFTPSPGTITHFHTPGGLGIRVDSGVYSGYKIPPYYDSLIGKLIVHGRNRVECMMRLRRALDEFVVDGIKTTLPLFRDLVGNADIANGDYDIHWLEKYLAKEE

SEQ ID NO: 11810 - protein, 144 aa, Mesorhizobium loti
MKTVFVLNGPNLNALGKREPGIYGGKTLAAIADDCKQAGASLGLGIDFRQSNHEGDLVDWIQEAGDKAAGIVINPGAYSHTSIAIHDAIRSIAPLPVAEVHLSNIHARESFRHVSMVAPVAVGMICGFGPLGYTLALQALAARL

SEQ ID NO: 11811 - protein, 527 aa, Mesorhizobium loti
MSSDTTIAPEALTFSDLGLSPKVLSAVTDAGYTVPTPIQAGAIPHALLGKDILGIAQTGTGKTASFVLPMLTRLEKGRARARMPRTLILEPTRELAAQVEENFVKYGKNHKLNIALLIGGVSFDEQDKKLERGADVLIATPGRLLDHRERGKLLLNGVEILVIDEADRMLDMGFIPDIERICEMIPFTRQTLFFSATMPPEITKLTEKFLHAPVRVEVSKAASAATNITQRLVKSGSKPWDKRETLRNLIKAEDAELKNAIIFCNRKVEVSELFRSLLKYDFDAGALHGDMDQRARMQMLANFRDGKLRYLVASDVAARGLDIPDVSHVFNYDVPIHAEDYVHRIGRTGRAGRSGKSFTIATKSDTKYIDAIERLIGNKIEWHDGDLSTVVASEGEDDAPRRGKGAPRRAGRKDDDRKDRGERKKGGERRARHSEEDAAVAQQEQPDVAETAVADISERRARKEAIRSENTERKSSDRNEPRAPERGDTRPQRDNSRPARHRHQEDNDTTVGFGDDMPAFMRIVAKV

SEQ ID NO: 11812 - protein, 292 aa, Mesorhizobium loti
MAILVTGSTGTIGSQVLAHLQGHNVEVRALTRSPETAQFPAGVTAVRGDLADPDSVRAALRGVSTLFLLAPNVADELTQAMLTLTVAREAGVKGIVYLSVFGGDGYADVPHFAGKYTVERMIEALDLPATILRPAYFIQNDLRQKDGLLKTGVYGSPIGKKGVSMVDIRDIGEAAAIELLRREQAATPLGRETYALVGPDSLTGEGIATIWREALGRAIRHGGDDLVVMEQRTKTMLPAWHALDLRLMFSRYQTEGAVATADDIERLTKLLGHAPRSYTAFARDAAAQWTKG

SEQ ID NO: 11813 - protein, 1378 aa, Mesorhizobium loti
MAQTQTFNGRRRVRKFFGKIPEVAEMPNLIEVQKASYDQFLMVDEPKGGRPDEGLQAVFKSVFPISDFSGSSMLEFVKYEFEGPKFDVDECRQRDLTYAAPLKVTLRLIVFDIDEDTGAKSIKDIKEQDVYMGDMPLMTLNGTFIVNGTERVIVSQMHRSPGVFFDHDKGKSHSSGKLLFAARVIPYRGSWLDIEFDSKDVVHARIDRRRKIPVTSLLMALGMDGEEILSTFYNKITYVRAGDHWRIPFNVERFRGLKAVGDLVDADTGEIVVEAGKKITARQARQLGEKGLKAIKATDEDLLGNYLAEDIVNYATGEIFLEAGDEIDEKTLKVLLGTGEQEIKVLDIDHVNVGAYIRNTLNVDKNESRQDALFDIYRVMRPGEPPTLETAEAMFNSLFFDSERYDLSAVGRVKMNMRLELKAEDTVRVLRKEDILAVVKTLVELRDGKGEIDDIDNLGNRRVRSVGELMENQYRVGLLRMERAIKERMSSIEIDTVMPQDLINAKPAAAAVREFFGSSQLSQFMDQTNPLSEITHKRRLSALGPGGLTRERAGFEVRDVHPTHYGRICPIETPEGPNIGLINSLATFARVNKYGFIESPYRKIVDGKLTNDVVYLSAMEEAKHHVAQANAELDKNGGFVDEFVICRSAGEVMMAPRENVDLMDVSPKQMVSVAAALIPFLENDDANRALMGSNMQRQAVPLVRAEAPFVGTGMEPIVARDSGAAIGARRGGIVDQVDATRIVIRATEDLDPGKSGVDIYRLMKFQRSNQNTCINQRPLVRMGDRVNKGDIIADGPSTELGDLALGRNVLVAFMPWNGYNYEDSILLSERIVADDVFTSIHIEEFEVMARDTKLGPEEITRDIPNVSEEALKNLDEAGIVYIGAEVQPGDILVGKITPKGESPMTPEEKLLRAIFGEKASDVRDTSMRMPPGTFGTVVEVRVFNRHGVEKDERAMAIEREEIERLAKDRDDEQAILDRNVYARLSDVLVGKEAIAGPKGFKKGSTLSKDTLDEYPRSQWWQFAVENEKLQSELEALRGQYDDSKKALEQRFMDKVEKVQRGDEMPPGVMKMVKVFVAVKRKMQPGDKMAGRHGNKGVVSRIVPVEDMPFLEDGTHADIVLNPLGVPSRMNVGQILETHLGWACAGMGKKIGELIDTYKAAGDIKPLRKTLESFMPANDRNEPIREYDDESIVRLSEQMRRGVSIATPVFDGAHEADINIMLEQAGLHTSGQSQLYDGRTGEPFDRKVTMGYIYMLKLHHLVDDKIHARSIGPYSLVTQQPLGGKAQFGGQRFGEMEVWALEAYGAAYTLQEMLTVKSDDVAGRTKVYEAIVRGDDTFEAGIPESFNVLVKEMRSLGLNVELENTKLDDAPVRLPDAAE

SEQ ID NO: 11814 - protein, 277 aa, Mesorhizobium loti
MALKKFNPVTPSTRQLVIVDRSGLYKGKPVKGLTEGLTKSGGRNNYGRITARFIGGGHKRSYRIIDFKRRKFDVVGTVERIEYDPNRTAFIALIKYDDGELSYIIAPQRLAAGDKIVAGEAVDVKPGNAMPLASMPVGTIVHNIELKPGKGGQVARSAGGYAQLVGRDQGMAILRLNSGEQRVVHGSCMATVGAVSNPDHGNINDGKAGRTVWRGKRPHNRGVTMNPVDHPHGGGEGRTSGGRHPVSPWGKPTKGKKTRSNKATDKFILRSRHQRKS

SEQ ID NO: 11815 - protein, 346 aa, Mesorhizobium loti
MTKYKLEYIWLDGYTPVPNLRGKTQIKEFAEFPTLEQLPLWGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTETYGIDIEFHCKPLGDTDWNGSGMHCNFSTKFMREVGGKAYFEALMAQFDKNLMDHIAVYGPDNDKRLTGKHETAPWNKFSYGVADRGASIRVPHSFVKNDYKGYLEDRRPNSQGDPYQIASQVLKTISQVATDAKVSAAA

SEQ ID NO: 11816 - protein, 467 aa, Mesorhizobium loti
MPSNVTAELSGFAALGITGALLKATHNAGFTEPKPIQMQAIPPQLEGRDIFGIAQTGSGKTAAFALPILSKIIALGTKRRAKTTRALILAPTRELAVQIEDTIKILAKGAHVSTALVLGGVSRFSQVKKVAPGVDILIATPGRLTDLVREGDLILSDTKWLVLDEGDRMLDMGFINDVKRIAKATAPDRQTALFSATMPDEIAELAKGLLKNPVRIEVSPQSTAAAEIVQGVVFARTKQKRQVLSTMLADEAMKSVIIFSRTKHGADRVTKDLERDGFKAAVIHGNKSQNARQKALNDFREGSVRILVATDIAARGIDVPGISHVVNFDLPDEAESYVHRIGRTGRNGMDGIAITLCDPSENSKLRQVERIIRTKLPIVADHLGSPDPQRNPAEKNERFEPANDRNDRNGRRDGRRPGGENKGNGFGKKRFGDKPAFAGERKPEGAKPFKGNNKRRFGGKRPAARAA

SEQ ID NO: 11817 - protein, 273 aa, Mesorhizobium loti
MTLYRADPKHGVAWVTGGSSGIGRSLARDLASQGYAVAVTALDDDPIDTLIVETAQMPGSVTAFPCDVTDEPRMARTVAAIEKELGPIVLAVFNAGNYISTPGEALVVKDFRRTFEVNYFGIINGLVPVVEYMRVRSRGHVVLVGSVTAYFGWPTTAAYGGTKAAINILAESLKYDFDKMNIRVQVINPGFVDTPLTEKNMLPMPGLMPVTRATRRMIKAIKSGGFEVTFPYRTSWPLKFLALLPRPISRWVISLMTSWKARPLHYERKPPNE

SEQ ID NO: 11818 - protein, 293 aa, Mesorhizobium loti
MAQDSPFTVDADWLQARLGEPGLTIVDASWYLPAQKRDARAEYNAAHIPGARFLDQDAVSDPDAALPHTLPSPQHFAQYVGSMGVSADDTIVVYDGPGFFSAPRAWWMFRIMGVFQTYILDGGFDAWKTAGRPVTAEPTKIAPSVFHADFDAGRVASLADMRRIVETSASQIADARGPGRFTGAEPEPRAGIRSGHMPGARNVPYSALSENGMLLSKDRLRKVIEEAGIDLSKPVVTSCGSGVTAAVVTLALETLGHTDNRLYDGSWTEWGGLSDTPVVTGPATPGPAKTGKE

SEQ ID NO: 11819 - protein, 424 aa, Mesorhizobium loti
MTAIIDIVGREILDSRGNPTVEVDVVLEDGSMGRAAVPSGASTGAHEAVELRDGGARYLGKGVLKAVEAVNGELFEAIGGMEAENQIHIDQTMIELDGTPNKSRLGANAILGVSLAVAKAAADAAGLPLYRYVGGTKAHILPVPMMNIINGGAHADNPIDFQEFMILPVGAPTLREGVRWGSEIFHTLRKKLKDAGHNTNVGDEGGFAPNLKSAPVALDFIMESIEKAGFKPGEEIALGLDCAATEFFKDGNYVYEGEKKTRDPKAQAKYLAKLAADYPIVSIEDGLAEDDWEGWKYLTDLIGKKTQLVGDDLFVTNTARLRDGIRMGVANSILVKVNQIGSLTETLDAVETAHKAGYTAVMSHRSGETEDSTIADLAVATNCGQIKTGSLSRSDRMAKYNQLIRIEEELGKQARYAGKSVIKG

SEQ ID NO: 11820 - protein, 345 aa, Mesorhizobium loti
MATAARKAPAKSKSEGKSGLSAPKPAEFTKDEELAAYRHMLLIRRFEEKAGQLYGMGFIGGFCHLYIGQEAVVTGMKMALIDGDQMITAYRDHGHMLAMELSPRGVMAELTGRRGGLSKGKGGSMHMFSKEKHFYGGHGIVGAQVSLGTGLAFANRYRDNNNVSLTYFGDGAANQGQVYESFNMASLWKLPVIYIIENNRYAMGTSVSRSSAETNFSHRGASFKIPGIQVDGMDVRAVKSAGDQATEWCRAGNGPIILEMQTYRYRGHSMSDPAKYRSKEEVQKMRSEHDPIEQVKARLTEKKWATEDELKTIDKEVRDIVADAAEFAQNDAEPDPSELWTDIVL

SEQ ID NO: 11821 - protein, 461 aa, Mesorhizobium loti
MPIEILMPALSPTMEEGNLSKWLKNEGDKVVAGDVIAEIETDKATMEVEAVDEGTLAKIVVPAGTEGVKVNAVIAVLAVEGEDTDKAGEGIGEEPAKAETASPAPVAAKSEAAAPVAAAPKTEIAADPDIPAGTEMVSTTVREALRDAMAEEMRRDGDVFVMGEEVAEYQGAYKITQGLLQEFGPRRVVDTPITEHGFAGVGVGAAMAGLKPIVEFMTFNFAMQAIDQIINSAAKTLYMSGGQMGAPIVFRGPNGAAARVAAQHSQCYAAWYSHIPGLKVVMPYTAADAKGLLKAAIRDPNPVIFLENEILYGQSFDVPKLDDFVLPIGKARIHKQGKDVTIVSFGIGMTYAVKAEAELRGLGIDAEIIDLRTIRPLDLDTIIASVKKTNRLVVVEEGFPQSSVGDHIANQVSQRAFDFLDAPVITIAGKDVPMPYAANLEKLALPNVGEVIEAVKAVTYR

SEQ ID NO: 11822 - protein, 453 aa, Mesorhizobium loti
MPINITMPALSPTMEEGNLSKWLVKEGDKVSPGDVIAEIETDKATMEVEAVDEGTVAKLVVPAGTEGVKVNALIAVLAAEGEDASAAAKSGGGAAPAKAEAPKADAPKAEAPKAEPAAAAAPKAEPAPVANGHAAGERTFASPLARRIAKEAGVDVSAVTGTGPHGRVVKADVDAAIAGGGAKAALAAKAPAGAPAAPAPAVKPMSDDQVLKLFEQGSYELVPHDNMRKTIARRLVEAKSTIPHFYLTLDCELDALLALRTQINAAAPMKKTEKGDVPAYKLSVNDMVIKAMAMALKAVPDANASWTETAMVKHKHADVGVAVSIPGGLITPIIRKADEKTLSTISNEMKDLASRARSRKLKPEEYQGGTTAVSNLGMFGIKDFAAVINPPHATILAVGAGEERAVVKNGELKIATVMSVTLSTDHRAVDGALGAELLVAFKRLIENPMGMLV

SEQ ID NO: 11823 - protein, 481 aa, Mesorhizobium loti
MAENYDVIIIGSGPGGYVTAVRSAQLGFKTAIVEREHLGGICLNWGCIPTKALLRSAEIMHYSDHLKDYGLKLDGKVSVDTSAVVDRSRKVSLRLNGGVAFLMKKNKVDVIWGEAKLSKPGEVVVSKTAKTPMEPQPPVPKGVKGEGTYTAKHIILATGARPRALPGIEPDGKLIWTYFEAMVPKEMPKSLLVMGSGAIGIEFASFYRTMGADVTVVELLPAVMPVEDAEVSKFAQKQFEKQGMKIILEAKVTKVEKGANSVTAHVEMKDGKVEKITADRMISAVGVQGNIENLGLEALGVKTDRGCIVVDGYGKTNVPGIYAIGDVAGPPMLAHKAEHEGVVCVEKIAGFPGVHAIDKLKIPGCTYCNPQVASVGLTEAKAKAEGKDIRVGRFQFAANGKAIALGEDQGFIKTIFDKKTGQLLGAHMVGAEVTELIQGFVVAMNLETTEEELMHTIFPHPTLSEMMKESVLDAYGRALNA

SEQ ID NO: 11824 - protein, 394 aa, Mesorhizobium loti
MFEDLQPAPADKILALIGLYRADPRPNKVDLGVGVYKDRDGKTPVMRAVREAEKRLLNSQDTKTYLGLAGDTGFNAVMAKLAFGPGADMTRIRAAQAPGGSGALRLVAELLKRTRSDATIWLSDPTWPNHMPVMRAAGLQIREYPYFDAASGAVRFDDMLAALRTAKSGDVVLLHGCCHNPTGANLDAAQWQAVTDLMVERGLLPFVDIAYQGFGDGLEADALGLRLLAAKVPEMVVASSCSKNFAVYRDRVGAAMVLARDSAQADVAMSQMLSAARAMYSMPPDHGAAAVRIVLEDASLRADWEAELEEMRLRMLRLRVAFAEALRRQSNSDRFDFVASHRGMFSRLGLTEAQVERLRAEHGVYMVGDSRINVAGLPEDGMDALAKAIVSVLD

SEQ ID NO: 11825 - protein, 525 aa, Mesorhizobium loti
MGGTVSANHDGANLLEVRGLTKIFGTLTACDHIDLNIAKGEIHALLGENGAGKSTLVKMLFGSLEPNSGEIFWNGQAVRITSPGAAKKLGIGMVFQHFSLFEALTAAENIALSLDDGSPISSIAAKARALSYSYGLPLDPDSLVGDLSVGERQRIEIIRCLLQTPQLIILDEPTSVLTPQEADKLFETLERLRAEGKSILYISHRLEEVKRICDRATVLRHGKVVGHCNPREETAASLARMMVGNEVQAVVRAPVEGIETAQPLLEIRSLTRKPATPFSIPLKAISLNVRAGEVIGIAGVAGNGQGEFFESVSGEVLQQDAASVRIRGKDAGGLTITGRRLLGAAFVPEERLGHGAAPRMKLSENLLLSRHATDGKAFVGTGGMVKSGAIYAASQRIIEAMDVRKSAPDPEAAALSGGNLQKFIVGRELDRRPSVMVVNQPTWGVDAGAAAHIRQALIELSRSGSAVLVISQDLDELFEISDAIAVMHNGELSKPMPIAEATFEKVGLLMGGAEPGHAEHTLETA

SEQ ID NO: 11826 - protein, 248 aa, Mesorhizobium loti
MSSSNLNGKAALVTGGSRGIGAAIARRLAADGADVALTYVHGEEQARSVVAEIEAKGGRAIAIRADNRDAEAIDRAVDETAAAFGRLDILVNSAGIWRAAPIDTLSLADFDETMSVNLRAPFIASKAAAAHMGEGGRIISIGSNLAERVTDTNLGAYSASKAALVGLTKALARDLGSRGITANVVHPGSTDTDMNPADGPHAEHQRQKMATPRFGKADDIAGMVAWLAGPEGRFVTGAALTIDGGANA

SEQ ID NO: 11827 - protein, 714 aa, Mesorhizobium loti
MLRAARYHGVELDPNEFRAASAVPAAADLSQWAQDAGMWSRAVRIRWSHLLRFQDAGPVVLLFNDGGAALLTGASAERNVVFLKSADAPEDGEAVAIDELRLSQVWTGEALLLRATRSYVAADAPFTLRWLAELVRLESHALRDITIASFTLSVLTILPPLIVMTVVNKVLQFNSISTLVLLSAVIAVVFAYETLLGHARRLIINVVGARLDTKLQLHVFSRLLRLPLDYFERHPAGETMYHLAQVYRIREFLTGKLLSTFLDMITLCVLVPVMFYINTALAWIVLACAVVIMLIILAFLMPLRRRYQRVVDAETWKSAALGETVVGIKTVKALGLEPQRKALWDERVAEAGKARLAFGQLASWPQTLVTPIERVMVLGTMLIGAYLAMNDRTGYMVGGLFAFMMIAQRVAQPLVGLARLVEDYEEVGAAIGEAASVLNRPLESSSNSTGLRPRLVGEVVFSDLTFSYIATKIPALDRVSFHIPAGSMFGIVGRSGSGKSTVARLLQGINRDYSGFLKLDGVDLKEINLRHLRQGLGVVLQDNFLFRGSIRDNIIAGRPGLTLSDAMRAAHLAGAQEFIERMPNGYDTYIEEGSPNLSGGQKQRLAIARALIHDPTILILDEATSALDPESEAVVSANLMRIASGRTMIIVSHRLASLTECDNILVMDQGKVLDVAPHATLLERCALYRQLWSQQNRHLDGRHGRPVAVPPRLV

SEQ ID NO: 11828 - protein, 256 aa, Mesorhizobium loti
MTPGIRPLVAGNWKMNGTSASLNELRMIGNGFMSGLDAETEALVCVPATLLSHAAEILSRTPVHAGGEDCHTKESGAYTGCISAEMLKDAGASHVIVGHSECREQRGEDDATVQAKAAAAWRAGLVAIICIGETQQQREAGATLEVLSRQVAGSVPPSATPSNTVIAYEPVWAIGTGLTPTAADVAEAHAHIRERLSEKLGASAAKTRILYGGSVKPSNAVELLGVRNVDGALVGGASLKAADFLGIAEAYRSISG

SEQ ID NO: 11829 - protein, 541 aa, Mesorhizobium loti
MLGPSAHIDTFTRDHLPPPDQWPDFLLDGFDYPEHLNVGVELTDRLVEKGLGDHTALIGNGRRRTYKELSDWTNRLAHALVENYDVKPGNRVLIRSANNPAMVACWLAATKVGAVVVNTMPMLRTGELTKIVDKAEITIALCDTRLMDEMTACAKDSTFLKQVIGFDGTANHDAELDRAALDKPVTFTAVNTGRDDVALLGFTSGTTGVPKATMHFHRDLLIIADAYAREILQVTPDDIFVGSPPLAFTFGLGGLAIFPLRFGAAATLLEQATPPNMIHIIETYKATISFTAPTAYRAMLKAMDEGADLSSLRVAVSAGETLPAPVFEEWTEKTGKPILDGIGATEMLHIFISNRFDDRKPASTGKPVGGYEARIVDDAMREVPRGETGRLAVRGPTGCRYMADDRQKEYVRDGWNLTGDTFTQDEDGFFHFAARSDDMIVSAGYNIAGPEVEAALLSHPDVAECAVIGAEDGERGQIVEAHVVLVQGVAPDALTVKRLQDHVKAMIAPYKYPRSIKFIAALPKTQTGKIQRFRLRTEKIN

SEQ ID NO: 11830 - protein, 265 aa, Mesorhizobium loti
MSFNERMSYSDYLHLEKVLEAQTPLSSAHDEMLFIIQHQTSELWMKLALHEIGAAIRSIRADRLEPSFKMLSRVARIFEQLNNAWDVLRTMTPSEYTEFRDALGQSSGFQSWQYRAIEFMAGNRNLAMLGPHKHRPDLSGKLEAILAEPSLYDEALLLLARNGFDIGADARRTDWRETRTENEEVLVAWQTVYRDPQRYWMFYELAEKLVDFEDYFRRWRFNHVTTVERIIGLKRGTGGTSGASYLKKMLEVVLFPELWTVRTRL

SEQ ID NO: 11831 - protein, 474 aa, Mesorhizobium loti
MSDKVVTRFAPSPTGYLHIGGARTALFNWLYAKHTGGTMLLRIEDTDRERSTAAATAAILDGLSWLGLGWDGDAVSQFERAPRHREVAEELVRMGKAYYSYETPAELEAMREAARAKGLPPRYNGQWRDRTPSEAPAGVKGAIRIKAPTEGETIVHDRVQGEVRFPNKDLDDFIILRSDGNPTYMHAVVVDDHDMGVTHIIRGDDHLTNAARQTVIYNAMGWDVPSMSHIPLIHGADGAKLSKRHGALGVEAYRAMGYLPEALLNYLARLGWSHGDDEIMSIKDMISWFDIGDVNKGAARFDFAKLEAINGAHMRRMADAQLLDIFIATLPYLEGGPAMAARLNEHNKAQLLAALPGLKERAKTLVELVDGAAFLFATRPLPVDEKAALLLNDGARKILRGAHEALNALSGDWTAAAAEAAVRDYALAGGHKLGAVAQPLRAALTGKSTSPGVFDVLAVLGREESLARIADQID

SEQ ID NO: 11832 - protein, 433 aa, Mesorhizobium loti
MGGANQEATATLQFAGKTHEFKVRSGSVGPDVIDIASLYSTTGAFTYDPGFTSTASCESEITFIDGDAGILLHRGYPIDQLAEHGDFLEVCYLLLYGELPTKAQKDDFDYRVTRHTMVHEQMSRFFTGFRRDAHPMAVMCGVVGALSAFYHDSTDISDPYQRMVASMRLIAKMPTIAAMAYKYHIGQPFIYPKNDLGFAANFLHMCFAVPCEEYKINPVLARAMERIFILHADHEQNASTSTVRLAGSSGANPFACIAAGIACLWGPAHGGANEAALNMLGEIGHVDHIPEFIARAKDKNDPFRLMGFGHRVYKNYDPRAKIMQKTAHEVLGELGIKDDPLLDIAMELEKIALTDPYFIEKKLYPNVDFYSGITLKALGFPTTMFTVLFAVARTVGWIAQWKEMIEDPRQKIGRPRQLYTGAPERDYVPIAKR

SEQ ID NO: 11833 - protein, 152 aa, Mesorhizobium loti
MVAATTLEAVDIMGLMKLLPHRYPFLMIDRIIDIDGDDSAIGIKNVTINEPHFQGHFPEQPVMPGVLIVEAMAQTAGAICIRSLGASKPSLVYFLTIDNAKFRKPVVPGDQLKIHVKKIKKRGNLLKFACEALVDGTKAAEAEISAMMVTGD

SEQ ID NO: 11834 - protein, 822 aa, Mesorhizobium loti
MPAFSQGLEKALHQALTLANERHHEYATLEHLLLALIDDTEAAAVMRACNVDLDELKHTVLTYIDTELDNLVTGYDEDSKPTAGFQRVIQRAVIHVQSSGREEVSGANVLVAIFAERESHAAYFLQEQQMTRYDAVNYISHGIAKRPGASETRSPRGADDEQGGQNGAEPQEEGGKKKQQQDALTAYCVNLNNKAKAGKIDPLIGRESEINRTIQVLCRRSKNNPLYVGDPGVGKTAIAEGLAKRIVEGDVPEVLHNATIFALDMGTLLAGTRYRGDFEERLKQVVKELEDYPGAVLFIDEIHTVIGAGATSGGAMDASNLLKPALSSGAIRCIGSTTYKEFRQFFEKDRALVRRFQKIDVNEPTIEDAIEIMKGLKPYFEEFHKVRYTSEAIKASVELSARYINDRKLPDKAIDVIDETGASQMLVPEAKRKKTIGIKEIEATIATMARIPPKTVSADDEKVLQGLDIELKRVVYGQDTAITALTSAIKLARAGLREPEKPIGSYLFSGPTGVGKTEVAKQLAASLGVELIRFDMSEYMERHTVSRLIGAPPGYVGFDQGGLLTDGVDQHPHCVLLLDEVEKAHPDLFNILLQVMDHGKLTDHNGKQIDFRNVILIMTTNAGASDAQRAAIGFGSTKREGDDVEAINRLFTPEFRNRLDAIIPFGSLPVPVIHQVVQKFVMQLEAQLSERGVTFDLSPDAIAWLADKGYDERMGARPLGRVIQEHIKKPLADEVLFGKLKKGGTVRVTVEKKETGETGLKLESLADEAPVKPKKEEPEDAPKPPKAVAKKPAAKKVVAQKPEPKGKDGGKRSLVPQLPRKG

SEQ ID NO: 11835 - protein, 326 aa, Mesorhizobium loti
MTDASSLPLYPHRHLLGISDLSPADIELLLDRADRAVAISRQSEKKTSTLRGRTQINLFYEASTRTQSSFELAGKRLGADVMNMSVASSSVKKGETLIDTAMTLNAMRPDILIIRHQSAGAAALLAQKVGCSVVNAGDGAHEHPTQALLDALTIRRAKGPLSKLIVAICGDILHSRVARSNIMLLNALGAQVRVVAPSTLLPSGIEKMGVIVTRSMAEGLKDADVVMMLRLQRERMEGAFVPSVREYFRYFGLDAEKLKAAKGDALVMHPGPMNRGVEIASEIADGPQSVIQEQVEMGVAVRMAVMEALLDPRRNQEGRKQEGRGA

SEQ ID NO: 11836 - protein, 263 aa, Mesorhizobium loti
MISLSPNLAVPVVPQGPCSLFLDIDGTLLEHAAHPDAVVVGDELRTLLVRLEAQLDGALAFITGRSIAAVDHLFRPLRLRAAGLYGLEHRLARDGPVEAASEPADIAALANEIATELDNADVYIERKGPILAIHTRAAPHLLQRATELVEQALDRLPAGYRVLAGNAGVELMPLEAAKGAAIRRFMQIPAFRGRRPVFLGDDTSDENGFETVNELDGISVRIKPQGSTAAPFALAGVDAALAWLDEMSRSETAKAATLAAMPK

SEQ ID NO: 11837 - protein, 520 aa, Mesorhizobium loti
MQWSPETLRHILATELPDAQVIVVSNREPYIHNREGDDIQLVVPASGLVSALEPITRACAGTWIAYGGGSADKLVVDKNDRIEVPPDNPSYTLRRVWLSEEEQQGYYLGFANEGLWPLCHIAFTRPIFRASDWEAYEAVNRKFADTVVAEARNERPIVLVQDYHFALLPRMIRERLPEAIIITFWHIPWPNSEVFSICPWREKILDGLLGSSIVGFHTQFHCNNFIDSVDRFLESRIEREDSAISYGGQISLVHAYPISIEWPPAQLGKLPDVAQCRRQVREKFGLAENVKLCVGVERLDYTKGILDRFNALDELLTLHPEWIGKVAFLQIAAPSRGTLPAYQQLYEECLRHAEDLNQRYGREGYTPVLMITEHHSQQQVYEIYRAADVCMVTSLHDGMNLVAKEFVAAREDEQGVLLLSMFAGASKELLDALIVNPYDAAMMGDALLQALTMSQEEQSQRMRRMREIVRDNNVYRWAGSMLLDAARLRKRDAVDRAVSAAPAAPANVISLLDRRRVAAL

SEQ ID NO: 11838 - protein, 496 aa, Mesorhizobium loti
MSGFVLAIDQGTTSTRAILFDGQMKVAGSGQKEFAQHYPASGWVEHDPEEIWASVVTTVKAALKNAGKAASDVAAIGITNQRETVVVWDRATGKPIHNAIVWQDRRTAPLCQKLKKQGLEKKFTRKTGLLLDPYFSGTKIAWILDKVKGGRKRAEKGELLAGTIDSFLIWRLTGGKVHATDATNASRTLVYNIAENAWDDELLAILNIPAKLLPQVKDCADDYGVTERDLFGAEIRILGVAGDQHAATIGQACFEPGMMKSTYGTGCFALLNTGSDLVRSKNRLLTTIAYRLNGKTTYALEGSIFIAGAAVQWLRDGIKVIGKAEQSGKLADEADPTQNVYLVPAFVGLGAPHWDAEARGAIFGLTRNSGPAEFARAALEAVAYQTRDLLDAMRKDWKGTSAKTVLRVDGGMVASDWTMQRLADILDAPVDRPTILETTALGAAWLAGSKAGVWPKAKEFAKSWALERRFKPEMDIATRSAKLAGWRDAVRRTLSA

SEQ ID NO: 11839 - protein, 508 aa, Mesorhizobium loti
MDTSSVRDIFVIGGGINGCGIARDAVGRGFSVFLAEMNDLASGTSSGSTKLIHGGLRYLEFYEFRLVREALMEREVLWKNAPHIIWPMRFVLPYAKGLRPAWLIRLGLFLYDHIGGRKLLPATRTLDMASDPAGKPLKPLFKKAFEYSDGWVNDARLVALNARDAADRGATIRTRTKVVGARRENGLWTIKIENLQNGETEEIKARLLVNAAGPWVDHVLSGVVGLNDVHNVRLVQGSHIVIAKKFDDPRAYFFQNKDGRIIFAIPYEDEFTLIGTTDRDYPGDPHDVKISDTEIDYLCAAASEYFAQPVKRSDIVWTYSAVRPLYDDGASKAQEATRDYVLKADGGEGTAPIVNAFGGKITTYRRLSESMLEKIEGFLGKRGKPWTSDAPLPGGDFPATGFDAQVAKLKTAYPFLDARLARRLTRLYGTRAQRLLGLAKSNAELGRNFGGDLYEAEVRYLVENEWALTAEDVLWRRTKRGLHLSREHVAALDEFMRGISRRHVAAAE

SEQ ID NO: 11840 - protein, 470 aa, Mesorhizobium loti
MNNDEFRQWSRRAADWGADYRNSLRERPVRPLVEPGDIFRSIDASPPEDAEPMDRIFADFEEKIVPGMTHWQHPRFFAYFPANAAPVSVVAEYLVSAMAAQCMLWQTSPAATELETRTVDWMRQALGLPEGFSGVIQDSASSATLNAVLTMRERALDWQGNKKGLAGQGQLRIYSSDQVHTSIDRAIWVSGIGEDNLVRIPVGGRFRSMDTAALEAAIVADRAAGMLPAGIIGSVGGTSIGGTDDIAAVAGVARRHGLYFHVDAAWAGSAMICPEYRHFWAGAEQADSVVFNPHKWLGAQFDCSIQFLRQPEDLVRTLAIKPEFLKTHGRDGIINYSEWSVPLGRRFRALKLWFLLRAHGLENLRAMVRNHVTWSEGLAARLAKEPDFEIVSEPMLSLFSFRHRAPSSADADEHNLRLVNAINDDGRIYLTQTRVDGQVAIRFQVGQFEATAGDVDSAFAVITEIARGMA

SEQ ID NO: 11841 - protein, 2124 aa, Mesorhizobium loti
MAKKPTTTTRNLDSDVARELEKALDLDLSGDIGSGDLDIAASMEDLEAQISQAADELAREGRDQRPALAANQAAPIANQAANPAPKAKPAELRPVETRNGNGTQPTGFAPANDDRQKDYKTLLHSLNRRASNTVYWIVAFVSLAWIAGAGGLANLLFGPSIWRIGTLDQFLARPELIGLAVAAIVPIILFWAFAAMIRRAQDMRIAAQSMTEVAFRLTEPENMAQDRVMMIGQAVRREVAAMGEGIERTLARAVELETLVHSEVNQIERSYSENETRIRSLVDGLGSEREAVVTHAERVRASIAGAHETLRDEIGAASDIIRDSILNASTKLSMTITNSGDTLIDRINESSMSIFDSVEGRLDTITDKLSTSGEAFASLLDTRIAKLTDTTDGLTRSLTDLLDDRTTGMVSLLGGAARTLNSEFEASLNGIERTLAERGQALISEFQTRAEALDTGTQKLNAALEARARQINETLVERAREIAHTFAESKDTLAAMIDQGKTQIGADMADIVTSTSSMLEARASDFAGRMEAARHVVSRSFDSDIQRLADARVGIEEAVENHSRKLSESRDRMAAAMQADLEKFAESRDGIDAAVTNQVQKLAEGRSLIARALEEDLRKVNESRAAIDASLGSHLERLEEGRNRLSLALNEDSGKLVQARTIIDEMVAGHVGKLAEGRNILSRALEADLGKLSDSRASIDGLVAGQVEKIAEGRAVLAKALENDIAGIKSLIEVHSAKLVEDRSQLGRSLEDDLSGIRGLLDDHSVKLANDRSLLSQTLEADLAKLAESRSSIDGLVAGQVEKLAEGRDILKRALESDLSTIKGVISSQSERLAEDRGQLSRVLEADLQNVNSVIADHMNRLVQDRSTLSKALEDDLAKLADSRSSIDGLVAGQVEKLAEGRDILKRALEADLNTIKNTVADQSQKLVDDRAQFARALEADLESVNSLVNSHSERLVQDRSTLSKALEVDLDNVNGLINSHAERLVQDRSTLSKALEADLESVSGLVNSHADRLVQERSTLSRALEDDLAKLAESRSSIDGLVAGQVEKLAEGRDVLRRALEADLAKLAESRSSIDGLVAGQVEKLAEGRDILKRALEADLQKLSESRGDIDGVIAGHVGKLAEGRNMLSRALEDDLGKLAETRKDVDRSLSGHIDQIAARSTDISAAIAADVEKIEQAFSRQTGIIEERAGTMERALSTGVDNVRSVLEKSAVFVAGALREKVLEVTSTLHEQAGAAFSDADRKIAERAEQTSAALLARAEDIARTFEEADRRLHARAEDTSNALLARADDTSSSLLARAHETADQLAARAGEIAGSFELADQKLAARAQDTADQLAARASEIAGTFDAADQKLVARAIETAQSLAARAGDILRNFESADQRLGMRIGESAEALAARATDLGRIFDAADQQLVSRIAEGSDALSNRASEIGRIFDEADQRLVSRIADSSSTIGEHAQSIVGAFASTEQKVADRARQTGQELAVHAREIEQALAGADERLASTAAAAAARVEEQIASVENRLAHTTETMGQRLNEQVSSAEAQLVSRANVIAETFTAVGQHIGQSTNDAAKTIGANTRELNTMLAARSAEMSKILDETARPLVERFAQGGSELQKSMEEVTERATEKLRSENAALVNALANRTAETLSAVEGARSSLSDSVADLIGRMTKSSSQLGQLIEQAAVNLGQVDERLTGSTQSFAATTEKAAQTFASSARLVDSNTTRLTELSSSTLREVASIATKFDEHSRLLASASDLLSSAQSNLEHTLERQSSLEDLAVGLVKKSEDLERVMRSFENLVGQTLQNAEGKTMESADKIRNAITDVVDSATKRFADATDEMRRTASSIKSELDLTRAELKKGVIEMPEEAKESTSAIRRAVSEQINALKELSDIVAKSGRGGGDTSEPRNLRPAPQAQAARPAEPPRRPPAPQPELRTPQPPLGGTALRGTLDLERPAEPRQRPEAGARTPQGGWVRDLLTAASNDADLRPATPPSPPAEAPRAAPAQRSPLHVVESLNSLSVDIARAIDHDASIELWNRYRRGERDVFTRRLYTLKGQQTFDEIRRKYQGEAEFRAAVDRYCDDFEKLLKDVSRNDRDNIMAQTYLTSDTGKVYTMLAHASGRLH

SEQ ID NO: 11842 - protein, 259 aa, Mesorhizobium loti
MDLGIRGKKAIVCASSKGLGKGCAMALAEAGCDIVVNGRNAELVAKTAAELRERFDVTVTEVVGDVSKPDVQKALLAACPEPDILVNNNGGPPLRDFRELDRAKILEGVTQNMVTPIELVQAVLDGMAKRGFGRIVNITSLSVYVPIPGLDLSSGARAGLTSFLAGVARTVIDRNVTINSLLPGKLDTDRLRGPHEAGTSEAPAAAAARKTRISADVPAKRLGTPEEFGQICAFLCSVHAGYLTGQNIPVDGGLYVSAF

SEQ ID NO: 11843 - protein, 457 aa, Mesorhizobium loti
MTVTVRFAPSPTGRIHIGNARTALFNWLFALNNKGRFIQRFDDTDIGRSKQEFADAILYDLHWLGIFPDATEYQSRRFEVYDAAVERLKAAGVLYACYETPEELDLRRKVRRTRGLPPVYGREALALTHEQVAEYQADGRRPHWRFLLPNFTGDPLQPERTEVHWKDLVRGEETVDLASLSDPVLVREDGTYLYTLPSVVDDIEMGVSHVIRGDDHVTNTGVQIALFKALGTEPPVFGHHNLLTTVSGEGLSKRTGALSIESLREDGIEPMAVASLAVLVGTSENVAAAHDLTELAGHFDPAATSKSSAKFDPDELFVLNRVLMHHMPFDEARDRLMVLGISGEQAEPFWLAVRGNLDRLADAVGWWRILREGPQDRPEFSDDDRDFLGQAFEVLPEEPWNGTVWKDWTGKIREATGRKGKGLFMPLRLALTGLPSGPELADLLPLMGREGTLARRP

SEQ ID NO: 11844 - protein, 601 aa, Mesorhizobium loti
MAHFKIDLRASAFRSVLGFTLTHWRRQPWRLSLIMGGFLLSTLADVLTPLYSGRLVDAVASSAGANAVAWNAAMTAFSILMALALTGVVLRNLAFMGIVELTLKMMADIAADAFHRVQRFSTDWHANSFAGSTVRKVTRGMWALDLLNDTILIALLPSVVMLVGSTLLLGWFWPLMGVVVAAGSVLFIMVTAMLSLGYVAPAARLANTWDTRLGGSLADAVSCNAVVKGFGAEEREERRLAKVVAKWRARTRRTWVRGTINGTTQGALLLVMRAAVIGLSLLLWSWGQASAGDVAFVLTSFFVLQGYLRDIGTHIRNLQRSINDMEELVDFQSEPLGIEDRPGARPIRITQGSISFDRVTFHYGNHRSPLYRDFSVDIAPGERVGLVGHSGSGKTTFVKLIQRLYDVNAGRILVDGQDISQVAQASLRGQIAIVQQEPILFHRSLAENIAYARPSATQEEIEHAARLASAHDFISSLPKGYGTLVGERGVKLSGGERQRVAIARAFLADARILILDEATSSLDSESEVLIQQAMERLMVGRTTLVIAHRLSTVRALDRLLVFDRGNIVEEGSHDELIRLKGGIYRRLFERQALELTKGLVI

SEQ ID NO: 11845 - protein, 457 aa, Mesorhizobium loti
MTKWSPNSWRAKPIKQVPAYPDLAALKNTEAQLATFPPLVFAGEARKLKKQLAAVAAGEAFLLQGGDCAESFAEHGADNIRDFFRVFLQMSVVLTFAGAQPVVKVGRVAGQFAKPRSSDNETKGEVTLPSYRGDIINGIEFDAKSRIPDPARQEMAYRQSAATLNLLRAFAQGGYANLENVHSWMLGFVSDSPQGEKYESLANRITETMDFMKAVGITSETNYALRETDFYTSHEALLLGYEEALTRVDSTSGDWYATSGHMIWIGDRTRQPDHAHVEYCRGIKNPLGLKCGPSLTADGLLELIDLLNPENEPGRLTLIARFGSDKVADHLPKLVRAVQKEGRSVVWSSDPMHGNTIEAAGYKTRPFDRILKEVQTFFEVHRAEGTHPGGIHVEMTGKNVTECTGGARAITAEELQDRYHTHCDPRLNADQAIELAFLVSDLLKKSHPVQHRQAVNG

SEQ ID NO: 11846 - protein, 607 aa, Mesorhizobium loti
MCGIVGIVGHSQVAPLIVDALKRLEYRGYDSAGVATIEHGELARRRAEGKLINLERRLKEEPLDGTIGIGHTRWATHGVPNETNAHPHFSDGVAIVHNGIIENFAELRDELVRDGYAFSSQTDTEVVAHLVARELAKGLKPVEAAHQALKRLEGAFALAIMFKGDEDLIVGARNGPPLAVGHGDGEMFLGSDAIALAPFTNSITYLEDGDWAVVRRDSVAIFDIDGKKVERKRQQSLSTSFMVDKGNRRHFMEKEIHEQPEVISHTLAHYVDFVSGVSKPLDLPFDFAKIGRLAISACGTAYLAGLIGKYWFERYARLPVDIDVASEFRYREMPLSANDAAFFISQSGETADTLASLRYCRKAGMKIGAVVNVRESTMARESDVVLPTLAGPEIGVASTKAFTCQLSVLASLAVRAGVARGVISQEQEKTLVRALSEAPRYANQVLKLEEQIERIARELSRYKDVLYLGRDTNFPLAMEGALKLKEISYIHAEGYAAGELKHGPIALIDENMPVIVIAPHDRIFEKTVSNMQEVAARGGKIILITDSKGAAQVSVKTMETIILPDVPEIISPIIYALPIQMLAYFAAVFMGTDVDQPRNLAKSVTVE

SEQ ID NO: 11847 - protein, 670 aa, Mesorhizobium loti
MFTKILIANRGEIACRVIKTARKMGIATVAVYSDADRDAVHVEMADEAVHIGPSPAAQSYLVPEKIIAACKETGAQAVHPGYGFLSERAAFCEALEKEGIVFIGPKPKAIKAMGDKIESKKFANAAKVSTVPGWLGVIENADHAEKIAGEIGYPVMIKASAGGGGKGMRIAWNQSEVRDGFDRARSEAKSSFGDDRVFIEKFVVDPRHIEIQVLADAHGNALYLGERECSIQRRNQKVAEEAPSPFLDAKTRKAMGEQSVALARAVDYQSAGTVEFIVDKDKNFYFLEMNTRLQVEHPVTELVTGIDLVEQMIRVAAGEKLSLKQSDIKLNGWAVESRLYAEDPYRNFLPSIGRLTRYRPPEEGQFGDVVIRNDTGVTEGSEISMFYDPMLAKLCTWAPTRIEAIDAMSEVLDSFVVDGIEHNIPFLAALMQHPRWREGAISTGFIAEEYPDGFAPVVPNSREKAVLASIVTAVELLRRDRLDRLGGRLAPHSGVLKRDWVVRLGDDYLQASILEGMISIPMEIDLSIDGGKALTVSSDWRPGDLIWRGTVGKRSVVAQIRPVANGLRIAWKGMSVTARAMLPRIAELERLMPEKVAPDTSKLLLCPMPGLVVSIAVTEGQEVKAGETLAVVEAMKMENVLRAERDLVVSKLNAKPGDSLAVDAVIMEFA

SEQ ID NO: 11848 - protein, 375 aa, Mesorhizobium loti
MKTRAAVAVAAGKPLEIMEVDLDGPREGEVLVEIKATGICHTDEFTLSGADPEGLFPAILGHEGAGVVVDVGKGVTSVKKGDHVIPLYTPECRQCPSCLSRKTNLCTAIRATQGQGLMPDGSSRFSIGKDKIFHYMGCSTFSNFTVLPEIALAKVNPDAPFDKICYIGCGVTTGIGAVINTAKVEQGATAVVFGLGGIGLNVIQGLKLAGADMIIGVDLNNDKKAWGERFGMTHFVNPKEIDGDIVPHLVNMTKRGADQIGGADYTFDCTGNTKVMRQALEASHRGWGKSVVIGVAGAGQEISTRPFQLVTGRTWMGTAFGGARGRTDVPRIVDWYMDGKIQIDPMITHLLKLEDINKGFDLMHEGKSIRSVVVY

SEQ ID NO: 11849 - protein, 125 aa, Mesorhizobium loti
MNLMAKTYFTSDHEWLRVEGGIATVGITDYAQEQLGDLVFVELPETGKKLTKGDTAVVVESVKAASDVYAPVDGEITEANGTLSSDPSLVNSAATGAGWLWKMRLADESQLAGLMDEAAYKAHIA

SEQ ID NO: 11850 - protein, 197 aa, Mesorhizobium loti
MEKPVTDRPSEAEVEAAVRTLLRWTGDNPDREGLIDTPKRVAKAFREMFGGYDMCPAEELGRTFEEVAGYDDLVIVKDIHFHSHCEHHMVPIIGKAHVGYLPDGKVVGLSKIARVVDIFAHRLQTQEALTAQIAGVIQDVLNPRGVAVMIEAEHMCMAMRGIRKQGSTTLTSTFTGVFKDTPEEQVRFVTMVRGGGA

SEQ ID NO: 11851 - protein, 437 aa, Mesorhizobium loti
MAEALRVGIAGLGTVGAAVARVLRDKAAELTRQCGRDIVVSAVSARDPKRDRGVDVSAAKWFDDPVKMAQSAEIDVFIELIGGDEGPARLSVKAALEAGRHVVTANKALLAKHGVALAEIAEKKGVLLNYEAAVAGGIPVIKTMREAMAGNSVTRVFGILNGTCNYILTRMEAEGISFDACLKDAQRLGYAEADPTFDIEGHDTAHKLSILTSLAFGTKIAANDIYMEGISNITQADIRAAGDLGYRIKLLGVAQRTDSGIEQRVHPTMVPTASVIAQVHGVTNAVAIETDILGELLLSGPGAGGNATASAVIGDIADIAKSRPGFQHGPVFGLPAKELRPYKKAQMRSHAGGYFIRLTVHDRIGVFAAIAKRMADNDISLESIVQHAVNGEAAAQKTVILVTHETTEAAVRKAVDGITKDGHLTDKPQVIRIERAG

SEQ ID NO: 11852 - protein, 403 aa, Mesorhizobium loti
MEEFHKVRRLPPYVFEQVNRLKASARSRGADIIDLGMGNPDLPTPKAIVDKLCEVVRDPRTHRYSSSRGIPGLRRAQAAYYQRRFGVKLNPDTQVVATLGSKEGFANMAQAITAPGDVILCPNPTYPIHAFGFIMSGGVIRSLQVEPDDGFIPALERGVRHSIPKPLALILNYPSNPTALVASLDFYKDVVAFAKKNDIIILSDLAYSEIYFDGNPPPSVLQVPGAIDVCVEFTSMSKTFSMPGWRMGFAVGNERLISALTRVKSYLDYGAFTPIQVAAAHALNGDEIAEVREVYHKRRDVMVDSFGRAGWNIPAPAASMFAWAPIPEPFKHLGSLEFSKLLIEHADVAVAPGVGFGEHGDDFVRLALVENEHRIRQAARNIKRFLSTSAKQPNNVVPLSAHR

SEQ ID NO: 11853 - protein, 537 aa, Mesorhizobium loti
MWDYIIVGAGSAGCVLANRLSEDPDVKVLLLEAGSRDWNPMIHIPGGIGKLFGPGVNWRFHTVPQKNLDNRSIWYPQGKTLGGSSSINAMIYIRCQKEDYDNWAALGNDGWAYEDVLPYFRKSEDNDRLANRYHGLGGPLAVSDQVGPHPLTRAFVRAVQQYGLPFNPDFNGDTMYGAGFYQVTCRDGRRRSSAVSYLHPVSRRPNLTVRTHARVTRIVVENGRAVGVELSEGKSRKVLRAESEVIVSAGAINSPRLLMLSGIGPADKLQALGIAPVADLSGVGRNLQDHLCTNVHLTLKDPISYDGQDRYPKALLHGIRWLLYRNGPAASVIVEGGGFFQSEGAKRPDLQIHIAPAMVVRGGQTRLDGHGFTINSTFLRPRSIGSVEVRSSNPADEPLVDPNYLSDPYDRGMALKSVRIIRDVLAQSEIAKFVKVERLPGPAAKTDEELMAYIRQYACCDYHPVGTCKMGVDETAVVDPELRVRGVDGLRVIDSSIMPVLISGNTNGPTMMIGEKGADLVKGVQSGRSAQAIAAVA

SEQ ID NO: 11854 - protein, 321 aa, Mesorhizobium loti
MMSDKKPFAAHGVIPACLMPFTADLAVDESAYRKHLADVSSVEGISGITINGHAAEVHALTIDEQYRAIVVAKDVLQDQVPTIVGVYTNSSLEAARIAAYAEQEGADALLVFPPDFMTLGGHLRPEMIVEHLKRITDASNLPIILFQYPLASNLAYPLQTLLDLCRRFPSIVAIKDQCGDGNLHERQIRELKALDRPVNTLTTHSAWLLGSLTLGCDGLLSGAGSVIASLQVALYRAVQANNLKTAKAINDRIYPTVRAFYDAPLLDMHNRMKEALVLLGRLDEAHVRPPLMKPDPAEIEKIRGLLNAAGLSAETLYRKVA

SEQ ID NO: 11855 - protein, 495 aa, Mesorhizobium loti
MAVRNDVSTRSYQQFIGGRFVDGSGSGSIERRSPATGDLVARYADGTPEDVDLAVEAARIAFEDGPWPRMSGMERAEVLNRLADLIRTNRDRLVRIEVEEVGKPVRFARGDIDGAAGLTRYAASLAMQMAGLTYTNIGDGKTALISREAVGVVALVTPWNFPALILSQKVPFALAAGCTVVLKPSEFTPGSAFEIAALAAEAGVPAGAFNVVSGYGATAGDHLTGHMGIDFVSFTGSTRTGSRVVGNTSRHLVKSSVELGGKSANIVFADADLEAAADGALMGVFFNNGECCVSGSRLFVQSSIADDFIAKVIARSRKMKVGDPFDDDTDVGALIDRNHLAKVTGFVKSGIEEGAQLVLGGNVAAGAVGHFHEATIFDRVEPHMTIFREEIFGPVLSITRFDTVDDAVRLANDTAYGLSNYIWSKNIDTVLTVAKRLKSGWVQANTIIDGAPQLPLTGVKGSGFGYEMGQAGFEEFTQLKTLLIQTGPRAPVFPV

SEQ ID NO: 11856 - protein, 276 aa, Mesorhizobium loti
MLEQVSPAAIGAAMPEKAASINRGLAIVTGGRRGIGRAICCELAQAGFDIAVIDIVDDENASETVNLVRRHGRNAAFYRKDISETSDNTALIERIEADLGGATCLVNNAGVQVSVRGDLLDVSEESFDRLVGINLRGTFFFTQAVARAMISRPHVRLERSVVTITSANAGLVSPEKGPYCISKAGLSMASQQFAIRLADTGIRVHEIRPGLIQTDMTADVYEKYSAQVEAGQLSAIRRWGQPEDIARGVATLAVGGMPFSTGDIYHIGGGMQMHRL

SEQ ID NO: 11857 - protein, 315 aa, Mesorhizobium loti
MANVAIVGSGFIGRAWAISFARAGHDVRMWDQSPAATGGARDYIEGVLGDLAANDLLRGQSVDTVLGRIATVGDLAEALADAAHVQENTPENLDVKREVFSLIDRLAGPQTIIASSTSALLPSKFTDHLQGRHRCLVVHPINPPYLIPAAEVVPAPWTSAETLEKTRAFLIDAGHAPLVMRRELDGFIMNRLQGALLEEAFRLVADGYASVEDVDIGIRDGLALRWSFMGPFETIDLNAPGGVRDYVDRYQGIYSNIFPQMLRRVDWAGEVMATVEAERSKRLPRGSLGDRQVWRDRRLMALAAHKKKSDQEFGQ

SEQ ID NO: 11858 - protein, 264 aa, Mesorhizobium loti
MKIVTWNINGVRARIGNLTHWLTESAPDIVCLQEIKTVDEQFPRAEIEALGYNVETNGQKGFNGVALLSKLRFDEVIRGLPGDDTDEQARFIEGVFSTDKGALRVASLYLPNGNPIDDEKKFPYKLNWMARLERWAEERLKLEEALVLAGDYNVIPEPIDARFPENWLGDALFQPQTRQAFRRLLNLGFTEAVRAVTDAPDTYTFWDYQAGAWQKNNGIRIDHLLLSPEAANRFSSASIEKHVRAWEKPSDHVPVAIDLALQPA

SEQ ID NO: 11859 - protein, 216 aa, Mesorhizobium loti
MSDIVLHNYYRSSTSYRVRIALEMKGLSYDYVPHHLRHGEHLEPAYLAVNPQGLVPALVLDDGTLLTQSLAIIEYLDEIHPAPPLLPKDPLGRARVRMLAQMIACDIHPVNNLRVLTSLRTLFGAGDQDITNWFRHWVNEGFQPLEKILASSPQTGTFCHGEAAGLADICLAAQITSNARFGVDLTPYPTITRINAACMALPAFQKAAPQNQMDAE

SEQ ID NO: 11860 - protein, 346 aa, Mesorhizobium loti
MKAVVFEKFGEAPTIQTVPDPKPAADGVVIKVEATGLCRSDWHGWMGHDDGITLPHVPGHELAGVVVAAGKQVSRWKAGDRVTVPFAVGCGRCFECSSGNHQVCEHQTQPGFTGWGSFAEYVGIEHADTNLVRLPDEMEYATAASLGCRFVTSFRAIVDQGRVKPGEWVAVHGCGGVGLSAIMIASSMGANVIAIDLTDEKLEFARKIGAVATINASTTPNVVKAVKQIANGGAHMSMDALGHPTTSFNSIANLRRRGRHVQVGLMLGEHARPQVPMDKIIAFELEILGSHGMQAYRYQAMMDMIRNGKLKPELLVGKKISLDEAPAALMAMGGFEGIGIGVVTKF

SEQ ID NO: 11861 - protein, 1217 aa, Mesorhizobium loti
MTAGPLPDARSTGPAMPLDTIRQQIRANYLPDEDEAVKRLAEATGLSAADRDAISARAADLVRAVRGSSDPRLMEVFLSAYGLSTKEGVALMCLAEALLRVPDTETMDDLIADKIAPHDWSAHSGGSSSIFVNASTWALMLTGRVLDEGEGGIEGTLRSMVRRLGEPVIRKAVAAAMREMGEQFVLGRTIAEAVKRGRPMTQKGYLYSFDMLGEAARTEADALRYHKAYADAISSLDAGSNGPDIRQNHGISVKLSALHPRYEVAQKEEMLPVMAERLLSLALAARHSRMGLNIDAEEADRLDLSLDVIERVLAEPELAGWNGFGVVVQAYGPRAAFVIDWLYALARKYDRTIMVRLVKGAYWDTEIKRAQTLGLAGYPVFTRKANTDVSYMACAKKLLGMTDRIYPQFATHNAHTVAAILSMATNRDSFEFQRLHGMGEALHETVRQAEGTRCRIYAPVGAHSDLLAYLVRRLLENGANSSFVHQLTDEDVEPEDIARDPLETVESQGPAANPAIARPSQIFGAGRRNSRGFDITDTVTLAAIDKARAAFAGPDRWHAKPITRAAGYGKPHPVVNPAKPDEVVGTVHEAAAKQVAIAVRIAVEAQPAWAKRPVGERAAILNRAADLYEANAVEFFALATREAGKSLADGVAEVREAVDFLRYYAAEAANAETGTQARGAIVCISPWNFPLAIFTGQIAAALVTGNSVIAKPAEQTPLIAFRAVELLREAGVPEDIIQLLPGDGPSVGGPLTADPRIAGVCFTGSTEVAKLIEKQLAETAAPDAMLIAETGGLNAMIVDSTALPEQAVRDILASAFQSAGQRCSALRVLYVQKDVEKKMLDMLKGAMEALNIGDPWRISTDVGPVIDDEAQASIRDYCTRKGLEGRLIAKLEAPKDGRFVAPHVFRVKGIEEMEREVFGPVLHVASFDADEIDAVIAAINRKGYGLTFGLHTRIEGRVQHFVDGIHAGNIYVNRNQIGAVVGSQPFGGEGLSGTGPKAGGPHYLRRFRKGPEAGTEVGEGHKVTATELADNLPDPALGGWSTRPDRIAILRKHLRGKGAAAIGAAAAIDFGQVDLPGPTGEANTLSLSPRGRVLCLGPDAETLLAQTIQALAAGNAVLAVAPGAPAALSALTGKGLPLAAIDGRPDPVEARALRVDVVAFSGTPEAARIVRQVIADRTGPIVPLVSEVLNPAAYAHERAVCVDTTAAGGNASLLAAA

SEQ ID NO: 11862 - protein, 306 aa, Mesorhizobium loti
MAGNGVASIGECMLELSGQTGPNWCMGFAGDTFNTLWALHALSEDRPATYVSAFGDDPFSQGQIGFFAENGIGIGSSPVIPGARPGLYAITLTGAERSFTYWRGDAAARQLASDPAALSKNLENQALVYFSGITLAILDDASRKTLLEAVTKARAAGSLIAFDPNYRPRLWRNRESAQAAIVEALGVTDVALPTFPDEQMLFGDETPRATAERLGQWVGEVIVKNGEQPALIAESGTLHDVPAIHVAAPVDTTGAGDSFNGGYLAARLAGHGPQEAASRAHRVAAAVVQVRGALAPFETLRAAFDS

SEQ ID NO: 11863 - protein, 485 aa, Mesorhizobium loti
MLQKTSHFMRQANLINGEWVQADSGQTVDVNNPATGLKIGTVPKSGKAETRRAIEAADAAFKTWRKTTALERSKLLRKLHDAMMDNQDVLAELLTIEQGKSLFESKGEIGSAAAYILWFAEEGRRTYGDVVPSPWADRRILVTKEPVGVIAAITPWNFPSSMLARKLGPALAAGCTAVVKPASQTPYSGLAWGALAEEVGFPKGVVNILTGSASEIGDEICANPLVSKITFTGSTEVGKLLIQKSSVTVKKVSMELGGNAPFIVFDDADIERAVAGAITAKYRNSGQTCVCTNRFLVQAGVYDKFVEKLAAASNGLKVGSGLEEGVQQGPLIDEKAVEKVEELIADATSKGGKIVAGGKRHALGGSFFQPTVIANATPKMRFMKEEIFGPVAPVFKFETEAEAIALANDTEFGLACYFYTGDLGRAFRVMEGLKYGMVGVNEGLITTPEAPFGGVKESGLGKEGGHQGIEDYLDTKYVCIGGLGL

SEQ ID NO: 11864 - protein, 416 aa, Mesorhizobium loti
MGRPVVAVTGIGVVTSLGVGKADNWAALTSGKSGIHPITRFPVDHLNTRISGMVDFLDSSSKGASPLTYELAETAAHEAVAESGLDSSDFGGPLFLASPPVELDWHERFSLYNSDKQDAGAERLLRVARALKELDIFETTQFGSIADRLADRFGTRGLPITLSTACASGATAIQLGVEAIRRGECDRALSIGADGSATAEALIRFSLLSALSTHNDIPEKASKPFSKDRDGFVLAEGSGALVLESLEAALARDATVLGILRGCGEKADDFHRTRSKPDGSPAIAAVRAALADAGLSKDEIDYVNAHGTSTPENDKMEHLSLSTVFGERISSMPVSSNKSMIGHTLSAAGAVEAAFSLMTMREGVIPPTINYDNPDPAIVLDVVPNKKRNAEVRSVLSNSFGFGGQNTCLVMAREPV

SEQ ID NO: 11865 - protein, 342 aa, Mesorhizobium loti
MRALQLIEDRRLETVDLPPPPPPALGEVTLRIRAVALNHIDVWGWRGMAFAKRKLPLVVGAEASGEVEAVGPGVSSLLPGQLVSIYGARTCGLCRACREGRDNLCEHVSGVHGFHLDGFAQEKINLPARLLVPAPPGVSDIGAAVAPVTFGTVEHMLFDNARLQPGETILVHAGGSGIGSAAIQLAKRMGCTIITTVGSNDKIDKAKALGADHVINYREDRFEGVVRKLTKKKGVDVVFEHVGADTFAGSMLCLKRGGRLVTCGSTSGVSTQINLMQLFQQQLKLLGSFGCRMENMANAMQKMAAGQVAPVIDTEVGFDDIDAALKRMEGRDVFGKIILRVA

SEQ ID NO: 11866 - protein, 388 aa, Mesorhizobium loti
MDAAVDASTSQFELNEEQRAIQEMAQAFAADRVAPNALDWDRRKHFPADVIRETGPLGLGGIYVRDDVGGSALGRLDAVLIFEALSHADPGFSSFISIHNMVASMIDRFGNDEQRQRFLPKLTSMEWLASYCLTEPGSGSDAAALKTRAVKSGGDYVLNGAKQFISGAGDSDVYAVMVRTGADGPKGISTIVVPKDAPGLSFGANEHKMGWHMQSTRQVIFEDCKVPAENLLSGEGAGFGIAMAGLDGGRLNIAACSLGGAQSALDKALSYTAERKAFGSKINQFQALQFRLADMETELQAARIFLYAAASKLDRKAPDAGKWSAMAKRFVTDTGFNVANNALQLLGGYGYLHDYGIEKLVRDLRVHQILEGTNEIMRVIIARALIGR

SEQ ID NO: 11867 - protein, 459 aa, Mesorhizobium loti
MTYQNYSLKQLQQIDAAHHLHPFTDHKELREAGSRIITHANGPFIYDSEGTELLDGMAGLWCVNIGYGRDELAEAAYAQMKELPYYNSFFKCSTPTPVLLSKKLAEIAPKNVNQVFYGSSGSEANDTALRLVRHYWVIEGKPEKNRVISRKMAYHGSTIAGTSLGGMDAMHKQLNGAVPNIVHVMMPYAYELALPGESDHDFGLRAAKSVEDAILEAGVDKVAAFIGEPVMGAGGVKIPPASYWPEVQRICRKYDVLLMLDEVITGYGRTGEWFAAQTFGIEPDTITTAKALTSGYQPLSALLVGDRITSTLVEKGGEFNHGYTYSGHPVACAVALKNLEIIEQEGLVDRVRNDTGPYFAKALQECIAGHDLVGEVRSIGLMGAIEIVKDKATKERFLPSGSAAVTVRDHAIANGMMLRATGDTMILSPPLIWTRDTIDMACERIGKALDLAQADLRKR

SEQ ID NO: 11868 - protein, 340 aa, Mesorhizobium loti
MTTTNPIDALLAEKGVLLADGATGTNLFAMGLEAGEAPELLNETAPDTITNLHQNFVDAGADIILTNSFGGTRHRLKLHHAQDRVHALNKRAAEIARAVADKAGRKVIVAGSVGPTGELLVPLGAMTYDEAVDAFAEQIEGLKQGGAEVAWIETMSAPDEIRAAAEAAIRVGLPYTYTGSFDTAGRTMMGLLPKEIHGVVDGLSEAPLGVGANCGVGASDILASLLDMTEAKPQATVIVKGNCGIPEFRGTEIHYSGTPELMADYVRLAVDAGAKIVGGCCGTSFQHLAAMRKALDAHTKAGRPTVETIVERIGPMRNKVATENTAETSEARRERRRSRA

SEQ ID NO: 11869 - protein, 249 aa, Mesorhizobium loti
MEQAMTKQDLRIKTRDGVAKAGLFRSAKTSSARAGVILYQDAFGPRPALDGIAERLAGEGYAVLVPDLFYRNAPYGPFDAKTAFTEENSKAALMALVTGTTQQMTISDGEAFLDALAGEGVRGLIGTVGYCMGGARALNAAAAYPERIRAAASFHGGNLASDAADSPHRKAASIKARVYVGMAGVDRSFPPEQSTRLEEALRNAEVDHTIENYVGMAHGWCVPDHSVYNQAGAERHWQRLITLFAETLG

SEQ ID NO: 11870 - protein, 490 aa, Mesorhizobium loti
MTVMAKPEQTNARTLVSAPALSPAAIAKPDLISVEQAKAMDVAGMTDLFKAHLNPGQLHFMKLLGFHKIKIERAEGMFYIDQNGRKILDFFGGFGSLAFGHNHPRILDARKKFQEEKRQEIAIAFMSQYAAALAHNLAKCSPGDLDMVFLGSSGSEAMEAAVKLAERAAGPKRPKVVYAENSFHGKTKGVLGITDGQLYRADFKVADNTVRIPFGDIEAVERLFRSDPEVGVIVLETIQGGGGIIQAEAQYWQKLRALCDQYGVLWVADEVQCGYGRSGRFYAFEHYGVVPDVTALAKSLGGGKAAVGAMIARREIYMKAYGTPKTAMIHAMATFGGMGEACVTSIEALNVLYDEGLIDNAAVTGDYLLQRLRALKEKYPKIIKDVRGKGLMVGLEFHDFSQTLPMVLRPIVSVLDDKLKGSLSGFVGALLLRDYDVLVAFTEYNRNVIRLEPPLICQREHVDRFVDAFDSLLSRGIVSIVKDFVKSQVR

SEQ ID NO: 11871 - protein, 301 aa, Mesorhizobium loti
MKNVILTDGGMGQELVRRSKSEPTPLWSARVLIDEPDLVRDLHAEFIRAGARVITINTYSATPERLAREGAEDLFKPLQKRGIELARQACDEAGEAAIAGCLSPLFGSYAPALTISYQETLDIYRRIVAEQADGVDLFLCETMASSDEARAAVTAASESGKPVWVSWTLADHGTPRLRSGETIAAAASALDGLPIAARLLNCCRPETIAAALPELIDLGGPVGAYANGFTSTEALKHGGTVDVLHARHDLAPDAYAEQAIGWVEAGADIVGGCCEVGPPHIAALRDRLQQDSYEISGVLHA

SEQ ID NO: 11872 - protein, 393 aa, Mesorhizobium loti
MPRPSSRISGIVPSGKDGWEVHFAAWTRKEAGEDIIMLSVGDHDFDTPSQTIEACVTAVRGSNHHYTPLPGLPRLRQAMAAASSACTGIETTPDQVIATPGGQAALYAAVQAVLDQGDHAIVVAPYYATYPNTFSAAGASFTVVETPAEDGFQPRADMIRAALRPNTRAILINTPNNPTGAVYSRERLEQLAQICREHDLWLLSDEVYWTLGGGEHVSPRSLPGMAERTLVINSMSKSHGMTGWRMGWLTGPQDMITLLINLNLVTTYGLPAFISIACAEALENRYGVKEIAERYAARRTVLLDAVRGMNNVSVRGSEGGMYVMLDISDVEPDDEKFAWALLDQEKVGVMPGSSFGEAAAGHIRISLCQPEPVLQEAAARLRRFASTYRREAA

SEQ ID NO: 11873 - protein, 348 aa, Mesorhizobium loti
MKLLEGAVDHGGSLGRARALFPNALQPFVDLSTGINPHSYPLFELPATSLWRLPEAARARELTEIAAGTYGAPSPANVVAAPGTQILLPRVASLVRPGKALVLGPTYAEHARAAAIAGHQVTEVSDFAALADADLAIIVNPNNPDGRVIERDRLLALAAGLRARGGLLVVDEAFMDVGPREHSLAGDVDQRGLVVLRSFGKFFGLAGLRLGFALSDAATVGWLETQFGPWAVAGPALDYGIRALADIGWQDAMRASLAEGAARLDALFGRFGVPVAGGTTLFRYFSLPDAASLFSALGKRGVLLRHFCDRPHVLRAGLPGCQEEWRRLESALAEWATRREDRQKGSKQ

SEQ ID NO: 11874 - protein, 394 aa, Mesorhizobium loti
MDIHEYQAKELLARHGVHVPRGGLAYSPEQATYRAREIGGGKWVLKAQVHSGARGKAGGIKLCANDEEISSAAEAMLGRKLVTQQTGPRGKLISRLYLEEAVDIAQELYVGFVLDRKEERVMIVASAAGGMEIEDIVEKEPNSILRTSVDPGVGMQRFQAREIAFGLGLDHNLIGKATETIFSCYQVFRDYDASMLEINPLVVTRDGNLIALDAKMSFDENALFRRPEISELRDKSQEDPRETFASDRGLSYVGLDGNIGCIINGAGLAMATMDMIKIAGGEPANFLDIGGGASPERVAKSFRAVLGDKNVETILVNIFAGINRCDWVAEGVIKAIREVGVNVPLVVRLSGTKAEEGRRILADSGEAVIVADTLAEAAEKAVAAWRAAAKKKAA

SEQ ID NO: 11875 - protein, 299 aa, Mesorhizobium loti
MAILLNRSTRVIVQGFTGKIGSFHAEDMKRYGTKLVGGVTPGKGGQTHLGLPVFNTVKGAVRETRAEASIVFVPPPFAADSIMEAADAGIKLCVCITDGIPSQDMMQVKRYMRRYRFEDRMRLIGPNCAGMITPGQALMGIMPGSIYLPGRVGIVGRSGTLGYEAASQMKALGIGVSTSVGIGGDPINGSSFKDILKLFEQDDETDAVVMIGEIGGPQEAEAAIWARDNMRKPLIAYIAGLSAPKGRRMGHAGAIISAFGESAQEKVEILKEAGVIIVPTPSSFGEVVADTLARMKKAA

SEQ ID NO: 11876 - protein, 693 aa, Mesorhizobium loti
MAKLKVDGKEITVPDHYTLLQAAEDAGAEVPRFCFHERLSIAGNCRMCLIEVKGGPPKPQASCAMGVRDLRPGPNGEPPEIFTNTPMVKKAREGVMEFLLINHPLDCPICDQGGECDLQDQAMAFGVDSSRYHENKRAVEDKYIGPLVKTVMNRCIHCTRCVRFTTEVAGISELGLIGRGEDAEITTYLEQAMTSELQGNVIDLCPVGALTSKPFAFQARPWELTKTESIDVMDAVGSAIRIDSRGREVMRILPRVNEQVNEEWISDKTRFIWDGLRTQRLDRPYVRKDGRLVAASWAEAFATIKDAVSKTTPEKIGAIAGDLAAVEEIYALKLLMASLGSKNVDCRQDGAALDPELGRASYIFNPTIEGIEQADAVLIIGANPRFEASVLNARIRKRWRVGNLPVGVIGDVGDTRYEYELLGAGPDSLKDLADGNGKFFQTLKKATHPLIIVGQGALARADGAAVLGQAAKLATAVNAARADWNGFAVLHNAAARVGGLDLGFVPGEGGKDVAGMLGETDVLFLLGADEIDMGKTGGAFVVYIGTHGDHGAHRANVILPAAAYTEKSGTYVNTEGRVQQTNRAGFAPGDAREDWAILRALSDVLGKKLPFDSLPQLRAKLYGEYPHLARIDQVAAGNAEDIAGVAKLGGRLNKGTFTSPVKDFYLTNPIARASAVMAECSALAKSGFKQAAE

SEQ ID NO: 11877 - protein, 1126 aa, Mesorhizobium loti
MHILTTTSASLDDLAEPVDLRQTPADIVALSFTDSDLAGLAAAWKADASRLPSMRLAALRDLRHPMSVDLWVDSVARRAKIILVRILGGYDWWRYGCDQLASTARERGIQLALLPGESHDEDLRLIEASTLPRQELDALLGYFREGGPANMGALVQRLARLAGQDAAVVEPVAVPKAGYYQPGRGVVPLPLEREGKVAPILFYRSMLLAADVAPIDVLFDALRQRGMTPVPIFVSSLKDPTSLAFAETALATLRPAAIITATAFASGAEPGVETLFDRAGVPVFQVIVATTRRDVWENNQRGLAPADLAMHVVLPELDGRILAGAISFKGESDVDPALGHRAFANRPEPDRVAQVADRVAAFIKLQETPRAERKLAVLIPDYPSAPGRTGYAVGLDVPSSVLAMLHDLKEQGYGVEGIPQSPRALLDLLERGGDGLGLEDYVGLSKELPAEVMTAVEAAWGKAEEETGLREGGASHKPSLSSKKHFPFRATTFGNITVALAPDRGRSADRRADYHDPTLAPRHALLAFGLWLRKSLGVHALIHVGAHGTLEWLPGKTVALSQTCFPEIVTGALPVIYPFIVSNPGEAAQAKRRIAAVTLGHLPPPLTGAGLDENQHKLERLVDEYAQADGLDRRRRDRLARLIVDTAQKTGLAAEAGVARTDAPDEALRRIDAWLCDLKDFAIKDGLHIYGRAPDDESDAMRRQSAEAEKAALLAALDGRHVKAGPAGAPARGRSDVLPTGRNLFTSDPRTMPTPTAYDLGKAAAEEVVRGYLQSHGDWPRSLVIDLWGSASLRTGGEEIAQGLALMGCRPQWDAATGRITGIEVLPPATLGRPRVDVTWRISGLFRDMFPTQIALIDAAANAVAARDEEDSENPLAARTRADGKISPRIFGTSPGTYGAGVEDLLSSGDWAAREEIGRAYLDATSHAYGGAGGEGISAPGAFETRIAEADLLVHTGDDPGRDILEGSADVAFIGGFSAALAALGRNADVIVLDTTDPQKPKPRSVSEAVSRVVRARAINPRFISGQMRHGPRGASEFAETVDRLVGFAETTHAISGALIEAVHDAYVGDADVRAFILRENPAAAKVIAERFLSARRRGLWHPLRNSIDDDLAALIAEAEALGVAA

SEQ ID NO: 11878 - protein, 498 aa, Mesorhizobium loti
MNAFSRRGACPALSAPMQTGDGLLVRLNAVYVGLSPKLSIGLAESALRHGNGIMEVTARGSLQIRGLTRESAALLAAEVDALGIAVRTGVPVETGPLAGIDPREIADPRPLAERIRAAVEEAGLTPRLGPKVSVVVDGGGQLTLDAVTADVRLKALRSGAGVRWQVSVAGDGQSARLLVAAEDHAARDVTVAVLRMVAEKGREAHARDLSERQLVSLAGWHSVAPPSVLPDISPTRGEISSFAAGSLSETMPHVSAPGVGETGGAGIISPLVGEMSGRTEGGASRKPIGLFPIAGDTFTLGIGLPYGSMPADKIIDLAQSAVTLGTSEIRLAPGRALLFLGQPSAANQSLQTIAAALGFVTSPSDPRTRIAACPGTPACASGRIATRTIAETIAAENADTLDFTLHISGCAKGCAHPGPAALTIVGGENGAGLVVNATAKALPAGYRPGYDAARGIGRVAAVIRSARFQGETAAACLTRLGPAAIAEAYRQAQTKKRK

SEQ ID NO: 11879 - protein, 297 aa, Mesorhizobium loti
MTETLLVTGAAGQLGRGVIRYLMDTHKVPPAKIIATTRNPENVADLAARGVVVRAADFNDATSLENAFKGADRVLIISTSDLDLKTGRRLKQHEAAVAAAKKAGVSHLLYTSMPNPEPVSPVLFAGDHYGTEQAIKASGIAYTIFRNGWYQENLFIALPHAIASGQWYTSAGDGRIAHGSRDDMAAAIAAGLASGSTDSKTYTLTGPQAYTTAEIAALVSEVTGKPLEVIQLPDEALTEGVKAAGVPEEFARVIVSFDANTRSGRIAMATDAVETLSGRKPRTLKQFLEANKAALAG

SEQ ID NO: 11880 - protein, 593 aa, Mesorhizobium loti
MSNGQSERREMTGAEMVVQALKDNGVKHVFGYPGGAVLPIYDEIFQQDDVEHILVRHEQGAGHAAEGYARSTGKAGVMLVTSGPGATNAVTPLQDALMDSIPLVCLTGQVPTSLIGSDAFQECDTVGITRPCTKHNWLVKDVNELAATIHEAFHVATTGRPGPVVVDIPKDVQFAKGFYVPPQIAPRTSYQPKVQGDLEKIKAAVELMASAKKPIIYSGGGVINSGPEASHLLRELVDLTGFPITSTLMGLGAYPASGKNWVGMLGMHGTYEANMAMHDCDVMICIGARFDDRITGRLNAFSPNSKKIHIDIDPSSINKNVHTEVPIIGDVGRVLEDMVRLWRATAKADKKALYPWWEQIAKWRGRDSLAYKMNHDVIMPQYAIQRLYELTKDKDTYITTEVGQHQMWAAQHYHFEKPNRWMTSGGLGTMGYGLPAALGVQIAHPDALVIDIAGDASVQMTMQEMSAAVQYKAPIKIFILNNQYMGMVRQWQQLLHGNRLSHSYTEAMPDFVKLAEAYGGHGIRCEKPDELDDAIKEMISVRKPVLFDCRVANLANCFPMIPSGKAHNEMLLPDEATDEAVANAIDAKGRELV

SEQ ID NO: 11881 - protein, 172 aa, Mesorhizobium loti
MHVAIYVAIAENGVIGRDGGLPWRLSTDLKRFKADTMGKPIIMGRKTYEGIGRPLPGRLNFVVTRDKTWRAEGVEVAHTLEAAIQLATVRVRCMSGVDEACIIGGGEIYAQALPLADRLHVTHVLAAVDGDAHFPPIDAETWRMVSSQEVPAGEKDSHATRYSVYERRRQIL

SEQ ID NO: 11882 - protein, 575 aa, Mesorhizobium loti
MDFGGVDGETALFHIVQPHAHRLEGLVRAAVEQHVVIGHVEMAVVVDPVLLDVHGLGDEGGGDGHGNFLVLVLDTAWWVRLRIHNRITSVDAGPFAEEFMALSDLNPVERNEEGIAAVLGILKQQLGERFQTGQAIRAQHAHTTTYIPTQAPDGVAFPETTAEVQEIVRACAAHRVPVIAFGVGSSLEGHTNAPGGGISVDTSRMNRILAVNPQDLDCTVEPGVTREDLNRHLRDTGLFFPIDPGANASLGGMAATRASGTNAVRYGTMRENVLSLTAVMADGETVTTGKRAKKSSAGYDLTRLLVGSEGTLGIITSLTLKLQGIPQAISGGVCPFPSVEAACNAVIATIQMGIPVARIELVNALQMRAMKNYSKLDYPESPCLFVEFHGSDAGVAEQAETFGMIAEENGGGPFLWTSVAEERTKLWKARHDAYWASLTLRPGAKGLSTDVCVPISRFAECVTETEADIAEMGLIAPIVGHAGDGNFHVLVLMDVNDPKEIALSEKFVARLNLRAIAMDGTCTGEHGIGQGKIGFLRPELGHGVDIMRSIKQALDPQNIMNPGKILPAVGWIGRG

SEQ ID NO: 11883 - protein, 785 aa, Mesorhizobium loti
MAARARNSRRSIILAVTITSFVLFLLGLALGGGGIWLASLGGSWYYIVVGLAFLIAAWLLYRRRSTALWLYAAIVLGTLAWAVWEIGFDWWELGPRGGIIVLVGLWLLTPWARRGLAGPDGRAPLILAVLASLAVAGYSMTADPKGIDGALDTDKVIPKANLGNDVPAGEWHYYGRTQFGQRYSPLDQITPDNVANLQPAWTYRTGDVKGPDDIGETTYQVTPLKIGDTLYICTPHNFAIAVDAATGKEKWRYDPKIKLDKDRQHQTCRGVSYYADTAIAAGQPCATRIYLPTSDARLIALDAASGQVCPAFAEGGTLNLLTNMPYPKSGYYYSTSAPLISGSKIIVGGAVNDNYSTQEPSGVIRAYDVGTGALVWKWDSGNPDQTTPLAAGQTYTANSPNMWSTPSADEKLGLLYVPLGNQTPDQLGAGRSANVEKFSSSIAALDLNTGQLRWVRQTVHHDLWDMDVPAQPSLIDITKADGTVVPALVGPTKQGDLYVLDRRTGEPLVAVKEVPAPGGAVEGDHTSPTQPVSDLSFSPKPLTDADMWGITMFDQMACRIAFHKLRYEGRYTPPSVQGSLIYPGNFGVFNWGGVAVDPVRQVMFGMPTYLAFTSRLVPRADVPPPGDDTKGSEQGLNRNEGAPYAVVMGPFLSPLGIPCQAPPWGYVAGADLRTGTIAYKHRNGTVYDMTPLPLPLKVGVPGIGGPIITAGGVAFLGAAVDNYLRAYDLTSGRQLWQARLPAGGQSTPMTYTVADGRQFVVIVAGGHGSVGTKPGDYVMAYALPK

SEQ ID NO: 11884 - protein, 817 aa, Mesorhizobium loti
MAARGGQNSPPDYLKGLNPEQRLAVETTEGPVLVLAGAGTGKTRVLTTRIAHILATGKAFPSQILAVTFTNKAAREMKQRIGILIGEGNVEGMPWLGTFHSIGVKLLRRHAELAGLRSDFTILDTDDVVRLIKQLIQAEGLDDKRWPAKQFAQMIDGWKNKGQGPADIAEGDARSFANGKGRELYKAYQERLQTLNACDFGDLLCHPIRIFRANPDVLKDYHRRFKYILVDEYQDTNTAQYMWLRLLAQRAEGRATVNICCVGDDDQSIYGWRGAEVDNILRFDKDFPGATIIRLERNYRSTAHILGAASHLIAHNEGRFGKTLFTDRNDPEDGKVNVHAAWDSEEEARAIGETIEAYQRQKHNLNDMAILVRASFQMRAFEDRFITLGLNYRVIGGPRFYERMEIRDALAFFRVVANSGDDLAFERIVNVPKRGLGEATIRQIHDTARALRIPMLEAAGNLAESDELKPKPRAALREVAANFERWQKALETKPHTELAETILEESGYTDMWKNDRSAEAPGRLENLKELIRSMEEYESLRSFLEHVALVMDAEQNAGQDAVSIMTLHSAKGLEFETVFLPGWEEGLFPHQRALDEGGRSGLEEERRLAYVGLTRAKKNLHIWFVSNRLIHGLWQSTIPSRFLEELPESHVEIAESGNSYGGYGNPYGGGSFASGRGGRQNPYGASRFDNVGANTEKSGAFSNTYSTPGWQRAQANRTEATDRNWGTRSGHQVERIGYGETDSGYGAGRTSVKGRTIDGELVAKSVADKPSPFSVGDRVFHQKFGNGNISAIEGNKLTIDFDKAGQKRVLDGFVAAV

SEQ ID NO: 11885 - protein, 371 aa, Mesorhizobium loti
MSETANSRAAELSHLRSRDFANGDPIPLPLTMASIFHTPGVETGVDQYGRYDNPTWRAVEHVLGHLEDAQCVSFPSGMGAISSVFFALLKSGDRVLLPADGYHATRAMAERFLKPLGITCDTRPTPTFLDGGFKGYSLVFVETPSNPRLDICDISAIAKAVHEQGGALVVDNTTMTPFGQRPLDFGADIVVSADTKAVNGHSDVLFGHVASRDADIISKVTNWRAMAGGIPGPFEAWLVHRGLETLEVRFDRMCSSAETIAQRLKEHRAVRGLRFPGLNGDPSHNLSRAQMERFGFLISFELASEDKAEDFINNCPLIEAATSFGGVHTSAERRSKRGDAVPPGFVRLSVGCEPVEELWKAIETSLNGIGG

SEQ ID NO: 11886 - protein, 243 aa, Mesorhizobium loti
MSQSLHGKTAIVTGSSRGIGRAIAEGLAAEGAAVVVNYVGNQKAADEVVAGIAGKGGKAIAIQADISSVSDVRRLFDETESRLGAIDIVVANVGVAVIKPLTEATEADFDLVFGTNAKGTFFTLQEAARRVRDGGRIIAVSTGGTKMFFTQTALYLGSKGAVEQFVRVLSRELGSRGITVNALSPGFTDTDLLPERDRAVAAGMSPFGRIGAPHDVADVAVFLASDEARWLTGDNIQAGGGVA

SEQ ID NO: 11887 - protein, 406 aa, Mesorhizobium loti
MQRFENAREAALALRPDDPVYCFRPQVLKADARQFMGMFPGKTAYAVKTNGEQIVLKTLVEAGVTAFDVASPGEFAAVRAVSPDAEMLYMHPVKAQSDIKLALEKYGIRVISLDHEDEITKLTRVVRALDIDPGSISVFVRIQTKGSAAYELSKKFGAGPAYAVELAERLNRTGYKVGLCFHVGSQIEDPDTYERALASADWVRNRLTFDIAGLDVGGGFPAEYGHDPNRKQIEMPSLGQIMSRLSGDLKEYQFDQMPLVAEPGRVIVARCLSLIVRVLLRKGKRLYINDGIWASLSDSWTGKITLPARFIPDPAIRTRNGAEKNVVPFKVCGATCDSVDILSRPFWLPETVDTGDWIEIGHIGAYSLSLRTRFNGFYPDTFVEVTTPFDEGDAPQGFASLETMAD

SEQ ID NO: 11888 - protein, 279 aa, Mesorhizobium loti
MTNKVWFITGSSKGFGRVWAEAALARGDRVAATARDAGTLADLVEKYGDNIAAIKLDVTDKKAVDTAVAEAHKRFGRLDVVINNAGYGHFGAIEEVSEQEARDQIETNVFGALWVTQAVLPIMRAQRSGRIIQISSIGGVNAFASLGLYHASKWALEAFSQSLSIEVAEFGIHVTLVEPGGFSTDWSGASAKVSKPIEAYAPARAKMAERRANSVAGDPEATGPAMLAIVDAAEPPLRVFFGDGGLPMIRQEYANRLATWDKWDHVSVMAQGANKNRKG

SEQ ID NO: 11889 - protein, 314 aa, Mesorhizobium loti
MKSRHVIEREGILDPTRMTPRIPARPDDALSLEAEFGIASARKALDHAGVEPSQIDLIICSASHHQRPYPAIAIEMQEALGTTGAGFDMGLGCSSAAAALHMAVNLVRSGAHKRILVTTPEIITGHLNFRDRQTHFIFGDASVSMVVEGLAQGDKRPGRFEVLDTRLWTQMSNNIRTNLGYHTRTAQDDPYMINLEGNLIKQVGNKVFKEVTVAGQKFIVEFLAEHGLTPQAIRRFWLHQANARMNAMILKLSFGHDVDHDRAPMVLERLGNTAGAGAIVALSENHADMKPGDFGLICAFGAGYSIGGALIRML

SEQ ID NO: 11890 - protein, 427 aa, Mesorhizobium loti
MTAPRPSKTHIGNHKLHPETLMLSYGFDPQLSEGAVKPPVFLTSTFVFKSAEEGRDFFDYTSGRKEPPSGTASGLVYSRFNHPNSEIVEDRLAIYEGTDACILFSSGMSAIATTLLAYARPGDVILHSQPLYGGTETLLTRTLSGFGIGAVGFADGVDEKAVRAAADAAVAKGRVSVILIETPSNPTNSLVDIALMRMIADEIGASQGSAPIIVCDNTLLGPVFQRPIEHGADVSVYSLTKYVGGHSDLIAGAAMGSKAVTKPIKALRGAIGTQLDPHSCWMLGRSLETLSIRMERANDNARLVAEFLRDHAKVEKVHYLPFLGEDTPAGRAYVRQCSGAGSTFSFDIKGGEKAAFAFLNALQIFKLAVSLGGTESLASHPAAMTHSGIPFDVRQRIGVLETTVRLSIGVEHPDDLIADLTQALAAV

SEQ ID NO: 11891 - protein, 263 aa, Mesorhizobium loti
MTGISPAVVAASKLGLTFQTNDGPVQALSNVDLTIGKGEFVSFIGPSGCGKTTLLRVIADLEKPTSGTISVNGMTPEQAREKRAYGYVFQAAALFPWRTIERNVGLPLEIMGLSKAEQAERIKRTLDLVNLSGFEKKYPWQLSGGMQQRASIARALAFDADLLLMDEPFGALDEIVRDHLNEQLLQLWARTNKTICFVTHSIPEAVYLSTRIVVMSPRPGRVSDIIESTLPKERPLDIRETPEFLAIAARVRDGLRAGHSYDD

SEQ ID NO: 11892 - protein, 442 aa, Mesorhizobium loti
MSNRLKVTPNDLSAFWMPFTANRQFKQAPRMFVSAKDMHYTTSDGRKVLDGTAGLWCVNAGHCRPKITEAIQHQAAELDYAPAFQMGHPIVFELANRLVDIAPKGMDHVFFTNSGSESVETALKMAIAYHRMKGEGARTRLIGRERGYHGVNFGGISVGGIVSNRKMFGTLLGGVDHMPHTHLPEKNAFSKGVPEYGAELANELERIVALHDASTIAAVIVEPVAGSTGVILPPKGYLQKLREICTKHGILLIFDEVITGFGRLGAPFAADYFGVVPDIMTTAKGVSNGVIPMGAVFVKKEIHDAFMTGPEHMIEFFHGYTYSGNPIACAAALGTLDTYKEEGLLTRGEELAPYWEDALHSLKGEPHVIDIRNIGLIGAIELAPIAGSPTKRAFSAFVKAFERGALIRTTGDIIALSPPLIITKGQINELIDHVREVLRSID

SEQ ID NO: 11893 - protein, 240 aa, Mesorhizobium loti
MTNRTEHTVIIGGSSGIGLATARKLLGPGMKVTITGRNQDKLISAWKSLGGAADKAAFDASKPDEVRQFFERLGPFDHLVLAASGGKGLGPFETLDLADIGSGVEEKVRPQLSCLQAALPTLNKSGSVTFISAVSAQATMPGIAGIGAINGMLLTVAPILAVELKPLRVNVVAPGVIDTPWWDFLPDEQRQAVFAEYAGKTPVGRIGRAEDVASAIAFLVSNGFMTGQVLTCDGGLRFAA

SEQ ID NO: 11894 - protein, 160 aa, Mesorhizobium loti
MGVAGCGKSAVGIALAAALDAVFIEGDRLHPPENVARMASGEPLTDQLREGWLDAIGERIATSIGEGQGVVAACSALKRSHRERLRGFCPDIVFLYLEIDPTTARRRVASRKGHFMPASLVDSQFAILEPPGSDERALTIDATRPVADAVADAMRLLANS

SEQ ID NO: 11895 - protein, 363 aa, Mesorhizobium loti
MTTAAKTKRDYSLVGESTRAAIETGLASAEWYHTDVPRKAMKELMQRSDGPAIRDTIIWIAAILGSAAGIVWFWGSWWVVPFLFVYGVLYGSSSDSRWHECGHGTAFRTRWMNDVVYHIASFMLMRNPVQWRWSHARHHTDTIIVGRDAEIAVMRPPDLLKAALAFTGILDFRYSLPTLVRQAFGTLSEEEKSYIPEMEQHKAVVAARWHMAVYVATIAFAIALESWQPLVLVGLPRLYGTWHMVMTGLLQHIGLADNVVDHRLNTRTVYMNPISRFIYWNMNYHVEHHIFPMVPYHALPKLHELIKHDLPEPNPSMWHAYREVWPVLLRQLKYEDFYLKRELPPTARPYRGEFHEVDMSAAE

SEQ ID NO: 11896 - protein, 325 aa, Mesorhizobium loti
MSARLVHIGSAVVDYVYRIDALPAPGTEKTASSFAQVAGGGFNMMVAASRTGMTVVFGGQLGSGPNGDFLRAAFAAEGIETLTPPSPAMDSGNCVAMISSDAERTFVSWPGAESILTLDMMAALSVAPDDWVFTSGYTLSYAGSRDALADWIEALPAQTPFVFDPTPIISDIPRPILSRVLARATWLSCNATEAAEIAGPGDVEALAARLLDDHCPQATGVVIRSAAKGCHVRLADGTAQTIPGFKVSAVDTNGAGDTHIGAFVSALARGVHPFEAGRYANAAAAISVTRHGGSSAPTDAEIQTFLSQAAATGTPGQNQKAHQTA

SEQ ID NO: 11897 - protein, 172 aa, Mesorhizobium loti
MATSTERAVLAGGCFWGMQDLIRRYPGVISTRVGYSGGDVANATYRNHGTHAEAIEINFDPAVISYRTLLERFFQIHDPTTRNRQGNDVGMSYRSAIYYTSDEQKRVAEDTIADVDASGLWPGKVVTEVAPAGAFWEAEPEHQDYLEKYPNGYTCHFVRPGWKLPVREKAVS

SEQ ID NO: 11898 - protein, 234 aa, Mesorhizobium loti
MSVEKVAVVVAGGSGMGAAAAKRLAADGFKVAILSSSGKGEALAKELGGLGVTGSNQSSDDLQRLADLTLERFGRIDVLVNSGGHGPRAPILEITDEQWRTGMDVYLMNVIRPVRIVAPQMVKQKGGAIINISTAWVAEPNVMFPTSAVFRAGVTAYTKIFSNTYAADNVRMNNVLPGWIDSLPTVEERRDNVPMQRYGTSEEVAATIAFLASEGAGYITGQNIRVDGGVIRAL

SEQ ID NO: 11899 - protein, 495 aa, Mesorhizobium loti
MALHAGAQPDRVACVDLASGRRWTYAALDEAIQRTVRVLETGYGIKPGQRIATLARNSADLLILQQAAMRLGAIFVPVNWRLASAEQQAILADCDPALLLHDAAPQAALPGRCIPVDVAAFTAAVEAETLAPRRPLPADDAPSIILYTSGTSGRPKGVIVTERNAFATAVNFSVLGRVGNASIFLCDAPMFHVIGLITSLRPTLLQGGTVLISPGFDAGATNRRLADPALGVTHYFCVPQMARMLRDHPDFAPSRWTSLTAIFTGGAPNPATDIRWWLAQGVRMADGFGMTEAGTVLGMPVEAGRIAGKAGSAGLPAPTIGLRLVDDDGRDVAAGEPGEIWLSGPSITPGYWNRPEETQRAFTADGWFRTGDIARRDGEGFVTLVDRRKDMFISGGENVYPVEIETVLLDHPGIAEAAVIGIADARWGEVGRAFVVVKPGCAVDPADLASHCGARIARFKVPKEFLLTDALPRTASGKIQKHILRSWTAPVRKHS

SEQ ID NO: 11900 - protein, 260 aa, Mesorhizobium loti
MELHLQGKVVLVTGATQGIGRAIAEALARAGAGGLLITGRDRKRGDAVAAELSAIGTPTIFVAADLGDTQTPALLAQACIERFGRIDGLVNAAGLTDRASFLDAGLDDWAALFAVNARAPFFLMQAAIADMRKRGEPGAIVNILSINAHCGSPELAVYSATKGALATLTKNAANAHRFDRIRVNGINVGWTDTPAERVMQSKTLGHGPGWLDAANAAQPFGRLLKPDDIANLSVFLLSDAAGPMTGAVIDQEQSVIGANR

SEQ ID NO: 11901 - protein, 278 aa, Mesorhizobium loti
MTKTWFITGASSGFGRQLTELLLERGDRVAATVRKPDALHDLATKYGERLWVGILDVTDSSAVRDIVGKAFAELKRIDVVVSNAGYALFGAAEEVADAQIERQIDTNLVGSISVARAVIPDLRQQGGGRIVQISSSVGQSAYPTMGVYAATKWGIEGFYEGTIPEIAPFGIEVTLVEPGASRTNFASSSADAGQILDVYDQTPVGDFRRLVASAGLAMFPGDPRKVASAIIASAEQTPAPRRLTLGSDAYALVHTALTERLAALESQKALARSTDVDA

SEQ ID NO: 11902 - protein, 276 aa, Mesorhizobium loti
MPELITLNDGAAIPQLGLGVWQVDHGITADVVGWAIKAGYRLIDTAQGYQNEEGVGEAIRAADVARSELYITSKLRNGAHERDAALRAFDDTMEKLGIEQIDLFLIHWPVPSRDKYVEAWKTLIELKQAGRIKSIGVSNFNRDHLERIIGETGVVPVANQIELHPRFQQRELREFHAGHNIQTESWSPLGSGRLLGDPTIAGIAKKHGKSAAQTIIRWHLQQGLIVIPKSVRQDRIAANFDVFDFELDAQDLKTIAGMDSADGRDGPNPATAAFLF

SEQ ID NO: 11903 - protein, 252 aa, Mesorhizobium loti
MASSIDPAEILAVRGLSASYGGRAVVSGIDLSLERGDVLGLLGANGSGKSTLLRAITGQIRPLGGTVAIDGADLARAPERAKSGFGLAVDPSDLPAALSGRQYLQLVASIRGCAEDDWPGVNVADRLGLNRWIERPIAEYSLGTRAKIAIAAALLGAPPLLILDESLNGLDPLAAFEVKCIILALASSGRHAVIISTHVVESVPGLCNRAMLLADGRMARAWHARQLAEAGRIPGAFEAEVMRALTVQAADA

SEQ ID NO: 11904 - protein, 523 aa, Mesorhizobium loti
MVEQGSIAPFSGTPLLRVEGVRKRFGGVNALRGVGLEILSGEVHALLGENGAGKSTLIKILSGVHVHDGGSIEIDGKPVSFSSPAQSRDAGVAVVYQDLSLVESLSVADNLLLGREPKTRLGFLKKRQLVAQAEAFLKSQNIPLDARAMVGSLPFAYRQMTEIAKALMGDVRLLILDEPTSALTDDEEKILFEAIRAVAARGVGVIYVTHRLNEVFRISNRVTVFRDGQNAGTFVTAQTNMRQLVGAIVGADHAVLKADGAASGQGMAPSAGSSENPVLELKSVSNDRLDGASLQLRAGEIHGLAGLIGSGRTEILQTIFGLRPVQSGEASLDGVSLKGTDPAAAIGLGIALVPEDRHVQGLVLEHSIERNLTLPRLPYFSRLGWLQRRPASEHANAAMRRLAVKAPGASTMVKNLSGGNQQKVVFGKWNEPRPRVLLLDEPTVGVDVGAREEIYGVIRAAAVAGSGVLLVSSDLSELLQLCDRISIVVDGRITRTVARPEFGSAEDLHHLIQISQPSEEHAA

SEQ ID NO: 11905 - protein, 568 aa, Mesorhizobium loti
MVLGLVGAALEGFGIGLIIPLLGIIMGHSDATGMAGFSAVLQQVGSGFSERDRLVVISAAILGSIVLKNIFAFANTLLTTFISGKASHSIRSALSEQLLRVGYPFFLRQSPGRLLNIISNESWRASDAIQIMLSAIISASAAAILLAFLLLLSWRMTLLVTLGLALVQIAHAILSANLKEPSRSVASRNSHLASQMLHLVHAGRLIRIFGQEGREKAIFDTASDGVRRASFVLQVRQGALPPLTEVLHAMLFLAVVIGAWLAQVSFPLIIAFVILLYRLQPHMRALQGSWSQLQGLSGSLEEVTWMLDPADKPRPPQGDGPFHGLRRGIKFDDVTFTYSGTDQREVVLHAATFEINSGRSTALIGRSGAGKTTIVNLLCRFVEPDTGRILVDGSPLDRIDANQWRRHIALASQELELVDGTIFENISYGQDAATLADAERAARLAEAHEFIERLPQGYETLVGYRGVNLSAGQRQRIALARALVRDPDLLILDEATNAVDGLSEAAIVETLKSRAGRRTTIVISHHHSTISFCDDVVILSRGRVKKQAPFGALASLSMDELYQHEPQD

SEQ ID NO: 11906 - protein, 258 aa, Mesorhizobium loti
MTNQQTSTGQQTSTGNPIRTAIVTGASKGIGAAIAQRLARDGLAVVVNYARGRAEADAVRGAIEAGGGKAIAVQADIADPTGIATLFDAGEKAFGGVDILVNNAGIMKLSPIAGTDDASFDAQIAVNLGGVFRGTREGAKRLRDGGRIVNFSSSVVGLYQPGYGVYAATKAAVEAMTHILAKELGARRVTVNAVAPGPVETALFMDGKSATQIEAIGKMIPLGRLGQPDDIAGVVSFLAGPDSGWVNGQIIRANGGVI

SEQ ID NO: 11907 - protein, 559 aa, Mesorhizobium loti
MGRWAPPGRTDMTGLPRYEDAVARFRIEDEIARLDGDPLTGINGYVECCGRHTGQNRLALRAISAGGELRLFSFDDLADMSGRVGNLLKDAGVGPGDVVAGMLPRIPELIALILGTWRIGAIYQPLFTAFGPKAIEHRLGYSGAKLVVTNPANRGKLDEMKTCPPIATILGPGDPLPAGDIDFRAALAAASPDCEPVMRKGEDLFMMMSTSGTTGLPKGVPVPLNALLSFGAYIRDAIGLRPDDVFWNIADPGWAYGLYYAITGPLLLGIATTFNEGAFNAGNTYDVIERLGVTSLAGSPTAFRLLLAEGPEAAARIKGRLRVVSSAGEPLNPEVIRWFDAHLAAPIHDHYGQTENGMMVNNHHGLAHAVRAGSAGFAMPGYRMVVLDDEGNELGLNQPGILAVDVANSPLRWFDGYHQAETPAIAGGYYRTGDTVEYEPDGSVSFIGRADDVITSSGYRIGPFDVESALIEHPAVNEAAVVGVPDPQRTEIVKAFVILAPAYQGSTELAEELAQHVRKRLSAHAYPREIDFVAELPKTPSGKIQRFLLRQAEVEKRKG

SEQ ID NO: 11908 - protein, 628 aa, Mesorhizobium loti
MTTDTKATETRAFEADVSRLLHMMVHSVYSDKDVFLRELISNAADACEKLRFEAVSRPELLGDDPKPRISISADPDNKEITVEDNGIGMSRDDMAEALGTIARSGTRAFIERVGSGTEDTQLIGQFGVGFYSAFMVADRVDVISRLAGSEEAWRWSSDGKGSYEIAPAPLEAAPRRGTRVVLHLMDDAVSYTGSYRLEQLAKSQSGHVPVPITLIEKPGAEARDIADGTALWVRPKSEIKPEEYTDFYRSVAGQYDEPAATIHFRAEGRQEYSVLAFVPGSRPFDLFDQDRKGRMKLYVRRVFITDDADLLPRYLRFVRGLVDSADLPLNVSREMIQESPLLASIRKGLTNRVLGDLAKLAENEAEAYAKVWENFGVVLKEGLYEDYERREQLLKLARFHSTASGEGWRGLADYVAAMKEGQKAIFFMAGDDRARLEASPQLEGFKARGIEVLLLTDPVDSFWVTMAPDFDGKPFKSVTQGVAELSDIPLLDDAKKPDTAAAPEVDGFLAFVKSALGDAVSDVKASDRLTESAVCLVAPEHGPDRQFERLMNAAGRLDKAAKPILEINPRHERVLALAGLGDEDQAFKDDAAHLLYDEARVLDGDKPADARAFSERLARLIARGIAKG

SEQ ID NO: 11909 - protein, 242 aa, Mesorhizobium loti
MNLSNQKILIVGGGSGMGLALARRCVEAGATVIIAGRSDDRLRQARETLGNPAGLEVAVVDIAREDQVAALFAEVGGLDHIVSTAADIEGAYRLLPELDLKAAQRMVNSKLFGPLLLAKHGAPRLAASGSMTLISGIAAYRPAARGSVVAAVNAALEGLVRALAVELAPLRVNAVSPGWVDTEIWAQVAGDRKAEMLAAMAERLPVGRVGQPEDIADAIFFLIGNGFTTGTTLHVEGGHRLV

SEQ ID NO: 11910 - protein, 256 aa, Mesorhizobium loti
MKLATFNINNINSRLENLLAWLAAAKPDVVCLQELKARDMQFPRTALADAGYGAVWKGEPTWNGVAILARGAEPVLTRDALPGDDADRQSRYIEAAVDGIVIACLYAPNGNPQPGPKFQYKLAWHARLEAHAAQLLDTGLPVVLAGDYNIVPEPRDIYATRSYDDNALVQPESRAAFAALIEQGWVDALRKIYPKETLYTFWDYRRNRWPRDAGLRLDHILLSKTLARRLKGAGIDRDVRGEDGASDHAPVWVELK

SEQ ID NO: 11911 - protein, 702 aa, Mesorhizobium loti
MAKQASKLAGTAATIHDQKLQRGEGGELHQTASGSTAVLTTAQGGPVSDDQNSLRIGARGPTVLEDFHFREKIFHFDHERIPERVVHARGYGAHGYFETYESLAKYTRADIFQRAGEKTPAFVRFSTVAGNKGSADLARDVRGFAVKLYTQEGNWDIVGNNMPVFFIQDAIKFPDLIHAAKAEPNSDFPQAQTAHDNFWDFISLTPESMHMIMWAMSDRAIPRSLRFMEGFGVHTFRLLNAKDESTFVKFLWKPKLGLQSVAWNEAVKINGADPDFHRRDLWDAIHAGNFPEWELQLQLFDQAFADSFDFDILDPTKLIPEEVLPPIAVGRLVLDRMPDNFFAETEQVAFMTQNVPPGVDFSNDPLLQGRNFSYLDTQIKRLGSTNFTHLPINAPKCPFHTFQQDGHMAMRNPVGRANYQPNSWDEGPRESPQKGFRSFAEAEAGPKARLRAESFADHYSQARQFYISQHPVEQGHIASALTFELSKVHTPVIRERIVSHLLNIDDALARKVADALGLKAMPKPADAGAPTRTDLPASDALSILKNGPGRFEGRKLGILVTDGTDAALLNALKQALTKAGAKFEIIAPKVGGAKASDGSWMDAQQMIAGAPSVLYDAIALLAAKPAMAGLLRESTARDFVADAFAHCKFIGFVEAAAPLLDKAGVVEDEAVIPLASAKDVAGFITRLGDLRLWAREPKVKLG

SEQ ID NO: 11912 - protein, 271 aa, Mesorhizobium loti
MNRNSGKTAIVTGASSGIGRASAEILARAGFTVFGTSRKASGQSSNGISMLVCDVTDDASVASLVSTVLGKTGRIDLLVNNAGIGLLGGAEESSVSQSQALFDVNLFGVMRMTNAVLPSMRRLGEGRIVNIGSILGLVPAPYSAHYSAVKHALEGYSESLDHEVRAFNIRVSVIEPAFVRTVFDQNGFEPDSVMKVYDEARAGLEALLRDVMPKADLPEVVAKVVLRAATDRHPLRRYTAGKAARQVSMLRRFAPTGMFDKILRKQFRLPV

SEQ ID NO: 11913 - protein, 293 aa, Mesorhizobium loti
MTDISKAGTFKLGDRTVKRLGYGAMQLAGPGVFGPPKDRDAALAVLREAIASGVDHIDTSDFYGPHVTNQIIREALHPYPANLTIVTKVSARRGADASWIPAMSPKELTEAVHDNLRNLGLDVIEVVNLRSMHGIHGPAEGSLEPQLNTLAELQRQGLIRHIGMSNVTSTQIAQGRSIADIVCVQNQYNIAHRDDDALIDALAADGIAYVPFFPLGGFTPLQSDTLANVARKLGATPMQVALAWLLRRAPNILLIPGTSSVGHLRENLAAAELDLPADALAVLNGIADEKAAA

SEQ ID NO: 11914 - protein, 658 aa, Mesorhizobium loti
MLHGFLRLAAGAGRSLAVPAILLALGAPAQAGSLLEDCANDKLTPPNRIVACTNVLEDKAASASDQAVAYFNRANALDRNGEFDRAIADYDKAIAFNPKDAEAFNNRGLIWGHKKDFDRALADYDKAIELNPQIAIAYANRGLIWNDIKHDYVKAIADFDKAIRLDPENNGLYNLRGNAYLRKGDYDQAITSYSQAIFLDSQDPNQYFNLGLAWTTKGNLERAIADYSQAISLDANHAEAYRWRADAWVKRGDTDQALSDYTEAIRLDPGDAETFRNRARIWERKRDYDRAIADYDQAIAFAPNDAVAYNGRGWMWSLKHETDRAIVDYVKATAFDPNYVLAYDNLGLAWWDKGDLDRAISAFDQAVIVDPKYAPAYNDRGLARMDKNQYDLAIADYNMAILIDAGFVSAYRNRGNAWNRKGQFDYAIADFDQAIDHDPDDADAYVGRGRSRIYKADYTKAIADLDQAIRIGPKSARAHDTRGLAMVYKADYAGALADYDEAIRLSPKNASAYRNRGIASFYFGPPAKAQADFEQAAAIKPGDSYHAIWLDLARRRNGQPSILVDAKLDMTRWPAAVVRLLLGQQTPEATLLAADNPDATKKSEQLCEANFYVAEFQRLQHHDEEALRLYRLALGGCPRDFIEYTAATSALRVMGKAP

SEQ ID NO: 11915 - protein, 477 aa, Mesorhizobium loti
MSHNLQFYVDGAWVDPVVPNTLDVIDPSNEDAFAQISLGSKADVDKAVAAAKRAFNSFGFTSVEERLDILNRVIEVYKKRSKDLALAVSREMGAPRQMALDSQVGVGLAHLEKMAEVLRTFQFRHVKGSALIVKEPIGVVGLITPWNWPLNQITCKVGPALAAGCTMVLKPSEIAPLDAIIFAEIIDEAGVPKGVFNLVNGDGPGVGQALSSHPDVDMMSFTGSTRAGILVAKAAADTVKRVHQELGGKSANILFPDVDLARAVTKGVAGCFGNSGQSCNAPTRMFVPRDRHDEAAGYAKAAAEKFVVGPADGANTKLGPVVSQMQFDKIQDLIQAGIDEGATLVAGGPGRPAELNRGYYVRPTVFADVTHDMRIAREEIFGPVLAILPYDTVEKAVEQANDTVYGLASYIQAKDIQKARDVAARMRSGNVYINYPAWDAGLPFGGYKQSGNGREYAEYGLEDFLEIKGIAGYEAAE

SEQ ID NO: 11916 - protein, 543 aa, Mesorhizobium loti
MSAKEIKFATDARDRMLRGVEILTNAVKVTLGPKGRNVIIDKAYGAPRITKDGVTVAKEIELADKFENMGAQMVREVASKTNDLAGDGTTTATVLAASILREGAKLVAAGMNPMDLKRGIDQAVAAVVVEIKAKAKKVKSSAEIAQVGTIAANGDATVGAMIAKAMDKVGNDGVITVEEAKTAETELDVVEGMQFDRGYLSPYFVTNADKMRVELEEPYVLIHEKKLGNLQAMLPILEAVVQSGRPLLIISEDVEGEALATLVVNKLRGGLKVAAVKAPGFGDRRKAMLEDIAVLTAGQMISEDLGIKLENVTIEMLGRAKRVLIEKDTTTIIDGAGTKATIQARVAQIKGQIEETTSDYDKEKLQERLAKLSGGVAVIRVGGVTESEVKEKKDRIDDALNATRAAVEEGIVPGGGVALLRARSALSGLNGANADVTAGISIVLRALEAPIRQIAENSGVEGSIVVGKLADSKDHNLGFDAQNETYVDMIKAGIVDPAKVVRTALQDAGSIAALLITAEAMITDIPAKDAAPAGGGGGGMGGY

SEQ ID NO: 11917 - protein, 104 aa, Mesorhizobium loti
MKFRPLHDRVVIRRAEGDTKSKGGIIIPDNAKEKPQEGEVIAVGPGARDENGALVPLDVKAGDLILFGKWSGTEVKIDGEDLLIMKEADIMGVIDKSVEAKKAA

SEQ ID NO: 11918 - protein, 270 aa, Mesorhizobium loti
MSTVIVVGHVNHDQVWSLSAPLASGSRLTYSDRVVRLGGGGFHTGTQLAKLGNDVRLISNLMDDDHGRAALAKLQASGIDTGYVTMWTGETRFTEILLEPNGERTILNPGGQLRPPFAAPEPVSGDAAYLNALVLDDGLVASLRTIPLVISQFPLRSPSHRPADIVIGSRADFPGEDVQGIWERASRIAGPRLRTLVLTDGMRPISLYDGKALNHVTPLKQVSVPDTIGAGDCFTGIFLHGLLQGLIPELSAEQASQQTAEWLSERSRTG

SEQ ID NO: 11919 - protein, 498 aa, Mesorhizobium loti
MTLSFDPRAKATTLYHGEFRPMFIGGKWVAAQSGQEMQALNPATGEVLTTVPRGGAADVDAAVAAARAAFEGPWSKFSPYERQCVLLRIADLFETHWEELSVSDTLDMGLPITRTLANRRRVIGMLRFYGGMATALHGEAIDNSIPGEIVSFTRREPVGVVGAIIPWNAPTAASIWKIAPALATGCTIVLKPSEEASLTPLLIARLMQEAGVPDGVVNIVTGTGAEAGARLAEHPDVNKIVFTGSTLTGQAIARAGVTNLKRVSLELGGKSPIIVCRDADIDKAVPVAAMAVFVHSGQICIAGSRLFVAREIHDEFVRRVAEFAGRLRIGHGIEAETEIGPLINARQAGKVEGYIKAGSDEGAKLVAGGSRLTGALYDGGNFIAPTVFGSVSDKMTIAREEIFGPVISAMPFDTLDEVVARANATPYGLAAGIFTTHLGTAHKLARRIRAGSVWVNMYHAIDPAVPFGGMKMSGYGREGGIEHLHEYLETKSVWIQTD

SEQ ID NO: 11920 - protein, 945 aa, Mesorhizobium loti
MEQRRSSQSFKRKELVAKLNPTGLRAFKAAADTAKMRGNPYVELVHFVQQLVLSERSDVQMIVADAGLDVSRLTADMTRAIDKLPYGATSVEEFSDHIFHAIQEGWSLATLEFGVEEVRSAHILLACLKTPALEGLVSKISAEFDKIDADGVIARFADVTEGSLEAGSPPAAAAAETPMKRGLGGDSALAKYATDLTQRARDGKIDPVIGRDPEIRQIVDILMRRRQNNPILTGEAGVGKTAVVEGFALRIAQGDVPPTLQNVSVRMLDVGLMQAGASVKGEFEKRLKAVIDEVQASETPIILFIDEAHTLIGAGGAAGTGDAANLLKPALARGELRTIAATTWAEYKQHIEKDPALTRRFQVVKIEEPSETVAVLMLRGVAGVLEQHHKVQILDEAIEASVSLSHRYIPARQLPDKAVSLLDTACARVAVSQHATPAEVEDILRRRQALEVEEGIIGREAAIGIEVVDRQARVEAGLAETETTLAAAQARWDREKALVAEILDLRAKLRGEGVPLDAVEGGEAAPGEAVDAPAATSHERKAPEAKTPKPETAEPKGSKSKSAKTKAAKMEAVAAHEPVPVPDSAADLARLRELMAELAEAQGETPLILPSVDRNAVAAVVQDWTGIPTGRMLSSQTEKALKLAATLAERVVGQDHAMEMIARRVQTSRAGLGAPEKPVGVFLLCGPSGVGKTETALALAETLYGGEQNLISINMSEFQEAHTVSTLKGAPPGYVGYGKGGILTEAVRRKPYSVILLDEVEKAHPDVHEIFFQVFDKGMMDDSEGRRIDFKNTLILLTSNVGSEVIMDRTKNGTLRTGMDDLDTALRGPLLKVFPAAFLGRVVTIPYYPLSDAMIEAITRHQFGKIARRLKATNDAELVIGDGVMDMVKARCTEIESGGRMIDAILTNTLLPELSRGVLNRSLEGKKMTKVTVGASSEGFTYSFE

SEQ ID NO: 11921 - protein, 104 aa, Mesorhizobium loti
MTFRPLHDRILVRRIEAEEKTAGGIIIPDTAKEKPQEGEVIAIGPGARDESGKLTPLDVKAGDRILFGKWSGTEIKLNGEDLLIMKESDVMGVIEQTATVKKAA

SEQ ID NO: 11922 - protein, 542 aa, Mesorhizobium loti
MAAKEVKFHSDAREKMLRGVNILADAVKVTLGPKGRNVVIDKSFGAPRITKDGVTVAKEIELEDKFENMGAQMVREVASKTSDLAGDGTTTATVLAQAIVKEGAKAVASGMNPMDLKRGIDKAVEAIVQELKTNARKVTRNDEIAQVGTISANGDAEIGRFLAEAMQKVGNEGVITVEEAKTAETELEVVEGMQFDRGYLSPYFITNQDKMRVELEEPYVLIHEKKLSNLQALLPVLEAVVQSSKPLLIIAEDVEGEALATLVVNKLRGGLKVAAVKAPGFGDRRKAMLEDIAILTGGTAISEDLGIKLENVTLEMLGRAKKVVIEKENTTIVDGAGSKDEIQGRVSQIKSQIEETTSDYDKEKLQERLAKLAGGVAVIRVGGSTEVEVKERKDRVDDAMHATRAAVEEGVLPGGGVALLRAAKALDSVQAENEDQKHGIEIVRRAIEAPVRQIAENAGAEGSIIVGKLREKPEFGWGWNAQTNAFGDLYNEGVIDPVKVVRTALQDAASVAGLLVTTEAMVAEKPKKEPAVPAMPAGGMDF

SEQ ID NO: 11923 - protein, 256 aa, Mesorhizobium loti
MDKVVVVTGAASGIGKEIALTFARKGAKVVIADLDLDAAEETAREIDPAALRALGVGMDVSNEDQVESGISRVVETFGRIDVLVSNAGVQTVAPLVEFDFDKWRKLLSIHLDGAFLTTRAALRQMYRQNSGSIIYMGSVHSKEASPFKAPYVTAKHGLIGLAKVVAKEGAAHGVRANVICPGFVRTPLVEKQIPEQARELGISPEDVVKTMMLRETVDGEFTTVQDVAETALFLAAFPSNALTGQSIVVSHGWFMQ

SEQ ID NO: 11924 - protein, 222 aa, Mesorhizobium loti
MSLRIADTAPDFAAETTHGPISFHDWLGNSWGILFSHPKDFTPVCTTELGYMAKLKPEFDKRNVKIIGLSVDPVERHAGWADDIAETQGQAPNFPMIGDPMLAIAKLYDMLPATAGDSAEGRTAADNQTVRHVYVIGPDKKIKLMIAYPMTTGRNFDEILRVVDSMQLTAKHRVATPVNWRPGDDVIIAGSVSNDEAKVLYPDGWKQPKPYIRIVPQPHSNA

SEQ ID NO: 11925 - protein, 749 aa, Mesorhizobium loti
MTSPLRQTRFKIGGMDCASCAAKIATAVRRLDGVADVSVSVTGASMTVSHGGPLNDDKVLRQVAWLGYGIVKAEARTDGPAAKAHDHAAHDHEGHDHQGHDHEGHDHGGGQEITKEAAGASHLHSHAEPGQVWWRSRRAAMTLACAVALLAAYSICHLFPSAERWVFLAALLVGLVPIARRALMAALAGTPFSIEMLMTIAAAGAVMIGATEEAAAVVVLFLIGELLEGVAAGRARASIQGLADLVPKTALVERGGGTVEVPAEQLAVGAVIVVRPGDRIPADGEIVEGSSDIGEAPVTGESTPKRKGVAEPVFAGTINSDGVLKARVTAAASDNTIARVVRLVEEAQEAKAPTERFIDRFSRIYTPGVLAVGALVAVLPPLVAGGDWNEWIYKGLAILLIGCPCALVISTPAAIAAGLATGARRGLLMKGGAVLEGFRRITAVAFDKTGTLTVGKPVVTDIVAFGRDERSVLALAAALEQGSSHPLAVAILDRARADKAPVPPAFAAKAISGRGVEGSVGGVAVFLGSGPAAGERADITQAQRLAVDSLNGQGKTVSVLVADGVVAGLIAMRDEPRPDAAAGIAALKAEGIRAVMLTGDNRRTAEAIAASLGIEARAELLPQDKQRIVGELQGEGLTVAKVGDGINDAPALAAADIGIAMGGGTDVALETADAAILHGRVLDVARMVRLSRAVMANISQNITVALGLKAVFLVTTISGITGLWPAILADTGATVLVTANAMRLLRWRG

SEQ ID NO: 11926 - protein, 398 aa, Mesorhizobium loti
MTPAWATEKPTALLVLADGTVIEGRGLGATGSAVAEVCFNTALTGYQEILTDPSYAGQIVTFTFPHIGNIGTNGEDIEDLNPAARAGAVGAVFKADVTNPSNYRAAGHLDQWLKKRGIVALSGIDTRALTALIREKGMPNAVIAHAPDGVFDLDDLKQRAAAWSGLIGLDLAKEVTSGQSSVWRETPWVWNEGFGEQAEPSLHVVAIDYGVKRNILRLLAGLGAKVTVVPANTGSEEILAMQPDGIFLSNGPGDPEATGDYAVPVIQDLLKTDIPVFGICLGHQMLALALGGRTAKMHQGHHGANHPVKDHTTGKVEIVSMNHGFAVDADSLPEGVEETHVSLFDGSNCGIALTGRPVFSVQHHPEASPGPQDSHYLFRRFVNLIREKRGEEQLAERV

SEQ ID NO: 11927 - protein, 306 aa, Mesorhizobium loti
MSHDGRIALTRDGVSLSRLVFGAWRLLDGGVRPDADQVARLIGTAVDLGLTSFDHADIYGNYEVEAAFGAGLSRWRGKRDQIELVSKCDIMLPSANRPQNRLKHYDTSAAHITASVDRSLANLGTDYLDLLLLHRPDPLMDADETAAALAGLVNAGKARAVGVSNFTPSQFDLLASRLPFALATNQIEMSVLKTSALTDGSLDHAQRLAYAPMIWSPLGGGSLFTGKEGREARVRAALAAVAAEVGAGDLATVAIAWLLRHPARLVPVLGSMKPERLAAMVKALEISLDRQQWFAILEASEGRPVA

SEQ ID NO: 11928 - protein, 264 aa, Mesorhizobium loti
MSGQANKGTAVVTGASSGIGAIYADRLAGQGYDLVLVARRADRLEELAEKLRYAYDRKVSVISADLSDDDDVRRVEQAISADDSVTLLVNNAGLGGQQVVATADADAAERMIKVNVIALTRLTRAVLPGLLARNRGAIVNIASVLAYETSFGGIYSGTKAYVVNFTEALHREVAGTGVKVQVVLPGATRTDFWELAGSDIDQLPKEIIMSADDMVDAALVGLARGEAVTVPALADAAKLDTFLGARQAFYGSLHADKPAARYAA

SEQ ID NO: 11929 - protein, 1167 aa, Mesorhizobium loti
MPRRTDIKSILIIGAGPIVIGQACEFDYSGTQACKALKEEGFRVILVNSNPATIMTDPELADATYIEPITPEVVAKIIAKERPDALLPTMGGQTALNTALSLRRMGVLDRYNVEMIGADATAIDKAEDRALFREAMSKIGLETPKSMLANATDVKNADRKTHEAERAALKAEKPDNLDAELDALETRWNLGEGDRKQRYISHAMAIAAQALDHVGLPAIIRPSFTMGGTGGGIAYNRAEFYDIVQSGLDASPTTEVLIEESVLGWKEYEMEVVRDKADNCIIVCSIENIDPMGVHTGDSITVAPALTLTDKEYQMMRNASIAVLREIGVETGGSNVQFAVNPADGRLVVIEMNPRVSRSSALASKATGFPIAKIAAKLAVGYTLDELENDITGGATPASFEPSIDYVVTKIPRFAFEKFPGAEPVLTTAMKSVGEVMAIGRTFQESLQKALRGLETGLTGLDEIEIPGLGHGATVANHADDRNAIRAALGTPTPDRLRMVAQAIRMGTSLEDVHAMCKIDPWFLEQIAGILAMEARIREHGIPQDAVNLRMLKAMGFSDARLASLTRTDAEVVTKIREKLDVHPVYKRIDTCAAEFASPTAYMYSTYEVPFAGALANEAQVSSRKKVVILGGGPNRIGQGIEFDYCCCHAAFALRDAGYEAIMINCNPETVSTDYDTSDRLYFDPLTAEDVLEILRAEQASGELLGVIVQFGGQTPLKLADALEKAGIPILGTSPDMIDLAEDRDRFQKLLHKLGLSQPKNGIAYSVEQARLVAGELGFPLVVRPSYVLGGRAMQIIHDESMLQSYLLDTVPGLVPEDIKQKYPNDKTGQINTLLGKNPLLFDTYLSGAIEVDVDCLCDGKATFVSGILEHIEEAGIHSGDSACSLPVHSLPSELVDELERQTAALARALNVGGLMNVQYAIKDGTVYVLEVNPRASRTVPFVAKTIGRPIAKIAARIMAGETLEDAFAHYGAMPDPRNPGHIAVKEAVFPFARFPGVDILLGPEMRSTGEVMGLDRDFALAFAKSQLGAGVDLPRSGTLFVSVRDEDKKGILPAVKRLAGLGFKVLATSGTQRFLAENGVVAEKINKVLEGRPHIEDAIRNRQVQIVFNTTDGQKAVSDSKSLRRATLMQKVPYYTTLSGAAAVAEAIAALKAGSLEVRPLQEYFA

SEQ ID NO: 11930 - protein, 189 aa, Mesorhizobium loti
METTPSITAGHAVLETVIGFMGIAWSEKGLIRLCLPERSRESVERRLMRHAGVSASTAQPPWVVELIASIKAYAAGEDVDFSNVPVDLDGVDDFRLAIYDAARKLSYGETTTYGELAKRAGHAGLPRETGAALGANPVPLVIPCHRILAAGGKIGGFSAPGGSVTKEKMLAMEGVRVGPPPPAQVSFGF

SEQ ID NO: 11931 - protein, 262 aa, Mesorhizobium loti
MTIKADPIEFAGKRVLISGGTKGLGRATVDRFLAGGARVITSARGALDPVDGVEFVQADLTTAEGGEALAKAALDRLGGVDILAHVLGGSTTPGGGFVALTDDYWLSELNLNLLATVRLDRLLIPQMIARGAGAVVHVTSIQSVLPLPEATTAYAAAKAALRTYSKSISKELGPKGVRVNAVSPGWIMTEGTEVFLERIQAANGGTLEDARQLVLDGLGGIAIGRGAEPFEVAEAIAFLASDRASSIHGSELVVDGGTVPTV

SEQ ID NO: 11932 - protein, 202 aa, Mesorhizobium loti
MILYSMIDSGNCYKPRLLMAKLGLAFTTIEVSSHTGETRKADFVAKNPNAMVPLLELDDGRRLAESNAILLYLAEGTRFLPADKYERGLAYQWLFFEQYSHEPYIAVRKALLTFPERARDATPERLAMTLERGHKALGVMNRYLENNAFFAGNAFSVADIALYAYTHTAEQGGFQLDAYPAVVAWLGRVEADPGHVPIEWVG

SEQ ID NO: 11933 - protein, 400 aa, Mesorhizobium loti
MAFLADTLSRVKPSATIAVTQKARELKNAGRDIIGLGAGEPDFDTPDNIKNAAIEAIRRGETKYPPVSGIVPLREAIAKKFKRENNLDYKPEQTIVGTGGKQILFNAFMATLNPGDEVIIPRPYWVSYPEMVAICGGTSVFADTSIENGFKLTAEVLEKAITPKTKWLLMNSPSNPSGAAYTQAELRALADVLLKHPHVWTLTDDMYEHLTYGDFAFKTIAEVEPKLYERTLTMNGVSKAYAMTGWRIGYAAGPVQLIKAMDMIQGQQTSGACTIAQWASVEALNGPQDFIARNKAIFQGRRDLVVSMLNQARGITCPSPEGAFYVYPSCAQLIGKKTKAGKVIDTDEAFCSELLEAEGVAVVFGSAFGLGPNFRISYATSDALLEEACTRIQRFTASLT

SEQ ID NO: 11934 - protein, 340 aa, Mesorhizobium loti
MSTQINRSWQMSGFGLSRLSQVTGKMPQPGPHELLVRTKAVSLNYKDRLIVDGTLIPELTFPFVPTSDAVGEIVAVGSAVSRFQVGQRVLGQVIADWPDGDAPPVPHKHTLGSSLPGMLSDHVVFGEDAAALAPPSLSDIEAATLPIAALSAWFAMAEATRPVAGQTVLIQGTGGVSLFALQFARAFGLRAIVTSSSDDKLERAKNLGAWQVINYRTRPAWDEAARELTNGLGVNHILEMVGGDNARRSLNALAAGGRLSVIGLLGAMELNFPIVPFMRNRIVVQGLSIGHRRAFERMNQAIEALGIKPVIDKVFGFDEVPQALQHLEKGPFGKIVISTT

SEQ ID NO: 11935 - protein, 538 aa, Mesorhizobium loti
MQIYDFIIVGSGSAGSVLAERLSASGRFSVLVLEAGGTDRRFYVQMPLGYGKTFFDPAVNWNYKTEADPGLGGNVDHWPRGKLLGGSSSINAMVWIRGAREDFDDWRAAGNPGWSYDELLPIFKALEDNEAGADRWRGTGGPLHISDTANAVHPLTKRYLAAGQQAGLPLNPDFNGAAQEGVGTYQISTKNGRRMSAARAFLRPAMKRGNVRVETNALASRILFEGKRAVGIEYLQNGQTKTARAGREVILSAGSINSPQLLQLSGVGPSALLKGLGIAVVHANENVGAHLQDHVGINYTFKGKVPTLNQILRPWWGKLLVGMQYILTRSGPLSLSMNHGGGFFRTDPAFSRPNMQLYFQAFSTVIPKSGERPILTPDPWPGFSIGLSNCRPSSRGEIMIRSSNPLDYPKITANAYSTNADVEEMLAAVKFVRKIASMPALAEIIQEEVLPGPSIQSDADLITDFRKRSGTVYHPVSTCRMGPDPTRAAVDPRLKVHGLEGLRVIDASIFPDNITGNTNAASVMTGWKGAELVLEDQK

SEQ ID NO: 11936 - protein, 241 aa, Mesorhizobium loti
MVANRGEDPKFLAQRFDRFQIMVYNKDVLDDRNKRAFLLTPREEFVLPQNLGRAYDHAFLDIGYGVTISGPHLVGRMTTAIDVQFGEAVLEIGTGSGYQSAYLANLTDKVHTIEIINPLAQRTRRTYDGLVERGYSEFGSVTSRNADGYYGWESVGPFDKIIVTCGIDHIPPSLLQQLKPNGVMVIPVGPPGAQHVLKVTKQQLADGTFNIVRSDIYNGKVVPFVPFTKLEGDQIVGTHNS

SEQ ID NO: 11937 - protein, 311 aa, Mesorhizobium loti
MKLFAGNSNRVLAEAVARYLNIPLGKATVRRFADQEIFVEIQENVRGEDVFILQSTSFPTNDHLMELLIMIDAFMRSSAKRITAVIPYFGYARQDRRASGRTPISAKLVANMITRAGVDRVLTLDLHAGQIQGFFDIPTDNLFSVPVMARDVKAKYKQLGNVVVVSPDIGGVVRARALAKRFDAQLAIVDKRRERPGESEVMNIIGAVAGKDCLLIDDIVDSGGTLCNAADALLANGATSVTAYITHGVLSGGAVARISGSKLQELVITDSIQPTQGVLDAPNIRVISIADLMGEAISRTATEESVSSLFD

SEQ ID NO: 11938 - protein, 181 aa, Mesorhizobium loti
MKPSLEDTLLASIRTIPDYPKPGILFRDITTLLGNARAFRRAIDELVHPYAGQKVDKIAGIEARGFILGGAVAHQLSAGFVPIRKKGKLPFDTVRVAYSLEYGLDEMEMHKDGVAPGEKVILVDDLIATGGTAEAAVKLLRQIGADILAACFVIDLPDLGGRAKLEALGVPVRTLIGFEGH

SEQ ID NO: 11939 - protein, 626 aa, Mesorhizobium loti
MTAIYRWFENWVYPFREPANLRPPSSVGGFLWHYVGQAKFAFFAMLVIGGIAPLVEAGLFYFVGRLVDILDQLPGERSWHALWTAAGPELVFMIAVVLVIRTIVVGLSALVDEQTITPGFYNLVRWQAHRHVSRQSYAFFQNDFAGRIATKVWQAGQATGDLMESFIEVIWFMVVYTVTTLALVAGLDLRLAVLVVIWISAFGWLAKLYLPAIRKHAEATAEAGSMINGRIVDSYSNVQTLKLFAADGDDRYIRNGFDIYLDALRPFTRRLTGVRMALTTLSGIMITTIGCFAVYLWVEGSITVGAVAFTLSLVLRLNMLLGRVMMQLNGILRNLGVLENSKALISQSLGLVDAPDARELVVAGGRIDVKGVEFHYGKGFGVLNGIDLVVRPGEKVGLVGPSGAGKTTLANLILRLYDLEGGSITIDGQNVAKVTQNSLRANIGVVSQDTALFHRSLRDNIKLGMPDATDAAVIAAAKKAEAHDFILGLRDNRDRAGYEAFVGERGVKLSGGQRQRVAIARVFLKDAPILILDEATSALDSDIEAAIQENLARLMENKTVIAIAHRLSTIAALDRLVVLDGGRIVEQGTHDELVALDGLYARLWKRQSGGFLYHEESVLEETRPAE

SEQ ID NO: 11940 - protein, 628 aa, Mesorhizobium loti
MLLFSWFERRLDPFPAAEPVEPPKTLVAFCLHYTRGAWRYILVDAVLVAAIAIAEVWMFGFLGRIVDWLSGQNRETFLQTEGWKLAGMAFIVLFALPGTVWVHSLLNQQTLMGNYPMRIRWQVHRYLLNQSMSFYQDEFAGRIATKLMQTALAVRECVIKVIDVLNYVIVYFLGMLLIVGSADWRLAAPLAVWLVGYILLLRYFIPRLGKVGEEQANARSIMTGRVVDSYSNIQTVKLFSHAKREATFAREGMMGFLDTVYRSMRLVTVLFGTLYILNALLLFSVTAISLWLWMGQVVTIGAVAVVIGLVLRMWGMSQWIMWEMSGLFENIGTVQDGIASISLPRLVEDRPDSKEIAVSRGEIRFEDIRFHYGKQKGVIENLSLTVKPGEKVGIVGRSGAGKSTLVNLLLRFYDLESGQILIDGQEIAGVKQDSLRAQIGMVTQDTSLLHRSVRENILYGRPDASDEMLVEAARRAEALDFIGGLADHNGRKGFDAYVGDRGVKLSGGQRQRIAIARVMLKDAPILILDEATSALDSEAEAAIQENLYKLMQGKTVIAIAHRLSTIAAMDRLVVMDQGRVIEEGSHDELVAKGGLYAQLWQRQSGGFLLEDIPADVANDVIAKGQAAE

SEQ ID NO: 11941 - protein, 286 aa, Mesorhizobium loti
MKARLWFEALRERICGAFEQIEQDLQGPLASWSPGRFEKTPWERDAGKGGGGTMSMMHGRVFEKVGVHTSTVYGEFSPEFRKQMPGAEEDPRFWASGISLIAHPWNPNVPAVHMNTRMVVTSRQWFGGGADLTPVLDRRRTQDDPDTIAFHRAMQFACEKNVAVADHPKFKTWCDEYFFLPHRNEPRGVGGIFFDWLHSGEDRGGWNADFNFVQDVGRSFLVVYSHLVRANFNENWTDGDRDEQLIRRGRYVEFNLLHDRGTIFGLKTGGNVASILSSLPPEVRWP

SEQ ID NO: 11942 - protein, 458 aa, Mesorhizobium loti
MTAKTFDAIIIGAGQAGTPLAGRLNAAGMSVALIERKLVGGTCVNTGCIPTKTMVASAYAAHLARRATDYGVTLGGPVGVDYKAIKARKDKVSGASRTGLESWIAGMDKCTLYRGHARFESANTVRVGDDLLTADKIFLNTGGRASVPDLPGIHDIDYLTNSSMMDLEVLPRHLIVVGGSYISLEFAQMFRRFGSEITVIEKSPRLTGREDEDVSATILSILENEGITVHVGADDIGFAKQGDDIAVTFSAGKPPAVGSHVLLALGRTLNTDDLGLDRAGVAVDKRGAIIVDDQLRTSVPGIWAMGDCNGKGAFTHTSYNDYEIVAANLLDNDPRKVSDRIEAYALYIDPPLGRCGMTEAAVKKSGRRALVGQRPMTRVGRAVEKGETQGFMKILVDADTRQILGCSVLGPGGDEAVHCVLDLMYAKAPVDTLARATHIHPTVSELLPTIAQELKPLA

SEQ ID NO: 11943 - protein, 260 aa, Mesorhizobium loti
MPATNTLSIPDLAGKAVLVTGASTGIGAALALAYAAQKSKVALHYNSSQEAAEKLAKTIRDSGGEVFLVQGDFSVPADVERVVEDSAQHFGRLDGLVNNAGGMLGRIPYAEQTEAHYDAVMDLNARSVLTASRKAMPWLKKQGGFIVNTSSIAARNGAGGGAGLYGSAKAFVSNVTRGMAKELIGFGIRVNAVAPGTILTPFHERYSTDEQIKGMVATIPQGRAGTAEDCVGAYLFLSSNLLSGYITGQVIEVNGGQLMP

SEQ ID NO: 11944 - protein, 253 aa, Mesorhizobium loti
MNPNGQIAIVTGGGSGLGEATARALAAKGARVAIFDVGIERAAKVAADIGGISVQCDVSSADSGTAALAETASKLGEPRILVNCAGIAIGVKTIGKDGPHPLDQYRKVIEVNLIGTFNMIRLVADRAASLEPLQGGERGVIVNTASVAAYDGQIGQAAYSASKGGVVGMTLPVARDLARSGIRVCTIAPGIFKTPMMAGMPQEVQDSLGAAVPFPSRLGEPSEYAALALHIIENQMLNGETIRLDGAIRMAPK

SEQ ID NO: 11945 - protein, 433 aa, Mesorhizobium loti
MRRIVVTGMGAVTPLAANVEASWSRLLAGRSGIRRLPDDVVGDLPAKIGGVVPSLDEDPGAGFDPDGILAAKDQRRVDRFILFALAAAEEALAQAKWKPALETDRLRTATIIASGVGGFPAITEAVRTVDLRGARRLSPFTVPSFLVNLAAGHISIRHGFKGPLGAPVTACAAGIQAIGDAARLIRANEADIAVCGGTEACMNTVSLGGFAAARSLSTGFNWAPAQASRPFDISRDGFVMGEGAGVLVIEALGHALARGAKPLAELVGYGTTADAYHVTSGPEDGGGARRAMEIAIAQAGISPSEVRHLNAHATSTPVGDLGEIEAIKSVFGRDLAIAVSATKSATGHLLGAAGGLGAIFSILAIRDQVAPPTLNLSAPDPAADGIDFVANEPRPMEMEYAISNGFGFGGVNASALFRRWIAPAARRERQGQS

SEQ ID NO: 11946 - protein, 271 aa, Mesorhizobium loti
MNKINPGVALVTGASSGIGRATADALLSAGYRVFGTGRRTASKQSDGVTMLTCDVTDDTSVAKMVDDVLAKAGRIDLLVNNAGMGLFGGAEESSTAQAQALFDVNVFGVFRVTNAVLPAMRRQGTGRIVNLSSVQGLIPAPYFALYASTKHAIEGYSESLDHELRPFGIRVSLVEPAYTRTSFEDNLAAPDQLLDIYDSARAGMTVAVRKAMEKGDAPEVVAKTVLAAATDPAPKKRYAAGKMARQVSLLRRFVPASAFDKSLRKQLGLPA

SEQ ID NO: 11947 - protein, 972 aa, Mesorhizobium loti
MRTTCPYCGVGCGVLAKVAADGQVSVRGDPDHLANFGRLCSKGSALAETIGLDGRLLHPEIHGRRTGWNEALDIVASTFSQTIAEHGSDAVAFYVSGQLLTEDYYLANKLMKGFVGSANIDTNSRLCMASSVAGHRRAFGSDTVPGTYEDLERADLIVLVGSNVAWCHPVLYQRIAAAREKRPEMKIVLVDPRRTMTSDIADMHLAIAPDGDVALFTGLLAWLGQHNALDRAYITAHTTGFGQALFAASALDLAGVAAATGLSEDELGGFYSLFAATAKTVTVYSQGVNQSSSGTDKVNAIINCHLATGRIGKPGAGPFSVTGQPNAMGGREVGGMANMLAAHMEIENPEHRDRVQRFWNAPGIAQKPGLKAVEMFQGVADGRIKALWVMATNPVDSMPDADAVEAAIKACPFVVVSDVLASTDTVRHAHVRLPAAAWGEKDGTVTNSERRISRQRSFLSAPGEARPDWWIIAEVARRMGFGEAFAHETPAEIFGEHAALSGFENDGGRDFDIGAYAGIDSVSYASLEPFQWPAPSQGTPLWPAGHIPRKGGDQPSLLPSPIVNVSERVAGPKLPISPLEGGEEWSAQRTESQLLGFPNDERPERQRRAGTGRTEGGDQARHLQQANGTTERDPTRFFANGHFYTADRKARFIAIRPTTETRTTPDFPLILNTGRIRDHWHTMTRTGKSPRLSQHIAEPFVEIHPLDAQHHGIGDADIVRISSPRGDVLVRALITPRQRQGSVFAPMHWTDQFAAKGRLDALTAPLIDPVSGQPALKHVAARIEKFAAKAFAFAVMRRRPEAIAADYWAVARCRGGWRVELAFANDDADWTAFAGSLFEAPSTEMLAYHDRDAGQHRIAAFDGEHLTGALFVARGPVAVSRGWAAEQLEEVQASQRERFRIVAGRAGAERPDAGATVCSCFSVGANQIVAAVAAGCTTVEAIGGALKAGTNCGSCRSEIRALIQASRVQAAE

SEQ ID NO: 11948 - protein, 504 aa, Mesorhizobium loti
MTIAKETAELLAKLGVAKDALVGGDLIVRSPVTGEQIAALKTISPADAAKTIDAAHKAFQSWRLVPGPKRGELVRLLGEELRAHKAELGRLVSIEVGKIPSEGLGEVQEMIDICDFAVGLSRQLYGLTIATERPGHRMMETWHPLGVVGVISAFNFPVAVWSWNAALALVCGDAVVWKPSEKTPLTALACEAIFKRAVKRFGADAPQGLAPVLIGDRAVGEILVDHPKVPLVSATGSTRMGRDVGPRLAKRFARAVLELGGNNAGIVCPTADLDMALRAIAFGAMGTAGQRCTTLRRLFVHESVYDALVPRLKKAYQSVSVGNPLETSSLVGPLIDKAAFDAMQKALTEAAAHGGKVAGGARVENGHPDAYYVHPALVEMPKQVSPVTEETFAPILYVMKYSDFDAVLDEHNAVGAGLSSSIFTRDLQESERFLGVDGSDCGIANVNIGTSGAEIGGAFGGEKETGGGRESGSDAWKAYMRRATNTVNYSKALPLAQGVSFDID

SEQ ID NO: 11949 - protein, 398 aa, Mesorhizobium loti
MAADKNAFVWEDPFLIEDQLSEEERMVRDGAAAFAADKLAPRIEDAYLNEKTDAGIFREMGEAGLLGITIPEEYGGLGANYVTYGLVAREVERVDSGYRSMMSVQSSLVMYPIHAYGSDEQRKKYLPKLASGEWIGCFGLTEPDAGSDPGGMKTRAEKTANGYKLSGSKMWISNAPIADVFVVWAKLKGETGKDEIRGFVLEKGMKGLSAPKIGGKLSLRASITGEVVMEGVEVGEDALLPNAKGLGGPFGCLNRARYGISWGSMGAAEDCWHRARQYGLDRKQFGKPLAGTQLYQKKLADMQTEIALGLQASLRVGRLLDAGKMAPEMISIVKRNNCGKALDIARQARDMHGGNGIQIGYHVMRHAQNLETVNTYEGTHDVHALILGRAQTGIQAFF

SEQ ID NO: 11950 - protein, 466 aa, Mesorhizobium loti
MSLDRSSIRAPERQLQPAPDDRLAALERVIRRFSNTDGLVKRGGLVTEVTQTHYKVRGLSDFARLGDMVEQRGQAGSRRGEIVKISRDEVVVAPFERSADAGIGDAVFRRGPLAVGPHNSWRGRTIDALTRAIDGGPPLIRGEDLSGGATTPGAMARQRVGTAFMTGVKVIDIFTPLCFGQRMGVFAGSGVGKSTLLAMLAGADAFDTVVVALIGERGREVREFLEDTIGDSMAKTVAVVATSDESAMMRRRAPDTAMRVAEHFRDQGHRVLLVLDSITRFAHALREVATGTGEPPVARGYPASVFTELPKLLERAGPGAEGKGSITAIISVLVDGDDHNDPVADSVRGILDGHVVLDRAIAEQGRYPPVNPLSSISRLAGKAWSVEQRALVTRLKSMISRFEDTRDIRLLGAYQGGADAELDIAVRQVPLIYEALTQSPRDRPSADPFSDLARHLKGKLNAESGD

SEQ ID NO: 11951 - protein, 377 aa, Mesorhizobium loti
MATQRILDFLATRRPSGPCLVVDLDVVRDNFRAFEKALPDSKIYYAVKANPAPEILRLLAAMGSSFDTASVAEVEMAMDAGAPADRISFGNTIKKERDIARAYQLGIRLFAVDCVEEVEKIARVAPGARVFCRVLTDGEGAEWPLSRKFGCVPAMAVDVLRHAKGLGLDAYGVSFHVGSQQTDLTAWDRALADAKKVFATLAEEGIVLKMVNMGGGFPTRYLRDVPAAQAYGQAIFSALRKHFGNAIPETIIEPGRGMVGNAGVIKSEVVLISKKADNDNVRWVFLDIGKFGGLAETMDEAIRYPLVTRHDGSETAPCVLAGPTCDSADVMYEKTPYPLPLSLTIGDEVLIEGTGAYTTTYSAVAFNGFEPLRSYVI

SEQ ID NO: 11952 - protein, 248 aa, Mesorhizobium loti
MGKLNNKVAIVTGAARGIGAGIAKRLAAEGAAVVVNYATSREAAERTVKEIVAAGGKATAVQGDVAEAAEVEKMFEAAEIAFGKPSILINNAATASFGTFEEASEADYRRLFDTNVLGTILTTKAAMRHFPETGGSIVNIGTISSWNPVPNTSLYSASKAAIDTLTLSLSRELGARNIRVNIVAPGYTHTEMTEGMVGTDFGNMLIAGVPLGQRFGKPDDIAPTVAFLASDEAAWLTGERINASGGAR

SEQ ID NO: 11953 - protein, 706 aa, Mesorhizobium loti
MKKLAAIAALSVSTLGLSAGASFADYTLNILHFNDWHSRIEGNNKYESTCSADEETKGECIGGAGRLITAIAQERKKLEGQNVLLLNAGDSFQGSLFYTTYKGTVEEEFLNQMKPDAVTLGNHEFDDGESALVPYLDKAKFPIVSANVMPNDKSGAAGKIKPSIVVEVGGQKIGIVGAVTNDTPELASPGPNIAIADDVESITAEVEKLKAQGVNKIIAVTHIGYNRERDIIAKIPGVDVVVGGHSHTLLSNTDPKAAGPYPTMVDNPGGYKVPVVQAASYSKYLGEFKVVFDDNGVVKSASGDPIFLDKSITPDPAVLARIKELGAPIEALKNKEVAETTDVIDGSRENCRAKECEMGNLVSDAILDRVKGQGVEIVISNGGGLRASIDKGTVTMGEVLTVLPFQNTLATFQISGKDLVAGLESGLSQIEDGAGRFPQVAGLKYSFDKSVAPNAGRVKSVEVMENGAWTPIKPDKDYLVATNNYVRQGGDGYKVFAERAKNAYDYGPGLEQVVADYLGAHRPYTPKLDGRITEIAATVAAAPAAEPAKPAEATPAPAPAQPAKPAEAAKPAEPAKPAEAAPAMPELPANSGNIANTPPAISTEAAPPPAPATPAPAPAEPAKPAEAAPAPAAPVPAEPAKPAEPAKPAEAAPATGSHVIVAGDTYWDLAKKAYGDATKWKLIYEANKGQRPHRLTPGATLTIPAK

SEQ ID NO: 11954 - protein, 353 aa, Mesorhizobium loti
MTSAIAVDPKAAKPVGVTAGHAPAGAGKVGVLLVNLGTPDGTEFKPMWRYLREFLSDPRVIELNKAIWYPILYGLVLTTRPKKSGANYARIWNQERNESPLRTYTRAQSEKLAEALGDLPDVTVDWAMRYGNPSTASVAERLVAQGCDRILSFPLYPQYSATTTATANDQLFRALMKLRRAPAIRSVPPYYAEPVYIEALASSIERHLATLDFEPEVVITSYHGIPKPYSDKGDPYQAHCLETTRLLREKLGWDEKKLITTFQSRFGAQEWLQPYTDKTVEKLGKDGVKSIAIVNPGFSVDCIETLDEIGREAAETFHHAGGKNFAHIPCLNDSAEGMTVIEAMVRRELSGWV

SEQ ID NO: 11955 - protein, 301 aa, Mesorhizobium loti
MKRVRKAVFPVAGLGTRFLPATKAVPKEMLTVVDRPVIQYVVDEAREAGIEHFIFVTGRNKAVIEDHFDIQFELYDTLAQRGKDEQLARLQRLQPAPGQTSFTRQQVPMGLGHAVWCARELVGDEPFALLLPDMIMQSEKSCMKSMVELYEETGNNIIAVQECDPAEAHKYGIVGRGEDTHHGFRITEMVEKPKTGTAPSNLYINGRYILQPEIFKILEGQEKGAGNEIQLTDAMLKLEKQQAFYGYHYQGRTFDCGSPEGFVEANVAFALWRSDMKENMAGVIRTLLDEMTPSERRVAVS

SEQ ID NO: 11956 - protein, 325 aa, Mesorhizobium loti
MTDLLHDTPLFHETEGNPRPENATGGFFITRDRKKIRYGLFAAVARPMRGTVVLLSGRNECIEKYFETIRDLAARGFGVATLDWRGQGDSDRLIRDRQRGYVRSFRDYTADLEQFFEEIVLPDCRGPYYILAHSAGAVIALLAAPSMVNRVRRMVLIAPFLTLPDLPVSIRTVRRVCSVFCALGLGRLYAAWGPRPRHTLPFEANKVTSDPRRYRRNTRIYEEYPRMALGGPTIRWLQAAAKASEAISDPDFMARIQVPLLIIAAGADRVVSTRAVEAYARSLRLGSLLMIDGSKHEILQEVDLYREQFLAAFDAFIPGSDDPTA

SEQ ID NO: 11957 - protein, 524 aa, Mesorhizobium loti
MSTPSRPSRCRYSQEARETVPMNAPLNIAMPAEASAAPKNYRLLIDGKHVDARDGRTIARKSPGHGFTVSRYAQAGEAEVEAAVQAAHKAFETGPWPRMKAGERAAILFRAADLIEARLEDIARLDALESGKPIAQARGEIGGAVDIWRYGASLARTLHGESYANLGDAMLGVVLREPIGVVSIITPWNFPFLIVSQKLPFALAAGCTAVVKPSEMTSASTFVLGDILLEAGLPAGVVNILAGLGADVGAPMVSHPLVEMVSFTGSTRVGKMTMASAAQSLKKVSMELGGKNGQIVFPDADLEAAADAAVFGGFFNAGECCNAGSRLIVHEAIADDFLSAVKALTARVTVGDPLDDQTKVGAMISSDHLAKVTDYVTAAAGEGSNVYSGGKQLASNAGQYLDPTIIRGVTEDMAIAREEVFGPVLSVLTFESIEKALHIANNTPYGLSAGVWSASIDTCMSVARGVRSGTVWVNTFMEGYPELPFGGYKQSGLGRELGKRAVEDYTEEKTIQFHRGQRTGWWVG

SEQ ID NO: 11958 - protein, 253 aa, Mesorhizobium loti
MTRPAAIVTGGARGIGLACAEALADAGFDILVADLAEQAPDGLDTDISARGAKLAYVSCDVANLDSHAVLIDAAMRVFGRIDCLVNNAGVGAVVRGDLLELKPENFDRTLGINLRGTVFLSQAVAKAMLATLGDHTRSIITVTSVSAEMASPERSEYCVSKAGLSMWVKNLALRLAPENIGVFEVRPGIIRTDMTAGVTAKYDALIEGGLVPAKRWGEASDIGAMVATLAAGRLGFSTGSIINVDGALSVPRL

SEQ ID NO: 11959 - protein, 542 aa, Mesorhizobium loti
MTDYIIVGAGPAGCVLANRLSEDPGNSVLLLEAGGKDWHPYIHMPAGFAKMTKGIASWGWSTVPQKNMKDRVFWYTQAKVVGGGSSINAQIYTRGNARDYDAWEKEEGLAGWGYRDVLPYFKRAENNQRFANDFHGDQGPLGVSNPISPLPICEAYFRAGQEMGIPFNPDFNGANQEGVGYYQLTQKDARRSSASVAYLKPIRARKNLTVRTDVLVTRIVVEKGRAVGVEVVDRPGGEKKILHAEREVIVSSGAIGSPKLLMQSGIGPADHLKSVGVTPVHDLPGVGSNMQDHLDLFVIAECTGDHTYDNYAKLHRTAWAGLQYLLLKKGPVASSLFETGGFWYADPTAASPDIQFHLGLGSGIEAGVEKLNNPGVTLNSAFLRPRSRGTVRLKSADPANHPLIDPNYWSDPYDRAMSIKGLRLAREIMRQKALEPYVLREVLPGPSLASDDELFDYACRSAKTDHHPVGTCRMGHDEMAVVTPDLRLRGIEGLRVCDASVMPRVPSSNTNAPTIMVGEKGADLILGREPLPPAVFSGNRAA

SEQ ID NO: 11960 - protein, 390 aa, Mesorhizobium loti
MSKLISKWNYPTTVRFGAGRIKELPEVLEATGIKRPLFVTDPGLAKLPVVASTLKILDDAKVPYGVFSEVKPNPVDSNLTAGIAVFKKGKHDGVIAFGGGSALDLGKLIAFQAGQTRPVWDFEDVGDWWTRANSDAIAPIIAVPTTAGTGSEVGRAGVITNEETHTKKVIFHPKLLPAIVIADPELSVGMPAFITAGTGMDALAHCLEAYCAPGYHPMADGIAVEGIRLVFENLPKAYANGKDLVARAHMMSAAAMGAAAFQKGLGAIHSLSHPIGALYDTHHGMTNAVFMPYVLAFNRDSIEERIARLAAYCGIKGGFDGFAKAIIKLRKELKVPHALPGLIKGLDMDKKRKALIADMAVVDPTAGGNPVKLTKKAALTLLENAIAGTI

SEQ ID NO: 11961 - protein, 462 aa, Mesorhizobium loti
MTETVKLKSPIDGSIYAERPVATDQAVNAAVERAKAAQEKWAETPIVERGKYMLAMLEALVAMTDEIVPEIAWQMGRPVRYGGEFGGVKERTNYMVEIAEQALKSVPASNPKDGFRRYVKKDPLGVVMVIAPWNYPYLTAVNTIVPALMAGNAVILKHAAQTLLVGERFQQAFDKAGLPKGVFQNVVLNHAQTEKLLGSGKIDHVNFTGSVGGGRAIERAAAGTFMTLGLELGGKDPAYVLPDAKMDHAVANLVDGAFYNSGQCCCGIERVYVHEKVYDEFVEGFIAETKNYVVGNPLEQTTTMGPMAQARFADLIREQKAEALRKGAKAHINMKMANDKAGSPYLAPEVLTEVDHQMSVMREESFGPIVGIMKVRNDEEAIALMNDSAYGLTASIWTRDTEHAVAIGNRVETGTVFMNRCDYLDPALVWTGVKDTGKGAGLSAIGYDNLTRPKSFHLREAI

SEQ ID NO: 11962 - protein, 260 aa, Mesorhizobium loti
MEVIMTKTPFKTLEDKVALITGASSGIGRATAVELARRGAKVIASARRAFEIETLVADIKNEGFEATAVVADVNVEHSVIDLVAKTISTYGRIDIAFNNAGTEGMFSPFVDQTNETYDTIFNANVRGVFWSMKHEAKAMLAQGGGAIINNASMGGVIGFANAGLYIASKHAVLGLTKTASIELFKQGVRVNAINPGIIDTPFQDRIWPSAEAKDAFAASTVPGRAGSPEEMAAVVAFLASDDASFVSGHGLLADGGYSIA

SEQ ID NO: 11963 - protein, 410 aa, Mesorhizobium loti
MNLGMTERLKPIHARVAAMVRDEIMPLDKEFLGEVGKAGDRWVYSPRQSEILEGLKKTARERGLWNFWLTGSERGYGLSTVEYAYLAEEMGKAHLGAETFNCSAPDTGNMEVLERYGSADHKKEWLEPLLDGKIRSAYLMTEPDVASSDATNIGMRCERQGDDYVLNGEKWWASGAGDPRCAIYIVMVRTGGDGEPQHRRHSMILVPSDTKGVTKLRAMQVYGDDDAPHGHMHLRFDNVRVPASNLILGEGRGFEIAQGRLGPGRIHHCMRAIGQAEMALEMLCQRSVRREAFGQKLAKLGANFDIIAECRMEIEMARLLCLKAAWMIDQGDARAAAPWISQIKVIAPRVALRITDEAVQMFGAQGISQDTPLARSWTHLRTLRLADGPDAVHRRQVARTELKKYTQEKL

SEQ ID NO: 11964 - protein, 271 aa, Mesorhizobium loti
MAYLDELFSVAGKTALVTGAATGIGRMAAAALVKAGASVMIASRKGEDCIKVANAFNGLGAPGRAEGFAGDVSSEAGIAALVAEVKARTGKLGILINNAGVSWGAPLESFPYSAWAKVLGVNVTAVFHLTRELLPLLEAAASDADPARVINLGSVMGTQPLADDAYSYTASKAAVHHLTRTLALEFAARRITVNAFAPGPFQSRMTAFATGTDEQAKHVGGHVPIGRIGAPDDIAGATLYLCSRAGSYVTGAILPIDGGQSVQHGLTLFKE

SEQ ID NO: 11965 - protein, 258 aa, Mesorhizobium loti
MGRFDGATVLITGAAGGLGRGAAKGFASEGARLVLSDIDEKALADLAATLPAETAILAGNVADEKLSEDLVRLAVEKFGRLDVTVNNAGIVQSFVRLPQVPSDEARRVLEIDLLGVFYAMKHQIPQMERQFRATAKGGAIVNIASVAGLVGAPKLSVYAAAKHGVVGLTKSAAAEYATKGVRINAICPAHTRTAMVDSFVRASGAPEAEALAELTRGVPMKRVAEVDEITTAILFAADPANSFMTGHALAVDGGVGAI

SEQ ID NO: 11966 - protein, 259 aa, Mesorhizobium loti
MQKMLALANKIAIVTGASSGIGRATAKLFAEEGARVVVAARRQAELDTLVAEISDAEGTAVALAGDVRDEAYAKALVDLAVESFGGLDVAFNNAGAVGQMGPISGLSLEGWRETLDTNLTSAFLGAKYQVPAMIERGGGSLIFTSTFVGHTIGMPGMTSYAASKAGLIGLTQVLAAEHGPQGVRVNALLPGGTDTPASITNAPDAGPEVLAFVQALHALKRMAQPEEIARSALYLASDASSFTTGTALFADGGVSINRT

SEQ ID NO: 11967 - protein, 280 aa, Mesorhizobium loti
MNAMSVERGTALRGFALTAALLSGLLLAGCQTSGPTGEFNNIDKAQGSSENISSLSAVIQRNPQDPEGYNVRGSAYGRGGQYQAALKDFNQAIQLNPNFYQAYSNRALIQRFLGNQAAALGDYNKSIQINGNYDAAYIGRGNLYRKAGRTQDAFNDFQKAIQLDTTDARAYHNRGLIYQSQGQHKFAIEDFSTAISLAPDAAEPYNGRGLSYLATGDEDNAFSDFNMAIKLDGQNAEAWANQALIYERRGDKAKAAKSYKEAVRLNPNYQPAKDGLARVS

SEQ ID NO: 11968 - protein, 524 aa, Mesorhizobium loti
MSSVGAGFRLARAGWVLVREGVIAALPGEELSGLPKFGWQLARLFTRRRALAYQRSDRLAKAVVRLGPSYVKLGQFLATRPDVVGNDMALDLAMLQDKMHTFPKAEAVAAIEASLGRKVRDLYAEFGDPVAAASIAQVHAAEAIHDGVATKVAVKVIRPGVRRRFFQDLESYFLAARLQEKYIPSSRRLRPVEVTETLAQTTKIEMDLRLEAAALSELGENTKDDPGFRVPSVDWERTGRDVLTMEWVDGVKMNNIAGLEEAGHDLKAIAANLIQSFLRHTLRDGFFHADMHPGNLFVEANGTIVAVDLGIAGRLGKKERRFLAEILYGFITRDYLRVAEVHFEAGYVPRQHNVAAFAQAIRAIGEPIHGQPAETISMAKLLTLLFEVTELFDMATRPELILLQKTMVVVEGVARTLDPAFNMWKTAEPVVGGWIAGNLGPRIMMIDARDGAKALLTLARQAPELAARTDRLSREIDLMAEHGLRFDETTARAIGKAEARYSRSGRVALWVIALTLVYIAWKIL

SEQ ID NO: 11969 - protein, 306 aa, Mesorhizobium loti
MIVVVGSINLDLIAKVDRLPSPGETVRGSGFSTAPGGKGANQALAAARAGVPVRMVGAVGKDSFAGEALALLREAKVDLSGVAETFASTGTALIMVGDDGENIIAVVSGANASVVTGDLSKAFLKKGDVVLLQHEIPLATVDAALDQARAAGAITVLNTAPFQGDATAFLGKADYVVANETEFDLYGEALALNGRDRAARMRDFAAKTGRSIVVTLGGDGVMAATPSDFLTVAAMKITPVDTVGAGDTFCGYFAAGLSSGLALDQALARAGAAGSLACLKPGAQPAIPLAKDVDQALQEVSRNDAP

SEQ ID NO: 11970 - protein, 272 aa, Mesorhizobium loti
MASLSSLTARLPGRAAAKVSAPATITVDKTKFKGTLIAKGLTKSYKGRKVVSGVTLGVRAGEAVGLLGPNGAGKTTCFYMVTGLVPVDEGTIEIDGFDVTSMPMYRRARLGIGYLPQEASIFRGLNVEQNIRAVLEVVEKDRKVRERNLDELLEEFHISHLRKAPSMSLSGGERRRLEIARALATRPAYMLLDEPFAGIDPIAVADIQQLVRHLTARGIGVLITDHNVRETLGLIDRAYIIHAGQVLTHGRADEVVANPDVRRLYLGEGFTL

SEQ ID NO: 11971 - protein, 340 aa, Mesorhizobium loti
MNMISPDAAANSKRAWLKILARYKKPDRRRSAVELAITLIPFATLWALSSAAYAYGHWWGLILILPAAGFLVRIFMIQHDCGHGSFFANRYADDWIGRALGVLTLTPYDCWRRAHATHHASAGNLDERGMGDIRTLTVAEYRQLSWRGRLAYRLYRHPLVMFGLGPIWLFIFSQRLPIGMMRGGLTPWVSSMTTNLAIALAAALLIWAVGPGAFLVVHLPIVILAGSAGIWLFYVQHQFEETEWAKDDDWEFQHAALHGSSYYDLPPVLNWFTGNIGVHHVHHLSAKVPGYRLQEVLRDYPELRGIGRVTLLDSLRCVKLALWDENRRKLVSFREARATM

SEQ ID NO: 11972 - protein, 535 aa, Mesorhizobium loti
MDFDYVIAGGGSAGCTLAARLSEDPSKTVCLIEAGGAGSNLLIRAPAGIIALLPGRPKINNWAFETVPQQGLGGRKGYQPRGKALGGSSAINAMLYTRGHRGDYDEWADLGCDGWSWDEVLPYFRRAEGNQRGADALHGGDGPLRVAEQQEPRPLSRAFVEACGENQIRRNDDFNGVEQEGAGLYQVTQFWGERRNGERCSVAAAYLQPAMNRSNLTVITGAHATAVILDGKRATGVRYRAGKDEAVAKARREVIVCGGAFGSPQLLLLSGIGPAAELAMHGIPVIHELPGVGKNLQDHLDFIMGWTSKDADMMGIGLRGLPGLLRHMLRWRKDGGGMIATPYAEGGAFLKSDPAIERPDLQLHFCIAIVDDHGRKLHMGYGFSCHVCVLRPHSRGEVGLSTHDPMAPPRIDPRFLSDERDAELLLKGVRMMRGILEAPALARYRHKEIYTAGVSSDADLMSHIRARADTIYHPAGTCKMGVDELAVVDPQLRVHGLEALRVVDASVMPTLIGGNTNAPTIMIAEKAADMIKAAA

SEQ ID NO: 11973 - protein, 254 aa, Mesorhizobium loti
MLAKPRPLDHIGDADDGVAAKAAGLDALYGHLKPLEIIERSARELFHDEIAAVSSFGADSAVLLHMIAEIDRTLPVIFLDTGKHFEETLGYRDALVADFGLTNIQVIKPEEAALARIDPTGNLHQSNTDACCDVRKVEPLARGVAPFRAWFTGRKRFQASTRAALPVFEAVGARIRINPLAHWTTSDQADYMRAHALRENPLVAYGYLSIGCFPCTQPVQPGEDARSGRWAGHAKTECGIHLSGLEVSLTDASL

SEQ ID NO: 11974 - protein, 556 aa, Mesorhizobium loti
MYRYDEFDHDFVQARVAEFSDQVQRRLSGEISEDQFRPLRLMNGVYLQLHAYMLRIAVPYGTLNGKQLRMLGHIARKYDKGYGHFTTRQNIQFNWPALSDIPAILADLASVEMHAIQTSGNCIRNVTADHFAGAAADEVADPRPYAEILRQWSSVHPEFSFLPRKFKIAVTGAERDRAAIQTHDIGLHLKKNAAGELGFAVYVGGGQGRTPMVARKIRDFLPEADLLSYCTAILRVYNLYGRRDNKYKARIKILVHETGVEEITRQVEAEWQDLKDAELKLPDADIRAIQAYFAPPELADRPEGDQAVKLARLDSKGFSEWLDQNVVTHRHPDYAAVTISLKGIGEVPGDASDSQMEAIADIAEKYAFDELRVSHEQNLILPHVARADLKAVYDALVDIGLATANSNLISDIISCPGLDYCALATARSIPIAQEISQRFASLERQREIGELKLKISGCINACGHHHVGHIGILGVEKKGSELYQVTLGGSADENTSVGEIIGRGFSSEEITDAIEQIVETYLGLRLNPQEKFIDAYRRVGPAPFKEALYAGETKAA

SEQ ID NO: 11975 - protein, 356 aa, Mesorhizobium loti
MHRLPKEVGSWIYNFFYNEHSIAYLKIDAQLCVAAKGGNVKHYGLSSLRIGQPVADQLEFMEGLLPSPELPYHMAMVELPSGRVADLHLFADNAYVWLLFLDATAERDNKQRLQQKAYEMTLLQERERQLNEKLQSMNEALRESQEGLQREYQRAETLLLNILPASIAERLKADEQIADNHAEVSVLFADIVGFTERARSVGAVTTLAILNYFFKAADRLSEQYGCEKIKTIGDCVMVVAGLPAARPDHAEALARYALELREAVQHERFAGERLRLRIGIHSGPIVAGVIGKRRFAYDLWGETVNLAARIQTSAEPDEIRISDATRRLLGPDFACDPLAETELRGTGRVRMWRLPA

SEQ ID NO: 11976 - protein, 168 aa, Mesorhizobium loti
MELKMLQKKICMLGGFGVGKTSLVRRFVQSIFSETYLTTVGVKIDKKSVALPDKTVDLILWDLAGEDDIGSFRVSHVRGATGLVLVVDGTRAATLAAALTLRERVEAEFGTMPFVLLFNKSDLADRWEISDGDIDNLRQLGWQIYLTSALSGEYVDDAFHQLASMVAK

SEQ ID NO: 11977 - protein, 424 aa, Mesorhizobium loti
MIGLGYVGLPLAVATARAGFPVSGFDIEARKVERLNNGQSYIEAVTSTALAGEVASGRFRATADFAELTVCDVIIICVPTPLTKHREPDLSFVRNTAGTIAKHLRLGQLIVLESTTYPGTTDDVIKPILEETGLQSKIDFFLGFSPEREDPGNRSFEVATIPKVVAGDGVDAATLVQAFYQGVIETVVPVSTTATAEAVKLTENIFRSVNIALVNELKIVLGAMGIDIWEVIEAAKTKPFGYMPFYPGPGLGGHCVPIDPFYLTWKAREYELPTRFIELAAEINTAMPRHVVDELAKALDRRCGKALSRSRILIIGLAYKKNVPDIRESPSLRLIELIEEWGGKAEFHDPHVTEIPTTREHMAIKGRRSVELTEAALKDFDAVVVATDHDAIDYQAIADHALLIVDTRNVFGRLGLARETVVKA

SEQ ID NO: 11978 - protein, 322 aa, Mesorhizobium loti
MHRVTEARAKAAAENPDGTDRVYGGNQAEKGAYPFQVALLTTARLDDNPASQANAQFCGGSLIAPQWVLTAAHCLNDKGRPISPDSVTVLTGATDLSEGNRHKVLEVIVNEGYSEQTLDNDLGLLRLAEPADAPAIKLTREATPDTGKTTVTGWGKMQDGTFPTTLMVADLDLQPNSTCNSGIKAIYAHDLKAALGDLSHRMRYSEKGIDAAANAIAADMTDPLTGNMICAGTTSGVRDACNGDSGGPLFMTGADGPVQVGVVSWGEGPADGSAACGHKDAYGIYTRLANYGGWIEAKMKTPAPAPEKPKAGLGTAQKPKTP

SEQ ID NO: 11979 - protein, 475 aa, Mesorhizobium loti
MEKAEIGLIGLGTMGSNLALNIAEHGHRIAVFNRTRARTDAFVENAGALKDMVVPCYSLEELAAAIRPPRPIIIMVLAGKPVDEQIEALRGVLSGNDIVIDAGNANFRDTMRRFSELSGSGLTFIGMGVSGGEEGARHGPSIMVGGTEDSWKRVEKVLTAISAKFKDEPCAAWLGTDGAGHFVKTIHNGIEYADMQMIAEIYGILRDGLGMGPKDIGTVFSNWNKGRLNSYLIEITAKVLAADDPKTGKPVVDIILDRAGQKGTGKWSVIEAQQLGIPATAIEAAVAARVLSSIKDERLAAEKAYGNIGVSKISGDKDALLKDLELALFAGKIAAYAQGFAVMSGASKEFNWNLPMPTIARIWRAGCIIRSQMLDTMAEAFSSGGASTNLLMAPAFISLMQEAHPSLRRIVAKASEAGAPVPALSSALAYFDSYRQGRGTSNLIQAQRDFFGAHGFERIDEQGAFHGPWGSGAAG

SEQ ID NO: 11980 - protein, 338 aa, Mesorhizobium loti
MKAVICRSPGELVLEDRPAPGAPPAGWALVAVSHVGICGTDYHIFEGKHPFLAYPRIMGHEVSGTVIETGEGPDLAIGEPVVINPYLSCGKCIACRHGKPNCCVKIEVLGVHRDGAMCERILVPAQNLYPANGLSLADAAAVEFLAIGAHAVRRARADSGARALVIGAGPIGLGNAIFARIAGLDVTLLDMSSERLAFAENELGFSILDGSRGAVPDLVKDATSGEGFDVVFDATGNTRSVQSAFAHVAHGGTLVLVSVVKDDIVFSDPEFHKREMTLVGSRNALRADFDHVAASIRNGAVPLAKLVTHRTTLADTPSDLARWAHEKSGLIKAVIEIG

SEQ ID NO: 11981 - protein, 302 aa, Mesorhizobium loti
MTLQGKVALVAGGTRGAGRGIAVELGAAGATVYVTGRSTRAQQSEYARPETIEETAELVTANGGSGIAVQADHLVADDVRGLIERIRKEQGRLDILVNDIWGGEKLFEWDKPVWEHNLDNGLRMLRLAIDTHLITAHHALPLMIEQPGGLLVEVTDGTAEYNAEHYRLSPFYDLAKVAVNRMAWAHAKDLAKHGATSVSLTPGWLRSEMMLEAFGVREVNWRDATAKVPHFIISETPRFIGRAVAALAADTDRSRWNGQSLSSGGLAQVYGFTDLDGSRPDAWRYVPEVQDAGKPADATGYR

SEQ ID NO: 11982 - protein, 868 aa, Mesorhizobium loti
MNLEKYSERVRGFIQSAQTMALSRNHQQFTPEHILKVLVDDDEGLAASLIERAGGNVRDVKLGVETALEAMPKVEGGNGQLYLAQPLAKVFSTAEELAKKAGDSFVTVERLLQALTMEKSAKTADILAKAGVTAQALNQVINDVRKGRTADSASAEQNYDALKKYARDLTADARAGKLDPVIGRDDEIRRTIQVLSRRTKNNPVLIGEPGVGKTAIAEGLALRIVNGDVPESLKDKQLMALDMGALIAGAKYRGEFEERLKAVLSEVTSANGNIILFIDEMHTLVGAGKADGAMDASNLLKPALARGELHCVGATTLDEYRKHVEKDPALARRFQPVFVDEPTVEDTVSILRGLKEKYEQHHKVRISDSALVAAATLSNRYIADRFLPDKAIDLVDEAASRLRMQVDSKPEALDEIDRRIMQLKIEREALKVETDDASKDRLVRLEKELVGLEEESTEITAKWQAEKQKLGLAADLKKQLDEARNELAIAQRKGEFQRAGELAYGKIPELEKKLKEAEAQDGKAGMVEEVVTPDHVAHIVSRWTGIPVDKMLQGERDKLLRMEDEIGKRVVGQGEAVQAVSKAVRRARAGLQDPNRPIGSFIFLGPTGVGKTELTKALASFLFDDDSAMVRIDMSEFMEKHSVARLIGAPPGYVGYEEGGALTEAVRRRPYQVVLFDEIEKAHPDVFNVLLQVLDDGRLTDGQGRTVDFRNTLIIMTSNLGAEYLVNLGEDQDVDAVRDEVMGVVRASFRPEFLNRVDEVILFHRLRRKDMDRIVEIQFKRLESLLVDRKITLSLDHEAIEWLAAKGYDPAYGARPLKRVMQKELQDPLAEKILLGEILDGSTVKVTSGSDRLNFRSKPTVVATEAAA

SEQ ID NO: 11983 - protein, 756 aa, Mesorhizobium loti
MRDQASGPRVLLKRLRELMQEPLEPQERLDRIVRDIASNMVAEVCSLYVLRADSVLELYATEGLNPNAVHLAQLRLGQGLVGTIAASARPLNLSNAQEHPAFAYLPETGEEIYNSFLGVPVLRAGRTLGVLVVQNKTMRHYRDDEVEALETTAMVIAEMIATGDLARLTRPGLELDLRRPVSFTGLSFNDGVGLGHVVLHEPRIVVTNLFNEDSEEEVRRLETSLGSLRLSIDDMLERRDVAFEGEHRQVLEAYRMFANDRGWVRRLEEAIRNGLTAEAAVEKVQSDMRARMLHMTDPYLRERMSDFDDLANRLLRQLMGRGPEDVAASLPKDAIIVARSMGAAELLDYPREKMRGLVLEDGAATSHVVIVARAMGIPVAGQMKGAVSMAENGDAIIVDGEEGVIHLRPQSDLEAAYAEKVRFRARRQEVYRELRKKPSTTRDGVQVDLLMNAGLAVDLPQLAEAGAAGIGLFRTELQFMVASTFPRAEAQEKLYRDVLEAARGKPVTFRTIDIGGDKVLPYFKGAIQEENPALGWRAIRLTLDRPGLLRTQIRALLKASGGRELKLMLPMVTELSEIAQAREIIDREVRHLSRFAHHLPTSLKLGAMLEVPSLLFQLDELMKAVDFVSVGSNDLFQFVMAVDRGNTQLANRFDTLSAPFLRVLKQIADAGIRNHTPVTLCGELAGKPISAMALIGLGFRSISMSPASIGPVKAMLTELPLDELTAFFDDNLMAPAQGLPMRALLQAFADDRSIPL

SEQ ID NO: 11984 - protein, 417 aa, Mesorhizobium loti
MARIVMKFGGTSVADIARIRNVARHVKREVDAGHEVAVVVSAMAGKTNELVGWTREASPMHDAREYDAVVASGEQVTAGLLAITLQNMGVHARSWQGWQIPIKTDNAHGAARILDIDGAFLIKRFGEGQVAVIAGFQGIGPDNRIATLGRGGSDTSAVAIAAAVKADRCDIYTDVDGVYTTDPRIEPKARRLAKISFEEMLEMASLGAKVLQVRSVELAMVHRVRTFVRSSFDDPDAPGMGDLLNPPGTLICDEEEIVEQQVVTGIAYAKDEAQISLRRVGDRPGVAAGIFGPLAEANINVDMIVQNISEDGKFTDMTFTVPSGDVDKALAVLDRLKAEVGYDVVQSEAGMSKVSVIGIGMRSHAGVAATAFKALADKAINIRAITTSEIKISILIDGPYTELAVRTLHSVYGLDKQ

SEQ ID NO: 11985 - protein, 413 aa, Mesorhizobium loti
MSTTISPLAPKKYPKMPVIEGVRIATAEAGIKYKNRTDLLAMVFDAGTAVAGVFTKSKCPSAPVDFCRQNLAAGKARVLVVNSGNANAFTGKKGRESTALTGEAAAKAAGCTAGEVFLASTGVIGEPLDTTKFSHLLAGLVSDGKPDLWTEAAKAIMTTDTYPKVATQTVKLGDTDVTINGISKGAGMIAPDMATMLSFIATDAPIAAPVLQDLLSRGTAKTFNAVTVDSDTSTSDTLLIFATGKAAKRGAPEITDPKDARLGQFRRALGKVLKSLALQVVRDGEGARKQVEVTVTGAKSARSAKRIALSIANSPLVKTAVAGEDANWGRVVMAVGKAGEPADRDRLSIWFGDIRLAHEGERDPGYSEEATSTYMKRDDIRIRADIGIGRGKATVWTCDLTKEYVAINGDYRS

SEQ ID NO: 11986 - protein, 292 aa, Mesorhizobium loti
MSKIETIGIIGAGQMGGGIAHVSALSGYKVLIYDISPDRIEKGIATISGNMARQVGSGKLDEKLRNQAMARIASAPAMADLAGADLVIEAATEDETIKRKIYAQLCPQLNPEAILATNTSSISITRLAAQTDRPERFIGIHFMNPVPLMKLVELVRGIATEDQTFEAAKTYVKQLDKTITVSEDFPAFIVNRILLPMINEAIYTLYEGVGSVDAIDTAMRLGANHPMGPLQLADFIGLDTCLSIMQVLHDGLSDSKYRPCPLLVKYVEAGWLGRKTGRGFYDYRGEHPVPTR

SEQ ID NO: 11987 - protein, 466 aa, Mesorhizobium loti
MSDKKTSNQMWGGRFASGPAAIMEAINASISFDRKLYAQDIRGSIAHSEMLAQTGIISTADQEKIAHGLNTILKEIEAGSFEFSTRLEDIHMNVEARLADLIGSAAGRLHTARSRNDQVAVDLRLWVKDECFRVAEALKGLITALLARAEEHAATVMPGFTHMQAAQPVTFGHHCMAYVEMFARDLSRVRDAIERMDESPLGAAALAGTSFPIDRHRTAKALGFREPMRNSLDSVSDRDFALDFLAMAAICATHLSRLAEEIIIWSTPQFGFIRLSDSFSTGSSIMPQKKNPDAAELVRGKTGRVNGHLVGLLTVMKGMPLTYGKDMQEDKESVFDAAETLDLMLAAMTGMVSDMTVNAAAMKKAAGSGHATATDLADWLVRTLGLPFREAHHVTGRAVALAEEKKVSLEKLSLEDLQSINPGITADIFSVLAVQNSVKSRTSFGGTAPSEVRKQIRYWKKRLAKA

SEQ ID NO: 11988 - protein, 422 aa, Mesorhizobium loti
MNHFDYRDGVLHAEDVAIPDIAAQVGTPFYCYSTATLTRHYRVFAQAFAGLDALVCYAMKANSNQAVLRTLARLGAGADVVSEGELRRALAAGIPASKILFSGVGKTAREIDLALEAGILCFNVESEPELELLSARAVALGKVAPISLRINPDVDAKTHKKISTGKAENKFGIAWQRARQVYARAATLPGIKVTGIDTHIGSQITELQPFDDAFALLVDLVGALRADGHAIEHVDLGGGLGIPYRVDNNPPPLPDAYAQIVRKHVTKLGLKVMFEPGRLIVGNAGILVSEVIFVKEGDAKNFLVVDAAMNDLIRPTLYDAFHDIRPVVQPPADTPRMMVDVVGQVCETGDYLGLDRDLPRLKAGDLVAVSTAGAYGAVQAGTYNTRLLVPEVLVDGDRFHIVRPRLTYDDLIGLDSVPDWLA

SEQ ID NO: 11989 - protein, 180 aa, Mesorhizobium loti
MPIVRDKDIEVLFSASAIARRNLELAKEIAGHDYHDLLVISVLKGSFIFAADLIRAMHDVGLSPEVEFIFISSYGAGTTSGEVRVLRDIDNEVAGRDVLLIDDILESGKTLTFTRDLMLSRGAKSCSIAVLLDKRMRRQTALVADYVGFDCPDYFVVGYGMDVAHAFRELPFVGVVKGDA

SEQ ID NO: 11990 - protein, 309 aa, Mesorhizobium loti
MASPPRLLSVGALTLDTILRVETLPTHQGKFIAADGVQIASGMATSAACAAHRLGAEVSLWASAGDDLIGEQLIAGIEAEGVDCSYVRRVSGARSALASILVDAHGERIIVPFYDSLAQADPETLPFADITAFDAVLVDVRWPDAAALALKAARAAGRPAILDADTASLAVLERLLPLASHIVASEPAVRIICGQALDLASACTDMASRTDAFVAVTGGAAGIWWFDRKAGSSRHVAAPRIKAVDTLAAGDVFHGAFAVGLAEAMPVEQALRFASAAAALKCLRFGGRLGAPDRAETLAMVTATWPETA

SEQ ID NO: 11991 - protein, 369 aa, Mesorhizobium loti
MNQTPDQARPTPRAGIMDIDAYVPGKSAAPAGVAKVYKLSSNENPLGPSPKAIEAAREVAARLDIYPDGTARRLREAIAEVHGLTAQNIICSNGSDEILGLLAQTYLAPGDEAIFTEHAFMVYKIYIQSAGAAPIAVKETDERADIDAMLAAVTPRTKIVFLANPNNPTGTYVPFQEVRRLHAGLPRHVLLVLDAAYAEYVRRNDYEAGIELVRSAENVVMTRTFSKIGLGGARIGWMYAPMHIVDAINRVRGPFNVNATAIEAGIAAIRDRAHVERSVTHNETWLTWLSQEMTGLGLRVTPSVGNFLLIHFPDDQKHSAAAADDYLTARGYILRRVSGYGFPNALRMTVGTEEANRGVVAALTTFLKS

SEQ ID NO: 11992 - protein, 255 aa, Mesorhizobium loti
MAVEIEQFMCRSDNFGVLVHDPKSGQTAIIDAPEEAPILAAIKRTGWTPTMILTTHHHMDHVEANLALKERFKLRIVGPEAEKAKIPGIDETVEEGSVLHLGDERIEVIATPGHTAGHVSYHLPASKVAFTADTLFALGCGRLFECKPPVMYESLRKLAALPAATTIYCGHEYTLANARFALTVDPTNSALKERATRIEALRVDNKPTLPTTIGEELSTNPFLRWHDPAIRKHLGMEKAGDAEVFAEIRKRKDNF

SEQ ID NO: 11993 - protein, 378 aa, Mesorhizobium loti
MSADQPVTVEVGLGDRAYDILIGSGLLSRAGEEISRRLPGTRAAVVTDENVAAAHLDTLKAGLEKGGIQPTVITMPPGEKTKSFAHLEEVVDGILAARLERGDVVIALGGGVIGDLTGFSAGIVRRGMNFVQVPTSLLAQVDSSVGGKTGINSPRGKNLVGVFLQPKLVLADTEVLDTLPIREFRAGYAELAKYGLIDRPELFAWLEANWQKVFAGGPERAQAIAEACRAKADVVARDEFETGDRALLNLGHTFGHALEAATQYDGARLVHGEGVAIGMALAHRFSSRLNLASPDDAARVETHLRAVGLPWRMADIPGELPDAEALLAFITQDKKVSRGALTFILTRGIGQAFIAKDVPASEVLSFLRENHPTSRKAG

SEQ ID NO: 11994 - protein, 203 aa, Mesorhizobium loti
MNAHQANPPGESLAALLGRLGSRSIVFVGLMGAGKTAIGRKVATMLSLPFIDSDQEIESVSRMTVPELFERYGEAEFRALEQRVILRVLENGPQVLSTGGGAFMNAQTREAIAGHGVSVWLKAELDLLMDRVSKKQNRPLLKSADPRAVLERLMSERYPVYATSDVTVPTRDDRKEVIAAEVLNALCRHFGIDEIAATGEIES

SEQ ID NO: 11995 - protein, 501 aa, Mesorhizobium loti
MKARVTANAAYAIADIDKRLYGSFLEHLGRAVYTGIYEPGHPQADAEGMRKDVIELVRALDTPICRYPGGNFVSAYNWEDGIGPKENRPRRLDLAWRTTEPNLVGIHEFADWAEKAGTEMMLAVNLGSRGLDEARAFVEYVNHPGGSYWSDLRATNGRAQPWNCRLWCLGNEMDGPWQVGHKSASEYGHLANETAKALRGLDPTVELVVCGSSHSNMPTYPQWEATVLEATYEQVDYISLHMYFENYEKNTSEYLALPAKLDRYIGTVAGIIDYVKAKTRSKRDVKISFDEWNVWYHQRKQDAERMRGWDWPEAPRLLEDIYNFEDVLQVGCIINTFIRRSDVVRIACIAQLVNVIAPIMTDPGGGAWRQTIYWPFMLASRHGRGTALQLAVEVPTYDAAAADKVPWLDIAGVHDSNAGTLTFFAINRHGAETIEADVALERFAAKSIEHTIIRHDDLGACNTKDAPDTVSPVKGNGAALSSKGMTLNLPPHSYSMVRVTL

SEQ ID NO: 11996 - protein, 549 aa, Mesorhizobium loti
MPAVTGEANGLRGVAASEGVAIGPAFAHFPPEIAAQGRVLQASEIVGEIDRFRAAVAAVQARMDRALAQDSLSAGDRGIVAALRDIAADDSLTGEAEKAIRGGNDAVSAVITAAATIAADFSAVDDHYLNARADDVHAVGRQICLVLLGQDDVSLESMPEGAILIADDIGAWDLARAPLKRIGGVICGHGGATSHIAIIARSHGIPAVLGLGDQVNALRTARDVALDGNTGHVIVDPDAATRADYGGRVEAAAKERAGLTTFKTVTPKRADGKVIEVAANIGSLEEIEAAQEAGAMGVGLFRTELLFMRHMHLPSEDMQAETYAALAKAFAPHPVIVRTLDIGGDKPIAGIEFPDEDNPFLGWRGIRMCLDRPDIFKRQLRALLRAAVQGNIKVMLPMVSDISEVTRTRALVDECAAELKAEGVPHATFDLGVMIETPAAVLIAPALAKEVAFFSIGTNDLTQYIMAADRLNPTVAKLNDVTNPAVMSAIELTAKAGVAAGIMVGMCGEAAGRPDLIPAFIEMGLTELSMSPASIQRAKKTITAMAAGE

SEQ ID NO: 11997 - protein, 224 aa, Mesorhizobium loti
MARPRPIIFDCDGVLVDSEPLAARAYERVYEKHGMPGVHGGIIAQCVGMKQSDIIARIRELTGHQFPAAADGDIWAETKVLFTEELKPTPGIAAFLETLEGDRCVASSSSVERINHSLAVTGLAHIFGEAIYSSSMVKNGKPAPDIFLFAAARMGADPADCIVIEDSPFGIQGAVAAGMTAIGYTGGGHTYAEHAARLTAAGADFVCADWHEVSRQLSGLGVPA

SEQ ID NO: 11998 - protein, 454 aa, Mesorhizobium loti
MPTEVILPKVDMDMATGQISRWFAEEGARVKKGDVLFEIETDKAAMEIDAPASGVLRDVSGKEGVDIPVGAPVAWIYADDEAYGAKQDAAPISPLVGEMSAKSTEGDVVPPTSHSVMPPSALPGISPTRGEIGQSPPGERATPLARRLAREAGLALAGIIGTGPHGRVVKADVDAAIAGGGAKAAPAAKAPAGAPAAAPAPAVKPMSDDQVLKLFEQGSYELVPHDNMRKTIARRLVEAKSTIPHFYLTLDCELDALLALRTQINAAAPMKKTEKGDVPAYKLSVNDMVIKAMAMALKAVPDANASWTETAMVKHKHADVGVAVSIPGGLITPIIRHADEKTLSTISNEMKDLASRARSRKLKPEEYQGGTTAVSNLGMFGIKDFAAVINPPHATILAVGAGEERAVVKNGEIKIATVMSVTLSTDHRAVDGALGAELLVAFKRLIENPMGMLV

SEQ ID NO: 11999 - protein, 332 aa, Mesorhizobium loti
MDATVRELSYAQAIQEAMAIAMDMDERVFLMGEDIGVYGGAFQVTGDLVERYGTERVIDTPISELGGAGVAVGAALTGMRPIFEFQFSDFATLAMEQIVNQAAKMRFMLGGEVSVPVVMRFPAGSGTGAAAQHSQSLEAWLGHVPGLKVIQPATPYDAKGMLLAAVADPDPVMIFEHKLLYKMKGPVPEGYYTVPIGKADIRREGRDLTIVATSIMVQKALDAAATLEAEGIDVEVVDLRTIRPMDKQTVIDSVKKTSRLMCVYEAVKTLGIGAEVSAMIAESEAFDYLDAPIVRLGGAETPIPYNPELEKATVPQVPDIISAARDLVKGVR

SEQ ID NO: 12000 - protein, 342 aa, Mesorhizobium loti
MAGASKAVADSRANLPFVYRQYSAEQLREVLYKMYLIRRFEEGAEESYMRGLIHGTMHLSIGQEASAMGICMPLGEDDQITSTHRGHGHCIAKGAEVKRMFAEFFGKTTGYCKGRGGSMHIADVAKGNLGANGIVGGGIPIAVGAALSSKMMKTGKVVVSFFGDGANNEGAFHEALNMAAVWKLPVIFVCENNGYGMSTSTARSTAVKNIADRAAAYSMPGVIVNGNIFSEVAEASYRAVERARAGEGPTLIESKTYRHRGHSKSDRNRYRTKEEIEDWMSNRDPITLFENELREFGFIDDKGIEAIRSAVSQEIADGIEFAKASPSPDVSETGNYVYTEQA

SEQ ID NO: 12001 - protein, 262 aa, Mesorhizobium loti
MGSLSSKNALVTGSTSGIGLAIARAFAAEGANVTINGLGDPAAIEQERAGIEKDFGVKCRYSDANMMDGAAVSAMVHDAEAAFGSLDILVNNAGIQHVAPIEEFPDDKWEAIIRINLLAAFYAIKAAVPGMKARKWGRIINTASAHALVASPFKSAYVSAKHGIAGLTKTVALEVAQDGITVNAIAPGYVWTPLVEKQIPDTMKARGMTEEQVKHDVLLAAQPTKEFVTVEELAALTLFLCSDAARQITGTTLPMDGGWTAQ

SEQ ID NO: 12002 - protein, 472 aa, Mesorhizobium loti
MAAVRDLKATEMAASGGDDAIELGKRHLIQPWPYAGSVGAEARALIGEGDGIYITDNTGKRLIDGPAGMWCVNVGHRREELARVMYDQAMALSYNTPWYTMNAPSAELAMRIAGHAPDDLSHVFYTTGGSSAVETALRFMQFYNNVRGRPEKKLILSRGGAYHGSTYLSASLNGRPRDRDWMDGADELVIKLSSPDPFRRPQGMSLAAFTDFLVDQFRDTVARVGADKIGAFVGEPVQASGGVVIPPDGYLKRIREICRVNDILYVSDEVVTGFGRLGHVFASGDVFGIDPDMITFAKGVTSGYFPLGGVIISERLLQELRRSNHPDAMFGHGLTYTSHPVGCAVALKNLDLLEESVLAHTQAVAPYFQAQLKTLEELPLVGEVRGAGLMGCVECVADRESKNPLQLDKDVGKRIDAHCHELGLLVRPLINMCVMSPPLIITREQIDDMVGILREGISRTMDDLWKEGVWRG

SEQ ID NO: 12003 - protein, 436 aa, Mesorhizobium loti
MTDELERTDVVIVGAGFTGLSAALELKRAGINFVLLEARDRVGGRVEAVRNGLGERIDSGGQFLCEDMPELMALARARGKTFVETYVEGDFITHPSMPPKDAKQTYHGAMAIRERMNGIEPDDPSIKGMSVAAWLERQPDPIDARTAFRSMIEGLWCLPMDRVPLWYLIDNDRRITNEVPELQYSLRETMQSLAEDISGDLGDRVRLGEPATRVEHRPQGVRVVTGKGAMEARQLLVALPPATAAKLDFAPTLPARLAKALGVWESGAVIKILVRYPRPFWREQGLSGMVMWRDLPGLFACDASKDAEHAALVVFVGGPLALRWRVLDEAGLRAEVTGRLQEALGPDAGDIIDFSSRDWIKDRWSGGAYSDLIVDVTARDAERTILSGAPPVHFAASELSPSFPGYVEGAIVAGRIAARKIIAELQSPIATSASGS

SEQ ID NO: 12004 - protein, 264 aa, Mesorhizobium loti
MIETADAEYDDTAIRFLEALWGDGYLSPGGPEEVDRVVEGLSLEGKTVLDIGCGSGGITLHLVERHGAARATGFDVEQPVIEAARRRAAGRGLSDRASFVQAPPGALPFADRSFDAVFSKDALLHVPDKDGVFAEIFRVLKPGGVFAASNWMIGHDSEPSPEMKAYIAAEGLSFAMASPARYAHAMRNAGFADVTVRDRNPWYREVARGELERLKGPLYTPVAAVVGAAYVDKNIRTWEAMQKVLDSGEHRPTHLRGWKPDAIG

SEQ ID NO: 12005 - protein, 539 aa, Mesorhizobium loti
MKAWDAIVIGGGHNGLVNACYLQRAGLDVLVVEKNDWVGGAATSRELTPGFVYSNCSYVCSLFRPEIMRDLELPRFGLQVISYEGGAVFTRDGDYLANYRDHDAHRREFARFSRRDAEAYDRYARDVTRQCRFIQPLLMRTAPDPTSFKPRDIGELLYLGKKFAGLSAEEMALTLRFWTMSISDFLDEYFETDVIKANFALSGIIGTALGPMSPGTAYVLLHHYMGEVDGSVGAWGYARGGMGAVTKALAASFKASGGTIRTGAEVDHVLVSRGKAKGVVLAGGEEVYGKLVVSNADVKRTFLKLVEEKELPDIFLRRVKNFKIRGSSGKVNIALDSLPEFPALAKDSPVYRGDMHFTDSIERMERAYDDWKAGRWSADPFLDMVIPTTLDPTMAPPGKHFMSCFVQYAPPKVNGRDWTDADRDGFAESVVAQIAEYSPGFRDRIVHMEVRTPREIEAEVGLTEGNIFQGELTFDQLLFNRPVPGYAQYRSPVGGLYMCGSSTHPGGGVMGAPGRNAAAEILRDLAKSTSHMSLAHDVI

SEQ ID NO: 12006 - protein, 352 aa, Mesorhizobium loti
MTETDLVPVFDGHNDTLLRLYQSKDRDVEKLFVEGKSGGHIDLPRAKAGGFAGGMFAIFPPPVEKARRSAVPLAPSDSEPLPPEVPRAEALNSTMAMASILFRLERAGALAVCRTAGDVRNAMAKGTIAAVFHIEGVEAIDPELTMLDVLHAAGLRSLGIVWSRPNAFGHGVPFRFPSSPDTGPGLTDAGKALVKACNELKIMIDLSHLNEKGFRDVAGLSDAPLVATHSNVHALCTHSRNLTDWQLGAIRESGGMVGLNFATGFLREDGRMNADTSLDIMVRHVDSLLQALGEDGVGLGSDFDGAMIPAVIGDVAGLPKLIDALAARGFGRALIEKIAYRNWLGMLERTIG

SEQ ID NO: 12007 - protein, 522 aa, Mesorhizobium loti
MTGKARRPNVLLITCDQWRGDCLSAAGHPVVKTPNADALAAEGVLFKQHYGGAAPCSPARACLYTGLYQMNNRVCRNGSPLDARHGNIAQHARSIGYDPTLFGYTDVALDPRLLTSGDPRLKTYEGVLPGFTVRQLLPEHQKQWLSWLKQQGVDASAGSPGIHRPVGDEDDDSVTEAPPIYSKDHTPAAFLAGEFIRWLGEQEQAAPWFAHLSFISPHPPFIVPEPYNTLYDPADGPAFYRADSWRAEAQSHPYLAYDLSQRNRANFRPGAAGKVHDWSEDDFRRIRAIYYGMISEVDAQLGLIWQALKLSGTWDDTIVVLTSDHAEMMGDHFMLGKGGYFDGSYHIPLIIRDPRHRKAAGSAVDRFTEAVDILPTLIDLLGEPPEPHLDGCSLKPFLSGGSPAAWRDAAHWEFDFRSIADGEAEAHFGIGSRQCNLAVIRTKKFKYVHFGGGLPPLLFNVEADPGELTNLATSPAHLSTRLQFAERLLAWRAEHLDQSLALAELTENGVVGHVSKGIGSRE

SEQ ID NO: 12008 - protein, 219 aa, Mesorhizobium loti
MSLRINDIAPDFTAETTQGTISFHDWIGDGWAILFSHPKNFTPVCTTELGTMAGLEGEFKKRNVKIIGISVDPVASHDKWQADIKTATGQTVHYPLIGDKDLKVAKLYDMLPAGAGETSEGRTPADNATVRSVYVIGPDKKIKLVLTYPMTTGRNFDEILRAVDSMQLTAKHQVATPANWKQGEDVIITAAVSNEDAIKRFGAFDTILPYLRKTKQPSA

SEQ ID NO: 12009 - protein, 683 aa, Mesorhizobium loti
MSRTFSRALPSPQTPTFGGTMTSREQHDRMANAIRFLSMDAVEKAQSGHPGLPMGCADIATVLFTRFLKYDPKAPHWPDRDRFILSAGHGSMLLYSLLHLTGYEDMTIDQIKHFRQLGSKTAGHPEYGHATGIETTTGPLGQGLANSVGFALGERIMNAAFGNDLVSHYTYVLAGDGCLMEGVSQEAIALAGHLKLNKLIVFWDNNNISIDGPVSLADNTDQVARFQASGWNASHIDGTDPEAIAYAIEAARHSDKPTMIACKTTIGFGAPTKAGTNKAHGSPLGADEIAGARKFFNWESPPFEIPADILDAWRTAGKAGAKPRADWEGRLAKAEPKLKAEFERRLAGKLPSNFDAVIADYKKKLSADKPKVATRKSSEMALEVINGAVPETIGGSADLTGSNNTKTSQTKNITPDDYGQRYVHYGIREHGMAAAINGLTLHGGLIAYGGTFMCFSDYARPSMRLSSLMGIRSIFVMTHDSIGLGEDGPTHQPVEHLAALRAIPNHNVFRPADAVETAECWQIALESEKTPSTLALTRQNLPTVRIEHSAKNLSSQGAYELAAASGEAAVTIFATGSEVEIALGARDLLEKHGHPTRVVSVPCFELFDKQSDDYRKKTIGNAPIKMAIEAGIRQGWDHLIGSDGIFVGMTGFGASGTIEQLYPHFGITAEAAAKAAEARLHAK

SEQ ID NO: 12010 - protein, 336 aa, Mesorhizobium loti
MTVRVAINGFGRIGRNILRAIHESGRKDIDVVAVNDLGPVETNAHLLRYDSVHGRFPHEVSVSGDQITVGKEKFKVTAIKDPTQLPWKELGVDIALECTGIFTARDKAASHLTAGAKRVLVSAPADGADLTVVYGINHDKLTKDHIVISNASCTTNCLAPLAAVLHETVGIEKGMMTTIHSYTGDQPTLDTMHKDLYRARAAALSQIPTSTGAAKAIGLVLPDLKGKLDGISIRVPTPNVSVVDFKFIAKRATTVQEINEAVIAASNGKLKGILGVTHHPNVSIDFNHDPRSSIMALDQTKVMDGNFVSVLSWYDNEWGFSNRMGDTAVAFGKTIA

SEQ ID NO: 12011 - protein, 398 aa, Mesorhizobium loti
MAAFKTLDDIGNISGKRVLVRVDLNVPVADGKVTDATRIERIAPTIAELSGKGAKVILLAHFGRPKDGPSPEFSLEPIARATAEVLGRPVGFASDCVGDMAGSAVAAMNKGDVLLFENTRFYKAEEKNDPAFSERLAANGDIFVNDAFSAAHRAHSSTEGLARLLPSFAGRTMQAELEALEKGLGNPVRPVVAIVGGAKVSTKIDLLMNLVKKVDALVIGGGMANTFLAARGTDVGKSLCEHDLAPTAKQIMIEAAEAGCAIILPVDGVVAKEFKAGAACETVAISDVPADGMILDVGEKTVKTIGEWIDRAATLVWNGPLGAFEIEPFDHATVAAAKHAAARTKAGKLVSVAGGGDTVAALNHAGVADDFTYVSTAGGAFLEWMEGKPLPGVDVLKR

SEQ ID NO: 12012 - protein, 342 aa, Mesorhizobium loti
MMSERLEDIAAAIVANGKGLLAADESSGTIKKRFDVIGVESTADSRRDYREMMFRARDAMTKYISGVILYDETIRQKAADGTPLVDIIKASGAIPGIKVDAGAKPLAGFPGDTVTEGLDGLRERLADYYKLGARFAKWRAVIDIDTGKGVPSANSINSNTHALARYAALCQEAGIVPIVEPEVLMDGAHDIGTCYDVSKATLIKLYDELHAARVVLEGTILKPNMVLSGKKSGTVDSPEKVAEMTIKLFRETVPAAVPGIAFLSGGQEDEEATANLNAINAIGPHPWKLTFSYGRALQAAPQKAWSGKASNVAAGQAAFTHRAHMNYLAALGKWKASLEQAA

SEQ ID NO: 12013 - protein, 218 aa, Mesorhizobium loti
MSLTLHFHPLASFCWKPLIALYENGTAFKPVIVDLGDEHSRAAFLKISPSGKMPALRDDARDRSVLESTIVVEYLAAHYPGPVELVPADIDQALAVRQADRFYDFYVQEPMQKIVGDRLRPQDRTDPFGVEQARGQLRNSYAIVEQEMQSKTWAVGEAFSLADCAASPALFYANKVEPFGDKYPAVKRYHDRLLQRPAFAKVIEEAQPYFKFFPYNNG

SEQ ID NO: 12014 - protein, 305 aa, Mesorhizobium loti
MTNDDEMAFEMALIRRAAAVEVLLRRLLDDRPLSGEIARPDRLMAAMRHGVLNGGKRLRPFLVMESAALFSADGEAALRVAAALECVHCYSLIHDDLPAMDDDDLRRGQPTVHKAFDEATAILAGDALLTLAFDIVASEATVLPADRRAALVLALARAAGAGGMVGGQKLDLEAEQTPPDEAGIITLQAMKTGALIRFACEAGAIIAGAPAEDRERLAEFGSAIGLAFQLADDLLDLTADAGQMGKATGKDAAAGKGTLVALHGANWAHSQLHGLVGQAHALLDPYGDRAALLKEAATFVATRNS

SEQ ID NO: 12015 - protein, 251 aa, Mesorhizobium loti
MSANLFDLSGRQALVTGSSQGIGLALAKGLAQAGASVILNGRDTAKLAATAAQIPGAQTLAFDATEHDAVRSAIDNFELSGGPIDILVNNAGMQFRTPLEDFPADAFERLLQTNVASVFHVGQAVARHMIRRGRGKIINIASVQTALARPGIAPYTATKGAVGNLTKGMATDWAKHGLQCNAIAPGYFDTPLNAALVADPAFSGWLEKRTPAGRWGKVEELVGACVFLASDASSFVNGHILYVDGGITASI

SEQ ID NO: 12016 - protein, 786 aa, Mesorhizobium loti
MLGLRMPEYSSFIRFVRVRYLSGLLIFALASTAIMVALNRVNSFRHEIDALSSNLVVFTRDLRNATSFAETTGSAWRNETRDALTASARDHSERLTSEIDTLSAQFAALRSRLSAKTLNELETASVNGDLFWSAHDMVRNFNLMSVAQKADEWSYREIRNQNDLFVQPMLVRVRTAMDEERHLADASSDRLLLWASGLLFGVLAIVAFWIFRPMEQAIRRAFAQSAESLFKAEAADRAKSEFLANMSHEIRTPMNGVLGMAELLAKTELTPRQKTFTDVIVKSGNALLTIINDILDFSKINAGQLTLDPAPFRLTEAVEDVATLVSARVAEKNLELIVRVDPRLPAHVVGDAGRFRQIVTNLVGNAVKFTEKGHVLIDVGGETVNDVVQLRLRVEDTGIGIPAEKLQNVFEKFAQVDGSSTRRHEGTGLGLAIAARLVDLMAGKIGVESEIGRGSVFWFAVPLPVHHAEAREAIVPVDVTGARVLVIDDNPVNREILLEQLRSWSFDCAAAESGAVGLAFLDRACQLGASVDCIILDYQMPGMNGADVARAIAADSRLSAIPIVILTSVDQVDFGKMIIDFGISAHLTKPARSAVLLGTVISVIQKARSQGGKAQFIREPVQPKPVPQAAPPAFTVIRGPAVPVMAVPESTAMPNGPIDILIAEDNEVNQLVFGQILNGLGLSYRIAGNGRTAVEMYRSLHPKLILMDVSMPEMNGYEATRAIRAIETSSGGHIPIIGVTAHALKGDRDKCIEAGMDDYLPKPVSPDRLGTKIGTWLSETVVAKTA

SEQ ID NO: 12017 - protein, 478 aa, Mesorhizobium loti
MRRSRKVKILATIGPASSSEEMLQKLFEAGADVFRINMSHTDHELMRTLVGRIRAVEEKVGRPIGILADLQGPKLRVGKFANGKEVLTPGQTFTLDDNPEPGTSSRVYLPHPEILSSVEPGHRLLIDDGKLELKAVKSDGKSIVCTVVAGTTISDKKGVSLPDTDLPVGALTEKDRKDLDAVLATGVDWIALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMDRIATKVETDPTYAGIINAQRSEPEATGADAISLAAREIAETLKLSAIITYTASGTTGLRAARERPQVPIIALSPILNTARRLSLLWGTHCVVSPDATDLDDMVNRACRIALEEEFGKPGDRVIITAGVPLRTPGSTNMLRIAYVGSEKQGSR

SEQ ID NO: 12018 - protein, 392 aa, Mesorhizobium loti
MSDSIVIASAARTAVGSFNGAFAATPAHELGAVVIKELLSRAGVEAAEVDEVILGQVLTAAQGQNPARQASIIAGLPKETTAWGLNQVCGSGLRAIALGMQQIATGDAKVIIAGGQESMSLSPHAEHLRAGVKMGDYKMIDTMIKDGLWDAFNGYHMGNTAENVARQFQITRDDQDQFALASQNKAEAAQKAGKFKDEIVAFTIKGKKGDTIVDQDEYIRHGATLDAMTKLKPAFDKDGTVTAANASGINDGAAGALLMSEAEAARRGITPLARIASWATAGVDPAIMGTGPIPASRKALEKAGWSAGDLDLVEANEAFAAQACAVNKGMGWDPSIVNVNGGAIAIGHPIGASGARVFNTLVYEMRRRGAKKGLATLCIGGGMGVAMCVEAL

SEQ ID NO: 12019 - protein, 241 aa, Mesorhizobium loti
MTKVAIVTGGSRGIGAAISIALKSAGYSVAANYAGNDEAAAKFKAETGIPVYKWSVADYDACAAGIKQVEADLGPVSVLVNNAGITRDAMFHKITRDQWKEVIDTNLSGVFNMTHPLWNGMRDRKFGRVITISSINGQKGQAGQVNYSAAKAGDIGFSKALAQEGARAGITVNVICPGYIATEMVKAIDEKVLNERILPQIPVGRLGEPEEIARCVVFLASQDAGFITGSTITANGGQYFV

SEQ ID NO: 12020 - protein, 432 aa, Mesorhizobium loti
MANVVVVGSQWGDEGKGKIVDWLSERADVVVRFQGGHNAGHTLVVDGKVYKLSLLPSGVVRQGKLSIIGNGVVFDPHAFVAEVAKLKAQGVEVTPDRLKIAENTALILSLHRELDGFREDAASNSGTKIGTTRRGIGPAYEDKVGRRAVRVMDLADLETLPLKVDRLLTHHNALRRGLGHGEVTHDAIMAELTSVADEILPYMDRVWKILDDKRRAGERILFEGAQGTLLDIDHGTYPFVTSSNTVAGQAAAGSGVGPGAIGYVLGITKAYTTRVGEGPFPTEQKNEIGEFLGTRGHEFGVVTGRKRRCGWFDAVLVRQAVAVNGIKGIALTKLDVLDGLDEIKVCTGYRLDGEMIDYLPASQGAQARVEPVYETLEGWKGTTAGARSWNDLPAQAVKYVRYIEELIGAPVALLSTSPERDDTILVTDPFQD

SEQ ID NO: 12021 - protein, 391 aa, Mesorhizobium loti
MTTHTKPGLRPANPNFSSGPCAKRPGWSVEALKNAALGRSHRAKIGKTKLEQAIELTREILQVPADHRIGIVPASDTGAVEMALWSLLGERGVDMVAWESFGSGWVTDVVKQLKLPDVRKLEAGYGELPDLAKIDFDRDVVFTWNGTTSGVRVPNGDFIPADRKGLTICDATSAAFAQRLDFEKLDVVTFSWQKVLGGEGAHGMLILSPRAVARLESYKPAWPLPKIFRLTSGGKLIEGIFKGETINTPSMLCVEDYLDALHWAKSIGGLDVLVARADANAAVLDGFVDKSSWLGHLAVQPATRSNTSVCLSFTDPDVAALDADGQATFAKGLVSALDKEGVAYDIGSYRDAPPGLRIWCGATVETSDLETLLPWLDWAFAAQKASLKAAA

SEQ ID NO: 12022 - protein, 450 aa, Mesorhizobium loti
MAGNYFGTDGIRGRANKFPMTAEIAMRVGMAAGLSFQRGSHRHRVVLGKDTRLSGYMIENAMVAGLCAAGMDVFLLGPIPTPAVAMLVRSLRADIGVMISASHNPYYDNGIKLFGPDGYKLSDEIEERIESMLDKDVELTLADSDGLGRAKRVDGVHDRYIEFAKRTLPRSMSLSGLRIVVDCANGAAYKVAPEALWELGAEVVAINIEPNGFNINKECGSTHPAGLQKKVHEVRADIGIALDGDADRVVIVDENGAIVDGDQIMAMIAESWHQSGRLAGGGVVSTVMSNLGLERFLGDMKLQLHRTKVGDRYVVEHMRAHGLNVGGEQSGHIVLSDFSTTGDGLVSALQVLACIKRQGRPVSELSKKFEPVPQLLKNVRIAGGKPLEEAPVKAAIEDARNRLGKAGRLVIRPSGTEPLIRVMAEGDDPQLVEAVVNDIVEVISETRSAA

SEQ ID NO: 12023 - protein, 642 aa, Mesorhizobium loti
MNPNYRNLALWAIIAVLLIALFNLFQTPQTRGASSDVPYSQFLQDVAAGRVKTVTIAGARITGTYTDNSTGFQTYSPGDPQLVSRLQDKNVTINARPEADGSNSLFGYLISWLPMILILGVWIFFMRQMQSGSGRAMGFGKSKAKLLTEAHGRVTFQDVAGVDEAKEDLEEIVEFLRDPQKFQRLGGKIPRGVLLVGPPGTGKTLLARSVAGEANVPFFTISGSDFVEMFVGVGASRVRDMFDQAKKNAPCIIFIDEIDAVGRHRGAGLGGGNDEREQTLNQLLVEMDGFESNESIILIAATNRPDVLDPALLRPGRFDRQVVVPNPDIVGREKILKVHVRNVPLAPNVDLKVVARGTPGFSGADLMNLVNESALMAARRNKRLVTMAEFEDAKDKIMMGAERRSSAMTQAEKELTAYHEAGHAILALNVPSADPLHKATIIPRGRALGMVMQLPEGDRYSMSYKYMISRLAIMMGGRVAEEFKFGKENITSGASSDIEQATKLARAMVTRWGFSDKLGHVAYGDNQEEVFLGHSVARTQNISEETAQIIDAEVRRLIDEAYSTAKSILTKKKKEWIALAQGLLEYETLSGDEIKQLIAGEKPARDLGDDTPPSRGSAVPKSGGRRKKGPEPEGGMEPQPSS

SEQ ID NO: 12024 - protein, 338 aa, Mesorhizobium loti
MKTIELRAPGGIDNLRLVERPMPEPGRQEMIIKVKATALNYRDVEIARGSYHTAFALPLIPLSDGVGEVVAVGAEVTRFKVGDRVCGTFWQRWVGGSFAMAEPSYQRGGPIDGLLSEFARLDEQAAVLAPPHLSDVEAATLPCAAVTAWHALFTEGQLKPGETVLSLGTGGVSLFAVQFAAAAGAHVIVTSSSDDKLTRAKALGAHHGINYRVNPDWSSAVLALTDGRGADHIIEVGGPQSFAQSLKASARGAQINVIGYLGGSEGSINPLDIFRRQVRARGIPVGSRESFEAMNRGLTVNRIRPVIEKVFAWKDAAAAFRHLEHGSPFGKVVLDHTQ

SEQ ID NO: 12025 - protein, 599 aa, Mesorhizobium loti
MAQSSSADERRRSLKPLRRLFPYIAGYRTLVVGALISLAIAAATTLTLPLAVRRMIDHGFSSSSTTFIAEYFAALVAMAAVLAAASAGRYYFVITLGERVVADIRRDVFAHVTTLSPAFFDTAQSGEIVSRLAADTTQIKSAVGATASVALRNVILGLGAVGMMVVTSPKLSGLVIAAIPVIVLPLVAFGRSVRRKSRQAQDTLAEATAYASEQIGAVRTLQAFTNEKLVTGRFSGAVEAAFEAARASIFARSFLTFFAIFTIFSSVVAVLWFGSRDVLEGTISPGTLGQFLLYSVFAAGALGALSEVWGELAQAAGAAERLTEILAENPAIQAPAEPKPLPTVAKGAIVFDDVSFSYPARPDRAAVHGLSFQVMPGETVAIVGPSGAGKSTVFSLILRFYDPETGKILIDGVDVREADPVSVRERIAIVPQDVTIFAASARDNIGFGRPGAGNTEIEAAAKDALADEFILKLEHGYDSQVGERGVTLSGGQRQRVAIARAILRDAPILLLDEATSALDAESETLVQTALERLMQGRTTIVIAHRLATVLKADRILVMDGGRIVEEGTHQSLVAKGGIYARLAKLQFETGASAFRGAAE

SEQ ID NO: 12026 - protein, 148 aa, Mesorhizobium loti
MSEIIVRPLAQSDHADWKRLWTDYLTFYETKLPEEVYAVTWKRLFTAGEFEPKGFIATLDGKAVGLTHYLYHRSGWSERNNCYLQDLFADPDVRGKGIGAALINAVKQEAAKIGVKNVYWMTHETNATARKLYDHVARRTGFIEYDLL

SEQ ID NO: 12027 - protein, 1152 aa, Mesorhizobium loti
MAITKILVANRSEIAIRVFRAANELGLKTVAIWAEEDKYSLHRFKADESYQVGRGPHLTKDMGPIESYLSIEEVIRVARLSGADAIHPGYGLLSESPEFAEACAQAGITFIGPKPDTMRRLGNKVAARNLAIEVGVPVIPATDPLPDDMEAVKKLAKEIGYPVMLKASWGGGGRGMRAIRSEADLAREVTEGKREAKAAFGKDEVYLEKLIERARHVEVQVLGDTHGNAVHLFERDCSIQRRNQKVVERAPAPYLEMSQREELCGYALKIARETSYIGAGTVEFLQDADTGKFYFIEVNPRIQVEHTVTEQVTGIDIVKAQIHILDGFAIGTPQSGVPAQKDIRLNGHALQCRITTEDPEHNFIPDYGRITAYRGATGFGIRLDGGTAYSGAVITRFYDPLLEKVTAWAPTPAETIARMNRALREFRIRGVATNLTFLEAIINHPSFADNSYTTKFIDTTPELFQQVKRQDRATKLLNYLADVSVNGHPETRGRPTPKADAAAPVVPYLNGNVPGGSKQKLDVLGPEKFAGWMREQRQVLVTDTTMRDGHQSLLATRMRTHDIANIAGTYARALPQLLSLECWGGATFDVAMRFLTEDPWERLSLVREAAPNLLLQMLLRGANGVGYTNYPDNVVQHFVKQAASGGIDLFRVFDCLNWVENMRVAMDAVGAEGKLIEAAMCYTGDILDPARAKYDLKYYVGLASELQAAGAHIIAVKDMAGLLKPAAARVLFKALREATDLPIHFHTHDTSGLSAATVLAAVESGVDAIDAAMDAFSGNTSQPCLGSIVEALKGTERDPGLDPQWIRKISFYWEAVRNQYAAFESDLKGPASEVYLHEMPGGQFTNLKEQARSLGLETRWHEVAQTYHDVNLMFGDIVKVTPSSKVVGDMALMMVSQDLTVADVENPARDIAFPDSVVSMLRGDLGQSPGGWPAALQKKALKGDEPITARPGSLLKPADLKASRKEIEEKLERKLSEYEFASWLMYPKVFTDFAGAQETYGPVSVLPTPTYFYGMKSEDEIFIDIEKGKTLVVRCLAIGDVDDKGMVTVFFELNGQPRRVKVPDRAHGASAAKARRKAEPGNEAHVGAPMPGVVSALSVATGQAVKAGDVLLSIEAMKMETALHAERDGTVAEVLVKAGDQIDAKDLLIAFA

SEQ ID NO: 12028 - protein, 333 aa, Mesorhizobium loti
MAKKSFFCIDGHTCGNPVRLVAGGGPLLEGSTMMERRAHFLAEYDWIRTGLMFEPRGHDVMSGSILYPPTREDCDIAILFIETSGCLPMCGHGTIGTVTMAIEHGLIKPKTPGVLRLDTPAGLVIAEYKQVGEYVEEVRITNVPSFLHAEGLTVECPGLGEITVDVAYGGNFYAIVEPQENYRDMADHSAGDLIAWSPVVRQRLNEKYSFVHPENPGINRLSHMLWTGKPTVEGADARNAVFYGDKAIDRSPCGTGTSARMAQLHAKGKLKAGDAFVHESIIGSLFKGKVEKEVTVAGKPAIIPSIGGWARLTGLNTIFIDDRDPFAHGFVVT

SEQ ID NO: 12029 - protein, 311 aa, Mesorhizobium loti
MWTGVFPAVTTKFTADDRLDHAEMERCFGLQMEAGCDGIIVCGSLGEGPMLSPDEKIEVLKTAQKVAGKKPVLLTVNEAGTREAAAIARRAAREGADGLMVVPSPIYHTNAEETVAALRAVAEAGDLPVMIYSNRLAYRVDVTVDQMEELASDKRFVAIKESSDDIRRSTEIINRLGDRYDLFTGVDNLAFEALSVGAIGWVAGLVTAFPRETVAIFQLMKQGRREEALAVYRWFRPLLDLDVSTYLVQNIKLAEVLAIDTNDRVRMPRQPLSGERRKAVEKIIRDALAARPKLPSLQTSPLSADRQVAAE

SEQ ID NO: 12030 - protein, 498 aa, Mesorhizobium loti
MIEYGHFIGGKRVAGTSGRKQDVMQPMDGSVRGTVALASQAELRAAVENAKAAQPKWAATNPQRRVRVLMKFLELVARDYDELADILAREHGKTIADAKGDIQRGLEVVEVCIGAPHMMKGEFTDGAGPGIDVYSMRQPLGVVAGITPFNFPAMIPLWKIAPAIACGNAFILKPSERDPGVPIRIAELFLEAGLPAGILNVVNGDKEVVDAILDDPDIKAVGFVGSTPIAHYIYSRGTAAGKRVQCFGGAKNHMIIMPDADMDQTVDALIGAGYGSAGERCMAISVAVPVGNDTANRLMEKLIPRVESLKVGPSTDSAADFGPLVTAQALERVKGYVDTGVKEGATLVVDGRGFKMQGYEDGYYMGGCLFDNVTADMRIYKEEIFGPVLSVVRAPTYESAIKLANDHEMGNGVAIFTRDGDAARDFASRVQVGMVGVNVPIPVPIAYYTFGGWKASSFGDLNQHGPDAFRFYTKTKTVTSRWPSGIKDGAEFVIPTMN

SEQ ID NO: 12031 - protein, 473 aa, Mesorhizobium loti
MLQVRQDVLGERFRLQRAAFEKQPFPDPSVRKDRLKRLLALTEHHEADICAAIDADFGGRSAHETRLAELFVVRAGIRHTLSHLSGWMRERRVATTLPFLPGRNRLLPQPLGVVGIVSPWNYPFQLAVAPVTAALAAGNRVLVKPSELTPAFSALLARLAGEHFAPDELSVITGDAEMGKAFVSKPFDHLLFTGSTAVGRQVAIAAAANLTPVTLELGGKSPAIFDPSCDLDAATASIAYGKLLNAGQTCIAPDYLLVPKGQAGTVAAKLATAVAQLYPTLRDNPDYTAIISERHFQRLRAMIAEARDAGADVVEINPAGEDFGAASRKLLPTLVSNAGPDLRLMREEIFGPVLPIIEYATIDEAISHVNQADRPLALYWFGKDSTNRQRILRETVAGGVTINDCMLHLVQENQPFGGVGASGMGAYHGEWGFRTFSKEKPVFLQSRLSAGALLRPPYGKTFERLFGLLRHIT

SEQ ID NO: 12032 - protein, 258 aa, Mesorhizobium loti
MNSTGIDLSAFSLAGKRILVTGANTGIGQGIVLSIARAGGVVIGVGRSSMDETASKVAAIGARFETVSADLADTATAGPMLDRVWDESGPLDGLVNNAGIIRRADAVDLTETDWDDVMDVNLKTVFLLCQSFARRALADGRRGKIVNIASVLSFQGGIRVASYTASKHGVLGITRLLACEWAAKGINVNAIAPGYVETNNTQALRADPDRSAAILGRIPAGRWGEPSDIGDAAVFLLARASDYMHGAAVPVDGGWLAR

SEQ ID NO: 12033 - protein, 477 aa, Mesorhizobium loti
MAAKATGVVGKVRQVIGAVVDVQFGDHLPAILNALETTNVGNRLVLEVAQHLGENTVRCIAMDSTEGLVRGQEVRDTGAPITVPVGPGMLGRIINVIGEPVDEEGPVDAIEMRSIHQPAPTYVEQSTEAQILITGIKVLDLLAPYAKGGKIGLFGGAGVGKTVLIQELINNIAKAHGGYSVFAGVGERTREGNDLYHEFIESGVNKKGGGEGSKAALVYGQMNEPPGARARVGLTGLTVAEYFRDQGQDVLFFVDNIFRFTQAGSEVSALLGRIPSAVGYQPTLATDMGALQERITTTTKGSITSVQAIYVPADDLTDPAPATSFAHLDATTTLNRAIAEKGIYPAVDPLDSTSRMLDPMVVGEEHYAVARQVQSILQRYKSLQDIIAILGMDELSEEDKQTVARARKIERFLSQPFFVAEVFTGAPGKLVDLADTIKGFKGLCNGDYDHLPEAAFYMVGGIEEAVEKAQRLAAEAA

SEQ ID NO: 12034 - protein, 294 aa, Mesorhizobium loti
MPSLKDLRNRIASVKATQKITKAMQMVAAAKLRRAQEAAEAARPYSERMGSVLANITQAIGGGGDAPALMTGTGKDNVHLLVVCTAERGLCGGFNSQIARLARDHIRRLLADGKQVKIICVGKKGFDILRRDYASMILDRVDLREVKTLGFVNADAIAKKVIHLFNEGAFDICTLFYSQFKSVISQVPTAQQIIPAGVASAPAAAVDGGNAVYEYEPEPGEILSDLIPRNISVQVFRALLENAAGEMGAKMSAMDNATRNAGEMINKLSITYNRQRQAQITKELIEIISGAEAL

SEQ ID NO: 12035 - protein, 509 aa, Mesorhizobium loti
MDIRAAEISAILKDQIKNFGREAEVSEVGQVLSVGDGIARVYGLDNVQAGEMVEFPGGIRGMALNLEADNVGVVIFGADRDIKEGDTVKRTGAIVDVPVGPGLLGRVVDALGNPIDGKGPIKATERKRVDVKAPGIIPRKSVHEPMSTGLKAIDALIPVGRGQRELVIGDRQTGKTAIILDTMLNQKSVHDNGPEKEKLYCVYVAVGQKRSTVAQFVKVLEERGALEYSIIVAATASDPAPMQFLAPFAGCTMGEYFRDNGMHALISYDDLSKQAVAYRQMSLLLRRPPGREAYPGDVFYLHSRLLERAAKLNDDLGNGSLTALPVIETQANDVSAYIPTNVISITDGQIFLETNLFFQGIRPAVNVGLSVSRVGSSAQIKAMKQVAGSIKGELAQYREMAAFAQFGSDLDAATQRLLNRGSRLTELLKQPQFSPLKTEEQVAVIFAGVNGYLDKLPVNQVGKFEHGLLSHMRAAGKDVLDAIRKEKALSDDLRAKLKAEIDAFAKTFA

SEQ ID NO: 12036 - protein, 186 aa, Mesorhizobium loti
MAQSSSPISGVAERYAGSLFELALQANSVAKVESDLNSFEAMLAGSSDLTRLINSPVFSGEEQAKAIAAIADKAGITGLTGNFLRVVARNRRLFAVPGMIKAFRQIAAEHRGETAAEVTSAHELTAAQQTELKAALKSVAGKDVAISVTVDPSLLGGLVVKIGSRQIDTSLKTKLNSLKLALKEVG

SEQ ID NO: 12037 - protein, 218 aa, Mesorhizobium loti
MKFFVDTADIKDIRELNDLGLLDGVTTNPSLILKSGGKIADVTKQICDIVQGPVSAEVVATEYKDMMAEAEVLAKIAPNVCIKVPLTLDGLKACKTIRTQMNRMVNVTLCFSANQALLAAKAGASFISPFVGRIDDTGSDGMELIQEIRQIYDNYDYQTEILTASVRTVNHVKQAALIGADVITAPPATLKALVNHPLTDKGLAAFLADWAKTGQKIG

SEQ ID NO: 12038 - protein, 285 aa, Mesorhizobium loti
MRYNQLGNTGMFVSELCLGTMTFGAAGQNAQWGLIASLDQKGVNDIVGRSIAAGVNFFDTADVYSFGESERLLGQSLRDLGVKRSDVVIATKVHGTMGQGPNERGSSRGHIMDSVDASLERLQLDHIDLYQLHGTDAVTPIDETLRALDDLVASGKVRYVGVSNWAAWRIAKALGIADRKGFARFETIQSYYSIAGRDLEREIVPLISEEKLGLMVWSPMAGGLLSGKYGPGAPGNGEGRRASFNFPPVNEDRAWAAVAVMREIAKKHDVSVATVALGYVLAKPS

SEQ ID NO: 12039 - protein, 344 aa, Mesorhizobium loti
MDYRRLGASGLKVPALSFGAGTFGGSGPLFGAWGNSDAKEARRLVDICLEAGVNLFDTADVYSNGASEEVLGEAIKGRRDAVLISTKTSLPMGDGPADYGSSRSRLIKSVDAALKRLGTDYIDLLQLHAFDAGTPVEEVLSTLDELVRAGKLRYVGVSNFSGWQVMKSLAQADRHGYPRYVAHQVYYSLVGRDYEWELMPLGLDQGVGALVWSPLGWGRLTGKIRRGQPLPEKSRLHDTAGFGPPVEDEHLYRVMDALDAVAQETGKTVPQIAINWLLQRPTVSSVIIGARNEEQLRQNLGAVGWSLTPEQMKKLDAASEVTAPYPYFAYRRQEGFARLNPQAV

SEQ ID NO: 12040 - protein, 651 aa, Mesorhizobium loti
MSEVHVHRVQPAWKKNALIDNDTYLKWYADSIKNPDKFWGKHGKRIDWFKPFSKVKNTSFDGKVSIKWFEDGLTNVSYNCIDRHLKKRGDQTAIIWEGDNPYDDKKITYNELYERVCRLANVMKKHGVKKGDRVTIYMPMIPEAAYAMLACTRIGAIHSIVFGGFSPDALAGRIVDCESTFVITADEGLRGGKSIPLKENTDKAIDIAAKNFVMVKNVLVVRRTGGKVGWAPGRDLWYHDEVATVKAECKPEKMKAEDPLFILYTSGSTGKPKGVLHTTAGYLVYASMTHQYVFDYHDGDIYWCTADVGWVTGHSYIVYGPLANGATTLMFEGVPNYPSQSRFWEVIDKHKVNIFYTAPTALRALMGAGNDPVKKTSRKSLRVLGSVGEPINPEAWEWYFNVVGNGKVPIVDTWWQTETGGILITPLPGATDLKAGSATRPFFGVKPQLVDGEGKVLEGAADGNLCITDSWPGQMRTVYGDHDRFVQTYFSTYKGKYFTGDGCRRDADGYYWITGRVDDVINVSGHRMGTAEVESALVSHDKVSEAAVVGYPHDIKGQGIYSYVTLMKGEEPTEDLRKELIAHVRKEIGAIASPDKIQFAPGLPKTRSGKIMRRILRKIAEDDFSTLGDTSTLADPAVVDDLIANRQNKKG

SEQ ID NO: 12041 - protein, 221 aa, Mesorhizobium loti
MFAGRKFAAFLFDMDGTLINSIASAERVWSDWARRHGLDVASFLPTIHGVRAIETITNLALPGVDPAHEADLLLKAEAADLDGIVPIAGAVAFLKALPGESWAIVTSAPRSLALARMEAAGIPVPAVIVAAEDVSRGKPAPDCFRLGAQRLGVDARDCLVFEDAPAGIAAAEAAQASVMVISATHSHPLPTQHAAIAGYDGVGITIDERGWLALEAQRDAA

SEQ ID NO: 12042 - protein, 684 aa, Mesorhizobium loti
MPSTKTVDIAAHPLTAWQGPLGLPDFAHIGDSDFSPVFDAALTAHEAEIDAIAGNKDAPTIENTLAALELGGEALDHVSSIFWCRAGAYTNETIQALERDISPKMSRHFSAISMNEKLFARIDDLYQRRESLDLDAETLRVLEKTWKGFVRSGAKLDAEGKKRLARINEELSSLGTAFGQNVLADERDWALFLDEADLAGLPDFLKSSMAEAAEMRGQKGRYAVTLSRSIYEPFTTFSERRDLREIAFKAFTMRGQNGGASDNTEVVRDMLKLRAEKAELLGYASFAALKLDDTMAKTPKAVHDLLDPVWEKALEKAAADQKELERLAAQAGSNEKFAAWDWRFYQEKLRAEKFAFDEAELKPYLQLDRVIDACFDVATKLFGITFEEKKGIVAWHPDARVFVVKNADGSERALFLADYFARPSKRSGAWMSALKSGYKLGNGSKPVIYNIMNFAKPPAGEPALLSVDEAKTLFHEFGHALHGMLTDVTWPSVAGTSVSRDFVELPSQLYEHWLTVPAVLEKHALHVKTGKPMPKALLDKMLATRTFGAGFATVEFTSSALIDMAYHARPDAPAEPLRFEAETLEKLDMPDTIAMRHRTPHFGHVFSGDGYSAGYYSYMWSEVLDADAFAAFEETGDPFNPALAERLRKNIYAAGGSKDPEELYTAFRGKMPSPEAMMVKRGLV

SEQ ID NO: 12043 - protein, 255 aa, Mesorhizobium loti
MGERLAGKVAIISGGATGMGGAASELFAAEGAKVAIIDRNGEAAAATAAAIRARGRVAEHFVADVSDEAQVQAAVKGATEKLGPVTVLFNHAGTIVIKPFLETTVQEWDWLHAVNVRSMFLMTRAVLPGMIAAGGGSIVCTSSISAVAATPMEVLYDTTKGACHMFARAIAVEFRDRNIRCNAVCPGFIRTPHGLREVADLGKLGVDVSDAALAAQQGRIGEPEEVAKAALYLASDESSFVNGAHLFVDNGFTAM

SEQ ID NO: 12044 - protein, 401 aa, Mesorhizobium loti
MAEAYICDYIRTPIGRFGGSLSSVRSDDLGAIPLKALAERNAGIDWQAVDDVVYGCANQAGEDNRNVARMALLLAGLPKEIPGSTVNRLCGSGMDALTIAARAIKAGEAELMIAGGVESMSRAPFVMPKADTAFSRNAEIYDTTIGWRFVNPLMKKQYGVDSMPETGENVAEDFAVSRADQDAFAVRSQDKAVAAQANGRLAKEITAVTIPQRKGDPVVVSKDEHPRAGTTVEALAKLPTPFRQGGTVTAGNASGVNDGAAVLIVASEAAVKKYGLTPIARILGGAAAGVAPRIMGIGPAPATQKLCARLGLTPQQFDVIELNEAFASQGIAVLRQLGIAEDAEHINPNGGAIALGHPLGMSGARISGTAALELRERGGRYALATMCIGVGQGIAIALERA

SEQ ID NO: 12045 - protein, 507 aa, Mesorhizobium loti
MEEDNMHFSPDRPTFFVNPDYRQMADTSKPVIDPATLETVGAIASASDGEIDAALAAATKAQAAWKRLDAKSRAKHLHAVANAIEAADFTRCAELMVREMGKPYPEAIGEIANCAPIFRYYAEMARDDAGKVAGTTQAGSFQYARYEPYGVSVHIMPYNFPILLMCWTVAASLAAGNACIIKPAEATTLSTLDYMAVFRSLPEGLVSCLPGGAATAQALITSDRTHAVAFTGSVAAGKAVAVACAERMKPCVIEAGGSDPLIISKHAPLEVAAAGSVTAAFHLTGQVCTSAERFFVVDAVHDRFVELFAERTRALRIGNGMDKTEIGPLVSEAARAKVMRLVDDAIAHGAKAVTGGRIPPSHNTGWFYEPTILTGVTPDMAIVREECFGPVAAICRVKDFDEAIRLANDSLFGLGASVFTTDLAEAHEAAERLEAGMVWVNNPLIDNDALPFGGWKASGLGRELGRQGLDAFRRSKMVIIDHRPAIQDWWYPYPDSWFRETGGRKHV

SEQ ID NO: 12046 - protein, 689 aa, Mesorhizobium loti
MSNSVSAVNDNGVAIVTIDNSPVNALSFHVRAPLMQALVDLRDDASVTAIVIACAGRTFVAGADITEFGKPVQQPDLRAIVAMLETIAKPTVAAIHGTALGGGLELALGCHFRVADAGAKLGLPEVKLGLLPGGGGTVRLPRLVGAVKALKMIVSGTPIGADEAHEAGLVDAVFEGDLTTHAVNFAGEIARKGGPFTPVRDRDERLGETDLAAFDAEAADLARKARGLEAPVACAQAVRNAVTLPFDEALAAERALFVKLVASDQSRAQRHLFFAEREAAKLPAKDTYKRRIARVGVIGAGTMGGGIAMAFANGGFSVTLLETSAEALQRGLGTIEKNYAVSVSRGSLAEDAKHQRLAQFKGSTDYADLAECDLIIEAVFEDMAVKKEVFGKLDAVAKPGAILATNTSYLDINEIAGSISRPQDVLGLHFFSPANVMKLLEIVRADKTAPDALATVIDLARRIGKVAVVVGVCHGFVGNRMLAARGSESEALLLEGATPSQIDKAFTDFGWPMGPFQMGDLAGLDIGWRNRKARGLTAVIADTLCEQGRFGQKTGRGFYLYEAGARAGIPDPEVEALIRDKAAERGIAPRAISADEIIERTLYPLVNEGAKILEEKIAARASDIDVVWVNGYGFPIGKGGPMFWAGLEGAAKIVQRLDHWHQRTGKDVFKPAPLLKRMAETGSWEGVEA

SEQ ID NO: 12047 - protein, 804 aa, Mesorhizobium loti
MAVTPIVPPGAPGIPARWTSSAKSGVGTSLSPAGHIWFTISHGILEVYYPRLDSACTRDLGLIVTGPGGYFSEEKRDAAHEIEPFEAGVPAYRLVNTAGDGAYRIEKRILCDPARPVLLQEITFTALKGAPDDYRVYALLAPHLVNAGMGNTAWVGDHKGKPVLFASGRGSCLALASSLPWRDCSAGYVGFSDGWQQLNHTGILDQACQRAEDGNVALTGEIGFTSTTTKAVLALGFGATPDEAAENAFASLEQGFEPAAKTYLQNWREWQARLLPLDRHAASGINTYRTSTAVLATHRSIAMPGAAVASLSIPWGFNKGDDDLGGYHLVWPRDLVETAGGFLAAGDAASALQILEYLRSIQQPDGHWPQNAWLDGSAYWPGIQMDECAFPLLLADALHRAGHLPRARLATLLPMIERAATYVVRNGPVTGEDRWEEDAGYSPFTLAVEIAALLAAADLLDACGKKDEATYLRETSDGWNDQLERWTYATDTAICRAAGVEGYYVRIAPPDSAEAGSPKDGYVPIKNRPPGDTDRPAQEIVSPDALALVRFGLRSADDPRIVDTVKVIDAQLRCALPQGPIWYRYNGDGYGEHQDGTPFDGTGQGRPWPLLAGERAHYELAAGRKDEAANLLKALEDSAEPGGLLPEQVWDGADLPERQLLHGRPSGSAMPLVWAHSEHIKLLRSLRDGAVFDMPPQGVKRYIEAKTVSPFRTWRFNNKIRALPEGKTLRIELLAAATVHWSTDNWATAHDSQTVENAFGIHLADLPTTSLPEGSALIFTFFWPGTGDWENVDFSVTSGERDSG

SEQ ID NO: 12048 - protein, 338 aa, Mesorhizobium loti
MQIGMMGLGRMGANMVRRLMRDGHECVVYDINPASVAALVSDGALGAASLTEFVGKLAKPRCVWLMLPAAITGKIIDQVSALMEPGDIVIDGGNSYYHDAVNQAAKLAAKGIHLVDVGTSGGVWGLERGYCLMIGGPDVAVQHLDSIFATLAPGADAGAPAPDKAAGTAPFGYLHCGPSGAGHFVKMVHNGIEYGVMAAYAEGMNILKSANAGKRQRTADAETSPLENPQYYQFDIDLPQVAEVWRHGSVIGSWLLDLTAGALKSDPGLAQFGGRVSDSGEGRWTLKAAIDTGVPAPVLSSALFDRFSSQGESEFADKLLSAMRYAFGGHVEKPKAGK

SEQ ID NO: 12049 - protein, 475 aa, Mesorhizobium loti
MSKSRRPASDATAGDARMSQERSDTLVLFGATGDLAHKKIFPALYQMVAKGTLTEPVIGVAFDAWDIKQLQARARDGIVNALGKIDEKVFAKFASLLRYVSGDYRDPATFEKLKTALGTAQRPLHYMAVPPTMFETVVQGLEQSGTARGARLMVEKPFGHDLQSARWLNRVLHLVFDEQSIFRIDHYLGKEAIQNLLYFRFANSFLEPIWNRNFVESVQITMAEDFGVEGRGRFYDDVGCIRDVIENHLLNILLLLAMEPPVGRSADDLIDEKVQVLRAIRTLTKDDVVRGQFTGYLAEPGVAPNSPVETFAAVRFFVDTWRWQDVPFFIRAGKNMPVHVTEVVVRLKRPPLDVFDPIKPADQNYVRFRIDPQVVIAIGAQRKAPGDDMVGEQVELTALDDSKADMPPYERLIGDAMNGNGQLFTRQDAAELAWRIVGPVLGDTTPPHLYEPKTWGPAHAMAGFGPPNGWIDPVA

SEQ ID NO: 12050 - protein, 308 aa, Mesorhizobium loti
MQTTLKIGTRGSPLALAQAHETQARLMAAHGLPAEAFEVVVISTSGDRIQDRPLSEAGGKGLFTKEIEEALLAGAIDIAVHSSKDMPTQLPDGLELSAFLPREDARDAFVGKAAKTIADLLRGAKVGSSSLRRQALIRRMRPDLDVVMFRGNVQTRLRKLDEGVAAGTILAYAGLKRLGLEHVATDLMPLDIFPPAPGQGAIGIETRIGDRAVEKMLVAIHDVPTGQALACERAFLAALDGSCRTPIAGHATIETGNLSFAGLIISPDGTQSHTVELQGPAQDAARIGDEAARTVRAKAGEKFFDGWV

SEQ ID NO: 12051 - protein, 268 aa, Mesorhizobium loti
MPFSIATWNINSVRLRMPIVERLLDEYAPDVLCLQETKVPDELFPEKAFRRLGYQYIAFHGQKGYHGVATVARRPIEVVEKRRFCDIEDSRHLSVTVRAGGKTILLHNFYVPAGGDEPDPEINKKFKHKLDFVAEMNAIRAEHTEVSASVLVGDLNIAPLEHDVWSHKQLLNVVSHTPVETENFEAMRLAGNWVDLMRHNVPLDQKLYTWWSYRAQDWELSNRGRRLDHVWSSPNLVQDFAGYEILRAARGWERPSDHVPVIARFDLD

SEQ ID NO: 12052 - protein, 259 aa, Mesorhizobium loti
MVELTLPKNSKIQQGKTWPKPEGATNLREYRIYRWSPDDDENPRIDTYFVDMDDCGPMVLDALLWIKNKIDPTLTLRRSCREGICGSCAMNIDGSNTLACTKGCDDISGAVKVYPLPHMQVVKDLVPDLTNFYAQHASIEPWLKTVSPQPAKEWLQSHEDREKLDGLYECILCACCSTSCPSYWWNGDRYLGPATLLQAYRWLIDSRDEAKGERLDNLEDPFRLYRCHTIMNCAQTCPKGLNPAKAIAEIKKMMVERRV

SEQ ID NO: 12053 - protein, 602 aa, Mesorhizobium loti
MAGYNFVDHKFDVVVVGAGGAGLRATLGMAEQGLRTACITKVFPTRSHTVAAQGGIAASLSNMGPDSWQWHMYDTVKGSDWLGDVDAMEYLVREAPAAVYELEHYGVPFSRTEEGKIYQRPFGGHMMNYGEGPPVQRTCAAADRTGHAILHTLYGQSLKNNAQFFIEYFALDLIMEPDGTCTGVVAWNLDDGTIHRFSAKMVVLATGGYGRAYFSATSAHTCTGDGGGMASRAGFPLQDMEFVQFHPTGIYGAGCLITEGARGEGGYLVNSEGERFMERYAPSAKDLASRDVVSRCMTLEIREGRGVGKKKDHIFLHLDHLDPAVLHERLPGISESAKIFAGVDLTKEPIPVLPTVHYNMGGVPTNYWGEVLNPTTRSPDKVSPGLMAVGEAGCASVHGANRLGSNSLIDLVVFGRAAAIRAGQVIDRKSAIPSPNEASVEKIMDRFDGLRHANGSTPTAVLREKMQKAMQEDAAVFRTQESLENGCKRISQIWGELKDIKVFDRSMIWNSDLVETLELENLMANAITTVYSAEARKESRGAHAREDFSARDDAAWRKHTLARVSEDGKVTLSYRPVHTEPLLAEKDGGISLAKIAPKARVY

SEQ ID NO: 12054 - protein, 468 aa, Mesorhizobium loti
MAYDVVIIGSGPGGYVCAIKAAQLDLKVAVVEKNATFGGTCLNIGCIPSKALLHASEMFAEAGHSFDTLGVEIPAPKLNLTKMMAHKDATVASNVNGVAFLFKKNKIDSFRGTGKVVAAGKVSVTGEDGKVEEIETKNIVIATGSDVAGIPGVKVDFDEKIIVSSTGALSLDKVPGHLVVVGGGVIGLELGSVWARLGAKVTVVEFLDTILGGMDGEVSKQFQRMLSKQGFEFKLGAKVTGVAKAKKGATVTFEPVKGGAAETIAADVVLIATGRRAYADSLGLKEAGVEVDERGRVKTDGHLKTNVPGIYAIGDVIAGPMLAHKAEDEGVAVAETIAGQAGHVNYEVIPSVVYTSPEIASVGKTEEELKKAGIDYKVGKFPFSANGRARAMLHTDGFVKILADKASDRVLGVHIVGFGAGEMIHEAAVLMEFGGSSEDLARTCHAHPTMSEAVKEAALATFFKPIHI

SEQ ID NO: 12055 - protein, 251 aa, Mesorhizobium loti
MSEAQKVLLVTGGSRGIGAAVCRLGAKAGYRVAVNYASNRAAADALVAEIKAAGGDAFAVKGDVGGEADIIAIFEAVDRSYGRLDAFVNNAGIVDAKARVDEMSAARLERMMRINVVGSILCAREAVKRMSTRHGGKGGAIVNISSAAAVLGAPDNYVDYAASKGAIDTFTVGLAREVALEGIRVNAVRPGIIDTDIHASGGQPDRVALIQDTLPMKRAGTADEVAAAVLYLLSDAASYTTGAILNVSGGR

SEQ ID NO: 12056 - protein, 424 aa, Mesorhizobium loti
MATEIRVPTLGESVTEATIGKWFKKVGDAIAVDEPLVELETDKVTVEVPAAAAGTLGEIVAKEGETVGVGALLGSISAGGSAPATKPQAVSQASSPDAASTSKQAAAETAKIAGDAGAVEPRSMPPAPAAAKLIAENNLSVDQLSGSGKRGQVLKGDVLDAIAKGAPSQPAETPRAAPAPIAVRAPSSGDDASREERVRMTKLRQTIARRLKEAQSTAAMLTTFNEVDMSAVMALRTKYKDVFEKKHGVKLGFMGFFTKAVTHALKEIPAVNAEIDGTDIIYKNFAHVGVAVGTEKGLVVPVVRDADQMSIAEIEKEIGRLGIAARDGKLSVADMQGGTFTISNGGVYGSLMSTPILNAPQSGILGMHKIQDRPVVVGGQIVIRPMMYLALSYDHRIVDGKEAVTFLVRVKESLEDPERLVLDL

SEQ ID NO: 12057 - protein, 995 aa, Mesorhizobium loti
MARQDQTNDQFSLTSFLYGGNADYIDALYAAYEDDPASVNPEWQEFFAGLKDDAGDVRRNAKGASWAKPSWPLQANGELVSALDGNWGIVEKHLEKKVKDKAVTNGVVLSDADVHQATRDSVRAIMMIRAYRMRGHLHANLDPLGIAKPLEDYNELSPENYGFTAADYDRPIFLDNVLGLEFGTIRQMLEILTRTYCSTLGVEFMHISDPEEKAWIQARIEGADKEISFTNTGKKAILQKLVEAEGFEQFIDVKYKGTKRFGLDGGEALIPALEQIVKRGGQLGMKEIVLGMAHRGRLNVLSQVMAKPHRAIFHEFKGGSAAPDEVEGSGDVKYHLGASSDREFDGNKVHLSLTANPSHLEIVDPVVMGKARAKQDYLFGRGREEIVPLEERAKVLPLLLHGDAAFAGQGVIAEILGLSGLRGHRVAGTLHFIINNQIGFTTNPRFSRSSPYPSDVAKMIEAPIFHVNGDDPEAVVHATKVAIEFRMKFHKPVVVDMFCYRRFGHNEGDEPAFTQPIMYRNIRTHKTTVQIYADRLIAEGHITQAELDQMKADWRAHLESEWEVGQHYKPNKADWLDGAWSGLRTADNQDEQRRGKTAVPVKTLKEIGKKLTEVPKGFEAHKTIIRFLENRREAIESGEGIDWSTAEALAFGAILLDGNPIRLSGQDSERGTFSQRHSVLYDQRDETRYIPLNNLSAAQAGYEVINSMLSEEAVLGFEYGYSLAEPKALTLWEAQFGDFANGAQVVFDQFISSGERKWLRMSGLVCLLPHGYEGQGPEHSSARLERFLQLCAEDNMQVANCTTPANYFHILRRQLKRDFRKPLILMTPKSLLRHKRAVSTLPEISGESSFHRLLWDDAQLLPNQPIKLTKDSKIRRVVLCSGKVYYDLYEEREKRGINDIYLLRVEQLYPFPAKALITELSRFRNAEMVWCQEEPKNMGAWSFIDPYLEWVLAHIDAKHQRVRYTGRPAAASPATGLMSKHLAQLAALLEDALGE

SEQ ID NO: 12058 - protein, 300 aa, Mesorhizobium loti
MSILVDKNTKVLVQGLTGKTGTFHTEQALAYHGTKMVGGIHPKKGGETWTGSKGESLPIFATVAEGKAKTGANASVVYVPPAGAAEAILEAIEAEIPLIICITEGIPVMDMVKVKARLDRSTSRLIGPNCPGVLTPDECKIGIMPGNIFRKGSVGVVSRSGTLTYEAVFQTTNVGLGQTTAVGIGGDPVKGTEFIDVLEMFLADDETKSIIMIGEIGGSAEEDAAQFLKDEAKRGRKKPMAGFIAGRTAPAGRTMGHAGAVISGGKGGAEDKIAAMESAGIKVSPSPARLGTTLVEAIKG

SEQ ID NO: 12059 - protein, 397 aa, Mesorhizobium loti
MNIHEYQGKALLKSFGAPVAEGVPVFKASEAEAAARALPGPLYVVKSQIHAGGRGKGKFKELSPDAKGGVRLAKSVADVVANANEMLGHTLVTKQTGPAGKQVNRLYIEDGADIERELYLSILVDRSVGRIAFVVSTEGGMDIEAVAHDTPEKVITVAIDPERGVTADDVKKLNAALKLDGDAAKDGGTLFPILYKAFIEKDMSLLEVNPLIVMKNGRLRVLDAKVSFDNNALFRHPDVLELRDTTEEDEKEIEASKYDLAYVALDGNIGCMVNGAGLAMATMDIIKLYGAEPANFLDVGGGASKEKVTAAFKIITKDPAVKGILINIFGGIMKCDIIAEGVIAAVKEVGLEVPLVVRLEGTNAELGKKIINDSGLNVVSADDLDDAAKKIVAAVKG

SEQ ID NO: 12060 - protein, 322 aa, Mesorhizobium loti
MARNKIALIGSGMIGGTLAHMIGLKDLGDVVLFDIAEGIPQGKGLDIAQSSPVDGFDSRLTGVNDYAGIEGADVCIVTAGVPRKPGMSRDDLLGINLKVMEQVGAGLKKYAPKAFVICITNPLDAMVWALQKFSGLPKTHVVGMAGVLDSARFRYFLAEEFKVSVEDVTAFVLGGHGDSMVPMIRYSTVSGIPLPDLVKMGWTSKEKLDQIVQRTRDGGAEIVGLLKTGSAYYAPAASAIAMAESYLKDKKRVLPCAAHLSGQYGVKGTYVGVPVVIGAGGVERIIEIDLNKSEQKMFESSVATVQGLTEACVKIAPQLASK

SEQ ID NO: 12061 - protein, 294 aa, Mesorhizobium loti
MASTAPFAKMNGIGNEIIVADMRGRADQVTAAAALALNGDAATRFDQIMAIHDARTPGTAYYVDILNSDGTSAQACGNGMRCVVQALAAETGQKTFTFETRAGILNAREHADGTISVDMGMPHFGWQEIPLAEEFRDTRMIELQIGPIDAPVLHSPSAVSMGNPHAIFWVDRDVWSYELERFGPLLENHPIFPERANITIAQVTSPESMIIRTWERGAGLTKACGSAACASVVAAARTRRTGRSVNLLTPGGGTLHVEWLDNDHVILTGAAEWEFSGSFDPSTGTWARDTESAA

SEQ ID NO: 12062 - protein, 306 aa, Mesorhizobium loti
MAAADYYEVLDPRFARLFNGNAQVDKLFTGCRWAEGPAWFAAGRYVVWSDIPNNRMLRYDETDGSVSVFRQPSGNSNGNTVDRHGRLVTCEHSGRRVSRTEHDGSVTTIAAKWKGKRLNSPNDVVVKSDGSIWFTDPSYGIDTDYEGDKAESEIGACYVYRVDPHSGEVEAVITDMVRPNGLAFSLDESLLYVVDTGRTHGAENPAHMRVFNVGKHGKKVSSGKVFADCTAGLFDGFRLDADGRIWTSAADGIHCYDPDGTLIGKVKVPEVTANCVFGGAKLNCLYIAGTTSLYSVRLMVNGAKTF

SEQ ID NO: 12063 - protein, 896 aa, Mesorhizobium loti
MSKSLDSFNCRRTLTAGGTEYAYFDLVEAEKNGLTGIAQLPYSMKVLLENLLRNEDGRSVTKESIQAVAGWLTDKGTAGVEIAYRPARVLMQDFTGVPAVVDLAAMRDAMASLGGDPQKINPLVPVDLVIDHSVIVDEFGTPMAFARNVELEYERNEERYKFLKWGQQAFRNFRVVPPGTGICHQVNLEYLGQVVWTNTEDGETTAYPDTCVGTDSHTTMINGLGVLGWGVGGIEAEAAMLGQPVSMLLPEVIGFRLTGKLKEGVTATDLVLTVTQMLRKKGVVGKFVEFFGPGLSNMTLADRATIGNMAPEYGATCGFFPVDAETIRYLTMSGREESRIALVEAYSKAQGMWREAGSADPVFTDLLELELSSVVPSMAGPKRPEGRVALEGIPAGFAKAMDTEYKKAAEISKRYAVEGTDHDLGHGDVVIAAITSCTNTSNPSVLIGAGLLARNANRLGLKQKPWVKTSLAPGSQVVAEYLEKSGLQKELDQIGFNLVGFGCTTCIGNSGPLPAPISKTINDKGLIAAAVLSGNRNFEGRVSPDVQANYLASPPLVVAHALAGTVTKDLTTEPLGEDKNGNPVYLKDIWPSSAEIQEFIEKNVTRELFARKYADVFKGDEYWQNVKAPEGQTYAWDDNSTYVQNPPYFAGMTAGFGKIGDIKGARVLGLFGDKITTDHISPAGSIKAASPAGKYLTDHGVGVADFNQYGTRRGNHEVMMRGTFANIRIRNHMLGENGREGGYTIHYPSKEEESIYDAAMEYKKEGVPLVIFAGVEYGNGSSRDWAAKGTNLLGVRAVIARSFERIHRSNLVGMGVIPFVFEEGTSWASLNLKGDELVEIDGLSTIKPRQTMTAKITYGDGTVKNVPIICRIDTLDELDYFKNGGILQYVLRDLAA

SEQ ID NO: 12064 - protein, 407 aa, Mesorhizobium loti
MSKTKDVKKVVLAYSGGLDTSIILKWLQTELGAEVVTFTADLGQGGELEPARKKAEMMGIKDIRIVDVREEFVADFVFPMFRANTVYEGTYLLGTSIARPLISKHLVDIARETGADAIAHGATGKGNDQVRFELSAYALNPDIKVIAPWRDWSFKSRTDLINFAEQHQIPVAKDKRGEAPFSVDANLLHSSSEGKVLEDPWSEPPEFVHQRTVSPMDAPDKVTEIEIEFLKGDPIALNGKKLSPATMLAALNDLGRDNGIGRLDLVENRFVGMKSRGVYETPGGAILIVAHRAIESITLDRGAAHLKDEFMPRYAELIYNGFWFSPERLMLQAMIDKSQEDVEGTVRLKLYKGNVMVTGRKSKKTLYSDALVTFEDDRGAYDQKDAAGFIRLNALRLRTLAARNRKG

SEQ ID NO: 12065 - protein, 344 aa, Mesorhizobium loti
MSFKVAVVGATGNVGREMLNILEERGFPVSEVVALASRRSQGTEVSFGDRTLKVKALDQYDFSDTDICVMSAGGNVSKEWSPKIGKQGCVVIDNSSAFRYDQDVPLIVPEVNPDAISLFTRKNIIANPNCSTAQLVVALKPLHDFATIKRVVVATYQSVSGAGKEGMDELFTQTRAVFVADQVDVKKFTKRIAFNVIPHIDVFLDDGFTKEEWKMVAETKKMLDPKIKLTATCVRVPVFIGHSEAVNIEFEKPITADEARDILRDAPGCQVLDKREDGGYITPLESAGEDATFISRIREDSTVDNGLSMWVVSDNLRKGAALNAVQIAELLVERGLIQPKKKAA

SEQ ID NO: 12066 - protein, 620 aa, Mesorhizobium loti
MSNFVGIVPALAQALEKRGYSELTPVQKAVLELGSADALVSAQTGSGKTVAFGLAMAPTLLDGAERFGAAMAPLALAVAPTRELALQVTRELEWLYEPTGATVASCVGGMDMRTERRALERGAHIVVGTPGRLRDHITRNSLDMSALKAVVLDEADEMLDLGFREDLEFILDAAPAERRTLMFSATVPRSIATLAQGYQRDAVRISAAGEEKQHLDIEYRALNVAQADRENAIINVLRFYEAKNALVFCNTRAAVNHLTARFNNRNFSVVALSGELSQNERSHALQAMRDGRAKVCIATDVAARGIDLPNLELVIHADLPTNPETLLHRSGRTGRAGRKGVSALIVPGSARRRTERLLQNAGLKATWASPPSADDVIRRDDERILADPAFDEPVKDDERAFIDALLAKHGAEQVAAAFVRQCRASRSAPEDLIDVAPFTPSRERPAGEKFAQRDEAPSRRDDFGASVWFSLSVGRRQNAEPRWLIPMLCRTGSISKREIGAIKMQPEETFVQIAADWADRFLAAIGPDRKLQGNILVKRLDGTPDLSRAGYQAPSPDKKPHRGKAPFDPNAPKRKFEKRTPASAEQRPAHEAKPWAKKPGKPKFDNAGPPKHKKPKKRPS

SEQ ID NO: 12067 - protein, 464 aa, Mesorhizobium loti
MKEISCKLLVIGAGPGGYICAIRAGQLGVDTVIVEAGKPGGTCLNVGCIPSKALIHAAEEFEKVAHMAGGKSPLGISVSAPVLDLGKTIAWKDGIVSRLNSGVAGLLKKAGVKTVHGWAMFRDGKTVEVETETGSQVIRAETIVIATGSAPVELPFLPFGGPVISSTEALALSVVPKKLAVVGGGYIGLELGMAFAKMGAEVTLVEALPRVLAQYDAELTRPVVKRLAALGVEVMTEAKAKGLSTKGDALLVETADGKNTKVSADKILVTVGRKPVTEGWGLDQIDLDMSGKFIRIDDQCRTSMRGIFAIGDVTGEPMLAHRAMAQGEMVAEIVAGHKRNWDKRAIPAVCFTDPELVTVGLSPEEAKAQGEIKIGLFPFAANGRAMTKLGEDGFVRVVARADNHLVLGIQAVGQGVSELSTAFGLALEMGARLEDIAGTIHAHPTQGEGFQEAALKALGHALHI

SEQ ID NO: 12068 - protein, 438 aa, Mesorhizobium loti
MGEHIIKLPDVGEGVAEAELVEWHVKVGDMVREDTVLAAVMTDKATVEIPSPVDGEILWLGAEIGDTVAIGSPIVRLKVAGEGNVKPKGDAKAEAVAAEPPAKLPTPKPETAGPVAKASPKAGAPEAKPAPAVAKSTGQRSISGAPRPEGERPLASPAVRLRAKEAGIDLRQVAGSGPAGRIGHEDIEAFLARGPQVAKTSGLTRNDAVEDIKVVGLRRKIAEKMTLSKSRIPHITYVEEIDVTALEELRAALNKEKRADRPKLTLLPFLMRAMVKAIAEQPQLNSLFDDEAGIIHQHGGIHIGIAAQTPSGLVVPVVKHAEARDIWDCGAEVNRLAEAAKSGTATRDELSGSTITITSLGAMGGIATTPVINHPEVAIIGVNKMMVRPVWDGTQFIPRKMMNLSSSFDHRVIDGWDAAVFVQRIKALLETPALIFVD

SEQ ID NO: 12069 - protein, 337 aa, Mesorhizobium loti
MPRRTMIEAIRDAMDVSMGRDDKVVVFGEDVGFFGGVFRCTQGLQAKYGKSRCFDAPINESGIVGSAIGMAAYGLKPCVEIQFADYMYPAYDQLTQEAARLRYRSNGDFTCPIVVRMPTGGGIFGGQTHSQSPEALFTHVSGLKTVVPSNPHDAKGLLIAAIEDPDPVIFLEPKRLYNGPFDGHHDRPVTPWSKHELGEVADGHYTVPLGKAAIRRAGSAVTVLAYGTMVYVAQAAAEETGIDAEIIDLRTLLPLDLDAIVASVKKTGRCVIVHEATLTSGFGAELSALVQENCFYHLEAPVARVAGWDTPYPHAQEWDYFPGPARVGRALIETLEA

SEQ ID NO: 12070 - protein, 410 aa, Mesorhizobium loti
MADAGMLRFHVPEPEVRPGGTPDFSNVTIAAAGSVPRPDIDVDPRTIRDMAFSIIRVLNRNGEAVGPWAGLLSNEELLEGLRHMMTLRTFDARMQMAQRQGKTSFYMQHLGEEAVSCAFRKALEPGDMNFPTYRQAGLLIADGYPMVTMMNQIYSNEADPLKGRQLPIMYSSKEHGFFSISGNLATQYIQAVGWAMASAISNDSKIAAAWIGDGSTAESDFHSALVFASTYKAPVVLNVVNNQWAISTFQGIARGGSGTFAARGLGFGIPSLRVDGNDYLAVHAVAKWAAERARKNLGPTLVEYVTYRAGAHSSSDDPSAYRPKTESDAWPLGDPVVRLKNHLIGLGVWSDERHAQAEAEILDTVIAAQKEAESHGTLHAGGKPSTRDMFEGLYAEMPPHLRRQRQQAGV

SEQ ID NO: 12071 - protein, 343 aa, Mesorhizobium loti
MPKSRIMLDVLKGEAHFPPPLWMMRQAGRYLPEYRETRRRAGSFLDLCYDPDLAVEVTLQPIERFGFDASILFSDILVVPHALGRDVRFEEGRGPLLTPISVAEIMALESDVFHVNLEPVYETVRRLRAKLPDETTLIGFCGAPWTVATYMIAGHGTPDQAPARLFAYREPAAFQHLLKVLADHSAAYLIRQIEAGADVVQIFDSWSGVLDDASFDQFCVWPVAEIVRQVQAVHPDVPIIGFPKGAGARYRTYRQKTGVTGLGIDWTVPLAAAKDLQRSGAVQGNLDPLRLVAGGKALSDGVEAILKALGDGPLIFNLGHGITPETPIAHVEAMVKQVRSAAR

SEQ ID NO: 12072 - protein, 280 aa, Mesorhizobium loti
MVEATKKAFVTGHPIKHSRSPKIHGHWLAQHGIDGSYEAIDVAPQDFAEFIAALQANGFRGGNVTIPHKEAAFAVAQRRDQAAEEIGAVNTLWFEDGVLRGGNTDGHGFAANLDDCAPGWANTGPAVVLGAGGASRAVIQALKQRGFSDIRIVNRTLARAQELRDRFGAGVSAHGTAATDELLADAGLLVNTTALGMVGNEGLAADPALLPDHAIVTDLVYVPLETPLLAAARARGLKTVDGLGMLLNQAVPGFEHWFGVRPQVTAELRALIVADLVPKP

SEQ ID NO: 12073 - protein, 394 aa, Mesorhizobium loti
MTSHTPPPSGKNRLAFSTRTIHGGQSHDPLTGAVMVPIYATSTYGQQSPGVHKGFEYARSQNPTRFAFERAVADLESGTAAFAFASGLAAISTVLELLDSGAHIVATDDIYGGSFRLMERVRKRSAGLQVSFVDFTDLAAVEAAIRPETKLLWVETPTNPLLRIVDLEGVAALAKRKGVLTVADNTFCSPYIQRPLELGIDIVVHSTTKYLNGHSDMVGGVAVVGDNKELATQLKFLQNAIGAISGPFDSFLALRGLKTLALRMERHSDNGLKIAQWLEARKDVRRVLYPGLASHPQHSIAVQQMHAFGGMITAVLDRDLAGTKRFLERTQLFTLAESLGGVESLIEHPALMTHGSIPAEKRSEIGISDSLVRLSAGIEDGDDLIADLEQALGG

SEQ ID NO: 12074 - protein, 308 aa, Mesorhizobium loti
MPSILSISGVSKTYATGFTALKEVNLDIQRGEIFALLGPNGAGKTTLISIVCGIVNRSTGTVTVDGHDIGKDYRAARSLIGLVPQELTIDAFESVWATVNYSRGLFGKPPNHGFVEKVLRDLSLWDKKDAKAITLSGGMKRRLMIAKALSHEPRILFLDEPTAGVDVELRQDMWEMVRRLREDGVTIILTTHYIEEAEAMADRVGVINRGEIILVENKAELMHKLGRKRLVLELRNPLTAIPETISRYALELSPDGGQLTYTYDNQAERPGVASLIRDLEAAGIQFRDIDTQNSSLEEIFVNLVRREP

SEQ ID NO: 12075 - protein, 195 aa, Mesorhizobium loti
MDEKAAPGSETAIFAGGCFWGVQGVFQHVKGVSKAVSGYTGGAKDDAVYETVGTGRTGHAESVEITYDPSKVTYGQLLQVYFSVAHNPTQLNFQGPDSGTQYRSTIFAENDTQKQIAQSYIDQLDKAKLYPAPIVTTIETGKTFYPAENYHQDFLTLNPTYPYIVYNDLPKVANLKQLFPALYSEKPVLVLSASN

SEQ ID NO: 12076 - protein, 208 aa, Mesorhizobium loti
MGRAHTVSRGEDHPPIARSELPDDTAALARYLIGKLVVRDLPEGMVSGRIVETEAYVVGDAAGHGFRGMTPRNRSLFLERGHAYVYLAYGVSMMLNVSSEVPGIGTGVLIRALEPLDGIEIMRRNRGVERLRDLARGPGRLAAALRIDRSLDGLDLCRKGPLWLAKDNQKPGEIGQSTRIGITKDAARLLRFYVRGSLFVSGPRSLQE

SEQ ID NO: 12077 - protein, 306 aa, Mesorhizobium loti
MNAIDVHGLVKRFGDKTVVDQVTMSVAEGEIVGFLGPNGSGKTTTIRIMCGLLTPDEGEGTVLGFNIRTDSLSIKREVGYMTQKFSFYEDLTIGENLEFVARLYQLRPVEEYVARTLEELGLTTRRDQLAGTLSGGWKQRLALAACIMHKPKLLLLDEPTAGVDPKARREFWDEIHRLASGGLTVLVSTHYMDEAERCHRISYISYGKMLATGTVEEVVKNAGLTTFVVQGPRLAKVAEALQGRPGVDQVAPFGATLHVVGSDSKKLEAALADIEKEHKGVTVAPGETSLEDVFIQFMSGSKDNMA

SEQ ID NO: 12078 - protein, 208 aa, Mesorhizobium loti
MYKLYTRPGSGGFVVEAALALANAPFQQIDVPKSDRPDPAFLDISPLNQVPVLTLPDGSSMTESAAICILLAERHPDAGLAPAVNAPARADFLRWMAFMSSVLYPAVLRFYYAHRYTADADGTKAVKQAAIAEMDRGFAVLDAALKGRDWLVGDQMSLADIYLVMLVAWHPDIGTARAAWPDIERLWARLRDHPLLKTLNTSHEMWPT

SEQ ID NO: 12079 - protein, 230 aa, Mesorhizobium loti
MLTLFHHPMFATCRFVRLAFGEYGEELALIEEKPWTRRKEFLALNPAGTLPILLAEGDVPIVGATVISEYLDETRGVLKRDKRLFAEDPMQRAEIRRLIDWYLNKAESEVTRHLVRERVLKPIMPETAGGGSPDSGAIRAARANIRQHMKYTNWLAGTRHWLAGGRVTYADLAAAATLSVLDYLGEIDWREHAAAREWYTRVKSRPSFRPLLTDRVRGLSPVSHYADLDF

SEQ ID NO: 12080 - protein, 633 aa, Mesorhizobium loti
MQPGPRRKTHEAPDLTLQAPNKQKASVGEVNAVLRRILSENGRDHRWSYVVAISCMLLVSGTTAFTAWIMSPIVNQIFYERRGDLVVWICAGIMGAFLVRGFAGYGQAVALATIGNNLVARYQKRIFDHLMKLGVGFFNDTRSGRLAAQVNENVGGIRDLLSITLTSITRDAVTLVGLVGIMIYQDPVLSLSSLLIGPPLIWAVVYLTRRVRRITRESVLINSRLIGAVQEATQGIAIVKAFTMEDQLASRIGALADTAEQRSNKIARVSERLAPISDMLAGLAVTSVIAYSGYRALVLGQPPGAVFSFITALILAYDPARRLARMQVGMERALVNARMIYELLDLKPQQGDAPDAVEAQFTSGEVRFHNVSFRYVEETPVLQELSFVAAAGKMTAIVGASGAGKTTLVALLQRFYDVESGTIEVDGQDISKVTKQSLRGSIAYVSQSPYLFEGTIRDNIRYGRMSATDAEIERAAQQAAADGFIRQQPQGYDTPVGENGATLSGGQRQRVSIARAIVRQAPILLLDEATSALDNEAEARVQEALTHVMEGRTTIVIAHRLSTVVNADHIVVMEQGRVVEEGTHAALMADPHSVYARFHRVQGKKGLGLVDDSKPIQTPVRATRAKKTAVRST

SEQ ID NO: 12081 - protein, 273 aa, Mesorhizobium loti
MSEAGDMGLVVVGAAGRMGQTLIRAIHTIPGARVIGAVERADSPHLGKDAGELAGIGIINVPIGDDPLPVFAKADGVLDFTTPASSVEFAGYAAQARIVHVIGTTGCSADDNARIAAAARHATIVKSGNMSLGVNLLAVLVEQAARALDADDFDIEILEMHHKHKVDAPSGTALLLGEAAAAGRGIALAGNDVRSRDGHTGVRKTGSIGFATLRGGSVVGDHSVILAGTGERITLSHHAEDRAIFARGAVKAALWARGKKPGLYSMRDVLGLS

SEQ ID NO: 12082 - protein, 206 aa, Mesorhizobium loti
MSRTLVLVRHGQSEWNLKNLFTGWRDVDLTEQGHAEAKAAGQKLKARGLKFDIAFTSALSRAQKTCQHILDAVGQSDLKTIRDQALNERDYGDLSGLNKDDARKKWGEEQVHVWRRSYDVSPPGGESLKDTGARVWPYYLHDLQPHVLRGGTVLVAAHGNSLRALIMALDGKSGEEIVKLELGTGVPVIYQLNADSTVASKEVLEG

SEQ ID NO: 12083 - protein, 517 aa, Mesorhizobium loti
MPRRWRCRARRPAASSRRLDGSPVMDIAQETVGTEETLDPADWAAVQALSHQVIDDAVDYLSDIRDRPAWREMPAEVREAFAAPLPRSPVPLAAVYDEVSRTVMSYPMGNIHPRFWAWYMGSSNFTGALGDFLAAIQGSNLGGGNHAAGLMDSQVVNWCKQMLGFPASASGTLVSGGSMANVIGLTVARNAKAGIDVREHGVAAIEKPLRFYGSDQIHSCHRKAMEALGLGNRALRRIPTDADLRIDIPALRAAIVEDREAGFKPACVIGNAGTVNTGAIDDLRALAKLAHEEGLWFHVDGCIGALIAIAPDNAHRVAGIEWADSVALDPHKWLHAPFEVGCALVRDAVAHRRTFAVTPEYLESTPRGLASGEWLHDYGLQTSRGFRALKVWMALKEHGVDKFGRLIDQNIAQASYLAGVVEAEPLMELATSPTINIVCFRYQPGVTGEALKVLNTEIMLRLQEQGIAVLSDTTVHGEHWLRVAIANHRTRREDLDLLVEETVRLGREIAAEGSPRK

SEQ ID NO: 12084 - protein, 175 aa, Mesorhizobium loti
MNILIVYGTTEGQTGKIAARTATHLRERGHQVELRDSAALASDLKLGHFDAFVIAASVHQEHHQETVTNFVFAHHEALSTKPSALISVSLSAALGDQKKDAQKYVDRFVSVTDWQPSMTLLLGGALRFNKYDYFQEQFVKFVVMKSGDPSPERDHEFTDWNALANFADRFLETAG

SEQ ID NO: 12085 - protein, 254 aa, Mesorhizobium loti
MPSADFADLKGASVLITGGGSGIGAALTEGFVRQGANVAFIDIAEGPSTLLADRIEKEFGRRPLYLKTDLRDIEALRASAARAAEAHGDVTVLINNAAWDERHAVEDVTVEFWDNNQAINLRPHFFTAQAVAPGMKRAGGGSIINFTSTSYLINHPDMPAYTAAKAGILGLTKGLAGKLGPDRIRVNAVAPGWVITERQQERWVTEGALAAHVAKQCIKEVMRPDDMVGTVLFLASDASRMLTAQMLIVDGGFL

SEQ ID NO: 12086 - protein, 290 aa, Mesorhizobium loti
MSAVSIFSDHICQLGEGPSYDPASDALFWFDIVNGQLLEKPLTGALKIHELGQMASAIAIIDDQRQLIATETGLFVRDVATGTMTLHTPIEADNPLTRSNDSRVHPCGAFWVGTMAKDESKGAGSIYWFSRGELRRLFSDITVSNSICFSEDGAIAYYTDTATGLLMRVGCDPVTGLPVGEPKVFVDHRSSKGYVDGSVVDRDGVLWNAVWGGKAVKAYSPDGTLLREIPMPVTQASCPAFVGAKADRLAVTSAWKGKDDKQRKLDPQAGMTFLIDIPVNGRFEPRVLIA

SEQ ID NO: 12087 - protein, 376 aa, Mesorhizobium loti
MKADFYETLGVQKGADEKELKSAFRKLAMQFHPDRNPGDHSCEHKFKEINEAYETLKDPQKRAAYDRFGHAAFEQGGMNGGAQGFGAGGFADIFEDIFGDMMGGRQRRSSGGRERGADLRYNMEISLEEAFAGKTAQIRVPASISCTECSGSGAKPGTQPVTCSMCHGHGKVRATQGFFSIERTCPQCQGRGQTIKDPCPKCAGQGRVTEERSLSVNIPAGIEDGTRIRLANEGEAGLRGGPSGDLYIFLAVKPHEFFQRDGADLYCKVPISMTTAALGGSFEVTTLDGTQTKVKVPEGTQNGRQFRLKGKGMPVLRQPNVGDLYIQTAVETPQNLSRRQRELLEEFEQLSSQDNSPQSSGFFARMKDFFESFGER

SEQ ID NO: 12088 - protein, 638 aa, Mesorhizobium loti
MAKVIGIDLGTTNSCIAIMDGKEPKVIENAEGARTTPSIVAISGDGERLVGQPAKRQAVTNPENTIFAVKRLIGRRYDDPVTEKDKKLVPYKIVKGDNGDAWVEAGGKKQSPSQISAMILQKMKETAEAYLGEKVEKAVITVPAYFNDAQRQATKDAGKIAGLEVLRIINEPTAAALAYGLDKKDGKTIAVYDLGGGTFDISVLEIGDGVFEVKSTNGDTFLGGEDFDMRLVEYLAAEFKKEQGIDLKNDKLALQRLKEAAEKAKIELSSTTQTEINLPFITADATGPKHLTLKLTRAKFESLVEDLVQRTIDPCKAALKDAGLKAGEIDEVVLVGGMTRMPKIQEIVKQFFGKEPHKGVNPDEVVALGAAIQAGVLQGDVKDVLLLDVTPLSLGIETLGGVFTRLIERNTTIPTKKSQVFSTAEDSQSAVTIRVFQGEREMAADNKALGQFDLVGIPPAPRGVPQIEVTFDIDANGIVNVSAKDKGTGKEHQIRIQASGGLSDADIEKMVKDAEANAETDKKRRAVVEARNQAEALVHSSEKSLKEYGDKVSEAERTAISDAIAALKTAAEGDDAADIEAKSQALAEASMKLGQAMYEASQKEAAEADAKADAAKDSDVVDADFEEIDEDDDKKKSA

SEQ ID NO: 12089 - protein, 504 aa, Mesorhizobium loti
MSNHLFDAFRSRMPAPGHLLMETDDGRSLSYGDMLARSAQFAHALLQLDVEPGDRVAVQVEKSPEALLLYLACVRAGAVFLPLNTAYTLTELGYFFGDAAPRVIVCDPARAADIGRMVEPSGAVVVTLDRNGRGSLADQASRLPSDFHDVARGPDDLAAILYTSGTTGRSKGAMLSHENLASNARVLVEQWRFTSGDVLIHALPIFHTHGLFVATNVVLMAGAAMLFEQKFDPARIVALLPRGTALMGVPTFYVRLLQQDGLDRQAAKTIRLFVSGSAPLLADTHKAWRERTGHAILERYGMTETNMNTSNPYEGERRAGTVGFPLPGVALRIADPDTGKPLAQGEVGMIEVKGPNVFGGYWRMPEKTKAEFRADGFFITGDLGMVDTDGYVHIVGRGKDLIISGGYNIYPKELESEIDALDGVSESAVIGVAHPDFGEGVTAVVVRAPGAAITGAEVLGAIAGRLARYKHPKQVIFVDELPRNTMGKVQKNLLRDAYKDLYTS

SEQ ID NO: 12090 - protein, 344 aa, Mesorhizobium loti
MISNTTHMQREIEEIPKAVARLLDGSGAALAEAGRGIKERDPHFVVTVARGSSDHAATFMKYAVELTAGLAVASVGPSIASIYGRKLRLDGSACLAISQSGKSPDIVAMAETARAGGALTIAITNTADSPLARASDYAIDILAGPERSVAATKTFVNSAVAGLALMAHSTGDEALLAALARLPEHFGKAIACDWMSVLAETIEKQKSLFILGRGPSAAMANEAALKFKETCGMHAEAYSAAEVMHGPLALIGPDFPVLALAARDASEPSITEAADGLAAKGAPVFVTSALANRATRLPHVATGHPLTDPLTLIVSFYVFVEAFARHRGLDPDTPRNLRKVTETV

SEQ ID NO: 12091 - protein, 243 aa, Mesorhizobium loti
MADLAGKVVVITAAAQGIGKASALAFAKTGATVHATDINETLLAELAKTPGIKTRKLDVLNDEAVNTTFAEIGRVDVLFNCAGFVHSGSILEMKDGDLDFAFNLNVRAMIRTIRAVLPGMLERGDGSIVNMSSVAGAGKGVPNRFAYGVTKAAVIGLTKAIAADYVGKGIRCNAICPGTVESPSLQDRMHAQGDYEAARAAFIARQPMGRLGTPEEIADLAVYLAGATYTSGQAYNIDGGWSI

SEQ ID NO: 12092 - protein, 781 aa, Mesorhizobium loti
MEYGPAPEARNEADAWLAARDFGKALFIDGAWKAASGGKTFDTSEPSSGKLLAKVSDASAADIDAAVAAATKALPKWSASSGYARAKVLYAIGRAMQRHQRLFAVLESIDNGKPIRESRDIDVPLAIRHFIHHAGWAQALDRDFPGHKGVGVVGQIIPWNFPLLMLAWKIAPALAAGCTVVLKPAEFTPLTAILFAEICERAGVPKGVVNIVQGGPEAGAAIVNHPGIQKIAFTGSSEVGKIIRKATAGSGKKLSLELGGKSAFIVFEDADLDSAVEGLVDGIWFNQGQVCCAGSRLLVQEGIAEALIAKVKTRMSRLRVGSPLDKNTDIGPLVDLTQLDRVKGLVAEGAKQGAVCWQPDAALPSSGYYHLPTLATGVSPANILAQEEVFGPVLATMTFRNTEEAIELANNTRYGLAASVWSENVNLALHVAPQLKAGVVWVNGTNMFDAACGFGGYRESGFGREGGREGMFEYLTAKLPLGPVIKPAAVSAQPVEQADGAAIDRTAKLFIGGKQVRPDGNYSLAVATAKGKLAGEVGFGNRKDIRDAVSAARACKGWPEATAYNRSQVLYYLAENLSGRAGEFAARLTELTGATPKAAREEVDQSIERLFLYAGLADKFEGRVHQPPARAVTLALHEPVGVVGIVAPDASPLLGLISLVAPALAMGNTVVAVPSERYPLLATDLYQVIEYSDVPAGAINIVTGRSAELAGVLAKHDDVDGLWVFADAETCARAEAESIGNLKRVWSGNGRSLDWASDEAAGDAFLRRAVEVKNVWVPYGD

SEQ ID NO: 12093 - protein, 297 aa, Mesorhizobium loti
MTDIAATAEMQAALLSRALPYMQRYEHKTVVVKYGGHAMGDIELGKAFARDIALLKQSGVNPIVVHGGGPQIGAMLTKMGIESKFEGGLRVTDQKTVEIVEMVLAGSINKEIVALINAEGEWAIGLCGKDGNMVFAEKARKTMIDPDSNIERVLDLGFVGEPVEVDRTLLDLLARSEMIPVLAPVAPGRDGHTYNINADTFAGAIAGACKASRLLFLTDVPGVLDKNKKLIDELTVAEAKALIKDGTVSGGMIPKVETCIEAIERGVEGVVILNGKTPHAVLLELFTEHGAGTLIVP

SEQ ID NO: 12094 - protein, 278 aa, Mesorhizobium loti
MNDAPPFDLDAYLARIGYTGPRNASLDTLKALHFAHPQAIPFENIDPFLGRPVRLDLAALQDKIVLGGRGGYCFEHNLLFMHALKALGFEVGGLAARVLWGQSEDAITARSHMLLRVELDGRTYIADVGFGGLTLTAPLLLEPGREQKTPHEPFRIVEADDHFRLQAAIGGDWRSLYRFDLQPQYEVDYSVTNYFLSTSPTSHFLSSVIAARAAPDRRYALRGNRLSIHHLGGRTEQTEIATAADLADTLQGLLGIIIPDRTAFEAKVRETKIVETNA

SEQ ID NO: 12095 - protein, 331 aa, Mesorhizobium loti
MFDPKFRKVADKIFSKSGTRLAPYSGIPTFLAAPYREIAAENPNFGDLQVAIIGVPMDLGVTNRPGSRFGPRALRAIERIGPYNHVLECAPTHELRVADIGDTPFRSRYRLETSHEDIERRTNQIVDAGVIPLSVGGDHSISHPILKAVGKKAPVGLIHIDAHCDTSGLFDMTKFHHGGPFRNAVLDGVLDPTRTIQIGIRGSAEYLWEFTYESGMTVVHAEEVTGLGIPAIIEKARKIVGDGPTYVSFDIDSVDPAFAPGTGTPEVGGLTTREVLELLRGLKGLNIVGGDVVEVAPQYDATTNTAHAGAQVLFEILSLMVFSPAITGKGA

SEQ ID NO: 12096 - protein, 528 aa, Mesorhizobium loti
MTKQFVCAVDVGTGSARAGILDASGTLLGRADRPIAMNQPKPDHAEHDSRDIWSAVCAAVRAAREKAGVAAQDIVGISFDATCSLVVRDRQGDQLSVSTTGDKRWDTIVWLDHRAISEADECTASSHEVLNYIGGVMSPEMATPKLMWLKRNLPQTWNEAGYLFDLADFLTWQASGSLARSQCTLTAKWTYLAHEESAWQRDFFEIVGLDDLFEHGNLPERASPVGADIGPLTAQAAAELGLTESCRVGAGVIDAYAGALGVLGGFAGDEQDIGRHLALIAGTSSCVMAMSPDPQPFAGVWGPYYGAALPKLWLSEGGQSATGALLDHIIRWHGAGGEPDAAMHAKIARRVAELRAAEGDNLAARLHVLPDFHGNRSPLADPHAVGVVSGLTLDSSFDSLCKLYWRTAVGIALGVRHVLEALNENGYLIDTLHVTGGHTKNPLLMELYADATGCTVVEPLADEAVLLGTGMVAATAAGLFPDLNAACLAMQQGGKRRAANPAAGARFDRDYRIFLEMHRQRQALDDIR

SEQ ID NO: 12097 - protein, 256 aa, Mesorhizobium loti
MRLKGKSALITGSARGIGKAFAEAYAREGAIVAIADINLEAAQKTAADIGDKAYAVKLDVTDQASIDAAVKAVETRTGGLDILINNAALFDLAPIVEISRASYEKLFSVNVAGTLFMLQAAARSMIARGKGGRIINMASQAGRRGEPLVGVYCATKAAVISLTQSAGLDLIKHRINVNGIAPGVVDSDMWDQVDALFAKYENRPKGEKKRLVGEGVPYGRMGKPEDLAGMAVFLASDEAEYIVAQTYNVDGGQWMS

SEQ ID NO: 12098 - protein, 402 aa, Mesorhizobium loti
MLKRVVITGIGGLCGLGVDAQSIWAEMRAGRSAIGPIDNPFLHDLKVKTGCEIKALPDHGIERKQLVSMDRFSLLAVIAAKEAMRQSGLAPHADNTYRMGTIVGVGVCGFETVEENYRAILVEGKNRAGIFTVPRVMPGAAAGQVSMHLGLRGPVFGVTSACSSANHAIASAADQIRLGRADVMVAGGTEAPLVWGVLKGWEALRVLSPDTCRPFSADRQGLVLGEGAGMAVLESYDHAVARGATILAEIAGAGLSADASDIVAPTIEGPEAAMRFCLVDAGLNPEDIDYLNAHGTGTKANDQIETNAIKRVFGDYARSLSISSTKSMHAHCLGASGGLEMIACVMAIREGVVPPTANYREPDPDCDLDVTPNVARERKVRVAISNGFAFGGTNAVLAFKAI

SEQ ID NO: 12099 - protein, 234 aa, Mesorhizobium loti
MADLSAFPITTRWPAKYPDQIQLYSATTPNGVKISIALEEVGLPYEPHLVNISKDESWTPEFLSLNPNGKIPAIIDPNGPDGKPIGLFESGAILLYLADKTGLLVPADAARRYETIQWVFFQMASVGPMFGQVGFFHKFAGREIADKRPLERYRDESRRLIGVLDGRLKGRKWIMGNDYTIADISLLGWVRNLIGFYEARELVGFDDFANVAAWLERGLARPAVQKGLTIPAKG

SEQ ID NO: 12100 - protein, 363 aa, Mesorhizobium loti
MLTTTDDLRVKEIRELSTPDQVMREIPRTLTATRTVSASRNAIHAILNGTDDRLLVVVGPCSIHDPVAAVDYASRLAALRETLSDRLEIVMRVYFEKPRTTVGWKGLINDPDLDGSFNIDKGLRMARNVLSAVNNLGLPAATEFLDMTTPQYIADLVAWGAIGARTTESQIHRELASGLSCPVGFKNGTDGNLRIAGEAVKSAAQPHHFMAVTKGGRSGIATTTGNEDCHVILRGGVQPNYDAASVEAASVELARIGVAPRLMIDVSHANSAKKPENQPKVAADVAGQVAAGDERIIGLMIESNLVAGRQDVVPGKPLVYGQSITDGCIDWATTETVLHGLAGAVEWRRSARRAMLESRQGAA

SEQ ID NO: 12101 - protein, 264 aa, Mesorhizobium loti
MSASSDRNHETRAIVTGGAQGIGFAVAEALADEGCRALALIGRSQEKGDKAVAHFKKAGVDAIFISADVSKVADCKRAVATALAHFGTLNALVNAAATSARGSLVETSEELFDQIFATNVRGPFFLMQGLVAHLLERKAPGSIVNVLSMSAHCGQSFLTPYSTSKGALMTLTKNVANAYRFDRIRCNAVLPGWMDTEGEDIVQKKWHDAPDDWLAKAEAAQPMGQLVKPDQLARLISYMVSPQSGVMTGSLVDYDQSVAGSSPE

SEQ ID NO: 12102 - protein, 199 aa, Mesorhizobium loti
MAPRSAEASRKTKETDISVSVHVDGSGKSDIATGVGFFDHMLDQLSRHSLIDMTVRAKGDLHIDDHHTVEDTGIALGQALTKALGERRGIMRYASIDLAMDETLTRAAIDVSGRPFLVWNVSFSSPKIGTFDTELVREFFQALAQNAGITLHVTNHYGANNHHIAETCFKAVARALRAALEPDPRQPDAVPSTKGSLKG

SEQ ID NO: 12103 - protein, 278 aa, Mesorhizobium loti
MKITIILASYDSGHYHGGMGQGPDALIAGGLVDALTIAGHEVAVADIGRVGDDQEREIATGFAVCNAVSGEVRIAIDRGRFPIVLAGNCLTSAGAVAGEGADAIIWADQHGDLNTPETSVYGFLDGMALATVLGLCWRPMAGAIPGFKPIDPSRCVLVNARDLDPAEEELLKTLPVIRTECPGIGPATAKLKAVGAKSVHMHLDLDVHDPKELQANRYVTSGGPSPGQLRDAACAMALAVPVVGITVSAYDPAFDARGDVPPLVGELLNDLIATIEGR

SEQ ID NO: 12104 - protein, 263 aa, Mesorhizobium loti
MLKARVIPCLDVKDGRVVKGVNFVDLIDAGDPVEAAKAYDAAGADELCFLDITASSDNRETIFDVIARTAEQCFMPLTVGGGVRQVADIRKLLLAGADKVSINTAAVKNPDFVAEAADKFGNQCIVVAIDAKKVSGAGEADRWEIFTHGGREKTGIDAVEFARKMVDRGAGEILLTSMDRDGTKAGYDIALTRAIADAVRAPIIASGGVGTLDHLVEGIRDGHAGAVLAASIFHFGTYTIAQAKAHMAAAGLPMRLDSSGDRP

SEQ ID NO: 12105 - protein, 107 aa, Mesorhizobium loti
MAEFSFSDLEAIIRDRAHSGDPDSWTAKLFARGIDKAAQKLGEEAVETAIAAVKGDRQGLVSESADLIYHWLVVLGLSGVPLSDVLKELESRTGRSGIAEKASRPKG

SEQ ID NO: 12106 - protein, 484 aa, Mesorhizobium loti
MYLGLDLGTSGVKALLIDAGQTVVGSGHGSLDVSRPHPGWSEQDPSHWIRACEDAIAELKASHPRQFAAVKGIGLSGQMHGATLLDAADHVLRPCILWNDTRSHVEAAVLDADPRFRKLTGNIVFPGFTAPKLAWVKNNEPAVFAKVAKVLLPKDFLRLWLTGEHISEMSDSAGTSWLDVGKRRWSAELLAATSLDEKQMPSLVEGTEKAGGLRAELASKWGVEAGIPVAGGAGDNAASACGMGTVGAGHAFVSLGTSGVLFAANASYLPNPASAVHTFCHALPDTWHQMGVILSATDSLNWLSEITGKGAGELTAELGDTLKAPTGVSFLPYLSGERTPHNDSAIRGSFTGLAHESSRAVLTQAVLEGVAFAFRDSLEALKTAGTTLTRVTAIGGGSRSRYWLKSIATALQVPVDIPADGDFGAAFGAARLGLIAATGADPLAVCSAPRTDATIEPDAKLGGAYADAYHRYRALYPAIRGATA

SEQ ID NO: 12107 - protein, 387 aa, Mesorhizobium loti
MDFGLSEEQKLIVETTRAFVENELYPHEREVERTGVLRRELIEELKAKAIEAGLYAANMPADVGGAGLDTVTWLLYEKELGRANYALHWTCVARPSNILLAGTPEQREKYLFPCIRGEKWDCLAMTEPGAGSDLRGMKASAVQDGDDWVLNGTKHFISHADLADFAIVFMASGEEDSPRGKRKKITAFFVDKGTKGFTVRDGYRNVSHRGYTNAILEFDDCRLPASQVLGEVHKGFDVANSWLGATRLQVGATCLGRAERALGHAVEYAAQRQQFGQQIGKFQGVSFKLADMATELKAADLMVFEAGWKYDQGTVTDQDMAMAKLKATEMLAFVADEAIQIHGGMGLMDDLPLERIWRDARVERIWEGTSEIQRHIISRALLRPFGA

SEQ ID NO: 12108 - protein, 312 aa, Mesorhizobium loti
MTDYTKLIDAETWAFIERTNSYYPPDTIDYTITQQREIYDRMCREFFAGYPQGVTVETSAIATPTHDIPIRIYRSAPQPAATVLCIHGGGFMLGGLDSHDDVCAELCARTGYEVVSVDYRLAPEHLHPAAFDDAMTAFAWVASTRDRPILLCGDSAGGNLCAAVSHATRGHVKRPVGQVLIYPGLGGDRSKDSYVTHAEAPMLTMRDLEFYKHIRTGGQDRSGDATLAPLADTDFANLPPTVLVTAQCDPLSSDGETYRDRIIAAGGRATWFEEPGLVHGYLRARHTVGRARESFTRIVGAAAALGQGAWLW

SEQ ID NO: 12109 - protein, 219 aa, Mesorhizobium loti
MALDIKICGLKTDQAMAAALGGGASHVGFIFFAKSPRYVEPAEAGRLREAARGKAVAVAVTVDATDAFLDEIVSAMQPDMLQLHGSEHPERVAELKARYGLPVMKALPLSEAADLDRIRPFIGIADRFLFDAKPPKGSELPGGNGVAFDWRILAGLDAGVDYMLSGGLNAANIGDALRLANPPGIDISSGVESAPGVKDPALIEQFFRAVRAARDDRAA

SEQ ID NO: 12110 - protein, 466 aa, Mesorhizobium loti
MTGSKDYVVADISLAGWGRKELDIAETEMPGLMACREEFGAKKPLKGARITGSLHMTIQTAVLIETLKALGADIRWASCNIFSTQDHAAAAIAEAGIPVFAVKGESLEQYWDYTDRIFQWADGGLSNMILDDGGDATMYILIGARAEAGEDVLSNPQSEEEEYFYAQVKKRLKASPGFFTKQKAAIRGVTEETTTGVNRLYQLQKKGLLPFPAINVNDSVTKSKFDNKYGCKESLVDGIRRGTDTMMAGKVAVVCGYGDVGKGSSASLKGAGARVKVTEVDPICALQAAMDGFEVVTLEDAAPTADIVITTTGNKDVVTLDHMRSMKDMVIVGNIGHFDNEIQVASLRNLKWTNVKPQVDMITFPDGKRMILLSEGRLLNLGNATGHPSFVMSASFTNQVLAQIELFTKGEQYQNQVYVLPKHLDEKVARLHLDKLGARLTELSGEQAAYIGVTPQGPFKPEHYRY

SEQ ID NO: 12111 - protein, 536 aa, Mesorhizobium loti
MSEVGKRNPACPIDRIGLKTTGMVRYNFGAAALYEEAIRRGEARLTAHGALVAETGQHTGRSPKDKFVVRDAATEPEVWWDNNKAISPAQFETLFADFLAHAANKDLYVQDLVGGADAELKLPTRVITEFAWHSLFIRNLLIRPDKAELGQFVPEMTIIDLPSFRADPARHGSRTETVIAVDLTRQIVLIGGTSYAGEMKKSVFTMLNYILPQKGVMPMHCSANEGPAGDAAVFFGLSGTGKTTLSADPSRTLIGDDEHGWGPHGIFNFEGGCYAKTIKLSAEAEPEIFATTQRFGTVLENVVLDADGVPDFNDGRLTENTRCAYPLDFIPNASKTGRASHPKNIIMLTADAFGVMPPIARLTPAQAMYHFLSGYTAKVAGTEKGVTEPEATFSTCFGAPFMPRHPSEYGNLLRELIASHGADCWLVNTGWTGGAYGTGKRMPIKATRALLTAALDGSLKTGEFRTDANFGFEVPVAVPGVDSAILDPRSTWADKPAYDRQAARLVGMFAVNFEKFEPHVDATVMGAAPRMQEAAE

SEQ ID NO: 12112 - protein, 554 aa, Mesorhizobium loti
MQSALKASSNPDLAIDRDWWRGAVIYQIYPRSYQDSNGDGIGDLKGIIERLPYIAALGADAIWISPFFKSPMKDFGYDVSDYCDVDPMFGTLADFDALTAEAHRLGLKVMIDEVLSHTADIHPWFKESRSSRSNPKADWYVWADARPDGTPPNNWLSIFGGSAWQWDTSRQQYYLHNFLAEQPDLNFHNREVQDALLDVTRFWLERGVDGFRLDTINFYFHSQGLENNPPLPPEERNDQTAPAVNPYNYQDHLYDKSRPENLGFLERFRALLDEYPATAAVGEVGDSQRGLEVVAAYTAGGKRVHMCYSFDFLAPEKISAAKVRSVLEAFGKVASDGWSCWAFSNHDVMRPASRWAAGEADPVAYLKVISALLMSLRGSVCIYQGEELGLGEAELRFEDLQDPYGIRFWPEFKGRDGCRTPMVWDGDAKNGGFSQAKPWLPVPAKHLAQAVNVQQGDQASLLEHYRRFLSFRRAHPALAKGDITFIESEGDTVAFTRRAGNEQVVCVFNLGAKPAKVDLGSRSLQPLPGHGFSGQARPGSIELGGYGAWFGRID

SEQ ID NO: 12113 - protein, 460 aa, Mesorhizobium loti
MHNSDSSKTPIGGISRDRIAQLRETEGAAFRKARPKSQAKVGNGLPGFFGGVPMHWMNDWPTPFPILVDSAKGAAITDIDGNRLDDFCLGDTGSMFGHSPPPVARAIRRQAGRGLTYMLPSEDALAIGPLLQQRFGLPFWQIATTATDANRFSLRVARAVTGREKILVFNGCYHGSVDETMVRLIGGKPVNRPGLAGEFRDLTRTAKVIEFNDVAALEAALKDRDVACVIAEPVLTNSCMVLADPGFHDALRRLTRETGTLLLIDETHTISTGPGGYTRKYGLEPDFFVLGKPIAGGVPASVWGMSDEVASRYADYNRTKEPGYSGMGTTLSANPLQFAAMRATLEEVMTAENYDRMDHLAERLDAGLTGVIDRYRLPWHVARVGARVEFICAPGPLRNGAEAETAHAPELEAAIHVALVNRGVLIAPFHNMMLISPATSGAQVNRLIAAFGAVAAKLAA

SEQ ID NO: 12114 - protein, 289 aa, Mesorhizobium loti
MTPGHEFSGIVEAIGKAVSGFAVGDRVTGDPNIACGRCPHCHAGRVNLCRNLNAIGIHRDGGFAEYVVLPQKQAFILPADLPPTHGAFCEPLGCCLHGVDLAQIKPGSSVVVLGGGVIGLLTVQLAKLAGATTIILSTRQASRRVLAEELGATATVDPTAGDVIDAIAGSEGLMPGGADVVFECAGVRDTVEQSMRLARAGGTVVIVGVTPQGMKAEFEPFDLLFRELKVVGSFLNPYTHRRAAELIASGAIEIDRLISRQVPLEEAADVIANPPAPGEVKVLVVPRQG

SEQ ID NO: 12115 - protein, 333 aa, Mesorhizobium loti
MQLSLDQARGLCRMAALGAGANEEAAQSLTASIIAAEAEGLSTVGLSHFIDYLEALEAGRIDGNADPVITRPALAVYLSDARGGLAHTGFDRTIDDLAKAAKLFGVAIFSQKNAYTCGALGYFTGRLAAQGLVSFAATNGPAVLAGSGSVKPVYCTNPMSFAAPAADGAPLVIDQSSSATAFVNIRKAAEDGKKIPEGWALDASGNPTTDPAAAMKGAMLAFGGQRGANIALMVEVLAAGISGANWSLDAPWFTGGPDSPGTGLFVLAIEPKLLDPDFEQRMKDQLDRLRRRFGVHVPGRARAEAAEKAQARGITAPKAVVQRISEFAERYST

SEQ ID NO: 12116 - protein, 452 aa, Mesorhizobium loti
MSHAAAAKPATARKSQALSGTARVPGDKSISHRSFMFGGLASGETRITGLLEGEDVMRTGAAMKAMGAHIEKRGAEWVIRGTGNGALLQPEGPLDFGNAGTGSRLTMGLVGTYDMETTFIGDASLSGRPMGRVLEPLRQMGVQVLKATPGDRMPITLHGPKHAAPITYRVPMASAQVKSAVLLAGLNTPGITTVIEPVMTRDHTEKMLKGFGANLSVETDERGVRHIFIEGQGRLTGQTIAVPGDPSSAGFPLVAALIVPGSDITIENVLMNPTRTGLLLTLQEMGGQIDILNPRNAGGEDVADLRVRYSELKGVAVPPERAPSMIDEYPVLAVAASFAEGETLMQGLEELRVKESDRLSAVANGLKLNGVDCTEGEASLAVRGRPGGKGLGGHPNGLDTTVQTHLDHRIAMSFLVMGLATEKPVTIDDQAMIATSFPEFMGLMTGLGAEIR

SEQ ID NO: 12117 - protein, 268 aa, Mesorhizobium loti
MPDNDVILAVDTIHATYNHAITALHGVSFEIRRGEILALLGANGAGKTTTLKAVSNLLPAERGQVNAGTICYDGADVSRRKPGDLVRAGLVPVLEGRHCFKSLTVEENLVAGGIGRSGRRAEINQDLERIYAYFPRLKEKRRTLSGLTSGGEQQMTAIGRALMSRPRLLVLDEPSMGLAPLIVQDIFQTLRKLNRETGLSILVAEQNSAVALRYADHATVLENGVSVLSGAAADLRQREDVRAFYLGQSTTGQQPSPAAKPAHLHAVA

SEQ ID NO: 12118 - protein, 415 aa, Mesorhizobium loti
MTVSTVKTDHASAAVPPVARPAVPAHIIRDDAEAIAIAHALAAEFVKESSRRDRERVWPVAELDAFSQSGLWSINVPKAFGGPEVSYATLAKVIEIISAADSSIGQIAQNHLGVVAAIRTVSDADQQKLLFAEVLNGTRFGNAFSEFGSKRAADFETRFTDAGDHVVVNGRKFYSSGALLAHLVPIVALDDEGRAWYAIADRGAPGLTVIDDWSSFGQRTTLSGTVIIDNVKVPKTFLVPGYKGYDRPTADGAIFQIIQVAVDTGIAQAAIDETVHFVRTRSRAWIDSGVDNAWDDPYTIQAVGDLTLRLHAAQALLEKAGLAIDKAVAEPTAETVAHAQIVTAEAKILSTEIAIAATNKLFELAGTRSTLAEHNLDRHWRNARTHTLHDPVRWKYSILGKYFLNGENPPLHAWS

SEQ ID NO: 12119 - protein, 479 aa, Mesorhizobium loti
MAQFRKNLIDGEWVGDAGSHNINPSDTGDVVGEYASAGVEQAKQAIAAAKAAFPSWSRSGPLARHAVLKKASDEIMARKDEIGRNLAREEGKTLAEGIGETIRAAQIFDFFAGETLRLTGEMVPSVRPGVGVEITREAVGVVGIITPWNFPIAIPAWKIAPALAHGNTIVFKPAELVPESAWSIVDILHRAGLPKGVLNLVMGKGSVVGQAMLDSPDINAITFTGSVGTGKRVAAASVEHMRKFQLEMGGKNPLVVLDDADLAVAVDCALNGAFFSTGQRCTASSRLIVTEDIHDRFVEALKERMGKLVIGDALDAQTQIGPVVDATQLKQDEDYIAIGVREGATLAFGGERLDRKTPGFYLSPALLTEATNAMRSSREEIFGPVASVIRVKNYDEALSVANDTPFGLTSGICTTSLKHATHFKRNSEAGMVMVNLPTAGVDFHVPFGGRKGSSYGPREQGRYATEFYTTVKTAYTFAG

SEQ ID NO: 12120 - protein, 509 aa, Mesorhizobium loti
MAREQTKAATFPVDRNDVELVRGAHPPRWKNPTPDGPYNLVVIGAGPAGLTAARDAASLGAKVALIERGLIGGACVNVGGVPSKSIIRTARLYADMRDAENFGGDTPARLPVDFERAMMRMRQIRQRLSRADSAAAITAEGIDLYFGEARFGGPDTVEVAGKTLHFKKALVATGAHPSGPAIPGLAEAGYLDNESMFNLTRRPERLLVIGGGPLGCETAQAFCLLGAKVILAQSDPMFLPGEERDAAQILSDTLAREGVEVRLNTEVVAVRKEGGRKLADLLRDGDTTTISVDEIITGVGRSPNVRGLGLEEAGVVYDANGIKVDDHLRTTNPHIYAAGDVCLEYKFTHTAEAAARIVVRNALFRGRERLSDLVVPWCTYTDPEIAHVGLYPIEARQNGIPVKTYTVLMHDVARAVMDGEEEGFVKIHVREGSDRILGATVVASHAGEMINAVTLAIRSGMGLHALADVIHAFPTQAQGIKMAGDAYRRTRFTSLRRRLAARWLAWSRR

SEQ ID NO: 12121 - protein, 249 aa, Mesorhizobium loti
MPNFAGRFAGRSAVITGGASGIGLAVAQRIVEEGGRISVWDRDPAQIEQAKTVIPGLHGVAIDVADAAGVEGAAARTIEALGGVDILVTSAAITGPNMTTWAYSTEDWQKVIDININGVFYCNRALVPHMLERNYGRIVNIASIAGKEGNPNASAYSTSKAAVIGLTKSLGKELAKTKVTVNCVTPAAVRTAIFKQMSQEHIDFMLSKIPMARFGEVEEVAALICWIASEECSFTTAAVFDVSGGRATY

SEQ ID NO: 12122 - protein, 275 aa, Mesorhizobium loti
MTNLAGRGAIVTGGFSGMGFAIASALAEAGANVAVGSYIAPAGTDRSDAAYYPGIDEIERVRSALSAHGTRVHAAHLDVRDSEVTNRFVAEAEAAIGPADILVNAAGTTTEQPVCGHSDALWDKIVDTNLTGAFRTTRAVLPGMIARGWGRIVNIGSTAASVGWKDNPAYCASKAGLLGLTRCVALEGAAHGVTCVMISPTWVETELMRRNVAQVVEREGKGRTAQQAMAEIAKGNPQQRMLQPQEIAALAVFLCSDLAKGITMENIQITGGALW

SEQ ID NO: 12123 - protein, 613 aa, Mesorhizobium loti
MSKSSILRLSLFRDVAAFGAVIAQIGGRRTWTALLFLILGSLTEGISILLLVPLLHLVGRADQDFAVRLPSNDFVRWLVPDGTLQLTTVLCALVGLVAVQAAFNRFKSVYMARLLFDFINRLRMNLFESIGKARWGVFSRMRSSDLDHALTGDIDRVQGAAFSLLMLVQIAVLLVGYLVISMFISPVMTAFAIVIGIMMFIALQPFRARATAFGRVLTSNRQDQYRTVSEFLGGIKVAKSLNVEASYFAQLQSTLEKMKADNIDYVRNSSIGTAVFQVASVVGLSLFIYVALVRFNLSLAEIVVLLLVFMRIAPRFMDMQTQAQQVLINLPAYTAMRSLQARFDAEREPGHAQSEDMQKLSLDTGLNIRGVSFSYDDSGKAVVSDITFGLPAGKVTALIGPSGSGKSTIADMLLGLLEPTAGKILVDGVEIDAGNRRRWRDQVAYVPQDVFLLHDTIAANLRLAAPQASDDDLWTVLRAAHAGDFVERLDQRLETVVGDRGVRLSGGERQRIALARALLRKPSLLILDEATSALDWQNQSLIARSIDGLRGAMTILTIAHRPSMIAFADWVVAMEDGRIVEVGQYQRLKAKPASRLSRMLSGEQSETEPANVA

SEQ ID NO: 12124 - protein, 443 aa, Mesorhizobium loti
MNLTVFGIGYVGLVQAAVLAEVGHQVVCVDIDENKVERLNQGFVPIFEPGLESLVRENHAAGRIKFTTDAAAAVRHGEIQMIAVGTPPGEDGSADLKYVLAVAETIGREMDTAKIVVGKSTVPVGTCEKVKAKIAETLKKRGREDLSFDVASNPEFLKEGSAVADCMRPDRIIVGTSSEGTEAVMRELYAPFNRNHEKMIVMDVRSAEFTKYAANCMLATKISFMNEMANLAEQLGADIEEVRKGIGSDPRIGYHFIYPGLGYGGSCFPKDVRALIKTAEGVKFDAKLLRAVEERNNDQKSVLFDKVNRYFKGSLKGKTFALWGLAFKPNTDDMREAPARVLMEALWKAGATVQAYDPEAMQECQAIYGLRDDLLLCGTKEAALRGADALLIATEWKSFRAPSFDALKDALTTPVIFDGRNLYDPKVVARYGIEYHSIGRMAA

SEQ ID NO: 12125 - protein, 298 aa, Mesorhizobium loti
MKKIRKAVIPVAGLGTRFLPATKSMPKEMLPVVDRPVVQYAVDEAFEAGIEHIVFVTGRNKAVIEDYFDLHPELIGTLEQTGKKTQLEALESMLPVAGATSFIRQQSPQGLGHAVWCAREVIGNEPFALLLPDMVSFGGRGCLAETVDLYERTGGNVIAVERCDPSETNKYGIVGRGADIGGGFEVTAMVEKPAPANAPSNFYINGRYILQPEIFALLGNQQRGAGNEIQLTDAMVRLSKDQPFFAQPFLGRMFDCGSKEGFIQANIAFALARNDMKGPVFEMLQEFVRSHERQEEAA

SEQ ID NO: 12126 - protein, 244 aa, Mesorhizobium loti
MTRLNGKTAVITGGATGIGRAAATRFIEEGAFVFIYGRRQEALDAAVADLGANARAVKGSVSDLADLDRLYAAVKAERGTLDIVFANAGAGGPLPLGQITAEHIDETFDTNVKGTIFTVQQALPLMGPGGSIILTGSSAGTTGAPGFTAYSASKAAVRNLARTWAEDLKGTGIRVNVLSPGATATELAKEALGEEGQKAYGAMTPLQRMADPAEIGAVAAFLASSDSSFMTASEVAVDGGLAQL

SEQ ID NO: 12127 - protein, 250 aa, Mesorhizobium loti
MKKLEGKIAVITGGSSGIGLATAKRFVEEGAHVVITGRREKELKEAAAFIMRNVTTVVGDVSLLEDLDRLYAVVKEKHGHIDVLFANAGAGTIAPLAAATEAHFDQTFDVNVKGLFFTVQKALPLFKDGGSIILNSSVSNVLGLPGFSTYAASKAAVRNFSRAWTLELKDRKIRVNTMSPGAIETPALETTTGLTPEQAEQAVAQFASQIPMGRRGKPEEIAAAVTFLASDDSSYVTGVDLAVDGGMAQV

SEQ ID NO: 12128 - protein, 642 aa, Mesorhizobium loti
MVPGRLPMASRYHEVYDGWKRDPEKFWADAAGAIDWYSPWDKVFDADAGVYGRWFTGATCNTCYNAIDRHVARGRADQIALIHDSAITGTVKKFTYAELKREVVALTSVLKNRGIGKGDRVIIYMPMVAEAAIAMLACARIGAVHSVVFGGFASHELATRIDDAKPKLIISASCGLEPGRIVAYKPLLDKAIEMSGHKPDACLILQRDQLRCELKEHFDIDYADAVARERAAGANVDCVPVLATDPLYIIYTSGTTGQPKGIVRDNGGHMVALKWTMENEFGVKPGEVFWAASDVGWVVGHSYIVYGPLLHGSTSVLFEGKPIGTPDAGTYWRVISDHGVVALFTAPTAFRAIKGQDPKGEFVPRYDLSKFRTLFLAGERADPETIKWAEQKLNVPVIDHWWQTETGSPMTINPAGLGLLPVKYGSPGVPMPGYDIRVLDDAGHEVPRGTLGNVVVKLPLPAGCLPTLWNADARFRQAYLDEFPGFYKTADAGMIDEDGYLYVMARTDDIINVAGHRLSTGAMEEVLAAHPDVAECAVVGIADAMKGQIPLGFVVLNAGVARGGDVIEKEVVALVRERIGPVAAFKTVVTIKRLPKTRSGKILRGTMQKIADKEAWTMPATIDDPAILDEITAAMKARGIGI

SEQ ID NO: 12129 - protein, 527 aa, Mesorhizobium loti
MRAMRIEGVPASAGYAEGPLFDLDRPPAVYAGKATLAEEKTSLQAAIGTAVSRLSAMAEAADSDAAGILEFHIAMLEDDALRGPAFASITSGQTADVAWREALDAEIAGYEASDQDYFRARATDLRDIRDQVLRALTEDVDSAAPTGAILCGEDIAPTRFLETDWSHGGGIALKAGSTASHVAMLARSRGVPMVVGLREMSASPAGMALLDAEHGSIVLAPSPAEIGAFRQSSASFAARQGKAQRFLARPAVTKAGTAVRVQVNIADPSDVDGIDVATCDGVGLMRTEFLFGKNLPDEETQYRAYRKVLEWAGEKPVTIRTVDAGGDKPVPGFTVEEGNPFLGLRGIRLSLARLDIFRIQIRALLRAAPHGNLRVMFPMIAMADEYERAAALFAEEQAALAAGGVAQKMPPLGIMVEVPSVAIAPEAFAGVAFFSIGSNDLTQYVMAAARDNAAVAHFNSVRHPAVLRLIGSVAAFGRENGIPVSLCGDAGGDPAAIPSLLEAGLRDLSVAPAQLAMAKAAIADVSV

SEQ ID NO: 12130 - protein, 547 aa, Mesorhizobium loti
MKHFFNRRETIVTEALDGLLRTIGSGDLARLDGYPEIKVVLRADWDKSRVSVVSGGGAGHEPSHAGFVGKGMLTAAVSGEIFASPSVEAVLAAIRAVTGPAGCLLIVKNYTGDRLNFGLAAEKARAEGFRVEMVIVADDIALPDIAQPRGVAGTLFVHKISGHLSEAGHNLADIAAAARAAAKDIVSLGMSLSSCSIPGQPHEDRFGADDGELGLGIHGEPGVERIALQSVDRLVAIMAERLAAGLDPKASHALLINNLGAVPPLEMSLIANAVLASPLAKTVKLTIGPGPLMTALNMNGFSLSLIRLDAAREAALLAPVGPHAWMPAKPVAAPVIVPMAKAAGQSVAHKASQDASSRRLIVTVCEKLISLEASLNGLDAKAGDGDTGSTVATGARSILERLDVLPLANPAATLGAIGDILSSSMGGSSGVLLSIFFTAAAQVLGGGASLSKALLAGLERMTFYGGAKPGDRTMVDALEPALKALDADGLEEAAAAAQRGAEATAAMEKAKAGRSAYVGTKLQGVVDPGAHAVAEVFSAAATLLVTA

SEQ ID NO: 12131 - protein, 820 aa, Mesorhizobium loti
MTTRSLPELPVSAVLQALGAALAERNSAVLVAPPGAGKTTLVPLALLDAPWLGAGKIVLLEPRRLAARAAARRMAQLLDQEPGATIGYAMRMENRTSAKTRILVVTEGVLARMILDDPELPGISAVVFDEFHERSLDGDFGLALALDVQGALRPDLRLLVMSATLDGARVAKLLSGAPVIESEGRAFPVDISYDERPAGVPIEDAMAKAIRAALADEGGSVLAFLPGQREIERTAERLAGKVGADTDIVPLYGQLDGNAQDAAIKPAPPGRRKVVLATSIAETSITIDGVRVVIDSGLSRLPRYEPASGLTRLETVRVSKASADQRAGRAGRTQAGVAIRLWRAEQTAALPAFTPPEILEADLSGLLLDCAAFGVADPTGLAFLDPPPAPALNEARVLLRALHAIDEAGRLTQAGASMRKLALPVRLAHMVAEATKSGHAGEAAMLAVLLTERGLGGDGADLERRLMRFRGERSPRATAARQLAERLARQVGGTKNSEAAPAGSLLINAWPDRVAKARGERGRFVLANGSGAMLDAADPLAGEPFLVVADLQGKAQNARIAAAAAISEDDIRATLADRIETRRQTSFDRERRAVRVRETVRLGAITLAERMLPAPSGADADRAILDALREHGLSLLNWSKEAETLRQRLSWLHRGLGSPWPDMSDEALIERLDDWLLPFLSGAASLAAINPGVVSAGLASLVPHELQRKFDALAPTHFDTPSGSHVPIRYDGEWPVLAVRVQELFGLDRHPSIANGTVPLTLELLSPAHRPIQTTRDLPGFWRGSWADVRADMRGRYPKHVWPENPLLAAATARAKPRGT

SEQ ID NO: 12132 - protein, 281 aa, Mesorhizobium loti
MPSTVRTTTLPSGETVQVLGQGTWKMGEDSRRRADEVNALKLGLDLGLTLIDTAEMYASGGAEEVVAEAIAGRRAEVFVVSKVLPSNASHAGVQRACENSLKRLRTDRIDLYLLHWPGSVPLAETVEAFEAVKKAGKIRHWGVSNFDTEDMDDLAGLPDGSNVQTNQVLYNLVRRGPEFDLAPWSRKRGIPLMAYSPVEQGALARNTGLDAVAARHNATAAQIALAWVMHQDGIIAIPKASSQEHVRQNFAALDIKLTPQDITDLDRAFPPPTRKRGLEMI

SEQ ID NO: 12133 - protein, 909 aa, Mesorhizobium loti
MNMHSPNEPDAPEVMTTPQPGTAAVTPMMEQFIEIKAANPDSLLFYRMGDFYELFFDDAEKASRALGIVLTKRGKHQGHDIPMCGVPVHAADDYLQKLIGQGFRVAVCEQIEDPAEAKKRGSKSVVRRDVVRLVTPGTITEDKLLAPSESSFLMALGRVKGGSDHSFAIAWIDISTGAFRVAETTADRLLADIFRVDPRELIVAEPVFHDPELRPVFDVLGRVANPQPPSLFDSASATGRIARFFDVATPDSFGTFSRAELSAISGAIAYVEKTQKAERPPLSRPEREEQGSTLFIDPATRGNLELLRTLSGSREGSLFKAIDRTVTGGGARLLADRLMAPLTDPAAIGARLDSVSFFRTETRLCQAVRASLKSVADMPRALSRLALNRGGPRDLGALRAGFEAAGAIVEIFAATALPQELAEAMAAIRALPQALAQHLIQALGEELPLLKRDGGFLRGGYHPELDEMRALRDESRKVIAGLERSLIEETGIRSLKIRHNNVLGYYIEVTANHHAIMTGSDGAKARFIHRQTMANAMRFTTTELAELETKIANAADRALGIELAAFEALTAQAVGEAEKIRAGADALAAIDVSAALALLSESEAWCRPVVDSSLAFEISGGRHPVVEQALRRSGEGPFVANDCDLSPEGNAKNGAIWLLTGPNMGGKSTFLRQNALIAILAQTGSFVPATSAHIGVVDRLFSRVGASDDLARGRSTFMVEMVETAAILNQAGERALVILDEIGRGTATFDGLSIAWAAVEYLHEKNRCRAIFATHFHEMTSLAGKLARLHNVTMRVKEWEGDVVFLHEVGKGAADRSYGVQVARLAGLPEAVVDRAKQVLHQLEEGEVSGKTNRLVDDLPLFSVAMKREAPKPVKSDALGAALGDINPDEMTPREALEALYRLKGLAGK

SEQ ID NO: 12134 - protein, 343 aa, Mesorhizobium loti
MARSRLGFLAETLMPDYDVLCIGNAIVDIIAQCEEEFLETNGIIKGAMNLIDTHRAELLYSRMGPAIEASGGSAGNTAAGVASFGGRAAFFGKVSNDGLGEIYTHDIRAQGVAFDTTPLQGEPPTARSMIFVTPDGERSMNTYLGACVELGPEDVEADKASGAKVTYFEGYLWDPPRAKEAIRQTARLAHAAGREVSMTLSDSFCVDRYRDEFLDLMRSGTVDIVFANSHEIKSLYQTSSFDEALANIRKDCRIAAVTRSEKGSVIVRGDETVVIQATAIRELVDTTGAGDLYAAGFLHGYTQGRDLKTCGDLGSLAAGLVIQQIGPRPRQNLRREAEQAGLL

SEQ ID NO: 12135 - protein, 219 aa, Mesorhizobium loti
MQIPKLVIFDCDGILVDTENLANRRLAEWLTAAGYPTSFEYCRKNFSGRSMASVQKEIEETTEVRLGADFVERWNAGLPDLFSHGVEAIPYVREFVEAVRAAGIAYCVATSARISKMHITLGQTGLLPLFEHAMFSSTMVGRGKPFPDLFLHAAKTMGFAPADCIVIEDSVAGTQAGITAGMRVFSYHGDPHSDRDGLIEAGGILFDDMRELAGLVPIH

SEQ ID NO: 12136 - protein, 617 aa, Mesorhizobium loti
MTQRFLSRSRQWFHPATTPSISRLRQSAIKDQPLFRFFRSTENQRLVARLVRESFREHMFGYGAAILSMLVVAGMTAASAWILREITNEFVIDKRVDRVNMIAAAVAGIFVLKGLANFVQAYFMSRVGNAIIADRQRKIYDRILAQGIEFYHSTSSSDLITRMTNNAQAARNVLDLIVTSYVRDLVTLLALIGVMVWQQPVLSLICFVAGPVAIYGVNRILKRVRNFAAMEFRSVGQIVQVMQETAIGVRVVKSFNLESLMRKRMYKAVADVEDRANNIAALEAVTSPVMETLAGLAIAGAVMVSGLLVLQGGQMPGNIMAFIAALLLAYEPAKRLARVRISLESGIVGVRMMFQLADEPLTLAEKPDAKPLRAGPGEIRFDAISFAYQNGPPVLDRFDLTLEAGKMTALVGPSGGGKSTILNLIMRMYDPKSGKVLLDGQDISHATLASLREKIAYVSQDTFLFAGTIMHNIRLGRQDATDEEVIAAAKAANAHDFIMAQAKGYETDVGENGGLLSGGQRQRISIARAMLRNAEILLLDEATSALDAESEALFRDALQQLTDGRTTIVIAHRLSTVHQADTIVVLEGGKVVESGPHRALLTQGGLYQKLYEYQLMP

SEQ ID NO: 12137 - protein, 475 aa, Mesorhizobium loti
MDTQMLIGSKFENGAETEESILNPKTGATILNLPEASQAQIEAAVAAAEKAFVSWSRTTPAQRSGYLLKIADRIEAEAKEFAALEALNCGKPINSVLNDEIPAIVDCYRFFAGAVRSMPGVVAGEYLPGHTSMVRRDPIGIVASIAPWNYPLMMMAWKLAPAIGGGNTVVFKPSEQTPLTALRLARILAEILPEGVVNVVLGRGDSVGNALINHPKVNMISITGDVATGKKVLQAAAKSVKRTHLELGGKAPVIVFDDADLGAVVNGLRAFGYYNAGQDCTAACRIYAGKKIYDKLVADLSSAVSTIKYNQPDDTENEIGPLISRRQRDRVSSFVERASELKHIEITTGGRPGEGTGFYYQPTVVAGALQEDEIVRREVFGPVVSITRFTEVDEAVNWANDSDYGLASSVWTKDVSRAMATAARLQYGCTWINTHFMLTNEMPHGGLKQSGYGKDMSLYALEDYTAVRHVMVAHA

SEQ ID NO: 12138 - protein, 970 aa, Mesorhizobium loti
MNIKADFPSLVEEIDYGTPESRAQKQVTLNVDGRSITVPEGTSIMRAAMEGGVEIPKLCATDMLDSFGSCRVCLVEIEGRGGTPASCTTPVGEGMVVRTQSDRLDAIRRGVMELYVSDHPTGWNEKAGTGASEFDTVAKSVGLTENRYGVEGRNHVKQEDGVAPGHGSLAVDYIARDESNPYFTYDPAQCIVCSRCVRACEEVQGTFALTIEGRGFESRMVAGMHEDFIASECVSCGACVQACPTDALREKTVLEKGMPERSAVTTCAYCGVGCSFKAEVKDDEVIRMMPYKDGKANHGHSCVKGRFAYGYATHKDRILSPMIREKISDPWREVSWEEAIAHTAKEFRRIQYQYGRTSIGGITSSRCTNEETYLVQKLVRQGFRNNNVDTCARVCHSPTGYGLGQTYGTSAGTQDFDSVEFTDVAVVIGANPVSAHPVFASRLKKRLRQGAKLIVLDPRRTEMVKSAHIEADYHLPLKPGTNVAVLTSLAHVIVTEGLFDEAFIRERCDWTEFQDWASFVALPENSPETVGKLSGVDPDLIRGAARLYAKGGNGAIYYGLGVTEHSQGSTTVMAIANLAMATGNIGRPGVGVNPLRGQNNVQGSCDMGSFPHELPGYRHISGEAVRDIYESLWGVKLDDEPGLRIPNMLDAAVDGSFKGIYIQGEDILQSDPDTKHVAGGLAAMECVVVHDLFLNETANYAHVFLPGSTFLEKDGTFTNAERRINMVRKVLEPKARYADWEATQELARAIGLDWNYTHPSQIMDEIAQTTPSFANVSFELLDRVGSVQWPCNEKAPLGTPIMHIDGFVRGKGKFIRTEYVATDERTGPRFPLLLTTGRILSQYNVGAQTRRTDNVMWHSEDRLEIHPHDAENRGLRDGDWVRLTSRSGETTLRALITDRVSPGVVYTTFHHPDTQANVITTDFSDWATNCPEYKVTAVQVGASNGPSDWQREYDEQARNSRRIASLQAAE

SEQ ID NO: 12139 - protein, 547 aa, Mesorhizobium loti
MDKSAFQKQLAALRDHRSAAPASMRQAFAADPQRFQAFTATDGDLLLDWSKCAVDATTMDLLEKLAAAADLEGRRAAMFAGKKINITEDRAVLHTALRNLSGTGVTVDGQDVKADVLSVLDAMGAFADAIRSGKALGATGKKITDIVNIGIGGSDLGPAMATLALAPYHDGPRAHYVSNIDGAHIHDTLKGLSAETTLFIVASKTFTTVETMTNAQTARDWVQKALGKQAVGKHFAAVSTALDLVAKFGIEADRVFGFWDWVGGRYSVWGAIGLPVMIAVGPRNFRAFLDGAHEMDQHFRTAPLAGNLPALLGLVGWWHRVICGYPARAVIPYDQRLSRLPAYLQQLDMESNGKGVTLDGTPVATPTGPLVWGEPGTNGQHAFFQLLHQGTDFIPVEFLAAAVGHEPELKHQHDLLLANCLAQSEALMKGRTLDEARAQMLAKGMKPADVDKIAPHRVFSGNRPSLTILYRKLDPRTFGRLIALYEHRVFVEGTLFNINSFDQWGVELGKELATGLLPVVEGKESAANRDASTRGLVERIHQLRGSE

SEQ ID NO: 12140 - protein, 567 aa, Mesorhizobium loti
MPKALTELAAGLPEKPWLKSYPKNVQAEIGVLPYSSIGDFLVAACKQFSAQPAFTCMDKSISYADVEQLSAAFGAYLQSKGLQKGARVAVMMPNVLQYPVAMMGILRAGYVVVNINPLYTPRELEHQLKDSGAQAIVILENFANTLQAVIARTAVKHVVVAAMGDMLGGLKGTIVNFVVRRVKKMVPAWSLPGHVKFNAAMKAGAGLGFKPAKVAADDVAFLQYTGGTTGVSKGATLLHRNVLSNVVQNAQWMEDAYTIKPKPAHPNFICALPLYHIFALTVNALMGMQQGARNVLIPNPRDIPAFVKELQKYPVHIFPGLNTLFNALLNNEDFRKLDFKPLVLTLGGGMAVQKGVAERWKALTGCPVTEGYGLSETSPVATANKFSSGDFTGTIGLPLPSTEIAIRDDDGNNLPLGEVGEICIRGPQVMAGYWNRPDETAKVMTKDGYFKSGDMGFMDERGYTKIVDRKKDMILVSGFNVYPNELEEVVAMHPGVLEVAAIGVPDEHSGEVPKLFIVKKDPALTVEAIAAFCRENLTGYKRPKYIEFRTELPKTPVGKILRRALRA

SEQ ID NO: 12141 - protein, 382 aa, Mesorhizobium loti
MADKSFLNWPFFENRHRELAEVLEAWCSKSLPVDHHDVDAACRELVQKLGRDGWLKPTAVDTVNPGPLDVRTLCITRETLSRHDGLADFAFAMQGLGTGALSLFGTPDQQQWLARTRAGKAISAFALSEPRSGSDVANTEMTATRDGDSYVLTGEKTWISNGGIADLYIVFARTGEAPGAKGLSAFIVPGDVKGLGIAERLEVIAPHPLARLSFDQVRLPTSALIGKPGDGFRIAMSVLDVFRSTVGAAALGFARRALDESIKRVAERKLFGAPMAELQMVQGHIADMALDIDAAALLVYRAAWTKDMGAARVTREAAMAKLFATDKAQDVIDKAVQLHGGDGVRKGHIVESLYREIRALRIYEGASDVQKVVIARQVMGAA

SEQ ID NO: 12142 - protein, 257 aa, Mesorhizobium loti
MTAVPAISGKHALVTGGGSGVGRAIALALAGAGIDVTICGRRDAELAKVAGESDRIFGIAADVTDEASMASLYQAAEAARGAFDIVIANAGMAGSTPAHKTTLADWQKTLDVNLTGAFLTVKPALAGMAVRKAGRIVFVASTAGLKGYAYVAPYVAAKHGVVGLMRALAAETAKSGVTVNAVCPGFVETDMLEESIQRIIEKTGRSAGEARASLVSTNPQGRFIQPQEVAAAVLWLCGDAASSITGQAISISGGETW

SEQ ID NO: 12143 - protein, 278 aa, Mesorhizobium loti
MVEPLFSVRGLKVALPDMTRKPLIGRAPLAEILKGLDFDLPRGSVTGIVGESGSGKSTLGRALVRLLEPSAGSISFEGRDIAHLPEAELRPLRRDLQMIFQDPMSSLNPRRTIASIIAAPLRQNGLGDNLKTRVAEALQRVGLPQSFASRYRHELSGGQRQRVGIARALALSPKFVLADEIVSGLDVSTQAQILTLLEKLAAEMGLTVAFISHDLSVIRRLCRQVIVMREGVIVEASATDALFEAPKETYTRDLIAAIPLPEIDAGWLDIPAAAKAPT

SEQ ID NO: 12144 - protein, 524 aa, Mesorhizobium loti
MSEFDAIFVGAGHNSLACAAHLALKGWKTGIFERSSTIGGAVQTREFTLPGFRHDFGAMNLSLFAGSAFHRKYANELKTQGLEFAPVADCFASAFPDGRWFGVSNDLEKTASRMAAFSAADAATWRKLVAAFPGEAEHLFRLLGSPMSARALAGTAWNLWRKKGVAGALDTGRLLLSSPRTWLEETFESPYVRATLATWGMHLDFAPDIAGGAVFPYLESMANQSFGMVLGKGGADTIIRALAGMVTSAGGKIVTGAEVSEITVSNGKATGVRLTSGETHTATKAVIAGVAPKALTGTLLPGGSGNAGFDTAMKKFRYAPGTMMIHLALDELPGWRAGSELRQFAYVHLSPSLDAMSRTYQQAMAGMLPDEPVLVVGQPTAIDPSRAPQGKHVLWVQVRMLPAEITGDAGGKIAPAHWDQVKDAYAERVLDIIETYAPGLRSKILGRSVFSPIDLERENPNLVGGDQVCGSHHLAQNFLFRPARGYAGWNTPVGNLHLTGAATWPGAGTGAASGFMLAQQLGGR

SEQ ID NO: 12145 - protein, 523 aa, Mesorhizobium loti
MKAPDHIIVGSGINALVCAAVLGGKGAKVLVLERNDRIGGCMRTEEITAPGFIHDVMATTFVLFIISPAFAALGGDLARHGLEFCHTGTPTGVLTPDGSHAVLATDRAANVAALNAIAAGDGDRHADDVGGIERNAGLLFGLLGGSLWSYPTAKLLAGDAWRRGPRGLAAFLGEALAPARGWLESTYQSETIRALWAPWVLHAGLGPEDAFSGQIAKVIAFALEAAGAPIVKGGAKNLLSAFEALITERGGVIATEADVTSIILAGGRATGVRLASGETVHARKSVICSVTPTQLYGRLLGSEAPKADIEATRKYRYGKGNFQIHYALDKPPVWRGGGLDKVALLHLTPGLDGVSKACNEAVRGLLPEVPTICVGQPHALDPSRCPEGKAILWLQLPEAPRHIKGDAAGKLQAPADGQWTDALREAYADRAEAILASHIDGFKDNVIARRAYSPADLEAMNINLVGGDPYGGSSTIDQSFLWRPFKTSHNHKTGIKNLYHIGASTHPGAGLGGGSGFLLAGRL

SEQ ID NO: 12146 - protein, 557 aa, Mesorhizobium loti
MGTGNNKVEAGNQITQGSLVSRRNVLLGGTTLAAASALAGSNPIRLAQAAAAGSKPNILVIFGDDIGYWNTSAYNRGMMGYRTPNIDRIAREGAIFTDLYAQQSCTAGRAAFITGQSCFRTGLLKVGLPAAPEGLSGKDPTLAELLKPQGYATGQFGKNHVGDRNEFLPTVHGFDEFFGNLYHLNAEEEPENVDYPKNPEFHAKFGPRGVLKCTATETDDPTEDPRFGRVGKQKIEDTGPLTKKRMETVDEEFLGAAKDFIDRQHKASKPFFCWFNSTRMHINTHLKPASEGKTGLGMEADGMVELDGMVGQLLQQLDDLGIADNTIVLWTTDNGAEVFSWPDGGTTPFHGEKNTSWEGGYRVPGMIRWPGVVKPGTEINDIVSHEDWVPTLVAAAGEPNVKEKLLTGYEAAGKTFKVHLDGYDQHDLLAGTGPDPRKEFFYWTDEGNLAAFRYDRWKILFLEQRAEGFDVWEEPFVALRVPKIFDVRADPFERAQREAAEYVRWRFDRTYVLMPAQAFVGQHLQSFVAFPPRQKPGSFSLGQVLEKLQEAGNSGKE

SEQ ID NO: 12147 - protein, 429 aa, Mesorhizobium loti
MKDIMKNSAISERKNQSISRGVGMTTQIYADRAENSEIWDVEGRRYIDFSSGIAVVNTGHRHPRVIEAVKAQLDRFTHTCHQVVPYESYVRLAERLNAMLPGKFEKKTIFVTTGAEAVENAIKIARNATGRPAVIAFAGGFHGRTFMGMALTGKVVPYKVGFGAMPGDVYHAPFPVPLHGVSVADSLAALDRLFKADVDPARVAAIIVEPVQGEGGFYEAPREFLTALRKLCDQHGMLLIADEVQTGFARTGKMFAMDHHEVAADITTMAKSLAGGFPLSAVTGRAEIMDAPGPGGLGGTYGGSPIGVAAAHAVLDVIEDEKLCDRANTLGARLKQRLQSIRDDVPEIVDIRGLGFMNAVEFNDVKKGMPSAEIANAIRLKALDKGLILLTCGVYGNVIRFLAPITIQDEVMNEALDILESSIREVCAA

SEQ ID NO: 12148 - protein, 253 aa, Mesorhizobium loti
MAQSRFKQRTVLITGAGTGMGRAAALRLAEEEAHLVLVGRRPEPLERLVSDIEAASGTAMAITCDISRGDAVAAAVEKTIARFGRLDALFANAGVLGEFKPLADTETDDFDGLIATNLRGTFLTIKHCLPFLEGGAVLINASWTASSVMPGAGAYASTKGALLAMMRTLAVEQGPRNIRVNAINPGIILTPMADDVLSPDLAARLAAHTALRRNGTPEDVAGTVAWLLSDDAAFVTGQEIMVDGGYTIGGLRL

SEQ ID NO: 12149 - protein, 421 aa, Mesorhizobium loti
MTRQNYFFTSESVAEGHPDKVCDRISDEIVDLVYREAKKTGMDPWKVRVACETLATTNRVVIAGEVRVPETLLKKDKAGNILKDAAGHPVVNPAKFKSVARKAIREIGYEQAGFHWKTAKIEVLLHGQSPDIGQGVDNAADRQGEEGAGDQGIMFGYACRETPDLMPAPIYYSHKILELLAAARHQNNGEAGKLGPDAKSQVTVRYVDGKAAEATQIVLSTQHLDATWDSKKVRKVVEPYIREALGDLKIADDCMWYINPTGKFVIGGPDGDAGLTGRKIIVDTYGGAAPHGGGAFSGKDTTKVDRSAAYAARYLAKNVVAAKLADRCTIQLSYAIGVAQPLSVYVDLHGTGKVDEAKLEDALRTVMDLSPSGIRRHLDLNKPIYAKTSSYGHFGRKAGRDGSFSWEKTDLAKALKDAVAA

SEQ ID NO: 12150 - protein, 860 aa, Mesorhizobium loti
MSDTKSGDDKTLSVTPMKTLTLKRPGMEQGTVRQNFSHGRTKSVVVETKKRKFSLPGDKPEPAAAAPVPVFTPKPPVAAAPVVQEAPKAAPPPPPRAPVERSGMVLNELSRSEMEARRRALEGSKVREVEDRQRAAEEAKRRAEDEERRKREREESARRQAEEEARLQAEAESRRRAEEEARRRAPLAAELATADEEEEVKPKRAGAGAPVRRLVTPEVARPAKPTKGEEDRRRGKLTLNSALSDEDARARSLSSMRRRQEKFKRAMHNEPREKVMREVILPETITIQELAQRMSERAVDVVKFFMKQGQILKPGDVIDADTAELVATEFGHTVRRVAESDIEEGLFNIADNAEDLVPRPPVVTIMGHVDHGKTSLLDAIRNANVVSGEAGGITQHIGAYQVEKNGQKITFIDTPGHAAFTAMRARGAQATDIAILVVAADDSVMPQTIESISHAKAAGVPIIVAINKIDKHDADPQKVRSELLRHEVFVESMGGEVLDVEVSATKGTNLDKLLEAILLQAEILDLKANPDRTAEGVVIEAQLDKGRGPVATVLVQTGTLMPGDILVAGNEWGRVRALVNDRGEQIKEAPPAMPVEVLGLQGTPLAGDRFAVVNNEARAREITEYRQRLAREKAVAKHAGQRGSLEQMMSQLQTSGLKEFPLVIKGDVQGSIEAINAALDKLGTDEVRARIVHAGAGAITESDVSLAETSGAAIIGFNVRANVQARAAAAAAGIEIRYYSIIYNLVDDVKAALSGLLSPERRETFIGNAEILEIFDITKVGKIAGCRVTEGKVERGAGVRLIRDNVVIHEGTLKTLKRFKDEVSEVPGGQECGMAFQNYEDMRVGDIIECFRVEMVTRTL

SEQ ID NO: 12151 - protein, 267 aa, Mesorhizobium loti
MDGLMKGKRGLVMGVANDHSIAWGIAKKLSEHGAELAFTYQGDAFGRRVKPLADKLGASLVVPCDVEDSASVAATFETLGKEWGGLDFVVHAIGFSDKNELKGLYADTSRDNFVRTMVISCYSFTEVARNAAALMTEGGSMITLTYAGSVRVMPNYNVMGVAKAGLEASVRYLANDYGPRGIRVNGISAGPVRTLAGAGISDARHMFSYQQRNSPLRRTVTIDEVGGSALYLLSDLASGVTGEIHYVDSGYHIVSMPTLDELKQTDG

SEQ ID NO: 12152 - protein, 406 aa, Mesorhizobium loti
MRRVVVTGLGIVSSIGNNANEVQTSLHDARSGISFSDSFAEHGFRCQVWGAPTLDPSAMIDRRAMRFLSQGAAWNHVAMDQAIADAGLGESDITNERTGIVMGSGGPSTRTIVEAAETTLKNGSPKRIGPFAVPKAMSSTASATLATWFKIHGVNYSISSACSTSAHCIGNGYELIQWGKQDMVFAGGHEDLDWTMSDLFDAMGAMSSKFNDRASAASRAYDVNRDGFVIAGGAGVLVLEELEHAKARGAKIYAEIVGYGATSDGYDMVAPSGEGAVRCMRQALATVSTPVDYINTHGTSTPVGDSKEMGAIREVFGEKMPFITSTKSLTGHSLGAAGVQESIYSILMMQGGFIGESAHIETLDPEFEGMPIVRKRIDNAKIDTVLSNSFGFGGTNATLVFQRYSA

SEQ ID NO: 12153 - protein, 244 aa, Mesorhizobium loti
MTCLPSQSGKKLGLVIDLDTCVGCQACVTACKEWNTGGHMAPLTDIDPYGGHVDGVWFNRVHSYEHTTEMGGRTVNFPRSCLHCETPACVTVCPTGASYKRASDGIVLIDEDKCIGCKLCSWACPYGAREFDTDVGVMKKCTLCVDRIYNDNLAEEDRVPACVAACPTSARHFGDLGDPHSAVSQLVAERGGVDLMAELGYHPTNKYLPPRAHTQRAASVPAKALEPVRAEGGFLGWVDRMLSN

SEQ ID NO: 12154 - protein, 408 aa, Mesorhizobium loti
MKCAHLNSDDALWEEYHTHMTNPAEILGLPKPAWAADEVGMLYDMATRFMSEEIAPRYDEFEKNEMVDRESWRKAGAAGLLCASMPEEYGGSGGTFAHESAIIEAIGHVGVDGFGIGLHNSIVAPYILHYGSEEQKKKWLPKLATGELIGAIAMTEPGAGSDLQGVKTRAEKDGNQYRINGSKTFITNGQLANFIIVVTKTDPEKGAKGTSLIVVETDEVEGFERGRNLDKIGLKANDTSELFFNDVRVPTSNLLGHEEGQGFIQLMQQLPQERLQIGTGAIAMIERALALTIEYVKERKAFGKAIIDFQNTQFKLAELKTEATIGRVFYNDCVTRHINGGLDPVTASMAKYWLSDLQGKVVDECLQLHGGYGYMNEYPIARMFRDARVQRIYGGTNEIMKLLIGRSL

SEQ ID NO: 12155 - protein, 402 aa, Mesorhizobium loti
MAEAYVYDAVRTPRGKGKKDGSLHEVPAVRLAAKTLEALRDRNGLDTGTVDDIIFGCVDPVGEAGSVIPRAAAFEAGYDTKAPGMQISRFCASGLDAINFGAAKIAQGADEIVIAGGVESMSRVGMGASGGAWFMDPSVGLPGWFVPQGISADLIATKYGFSRDDVDAYAVESQKRAAKSWADGRFKNSVIPIKDQNGLTILDHDEHMRPSTDMQSLASLNPSFVMPGEMGGFDAVAVQKHPEVEEVNHVHHAGNSSGIVDGAAAVLLGSKKAGKAMGLKPRARIRTFANIGSEPVLMLTGPVDVTEKLLKRAKMKLSDIDLFELNEAFASVVLRYMQAFDIPHDKINVNGGAIAMGHPLGATGAMIFGTVLDELERRDLNTALVTLCIGAGMGTATIIERV

SEQ ID NO: 12156 - protein, 399 aa, Mesorhizobium loti
MSGSALYETFARAPLAFDHGEGTWLVTDKGERYLDFAGGIAVNSLGHSHPHLVAALTEQAAKLWHVSNLYEIPGQSRLGQRLVDATFADKVFFTNSGAEALECAIKTARRYHFVKGHPERFRVITFEGAFHGRTLATIAAGGQYKYLEGFGPKVEGFDQVGFDDIDAAEKAITPETAAILIEPVQGEGGIRPVPTQSLKRLRQLCDQHGLLLIYDEVQCGIGRTGKLFAHEWSGVAPDIMAIAKGIGGGFPMGACLATDEAAVGMTAGVHGTTFGGNPLAMAVGNAVLDVVLEDGFLEDVQRKALLMKQGLAAIADEFPDVVEDIRGTGLMLGLKCAMPNTKVNMALRDQHLLAVPAGDNVIRLLPPLTVTDAEIHEALNRIRAGAKGLADAIAVAAAK

SEQ ID NO: 12157 - protein, 303 aa, Mesorhizobium loti
MSVRHFTDLSTVSEGDLRFMLDDAVVRKARLKAGERTRPLEGKVLAMIFDKPSTRTRVSFDVGMRQLGGETIMLTGTEMQLGRSETIADTAKVLSRYVDAIMIRTTSHDRLLELTENATVPVINGLTDDTHPCQLMADIMTFEEHRGPVAGKTIAWTGDGNNVLHSLLEASARFRFNLNVAVPEGSEPAQKHIDWSKAHGGKLHFTRSPEEAVDQADCVVTDCWVSMGQEHRARGHNVFSPYQVNAKLMAHAKPDALFMHCLPAHRGEEVTDEVIDGPHSVVFDEAENRLHAQKAVLAWCLGA

SEQ ID NO: 12158 - protein, 396 aa, Mesorhizobium loti
MSNKKRNWKPQTALVHSGTLRSGFGETSEAMYLTQGYVYQTAQAAEARFKGEEPGFIYSRYANPTVDMFEKRMCALEGAEDARATASGMAAVTAALLCSVKTGDHIVAARALFGSCRWVVETLAPRYGIEATLVDGTDIANWEKVVRPNTKLFFLESPTNPTLEVVDIAAVAALANSIGARLVVDNVFATPLQQKPLQLGAHIVVYSATKHIDGQGRCLGGVILSDKKWIDENLHDYFRHTGPSLSPFNAWTLLKGLETLPLRVRQQTESAGKIADFLAEQPQIARVIYPGRADHPQAEIVKKQMSGGSTLICLDVKGGKQAAFALQNALDIVLISNNLGDAKSLITHPATTTHKNLSDEARAELGIGPGTLRLSVGLEDTDDLLEDIAQALKAAK

SEQ ID NO: 12159 - protein, 359 aa, Mesorhizobium loti
MSVLDRLGQKLLFAFDPETAHGLSIAALRCGLPAGTRAVRDIRLKVSLCGLDFPNPLGMAAGYDKDAEVPDALLGLGFGFAEVGTVTPLPQAGNPKPRIFRLTADEAVINRLGFNNEGHAAAEKRLAARKGRPGIVGVNIGANKDSADRIGDYERGVGRFARHASYLTVNISSPNTPGLRNMQAREQLGELLSRVMAARASAATQPPIFLKIAPDLVEAELEDIAAEVVEKRIDGIIVSNTTISRPPLRSGDVGRETGGLSGKPLFERSTIVLAKMRKLLGPGIAIIGVGGVDSAETALEKIRAGADLVQLYTGMIYAGPALPGRIVAGMARFCETERLKSIGELRDSHLDRWASKPLS

SEQ ID NO: 12160 - protein, 425 aa, Mesorhizobium loti
MNYQRFFEEAIDQLHAERRYRVFADLERIAGKFPRAIWRSNGRAEEITVWCSNDYLGMGQHPDVIAAFQNAAGKMGSGAGGTRNISGTSNPLVELEHELADLHGKDAALVFTSGFVSNEASISTIARLLPNCLIISDELNHASMIEGVRRSGAEKKIFRHNDVAHLESLLQAAGRERAKLIVFESVYSMDGDIAPIREIVELAERYNAMTYIDEVHAVGMYGPRGGGITEREGLADRIDIIEGTLAKAFGTLGGYITGTSAVIDAVRSYAPGFIFTTALPPAIAAAATTSIRHLKRSQAERDAQQQQAARTKQILSAAGLPVMESPTHIVPVLVGDPELCKMASDRLLGVHGIYIQPINYPTVPRGTERLRITPTPFHSDALIAGLQDALVETWDALGIPYGAAGRPAVAKSDRIVPLLVPKSGG

SEQ ID NO: 12161 - protein, 513 aa, Mesorhizobium loti
MDTTAQHGTVKEGPQDSTPRLTLSGISKSFPGVRALHNVSLSLYPGQVTALIGENGAGKSTLVKIMTGIYQPDAGTISIDGQAVTLPSAHAAFGHGVTAIHQETVLFDDLTVAENIFLGHAPRTRLGTIDWRTMRGNAREVLDTMHAGHIDADARLKDLGIANKHLVAVARAMSIDAQIVIMDEPTAALSMKEIEELFLLIEFLKEEGKAILFISHKFDEIYRIADRYTVFRDGEVVGEGLIKDAGQSQIVRMMVGRSVDHIFPQRKAEIGAPVLSVAGLSHPTEFNDIGFELHKGEILGFYGLVGAGRSEVMQAISGITRTSGGTITLEGKAIAPKSAADSIEAGIVYVPEERGKQGVVIGLPIFQNVSLPSLKRTSKSGLLRLAEEFSLARSYTERLDLRASSLSQDVGTLSGGNQQKIVIAKWLATAPKVIILDEPTKGIDIGSKAAVHGFMAELVAQGLSVIMVSSELPEILGMSDRVVVMREGLVAATYDNKGLDAETLVRTAAGIAA

SEQ ID NO: 12162 - protein, 495 aa, Mesorhizobium loti
MNLPPNALWIDQDDYDVRGFSHGLYIDGRWRPSSDGRVIDVVDPSSGSVIAAVPDATLEDALAAVDAAAKAATAWRETAPRKRSEILRRCFELMVERSETLAMLISLENGKALRDARGEVAYAAEFFRWNAEEAVRITGEFGTAPSGANRIVVDYEPIGICVLITPWNFPAAMATRKIAPALAAGCTVILKPASETPLTAYALAALYSEAGVPAGVVNVLTTTSPGPLTSAMLADPRVRKLSFTGSTGVGRTLLGEAAKHVVSCSMELGGNAPFVVFDDADLDAALDGAMIAKMRNAGEACTAANRIYVQSGIHDAFADGLRKRMAALKVGPGMSADTECGPMITRKAVDKIDRLVKDAVGRGAKVLCGGSIPEEEGFFYPPTVLSQVPPDADMAHEEIFGPVAPVTRFETEAEVIMHANNTEYGLAAYIYTRDVGRGLRVASRIEAGMIGLNRGLMSDPAAPFGGVKQSGLGREGGQHHGIAEFMEAKYIAVTF

SEQ ID NO: 12163 - protein, 408 aa, Mesorhizobium loti
MSLFAALRLPREILFGKGQRHALSTVAGRFGRHALVCTDERFAGTAVFAEIVQSLQAASIEVLVHDRVLPDVPRDSVGICVDEAEKFQPEMVIGIGGGSCLDFAKCADLLLSHGGKLQDYYGEFKVPGPTLPLIAVPTTAGTGSEVTPVAVISDPDRTLKVGISSPYLIAAVALCDPELTMTCPPALTAIAGADALTHAIEAFTAKQRGEDPSLAQQHVFIGKTALTDHFALLAIKLLGRSLEKACTDGTDADARADVMMGALAAGCAFGTAGTAAAHAVQYPAGALTHTAHGLGVATMMPYVMTYNSRVVAAEMAEIGDALGLEAKGRSAEEMADATIKEIRRLFTAIGITPTLADLGLPADKLDWTADQALGIDRLIKNNPRPFDLTAMRRLVQAAHDGDLAACAM

SEQ ID NO: 12164 - protein, 340 aa, Mesorhizobium loti
MRQSKFAPRHAVNAGERKTTSAMIASIAPNGVPTRSAPFGHTLARLAHQRPGIVGLTADLAKYTDLHVFAQEHPDRFYQMGMAEQVLMSAAAGLAREGFTPFATTYAVFASRRAYDFICMAIAEEKLDVKIVCALPGLTTGYGPSHQATEDIAIFRGMPNLTIIDPCDALDIEQATEAIADYKGPVYMRLLRGKVPVVLDEYDYTFEIGKARLLRDGADVLFISSGLMTMRVLEAAKALEADRIDCAVLHVPTIKPLDTQAILDGARRPGRLVVVAENHTIIGGLGEGVAALLMREGVAPVFRQIALPDEFLDAGALLTLHDRYGISSSELVRRVRKWTE

SEQ ID NO: 12165 - protein, 250 aa, Mesorhizobium loti
MLLKGKAVVISGAASPRGIGRSTATLMAEQGARIAILDLDEEQARDAAASLGPEHIGLACNVADLDSCKRAAAEVTEAFGRVEVLCNIAGITQPVKTLDIGPADWDRILDVNLRGVLYLSQAFIPHMRENGGGSIICMSSVSAQRGGGIFGGPHYSAAKAGVLGLAKAMAREFGPDGIRINCVTPGLIQTDITGGKLTDAMRADIIKGIPLSRLGDARDVAGAYLFLASDLASYITGAVIDVNGGMLIHG

SEQ ID NO: 12166 - protein, 369 aa, Mesorhizobium loti
MSDAKLQSVLSSLSQVARQLDALPSDTPAPDSSWVKLNTNENPFPLPEIIMQSAIAALERQYLYPEDDNISLREAAANAYSVSMDQVIAGNGSSELLGLVYRAFLTPGDSVAMMSPGFSFNRKLATLQGAQFVEIEFSKDHSLPMEQLLFGPAKDAKFILLANPNNPTGTFVPVADIERLVAKSDRLIVLDEAYVDFAPENGLRLINRYSNLLVLRTFSKSYAAAGVRVGFGFGHPEIIGRLRNIQNVFNMNVIGQAVGISVLAHRAAYADNHRHIRHERRRVTLALSQLGFSVIPSHANFLLARVPTAQDGSWWQSAFARQKILVAVFPDKGLENYIRVSIGTKEQMDAFLRAASRISRILNMSTPPR

SEQ ID NO: 12167 - protein, 119 aa, Mesorhizobium loti
MMFRITKEFHFSASHQLTSLPPDHQCARLHGHNYIVVVELSGGELDEHGFVRDYQDLAAFKHYIDGTFDHRHLNDVLGHDHATAECLARHFYDWCKVRLPETSAVRVSETPKTWAEYRP

SEQ ID NO: 12168 - protein, 477 aa, Mesorhizobium loti
MKFGSSGVRGLASELVGKASGLYTEAFAWRLISSRVQPNSSVFIGRDLRDSSQAIANNCMAALAANGFQPIDCGTIPTPALALYACKHGAAALMVTGSHIPADRNGIKFYGPNGEISKADEAAITRFVAERSIAYCLPTACLGTTWPMHCEEAIASYRERAHDMLEPGSLSGMRLGVYQHSSVAAELLVQVLRSLGASVVAVGKTATFVPVDTEAVDAATIAKLKKWVREFGLDAIVSTDADADRPLIADENGDLLRGDLVGLATALFLKADTIVTPVTSNSGISKALGFAVQRTKVGSPFVIEAMEALHGAGGVIVGFEANGGVLLGSDCVVNGKTLTALPTRDSFLPILAVLSTMASTKKKLSRLRGLWNLPVCASDRLQNFPAESSRRLMDHLASRNALQHFLASFGTVAEIDETDGLRARMLSGEIIHLRPSGNAPELRCYSEASTESRAMAIVASTLQGAHAFALTDEIEDL

SEQ ID NO: 12169 - protein, 497 aa, Mesorhizobium loti
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAEALEYGMVGINTGRMSSEAAPFGGMKQSGIGREGSRHGLEDYLEMKYLCMGGL

SEQ ID NO: 12170 - protein, 552 aa, Mesorhizobium loti
MAAKDVKFSRDARERMLRGVNILADAVKVTLGPKGRNVVIDKSFGAPRITKDGVTVAKEIELEDKFENMGAQMVREVASKTNDIAGDGTTTATVLAQSIVQEGHKAVAAGMNPMDLKRGIDLAVSDVVWTLIKNATKIKTSEEVAQVGTIAGNGDESVGKMIAEAMQKVGNEGVITVEEAKTAETELEVVEGMQFDRGYLSPYFVTNADKMVADLEDAYILLHEKKLSNLQAMLPVLEAVVQTSKPLLIISEDVEGEALATLVVNKLRGGLKIAAVKAPGFGDRRKAMLEDIAILTGGQVISEDLGIKLENVGLDMLGRAKKVSISKENTTIVDGAGKKEEIQGRVAQIKQQIEETTSDYDKEKLQERLAKLAGGVAVIRVGGATEVEVKEKKDRVDDALNATRAAVEEGIVPGGGVALLRASLSINAVGANSDQTAGISIVRRALQAPARQIAANAGAEASIVAGKILENKGATFGFNAQTGEYGDMIAMGIVDPVKVVRTALQDAASVAGLLVTTEAMIAEAPKKESAGGGGMPGGMGGGGMGGMGGMDF

SEQ ID NO: 12171 - protein, 270 aa, Mesorhizobium loti
MAFNIAIYLNRIGLARVPTTVDGLVALQQAQMRAIPFENIDVLLGDIPNLTENSIWAKLINARRGGYCFELNKLFGLALEALGFTIQPILCRVRMGAAEGGPRTHQAFILTIEGVDWLADAGFGGPAPIAPLRIDTEELQTAGRDVFRLRADSASGELVVERKNGNEWFPLYGFDRATALPSDFEGANFICARWDRSPFPSSLMMSVLTAEGPANLFNKDFSLIRNQIEETETLKTKSELQRVLSDVFRLHLPRSTIDSLWEKLGSRGRV

SEQ ID NO: 12172 - protein, 402 aa, Mesorhizobium loti
MGQASRHYWDRGALRLGNNAASIWKEMREGRSAIRLMVTSALHEMKGTVGTEIKELPQHDIGRNQLVSMDRHSLLAVLAAREAMQHAGLSCDKGNPYRFGATVGVCGWGWGTVEETYRDLLLGGATRAGIYTAPRGLPSAAASQVSMSLGLRGPVFAIASACASANHAIASAADQIKLGRADVMLAGGAEAPLVCLQMKAWEAMRALAPDTCRPFSADRKGVVIGEGAGMAVLESYEHAAVRGATILAEIAGIGLSGDAFHIVAPSVEGPEAAIRACLADAGLNAEDVDYLNAHGTGTKANDQTETAAIKRVFGDYAYSMSVSSTKSMYAHCLGAASALEMIASVMAIQEGIVPPTANYREPDPDCDLDVTPNVARERKVRVALSNAFAMGGMNAVLAFKQV

SEQ ID NO: 12173 - protein, 327 aa, Mesorhizobium loti
MSKSSRILGFGHHTPGRKVANAEIENNLGLEPGWIERRTGIRSRFWATDGDTLSGLATQAGDIALANAGIDRSDIGLLLLATSTPDHLLPPSAPLVAHKLGLGRAGAVDLTGACAGFVYALMFADGFTRLHGKPALVIAANILSRRINPAERASSVLFADAAGALVIGPCEDPYQGILGASVDSDGSRYGLIQIPAGGSNTPFHGELDLEQTRMTITDGREVFAKAVEMMTACSQDALAAARMRPQDIDRFVPHQANARIFDAVGRNLGIADEAIVKTIAEYGNSSAATIPLSLSLAHRAAPFRPGEKVLLAAAGAGLSGGALVVGI

SEQ ID NO: 12174 - protein, 422 aa, Mesorhizobium loti
MMPQSRVWHPFTQHALEPAIPEIARTEGAYLYKADGTRILDAISSWWVVTHGHRHPRIIKAIETTASSLVQIIFAGFTHEPAERLAKALVGLAPAGLDWVFYSDSGSTSVEVALKMALGYFRNIDAPRSRIVVMEHSYHGDTIGTMSVGARGAFNAAYEPLLFEVDTIPFPAAGREQETLDRFEAVARDRRTAALIVEPLVLGAGGMLMYPAWVLAELKKIAETSGTLLIADEVMTGWGRTGTMFACEQASISPDILCTSKGLTGGAIPLAATLATDAIFQAHYSEDRKKTFFHSSSYTANPIACAAALANVEIWRDEPVAERVAALSAKQAAGLQRFRDNPYFTDCRATGTIAALDLRTGSAGYLAEIGPKLRAFFLERGLLVRPLGNVLYLLPPYCITGGELDALYDAIEEAAERFGSRP

SEQ ID NO: 12175 - protein, 379 aa, Mesorhizobium loti
MNEALLVRYDASLRGLARKDRLRTLAPRAGLDFSSNDYLGLAASKRLGEAVAAAIARGTPVGATGSRLLRGNSPEHEALEADAAAFFGAERALFFGSGYIANFALLTTLPQKGDLLILDDLAHASMHEGARAGRAEFKLAAHNDIDAVEDAITRWRAEGGMGRIWIAVESLYSMDGDRAPMARLIALADRHEAFLVVDEAHATGIWGPNGRGLAAAFEGRDNTVALHTCGKALGASGALVTGPGTLCDYLVNRCRPFIYATAPSPLMAVAVREALAMLSDEPQRRVQLQERVAFAGRQLAERCGVKPSGSQIQSFVIGDNRRTMAVAAALQTRGFDIRGIRPPTVPEGTSRLRISLTLNVDEADISAMVGALVEVLASA

SEQ ID NO: 12176 - protein, 513 aa, Mesorhizobium loti
MTADIHHIGGAPVIIGAGIAGLMTALHLAPQPVVLLSRTSLGTEASSILAQGGLAASLGEDDSPDLHLADTLAAGEGLCDEQMARRVVEAAPQAVENLIRLGTPFDRSLDGRLQLGLEAAHSRRRIVHAAGDATGRELFRALLGVARRTRSITIMEGMTALRLVVAEGSIVGLLTVLHGAVFALPTRRVVLATGGIGGLFCDTTNPLSSFGHGLALAACAGAELADLEFVQFHPTALDIARRPMPLVSEAVRGEGAVLIDEHGHRLLADTPGAELASRDVVARAISDQLAAGHGVYLDARHCLGQKFARRFPAIDAICKHAGIDPAVEPIPVRPAAHYHMGGVAVDAEGRTSVSGLWACGEVACTGLHGANRLASNSLTEAVATAAWVAESVAGTSAGWQWPRLPATVPIRPDPSPIRTIVSNALGIVRNGKSLCDTVATLLPISVCETAAADPALVALLMAIAALRREESRGSHFRSDFPGRDAAALPSRLTLCTAFENAVTLRWQASERSR

SEQ ID NO: 12177 - protein, 497 aa, Mesorhizobium loti
MGEAAGRNSPPQTGQGEKTYMLTPLAPSVKRAPRKTLFAKPYVQVLVAILLGVAVGHFYPQIGENLKPLGDAFIKLVKMIIAPVIFLTVSTGIAGMSDLQKVGRVAGKAMVYFVTFSTLALIVGLIVGNVIQPGAGLNIDLTSLDVQAVNGYASKAHEQSVTGFLMNMIPTTIVGAFVEGDILQVLFFSVLFGIALAMVGESGKSVLSFLQDLTAPVFKLVGILMKAAPIGAFGAMAFTIGKYGIGSVANLAMLVGTFYLTAFLFVFGVLGAVCRYNGFSIFSLIRYIKEELLLVLGTSSSEAALPSLMEKMEKAGAKRSVVGLVIPTGYSFNLDGTNIYMTLAALFIAQATNTDLSVGDQVLLLLVAMLSSKGAAGVTGAGFVTLAATLSVVPAVPVAGMALILGVDRFMSECRALTNLVGNAVASLVVARWEGELDQAQLKAAFCGHQPAETSAGQPLITPAPSNSAASLPVESPGWSQTPDDRAAGSKQTLAGR

SEQ ID NO: 12178 - protein, 366 aa, Mesorhizobium loti
MSKRKVALITGVTGQDGSYLAELLLEKGYSVHGIKRRSSLFNTGRIDHLYHDPHESGVDLTLHHGDLTDSSSLTRVIQLVQPDEIYNLAAQSHVAVSFEEPEYTANSDALGALRILEAIRILGLVKHTRYYQASTSELYGLVRETPQTETTPFYPRSPYAVAKLYAHWITVNYRESYNLYACNGILFNHESPARGETFVTRKITRALTRIKLGMQRTLFLGNLNARRDWGHARDYVQMQWLMLQQQQPEDFVIASGEQHSVREFVTVAAAELGIDVRWVGEGVDEEGYDAKTGALIVKVDPRYFRPAEVETLLGDARKAKEKLGWEPKISFIELVREMVREDLRMAEREAVLMNQGYYSHSPRELC

SEQ ID NO: 12179 - protein, 631 aa, Mesorhizobium loti
MFSSSRRPSISAFLRPSGLLRSYKATRRFHIDLRGAAFRDVFAFTMRHWSKQPVRLAIIMIAMLVATLLDVLTPFYSGRLVDAVAQAATADAVVWDAALAAFSMLIALALGAVVLRNIAFVAYNDFILKMMSDIASDAFHRVQRFSTDWHAKTFAGSTVRKITRGMWALCLLNDTILFALFPSLIMLVGSSVLLGWYWPMMGLIIACGSVGYVALIIILSLGYVAPAASLANNWDTRLGGSLADAISCNAVVKGFGAEAREDHRLAKVISKWRHRTRRTWVRGTVSAAFQGIMLLALRAALIGYALFLWSRGQATPGDIALVLGSFTVLYGYLRDVSIHVRNIQRSANEMEELVETYSQPPDVADVPGAKPIRITKGHIDFESVHFHYGNHWSPFYSDLSISIEAGARVGLVGPSGSGKTTFVKLIQRLYDLDAGRILIDGQDISRVTQGSLRSQIAIVQQEPLLFHRSLAENIAYGRPGASRSDIEQAARLASAHDFIARLPNGYGTLVGERGVKLSGGERQRVAIARAFLADAPILILDEATSSLDSESEVLIQKAMERLMVGRTTLVIAHRLSTVRELDRLLVFDRGCITEQGDHAALIRRDGIYRRLFERQALELTKGCDETNVQHG

SEQ ID NO: 12180 - protein, 405 aa, Mesorhizobium loti
MKQAGRVVIITGAAGGIGRALVEIVAADGDIVVAVDLPGSGVLELAGGLGHPHLGLECDVSREEDIVALYGRIEAQFAKIDVLVNNAAIGPAMAATIDTGFEAFRRVLATNLIGPFIMAGEAARRMQPGAAIVNVASLAGVLGNPKRNAYASSKAGLIALTRSLACEWASRGIRVTAVAPGYVRTPMVAELERAGKMDLAAVRRRVPMGRMARPDEIARAVRFLASAQTGYITGSVLTVDGGWMSFNQPGDAHPPVDETPRAELFRPAERTGARTVVVTGGANGIGAAVVRRFAANSDTVVIADKDGAGAAELADLLGGRHVAKSVDLAVESDVVALFEEIRGRFGRIEVLVNCAAIADTFVRGIEIPQQIERVLDVNLTGTFTCARGDQVDGRRRRNPQSWIDQ

SEQ ID NO: 12181 - protein, 192 aa, Mesorhizobium loti
MLLLPIRLCEGSKSRNRLSGCWTSISPAPSPAREAIKSMDAGGVILNLGSINSFLPFVPRHAYGASTAGMNILTRCMAAELGSVGIRTATVALGYIRTPDIAQLVESGCIDSVAIKRRIPMGRMGEPEDVAEAVFFLASPDASYVNGSTLYVDGGLTSLADARNAQPTDQENPTECSPATGCGSSKPTRFED

SEQ ID NO: 12182 - protein, 396 aa, Mesorhizobium loti
MLAHRTNLFGTSGTAAARAAAKAAADAGKEIIDLTAGEIWSELAPTIRDGAIDAINKGVNRYTDTVGMVELREALARKISLDTGQIWKAEEVAVTSGAKQALFNAAMVLLNPGDEVIIPAPYWTTFPAQVLIAGGTPVFVDTRSNGYVPRPEHIKEAVTERTRAIVVNTPSNPAGAVYDVETLMAIAQLAVSHNLWIIFDECYGDFVHEDHTHHPIVSVAPEIRARALIVSSFSKSLALTGWRIGYLAGPKEVINAVNALQSHTTSNPNVIAQHAVLAHLQRGGSDYEGKLRSRLTSARRIGLDVLAWLTRVPVPRAQGGFYFYLDLSHLLRSASEDGASTTADDIVTALLAETGVAAVSGAAFGDPAGLRLSYGIPSEKLATGLARLVEFLNSWK

SEQ ID NO: 12183 - protein, 513 aa, Mesorhizobium loti
MPQSAEKVLDHAPLFREPEYRQMLAEKKLNFECPHPDQIVTDQRELTKTWEYREKNLAREALVINPAKACQPLGAVFAAAGFERTMSFVHGSQGCVAYYRSHLSRHFKEPSSAVSSSMTEDAAVFGGLKNMVDGLANTYKLYDPKMIAVSTTCMAEVIGDDLRSFIENAKNEGSVPSDFDVPFAHTPAFVGSHIDGYDGMVKGVLEHFWKGSERSQAAGTINIIPGFDGFCVGNNRELKRLLDLMGVTYTVIQDASDQFDTPSDGEYRMYDGGTKIEDLKGALNAEATLSLQHYNTRKTLEYCDEVGQATASFHYPLGVQATDEFLMKVSAISGQEIPEAIRMERGRLVDAMADSQSWLHGKKYAIYGDPDFVYATARFVMETGGEPTHCLATNGTSAWEAEMKELLASSSFGQDAQIWAGKDLWAMRSLLFTEPVDLLIGNSYGKYLERDTGTPLIRLMFPIFDRHHHHRFPLMGYQGGLRVLTTILDKIFDKLDRETSETGVTDYSYDLTR

SEQ ID NO: 12184 - protein, 198 aa, Mesorhizobium loti
MAALAKFRPVDSGQHDKDELREIVRERSFRFGRYTLSSGIESDIYFNMKPTMMVARGAQLAALEFLKIVEQVKAEYVGGLEMGAVPVIGSMAAVSSMMNKPINTIFVRKVPKAHGTRDVIEGLGPKEDLEGKVVLIVDDVATSGKSILKAIEEVRRVGGIVGDAACLVDRDEGATALLAQHGVTLHSVLHASEFVERH

SEQ ID NO: 12185 - protein, 337 aa, Mesorhizobium loti
MLEKFERYPLTFGLTPIEKLDRLGKHLGGKVEIYAKREDCNSGLAFGGNKLRKLEYVIPDAIASDADTLVTVGGVQSNHTRMVAAVAAKIGMKCLLVHESWVPHEDVVYDRVGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPAGSRILYAHLGGAPAINGYGYTFRNG

SEQ ID NO: 12186 - protein, 117 aa, Mesorhizobium loti
MKITQAFTFEAAHCLPRVPATHRCHRIHGHSYRVELRLEGPVDPDTGFVIDFFDVEAVFGPLLQRLDHQYLNEIEGLDNPTAENIAVWIWNQTKPLLGQMCSVTVYETPLCWAEYEG

SEQ ID NO: 12187 - protein, 419 aa, Mesorhizobium loti
MDIDIFAAYESNVRRYGRSFPTVFKKSLGATIWDESGKPYIDFLVGSGALNYGHNNPDIIEPAIQYLADQNIVLSLDMYTAAKRDFIEVFVESILKPRGLSYKIQFPGPTGTNANEAALALARKYTGRSSVMAFTNSYHGMSLGSLAVSGSASTRQLGGVARHDVIRVPYENYPNQTFDSASYIDHVLGDPGSGIEKPAAIILEPIQAEGGMNTASAPWLSEIQRICRKHDVVFIVDDIQAGSGRTGDFFSFEFAKIEPDIVCLSKSLSGSGNPLSIVLIRPDMDIWNPGEHSGTFRGNNLAFVTSAAMCKMWSDRQFTTAVERTAVKLQEHLDRLVAKYPKCIEQKRGRGLMAGLKCRSQAVVGRVHDVAFENGLLIESSGPNRDVIKVLPPITISDDELDHGIAILDQALQEKTNGD

SEQ ID NO: 12188 - protein, 458 aa, Mesorhizobium loti
MRHQILSNRSGEDLRASDLAHHLHPFTDHTVLAAEGGPRVIKDGDGIYVWETEGRRLLDGMAGLWCVNVGYGRKELGEVARQQMDRLAFYNTFFKTSHEPVINLAERLAAVTPEGIDNFFFGNSGSEANDTAIRLVRSYWAAVERPERQVVISREYAYHGSTLAGASLCGLPGMHGVAGLPIPGIAHAAAPYAWAAGKDQDDPAYGRASADALEAKILEIGPKNVAAFIGEPVMGAGGVITPPPRYWARVQEICRKYDILLVCDEVICGFGRTGEWFGAQSFGIAPDIMCMAKGLSSGYIPISAVGVGTRVAEILRTRPGVLSHGFTSSGHPVAAAVALKNIELIEAEGLVNHVRDVAGPALARRLGALAMHPLVGQVRGIGAMWALELTSDKATRAPFAPLGSVATRVRNLCFERGLATRAVREGLVFAPPLIITEAQVDEMADILTSCLDTAVAEL

SEQ ID NO: 12189 - protein, 440 aa, Mesorhizobium loti
MSHVFHRSALSVPPMAVAADGHYIIDINGRRYLDASGGAAVSCIGHGDPRVVAAVAEQIARLDYAHSGAFTSPSAEELAAHICAEAGQGMARVYFVGSGSEAVEAAIKMARQCQIERRQPSRHVVISRRLSYHGNTLGALGRSGSETRRAPYAPMLQKRTQIAPCFPYHYAEPGETPEAYGLRAAEALEAEILRLGSENVAAFLAETVVGATSGAVVPATGYFRHIREICDRYGVLLICDEVMCGAHRTGPFLACSDEGVSPDIVTLAKGLGGGYLPIGAVVCRADVHDSFAQGSGAFTHGHTYMAHPVACAAALEVQRVIVDDRLAERVVRQGALLDAALRDRLSQHTYVGDIRGRGLLYAVELVADRETRVSFDPEMRLAARIGAQAKGRGLLVYPGSGTIDGLRGDHVLLAPAYSIDAQRVGEIADILTEAIDAALG

SEQ ID NO: 12190 - protein, 415 aa, Mesorhizobium loti
MFLCRRQFDLRRRHAADGGQSRRGQGHSAVSAPRHGANGRNERGASCPVWPVLARTGAQGPAADAGTARRARLLVERLSRTCLLQKTWRGGCGGDCAGHAGGRHRIGNAPEHEALESDAAAFFGADRALFFGSGYIANFALLTALPQKGDLLVLDQLAHASMHEGAQAGRAEFKLAAHNDVDAVEDAITRWRAEGGMGRVWIAVESLYSMDGDYAPLESLVALADRHEAFLVVGEAHATGVWGPDGRGLATAFEGSDNIVALHTCGKALGASGALVTGPGTLCDFLVNRCRPFIYATAPSPLMAVAAREALTMLSDEPTRRVQLRERIAFAGRQLAERCGVVPSCSQIQSFVIGDNRRTMAVAAALQARGFDIRGIRPPTVPEGTSRLRISLTLNVDEADISAMLEALVEVLAST

SEQ ID NO: 12191 - protein, 653 aa, Mesorhizobium loti
MGKLFSKILIANRGEIACRVIRTARRLGMATVGVYSDADAKSLHVAMAGEAVHIGASPVAESYLKADRIIDAALKTGAQAIHPGYGFLSEAPDFVERVEAAGLVFIGPSASSIRAMGLKDAAKRLMEITGVPVVPGYHGEAQDPALLASRAIEIGFPVLIKARAGGGGKGMRRVETAGEFADALASAQREAKASFGDDKVLIEKYVEKPRHIEVQVFGDNHGNGVHLFERDCSAQRRHQKVIEEAPAPGMTPEMRVAMTHAAVKAAKAINYSGAGTIEFIVDASEGLRADRFWFMEMNTRLQVEHPMTEMVTGQDLVEWQIRVAAGELLPLTQDDIHLDGHAFEARLYAEDASRGFLPATGTLYHLRFPPEASSIRIETGVRQGDTISSFYDPMIAKIVTKGSDRKDALELLVSALAVTEVAGSTVNTAFLSALAQDEDFATGDVDTGLIARKQGALTALAEASARSKALAALRVASVDEATSNDPWASLTGYDHFGSTAKAISLGESGEISVSLTAETNGAWRAEVDEQTIRFSPTSLPEALASAVIWPGHVTVFDGAVSHTFIARDPLDEAADAYGGAGSLRAPMPGLVKLVRAKPGFKVSKGDPLLILEAMKMEHTITAPHDGTIAKIAAEGAQVADGTVLVRFEESGGN

SEQ ID NO: 12192 - protein, 562 aa, Mesorhizobium loti
MLFEKDSFEEVRRSFQWSIPERFNIGVDICDKWAEADPTRLAIVDVDPAGFTREYTFSDLRTMSNRLANALFGHGVGRQVGETGDRVGVLLPQRVETAVAHIAVTKLGCVSIPLFTLFGPEALEHRLRDSGARVVITDRAGAERVASIRSRVPSIELVVCVDGRGEGDEVSFQEMCSEQSDTFIPVDTHSDDPAILIYTSGTTGNPKGALHAHRVLLGHLPGVEISHDFLPKPDDRFWTPADWAWIGGLLDVLMPALHHGIPVVACRFSKFTTEAAITLIRSQRIRNVFLPPTALKMLKLKPAEECSGLDLRSVASGGETLGAELIQWGKDALGVTINEFYGQTECNMIVSSCAALEPPALGSMGRPVPGHDVDVIDPVSRLRQPAGVEGAIAALAPDPVMFLGYWNNPDATREKFIHGPEGRWLVTGDRGVRDNDGRLRFVGRDDDVIGSAGYRIGPAEIEDCLLGHPSVRLAGAVGKPDEIRGSVVAAYVVLREGFSPSQNLAEDIAAHVKSRLAAHEYPRVVRFIDEMPMTTTGKIIRGALRKIAQEEAALEARSRQKD

SEQ ID NO: 12193 - protein, 481 aa, Mesorhizobium loti
MEHAMFDARTYELFINGKWRAGGSKATLPVINPATEKVFASVASATVSDLDEALASAERSRKAWSSRPAKDRGEILVAAARILAEKAAAAARDLSAEQGKTIAEATGEYARAVETLEWNGRNVEELSASIPLGPNRMIVPEALGVVAAFTPWNYPAVLIARKLAPALAAGCPVILKGAEETPSVAVHIVESLRQAGIPDGVVNLVFGIPVHISRHLLSSPTVKVLTFTGSTAVGKQLAMLAANNLQRCILELGGHSPVIVCEDADLAKAIPAISEYKFECAGQSCNAPSRILVARSLYEQFLSRMTDAARKIKIGAPDDPATEMGPMANARRIEAMQRLTKDAVDRGARIETGGTRLDGPGFYWPPTILTGVPKDARVLHEEPFGPILTVAPFDTLEEAIEEANATEYGLAAYFFTGAADAQQKLINSLSAGAVSVNYLKGVSADAPYGGVKQSGYGYEGGEQGVRSFQILKMVNGLSSFG

SEQ ID NO: 12194 - protein, 468 aa, Mesorhizobium loti
MRLSNLGTEQLREKDRSFVFHPSTHLAKHSRGETPNRIMAGAEGVYIWDTEGRKSLDGFGGLYCVNMGYGCTEIAEAIARQAHELPFAHVYASQGTEPVALLAEAVVEYFGQNMRRVFFGLSGSDANETNIKLVWYYNNILGRPEKKKIISRHRGYHGSGLVTGSLTGLAFFHNFFDLPLDLVRHTTTPHHYRQAHDGESEQAFSTRCADELEGLILAEGPETVAAFIGEPVLGTGGIVPPPKGYWTAIQGVLDKYDILLIADEVVCGFGRTGEQFGSHLYGMRPDFVTIAKGLSSAYLPISGSIIGDRVWSVLEQGTEKHGALGHGWTYSGHTLCAAAALANIRLLKERNILEHVRDVGPYWHARMNAELAGHPIVGEVRGVGILAAVELMRDPKQRIPFESDLQVGVRAAAALFENGVIGRAMPHGDILGFAPPLIITRKEIDIIVDATAKSVETTYRALKAEGAI

SEQ ID NO: 12195 - protein, 391 aa, Mesorhizobium loti
MTRQFVFSSESVGAGHPDKMADNISDAILDAILRTDPKARVACETLVKTGMVVLAGEITSHAVIDYTQVARDTILDIGYDDDGIGFDGRRCAVVLALTEQSPDISQGVDEGRGQDLEQGAGDQGLMFGFACNETDTLMPLPIQLAHHLTKRQAEVRKTGQLGWLRPDVKSQVSVRYEGLRPVALDTIVLSTQHDEAVSQATVREGVIEEIIKPVLPTHLDTTGIRFLVNPTGRFVVGGPAGDCGLTGRKIIVDSYGGTGRHGGGAFSGKDPSKVDRSAAYAARYVAKNIVASGLAEVCEVQLAYAIGVASPVSVMVNTFGTARIEEKRIECLVLELFDLRPKGIIKMLDLVRPIYRNTATYGHFGREEPEFTWEKTDRADDLLREAGPAAA

SEQ ID NO: 12196 - protein, 776 aa, Mesorhizobium loti
MATLGVPRIGRRRELKFALESYWSGKSPAADLLATAKALRAASWREQHDRGVSKIPSNDFSLYDHVLDTVAMVGAVPARYTWTDGEVPLDTYFAMARGNQDQAADCGHAGDEHAANGHGLAAMEMTKWFDTNYHYIVPELTDDQSFALSSAKPVDHFLEAKALGIHTRPVLLGPVTFLKLAKSPEEGFNPIALLPRLLPVYEELLRRLKLAGADWVQIDEPALVVDLVPNERDALQFAYCRLSKAAPELKIMVAIYFGSLGDNLETAISLPVAGLHVDLVRAPEQLETVGRLAQKDLVLSLGLIDGRNVWRANLPAILDRIKPIVAGWPLDRVEIAPSCSMLHVPIDLDMETALDADVKSWLAFAAQKTDELVVLARALAEGRDAVAAELEASAEAAAARATSAKVHDPLVEGRVASIKVAMTRRKSAFDVRSKLQGDTFGLPSFPTTTIGSFPQTAEVRKARAAHAKGELSYVDYEAFLKKEIEAAVRWQEEIGLDVLVHGEFERNDMVQYFAEQLRGFAFTQHGWVQSYGSRFVRPPIIIGDVSRQNPMTLHWWRYAQSLTPKPVKGMLTGPVTILNWSFVRDDLPRSAVCRQVALAIRDEVSDLEKAGAKMIQIDEAALREGLPLREADWQAYLDWAVECFRLASTAVGDATQIHTHMCYSEFGDIVDAIAAMDADVISIETSRSQLELLDTLRTFKYPNEIGPGVYDIHSPRVPEVGEISNLIMLARKRLSDGQLWVNPDCGLKTRRWEEVRPALVNMVAAARAIRQKAQTA

SEQ ID NO: 12197 - protein, 340 aa, Mesorhizobium loti
MLKRKLGPEDLRRLETPAIERESHGQTSAKSSVPDSASTVAVDFAGVTKSYGNKIVVDELSFSVASGECFGLLGPNGAGKSTIARMLLGMTCPDAGTITVLGVPVPARARLARRGIGVVPQFDNLDQEFTVRENLLVFGRYFGMSTRQSEAVIPSLLEFARLERKADARVSELSGGMKRCLTMARALINDPQLIVMDEPTTGLDPHARHLIWERLRALLARGKTIILTTHFMEEAERLCDRLCVLEKGRNIAEGGPQALIDEHIGCQVMEIYGGDPHELLSLVKPHSQRIEVSGETLYCYAPDPDQVRTQLQGRAGLRLLLRPANLEDVFLRLTGREMEE

SEQ ID NO: 12198 - protein, 302 aa, Mesorhizobium loti
MAKWAGVFPAVTTKLTRDGKVDLRATKDSLDRLVKAGVSGVIVLPMLGENASMSLKDREDIIGGAVEVVAGRVPVLSGLAEITLDNAKANAKLYESFGAQGLMVFPSLGYKTDDRETVEWYKGVASASSLPIMIYNNPIAYGVDCTVNVLKQLVDTPEIVCVKEETGDIRRVTDMFVELGDRFSIFCGVDDLIVESCALGVTGWVSGMTNVWPSECVELFNLCIQNRYEEARALYHILTPSFHLDTHVKLVQYIKLAESLVYGAPEWTRAPRLPLVGEERDFVTSTIQLAIETLAKRVKKAA

SEQ ID NO: 12199 - protein, 407 aa, Mesorhizobium loti
MAKRALILVEGSRTGLLYVQAAQRLGLSPITLSADPTQYDYIAAEGIEAIHVDTADLDALIGECSRLRATYEIAGITCAKESVYATVAKLCRHFDLPGPNPTSIERCCDKFTQRQLLAEAGVPVPSYRLAANAADIESYAAEIGLPVILKPAVGVGSSGVRLCRNGDELAEHTTYLLGGKHIWRSSPRILVEEFAQGPYYSTEIMGDEVIGIYAGEFGPEPYFVFREFTLPALLTDEEQERIVDVSLGCLRALGLGWGPTCIEFRWTKRGPVVIEVNPRLGGAPGPQLVQLTYGLDLVTEHIKLVIGEKWDLRRRHSHTAAARILVPDRDGTLDWIDGDNRATAVPGVAEVEFYIGPNTPIVRKGDHRDWIGHVIVASPSRALTEATLHRAVDLIDWSIAPFPTLGE

SEQ ID NO: 12200 - protein, 452 aa, Mesorhizobium loti
MTTQVSEHNHDDAICPVDPAISSLRATAKGIDTRVVRGRITRAVGTLVHAVLPDTRIGELCLLQDPRTGLSLEAEVIGLLDDGVLLTPIGDLVGLSSRAEVVATGRMREVPVGNDLLGRVIDSRCRPLDGKGQIETTETRPLHGRAPNPMTRRMIERPLPLGVRVLDGLLTCGEGQRIGIYGEPGGGKSTLLSQIVKGAAADVVIVALIGERGREVREFIERHLGEEGLRRAVVVVETSDRSAVQRAQCAPMATALAEYFREQGLRVALMLDSLTRFCRAMREIGLAAGEPPTRRGFPPSVFSMLPGLLERAGMSERGSITAFYTVLVEGDGTGDPIAEESRGILDGHVVLSRAIAARSHFPAIDVLQSRSRVMDAVVSRTHRKAASFFRELLSRHAETEFLINVGEYKQGGDPLTDRAVESIDELREFLRQSEDEISGFEETVAWMSRLTA

SEQ ID NO: 12201 - protein, 321 aa, Mesorhizobium loti
MQTDSTLHDDAQARGASGRLPSEIWMQDGVRRVEQALARLLCAEDDGETELMAAMRYATLHGGKRTRALLCLATGALADTPAPMLDDVGAAIEMMHACTLVHDDLPAMDDDVLRRGLPTVHVKFGEATAILVGDALQAHAFLTLASLDAPSDNRIALVRELAQAVSAEGAAGGQAMDLSLVGKHVELDRIVAMHRMKSGALVRASVRMGALCAIAEDAAHAALYCALDRYSACFGLALQVVDDILDATADTATLGKTPGKDAAAQKPTCASIMGLQAARQLALDLLRDAGEAIPPLGTRAERLAQMLQRANAYLFKHAPCA

SEQ ID NO: 12202 - protein, 516 aa, Mesorhizobium loti
MNALSEQILSELRHLLIEMSDGGSVGPSVYDTARALQFHGNVTDRQDAYAWLIAQQQADGGWGSADFPLFRHAPTWATLLTLQRADPLPGAADAVQAATRFLERQPDPYAHSVPEDAPIGAELILPQLCGEAASLLGGVGFPRHPALLPLRQACLVKLGAVATLPSGHPLLHSWEAWGTSPTTACPDDDGSIGISPAATAAWRAHAVTHGSTPQVGRTDAYLQAASRATRSGIEGVVPNVWPINVFEPCWSLYTLHLAGLFAHPAFADAVRVIVAQLDARMGVRGLGPALHFAADADDTSVALCVLRLAGRDPPVDALRDFEIGELFVTFPGERNASVSTNIHALHALRLLGKPAAGTSYYVEANRNPHGLWDNEKWHVSWLYPTAHAVAALAQGKPQWRDERALAALLQAQRDDGGWGAGRASSFEETAYALFALHVMDGSEEPTGRRRIAQAVARALEWMLARHVAHALPQTALWIGKELYCPTRVVRVAELAGLWLALRWGRRVLAEGAGAAP

SEQ ID NO: 12203 - protein, 296 aa, Mesorhizobium loti
MMTLFRGLSAFPLTPTDAEGHVDTEGLARFLERIQRAGADSIGLLGSTGGYAYLTREERKRAVQAAVECIGGKTPLVVGVGALRTNEAQALARDAKSAGADGLLLAPMSYVPLNEDEVFQHFVAVAEAGELPLCIYNNPSTTRFTFSDALIARLSEVSNIVAVKMPLAANDDYAGELARLRSMTPDTFTIGYSGDWGAADALLAGCDTWYSVAAGLLPVPALALTRAAQSGDAVESTRLNRAFGPLWTLFKHYGSFRVMFVIADYLGLAHVQPPRPILPLPEDAGDDIRQALEKLE

SEQ ID NO: 12204 - protein, 607 aa, Mesorhizobium loti
MCGIVGIVGQQPVSERLVDALKRLEYRGYDSAGIATITDGTLHRRRAEGKLVNLERRLKEEPLGGTIGIAHTRWATHGPPTERNAHPHFTDGVAVVHNGIIENFAELKDELAATGAEFQTDTDTEVLAHLLARHRREGMRRGEAVHAMLKSVRGAYALAILFEDDPSTIIAARNGPPLAIGHGDGEMFLGSDAIALAPFTNEITYLIDGDWAVVGRTGADIFDYDGHPVARPRQTSVAVATLANKGSHRHFMEKEILEQPEVIADALGHYINFIENGADAVSGIDFAKIPSLAISACGTAYLAGLIGKYWFERYARLPVEIDVASEFRYREIPLSPQSAALFISQSGETADTLASLRYCKQLGLKIGAVVNARESTIAREADVVFPILAGPEIGVASTKAFTCQLAALAALAIHAAKARGTVTEDEVQALVESLAEMPRLMRQVLDSIQPEIELLSRELSKCHHVLYLGRGTNFPLAMEGALKLKEISYIHAEGYAAGELKHGPIALIDENMPVIVIAPHDRFFDKTLSNMQEVAARGGRIILITDGKGAAASKLDTMHTIVLPATDEIIAPMIFSLPIQLLAYHTALFMGTDLDQPRNLAKSVTVE

SEQ ID NO: 12205 - protein, 762 aa, Mesorhizobium loti
MSCCAPSAELALDLTSTTSVLPSSQEIRLASRSLGDNLWQTDLSVPTVHCAACIQAIETALGRLDRVEGARVNLSTKRVAIRWRGDSVPPFVAALGRLGFQAHLFEADPDKKDKTLAELIRAVAVAGFAAGNIMLLSVSVWSGAEGATRDLFHWVSALIAIPALTFAGGIFFRSAWNALRHGRMNMDVPIAVGVSLAYAMSLYETINHGDHAYFDASVSLLFFLLIGRTLDHVMRERARTAVKGLSQLAARGAMVLRGDGARDYLPVGEIEPGMQLLVAAGERVPVDSRVIRGASDLDCSLVSGESTPKTVASGEQVQAGTLNLTGPLTIEATAAAKDSFLAEMVRLMEAPEGGRAHYRRIADRVSALYAPVVHLTAFVTFLGWMAVTGDWHRAVTIAIAVLIITCPCALGLAVPIVQVVAARRLFEAGVMVKDGSAIERLAAIDVAVFDKTGTLTLGQPRLVNASTIDPAMLAIAADMAAHSRHPFSKAIAAFAGFAGQPKLEAVSEHPGLGIEATTADSTWRLGRRGWAGWKARTGGEGKYGGYGGTVLSKNGRIVASFTFEDATRADAKAAVGQLKDAGVSVEMLSGDIVHACGEVAGTLDIESFVPALLPSGKVERIEVLARAGHKVLMVGDGLNDTPALAAAHVSIAPATAADIGRNAADFVFLRESLLAVPLALDVSRQAGRLIRQNIAIAIVYNAVAVPIAILGHVTPLIAAIAMSASSLLVIGNGLRLQGFRLAELTRASSATHSGIHPSARSS

SEQ ID NO: 12206 - protein, 488 aa, Mesorhizobium loti
MSFKIAIIGAGSVGFTKKLFTDILCVPEFRDIEFALTDLSEHNLGMIKAILDKVVEANGLPTRVTATTDRRKALEGARYIISCVRVGGLEAYADDIRIPLKYGIDQCVGDTICAGGILYGQRNIPVILDFCKDIREVAATGAKFLNYANPMAMNTWAAIEYGKVDTVGLCHGVQHGAEQIAEVLGAKSRHELDYVCSGINHQTWFIDLRLNGRKIAKDELVEAFEAHPIYSQQEKLRIDVLKRFGVYSTESNGHLSEYLPWYRKRPDEITRWIDMSDWIHGETGGYLRYSTETRNWFETEYPQFLEAASKPIDPAKRSNEHASHILEALETNRVYRGHFNVRNDGLITNLPQDAIVESPGFVDRFGINMAAGITLPEACAATCMSSINVQRMSVHAAISGDIDLLKLAVLHDPLVGAVSTPEEVWQMVDEMVVAQAQWLPQYAHAVPAAKERLSKSAVKTREWAGAARRNVRSIEELRAEKAALKQAG

SEQ ID NO: 12207 - protein, 555 aa, Mesorhizobium loti
MTVVLAESFAPIVRHDHDGRQDQPIIDARNIEVAFKVEHGVVEAVKDISFQLYRGETIAIVGESGSGKSVTARAVMGLLSRRATVSPKSSICYDGQNILKFPESERRKLRGNRISMIFQEPMSSLNPIYTVGSQIVEAIRVHRKVSRRQAWARALELLRHVQIPEPEARLKQYPHQLSGGQRQRVMIAMALANDPDVLIADEPTTALDVTVQAQILNLIRNLQKELRMAVILITHDLTVVRKFSDYVYVMQHGAMCEHNVTERLFADPQHPYTQRLLAAEPRGRPQPLPEGSGAILEANDVRVCFMLRHGGFLKPDWRELVAVDDLGLRLCRHETLGLVGESGSGKTTFGQALLRLIDARRGEIRFDGQPIQGLSRNEMRPLRSRMQIVFQDPFSSLNPRMTIGQIIEEGLIVNSLGATRAERVDRVREALVSAGMPGDILSRFPHEFSGGQRQRIAIARAIALEPELILLDEPTSALDLSVQAQIIDLLRKLQDERGLSYLFISHDLKVVRALCHRVIVMQHGKIVEQGPVDEILTNPKTAYTERLVRAAFDVA

SEQ ID NO: 12208 - protein, 461 aa, Mesorhizobium loti
MPEVSMARHPRITFIGAGSTVFMKNIVGDVLQRPALSGATIALMDINPQRLEESAIVVNKLIATLGVKAKAETYSDQRKALAGADFVVVAFQIGGYEPCTITDFEVPKKYGLRQTIADTLGVGGIMRGLRTVPHLWKICEDMLAVCPEAIMLQYVNPMAINTWAISEKYPTIKQVGLCHSVQGTAMELAHDLSLPYDEIRYRSAGINHMAFYLKFEHRQPDGSYRDLYPDLVRAYREGRAPKPGWNPRCPNKVRYEMLTRLGYFVTESSEHFAEYTPYFIKEGRPDLIEKYGIPLDEYPKRCIEQIERWKDQAQAYRSAQRIEVEESREYASSIMNSVWTGEPSVIYGNVRNNGCITSLPRDCAAEVPCLVDASGIQPTYIGDLPPQLTALIRTNINVQELTVRALMSENREHIYHAAMMDPHTAAELDLDQICSLVDDLLAAHGDWLPAWARVSRKTEAA

SEQ ID NO: 12209 - protein, 430 aa, Mesorhizobium loti
MAITLRQSDADFEQRFAAFLTTKREVSEDVDAGVRQIIARVRAEGDAALIDYTQRFDRADLKSLGIAVSKQDIAAAYETADPKAIEALEFARDRIRSHHERQRPKDDRYTDATGVELGWRWTAIEAVGLYVPGGTASYPSSVLMNAVPARVAGVERVVMVVPAPGGIINPLVLVAADISGVTEIYRVGGAHAIAALAYGTETIKPVAKIVGPGNAYVAAAKRQVFGTVGIDMIAGPSEVLVVADGSNNADWIAADLLAQAEHDVSAQSILITDDPAFGKAVEQAVERQLQTLPRGETAAASWRDFGAVIEVATIEAALPLVDRIAAEHVELAIDDAEGFLSRMRNAGAVFLGRHTPEAIGDYVGGSNHVLPTARSARFSSGLSVLDFVKRTSILKLGPEQLRVLAPAAIALAKAEGLDAHGRSVAIRLNM

SEQ ID NO: 12210 - protein, 430 aa, Mesorhizobium loti
MDRIRIVGGNKLAGSIPISGAKNAALPLMIASLLTDDTLTLENVPHLADVEQLIRILGNHGVDYSVNGRREKQNEGYSRTINFSARNIVDTTAPYELVSKMRASFWVIGPLLARMGEAKVSLPGGCAIGTRPVDLFLEGLQALGADLDVDTGYVIAKTKNGRLVGNRYVFPKVSVGATHVLMMAASLAKGETVLENAACEPEIVNLAECLNAMGARISGAGTPTITIDGVESLSGARVRVIPDRIETGTYAMAVAMTGGDVVLEGARPELLQTALDVISQTGAEITQTNSGIRVKRNGAGISPVDVTTAPFPAFPTDLQAQFMGLMTMAKGKSRITETIFENRFMHVQELARLGAHITLSGQTAIVDGVAKLKGAPVMATDLRASVSLVIAGLAAEGETTVNRVYHLDRGFERLEEKLSNCGAVIERISA

SEQ ID NO: 12211 - protein, 271 aa, Mesorhizobium loti
MTNRLVLAGCGNMGYAMLSGWLKSGKLAPSAVFVIEPNAELRQRAATLGCATSADAGEIPADAVPDLVVIAVKPQVIRDVTAAYKRFGDGRTTFVSIAAGTPVATFEDILGNRAPVVRCMPNTPASIGKGMMVVFSNPLVSDDTKRFVADLLSASGEVATIDDEGLMDAVTAVSGSGPAYIFHFIEALTVAAEKAGLPSATARLLAMQTVYGAASLAAESQEEPGVLRQQVTSPNGTTAAALAVLMGEDRLTNLLTQAVEAARLRSIELGK

SEQ ID NO: 12212 - protein, 299 aa, Mesorhizobium loti
MAEVIDGKSVAEDVVRTVKALTAELVAKGKAKPGLAVVIVGEDPASQVYVASKSRTAKECGFHSLQHTLPAETSEEALLKIIADLNADPAVNGILVQLPLPAHIDAGKIIQAIAPQKDVDGFHFINVGKLGTGELDTAFVPCTPAGSMLLIQRVRGKDLSGLNAVVVGRSNIVGKPMANLLLAANCTVTIAHSRTKDLPALARTADILVAAVGRPEMIKGDWVKPGATVIDVGINRIPAPEKGEGKSRLVGDVAYAEAARQAGAITPVPGGVGPMTIAMLMANTLASAYLAAGLKRPTF

SEQ ID NO: 12213 - protein, 489 aa, Mesorhizobium loti
MTSQIIPVDPFDFIIFGGTGDLSERKLLPSLYYRQRDHQFSEPTRIIGTSRSKMSDEEFRAFASQAISDHVKPADIDAKELKTFLARLSYISADATSGAGFDKLKKAIGESESIRAFYLAVAPALFGDISHKLKENKLITPNSRIVLEKPIGRDLASARALNDLVGDDFHESQIFRIDHYLGKETVQNLMALRFANALYEPLWNSAHIDHVQITVAETVGLEDRVTYYDKAGALRDMVQNHMLQLLCLVAMEAPSSMDADAVRDEKLKVLRALKRINGNEAPKHTVRGQYRAGASAGGPVKGYVEELGKDSNTETFVAIKAEIGTWRWAGVPFYLRTGKRLATRVSEIVIEFKPIPHSIFGDSAGPIFANQLVIRLQPDEGVKQFIMIKDPGPGGMRLRQISLDMSFAQSFDGRAPDAYERLIMDVIRGNQTLFMRRDEVEAAWKWIDPIQNAWEGAKQEAQGYTAGTWGPSASIALIERDGRTWHESN

SEQ ID NO: 12214 - protein, 253 aa, Mesorhizobium loti
MSGQGMRLENKVAIITGAASGFGEGMAKRFAQEGARVVVADLNAKGAERVASEIGEAAIWTQTDVSLRSEFDEMVYAAKSAFGRIDIMVNNAGYTHRNGDMLKVDEETFDLITAVNMKAIYHAALAVVPIMERQGGGVILTTASTAGLRPRPGLTWYNASKGWAITATKSMAVELAPKNIRVNCLCPVAGETGMLEKFMGADTPQIRETFRASIPLGRLSTPLDIANAALWLASDEAAFITGVALEVDGGRCI

SEQ ID NO: 12215 - protein, 652 aa, Mesorhizobium loti
MAAEVPLWTPTQDRIDASPLTAFLKAAEAKAGATFASYADLHRWSVEDREGFWSLVWDFCGIAGEKGERLLADGDKMPGASFFPDATLNFAENLLKKTGAGEAIVFRGEDKVERRLSWNQLHGLVSRLQQLFLSLKVKKGDRIAAMMPNMPETVAAMLAAASIGAVWSSCSPDFGEQGVLDRFGQIEPVIFIGPDGYWYNGKAIEVADKVAAVAAKLGSVRKVLLVDYLGTSADVAATIDKAVAMEEALSPFAAKPVSFEPLPFSHPLYILFSSGTTGIPKCIVHSAGGTLIQHVKEHRLHAGLVDGDRFFYFTTCGWMMWNWLVSGLASGATLLLYDGSPFYPDGNVLFDFVDAEKMTFFGTSAKFIDSVRKAGLKPIRSHDLSTVRAISSTGSPLSPEDFRFVYEGIKKDVHLASVSGGTDIVSCFVLGVPNQPVWTGEIQGPGLGLAVDVWDDDGKPIRQEKGELVCTKAFPSMPIGFWNDPEGKKYQAAYFERFDNVWCHGDFAEWTAHGGMIIHGRSDATLNPGGVRIGTAEIYNQVEQMPEILEALCIGQDFDNDVRVVLFVRLAAGVELDEDLEKRIRAKIRSGASPRHVPARIVAVTDIPRTKSGKITELAVRDVVHGRAIKNKEALANPEALELFRNLPQLAE

SEQ ID NO: 12216 - protein, 425 aa, Mesorhizobium loti
MNYQRFFEEAIDQLHAERRYRVFADLERIAGKFPRAIWRSNGRAEEITVWCSNDYLGMGQHPDVIAAFQNAAGKMGSGAGGTRNISGTSNPLVELEHELADLHGKDAALVFTSGFVSNEASISTIARLLPNCLIISDELNHASMIEGVRRSGAEKKIFRHNDVAHLESLLQAAGRERAKLIVFESVYSMDGDIAPIREIVELAERYNAMTYIDEVHAVGMYGPRGGGITEREGLADRIDIIEGTLAKAFGTLGGYITGTSAVIDAVRSYAPGFIFTTALPPAIAAAATTSIRHLKRSQAERDAQQQQAARTKQILSAAGLPVMESPTHIVPVLVGDPELCKMASDRLLGVHGIYIQPINYPTVPRGTERLRITPTPFHSDALIAGLQDALVETWDALGIPYGAAGRPAVAKSDRIVPLIMAKAGG

SEQ ID NO: 12217 - protein, 762 aa, Mesorhizobium loti
MSCCAPGAEMARDLESSMSVLPSSQEIRLASRSLGGGLNQTDLSVPMVHCAACIQTIETALGKLDNVEGARVNLSTKRVAIRWRGNEVPPFVAALGRLGYQAHLFEAEIDNKDKTLAELIRAVAVAGFAAGNIMLLSVSVWSGAEGATRDLFHWVSALIAIPALAFSGGIFFRSAWNALRHGRMNMDVPIAVGVSLAYAMSLYETINHGDHAYFDASVSLLFFLLIGRTLDHVMRERARTAVKSLSQLAARGAMVLRGDGARDYLPVGEIEPGMQLLIAAGERIPVDGKIIQGASDLDCSLVSGESTPRNVAPGEPVQAGVLNLTGSLTIEATAAAKDSFLAEMVRLMEAAEGGRSQYRRIADRVSALYAPVVHLTAFVTFLGWMAATGDWHRAMTIAIAVLIITCPCALGLAVPIVQVVAARRLFENGIMVKDGSAMERLATIDTAVFDKTGTLTLGQPRLVNASSIDPAMLSIAADMAAHSRHPFSKAIAGFAAPGGQHKFDAVTEHPGFGIEATDGGSTWRLGRRGWAGWKARTGGEGKHGYGGTVLTKNGMIVACFVFEDALRADAGAAIDQLKHAGMSVEMLSGDTAAACAEVAKVLGVDDFVPCLLPSGKVERIETLAEDGHKVLMVGDGLNDTPALRAAHVSIAPATAADIGRNAADFVFLRESLLAVPLALDVSRKAGQLIRQNIAIAIVYNAVAVPVAILGHVTPLIAAIAMSASSLLVIGNALRLQASMPNSPAKDVRRNRQSDFNELARSS

SEQ ID NO: 12218 - protein, 505 aa, Mesorhizobium loti
MNKVEFSRPVKAPFDKRYGNFIGGKWTEPRSGRYFENHSPVNGQLLCEVARSDADDIEAALDAAHAAKDAWGRTSVAERSLILNRIADRMEENLDLLACAETWDNGKPIRETTVADLPLAIDHFRYFASAVRGQEGSLSQIDDDTVAYHFHEPLGVVGQIIPWNFPLLMACWKLAPALAAGNCVVLKPAEQTPAAILLWADLIGDLLPPGVLNIVNGFGLEAGKPLASSPRIAKIAFTGETTTGRLIMQYASQNLIPVTLELGGKSPNIFFKDVVAEDDDFFDKAIEGFVMFALNQGEVCTCPSRALIHESIYDRFMERALKRVEAIVQGDPLDPATMIGAQASSEQLEKILSYIDIGRQEGAEVLTGGARNVLPGDLAGGYYVKPTVFRGHNKMRIFQEEIFGPVVSVTTFKDDDEALSIANDTLYGLGAGVWTRDGNRAYRFGRAIQAGRVWTNCYHAYPAHAAFGGYKQSGIGRETHKMMLDHYQQTKNMLVSYSPKKLGFF

SEQ ID NO: 12219 - protein, 600 aa, Mesorhizobium loti
MKLTGGQIVARALKEYGVEYVAGVPGHGIWSLFDAFLEEGSTLPFIQVMHEQSAVHMADGFFRASGRPMACSTSIGPGATNTIIGLATCYADSIPAFFVSGGPATHMKGHGVMQEIERQNENAFPRITEQVTKRAYKAGRVDELPFIMHRAFNTMLSGRPGPVHVEVPMDIQVEAADVEIHPLDLRMARGVSYPDPKAVERAVKLLLSAERPVIVAGGGAISANASGELTRLAEKLGAAVSITWNGKGAISEDHALFIGAVGQTGTTCGNSITASADVIMSVGCRFTDWSASSYAKGVSFSIPPGKLIHIDLDHHEIGKNYPTEVGIVADAKATLEAMLAMISEAESKKAVMRRDRFLADVQKAKADWEALLAPRRDSRESPFTSQRPLGALRTVMSRDGIVVVGSGNTQGAVKQTFPIYQPRTHLTSGSFSPMGWAVPAAMGAKLAMPDRQVVSITGDGDFMMSLPELGTAVMNNIPVVFLVQNNQGYMSIRGGQRKFMGRHIASEFNRHKGNGEPYSADIAAVARNFGVESWKVTADEDLEKSLKAALDCGGPALVEVITSRDAAGPFATGWWDFPSPAYYEKEQAAYTEKRVLEQHM

SEQ ID NO: 12220 - protein, 500 aa, Mesorhizobium loti
MPPAGGIFHRPPTTRKSRRLTPRSACSNSTCSRTWGEQPWLLALHSIDSDRNAGRRPCKRRAIAMIRTIKSARGSVVNGGNGAMTSAVQTLLDQVEQGGDRAVRELSIRFDKFDRDSYRLTKAEIDACINSLTGREREDLDFAQDQIRNFAEAQRATLLDLEIETLPGVVLGHRNVPIQNVGCYVPGGKYPLLASAHMTVLTARVAGCERIITCAPPFQGKVAEKIVAAQALAGADEIYCLGGVQAIAAMAYGTETIAPVDMVAGPGNAYVAEAKRLLFGKVGIDLFAGPTETLVIADDSVDGELVATDLLGQAEHGVNSPAVLITNSEKLALDTVAEIGRLLTILPTAAIAAKAWEDFGEIILCETTKEMVAEADRLASEHVQVMTRDPDHFLNSMRNYGALFLGARTNVSFGDKVIGTNHTLPTNKAARYTGGLWVGKFLKTCTYQRILTDEASALIGEYGSRLSLMEGFVGHAEQSNIRVRRYGGRNVGYAMPVDPR

SEQ ID NO: 12221 - protein, 499 aa, Mesorhizobium loti
MMEHTADIVIIGSGIGGSSLAYSLADTGRRIVILERGEHLRDTPEARDDIAIFQNGFYRSSEEWLATDGESFLPGNYYYVGGNSKFFGAVMYRYRQEDFNPRDHMGGRSPGWPISYAELEPWYERAEILFGVRGDARQDPTEPPRNRPYRYLPVPDEPAIATVRQRLLQAGIHPASLPLAIDIDAWLRRAKTGWDAFPNTGAGKIDAEVGPLTKALEHPNATLITGANVQRLVTDASGRRVMAAVFIKDGVELSIGADVFAVAAGAVQSAALLLRSSTSVYPNGLGNSSDQLGRNFMNHNTTAMLAIDPFRRNTAVYQKTLGFNDFYNKDPLGSFPLGNVQLLGHITGNILKANAPLLPRWLAGLVARNCYGWFLTSEDLPNPESRVTIRNGRIVMNWVRNNMGAHETLIRRTRAVMREAGFPVVLTRTFGRKTTSHQCGTARLGSDPNTSVVSPDCRSHDIANLYVTDASVLPTSAAVNPALTIAALALKAGAAIRAM

SEQ ID NO: 12222 - protein, 548 aa, Mesorhizobium loti
MANFGSARWGILPRSETVAGKCDYIVVGGGSTGCVVASRLSENADVSVVLLEEGPNDINPYIHIPGAYYKTAQGPLLKRIPWEPMAGQSPDATPTMVQASVLGGGSSVNAMIYIRGVPSDYARWEELGASGWNYGDVLPYFLRSEDNNRFCNEAHAVGGPLGVSDIDNIHPLTRAWLQACQQAGLPYNHDFNSGDQAGSGLYQITARNGLRSSAATAFLKPVRRRPNLQVRTRARVSRIIVEQGRATGVEYFVNGRRWVLHAEREVILSAGAISSPKLLMLSGIGPADALRRHGIQVEMDLPGVGQNLQDHIEMSLVYQLNGPHSYDKYKKLHWKAAAALNYLLFRGGPASSNLIEGGAFWWGNKNETVPDVQFFMVVGAGIEEGVDTVPGGNGCTVNLGQIRPRSRGEVTLQSANPAENPRVAPRYFSDPYDLDAVTEGTMAALDIMEKPAISRYIAARQTPAPTMKTRSDIRNFCLETAHAALHPAGTCRMGQDEMAVVGPDLRVRGIDGLRVADASVMPTLISGNPNAVCIMIGERAASFLSEAA

SEQ ID NO: 12223 - protein, 253 aa, Mesorhizobium loti
MILKDRTAIVTGAGSGIGRAAALIIAREGAMVGVADRSADGANATVDQILAAGGRAKALVFDLTDDQALEAGFHDFIHTQGRIDILHNHAGVQVEGDVLGVSVKGFDTSWTLNVRAHFLGARIVMPFMKKAGRGVILNTSSSSGVLYDREMIAYTTTKHAVIAMTRQMAGDYGRFGIRVNALCPGWVDTPFNAPFIAQMGGREAIEAYIRERVPLGRWATVEEIAEAVLFLVSDRSSYMTGQILVVDGGETVI

SEQ ID NO: 12224 - protein, 427 aa, Mesorhizobium loti
MYDFGPFEFESKQDFFDKAMRFWNPDKTRFWQKAGIDLVIGKREGYFLYDMSGRRLIDLHLNGGTYNLGHRNPELVETLKSALDYFDIGNHWFPSVARTALAESLVNVSPGMKYAIFAPGGAEAVDIAIKSARYATKRRKIVSIIKGYHGHSGLAVATGDDRFTKIFLSDQPETFIQVPFNDIDAMERALEGEDVAALIMETIPATYGFPMPKDGYLSACKALCEKHGAMYIADEVQTGLMRTGSMWGWQAYGVQPDIMVTAKGLSGGLYPISAALVNERAGGWLNEDGAAHISTTGGAELGCVVGHKVIEMLQRPELVANVGTVTEFMAQAMREMLVRHGDIFTGVRQKGVILGLEFSNHLEGAVFVSRALYEQGVWAIFSSLDKRVLQWKPGVLLDHETCRDIMDRFDAAMPRARELLHQAGKAS

SEQ ID NO: 12225 - protein, 254 aa, Mesorhizobium loti
MTQSLKGRSVVVTGGSKGIGKGIARVFALSGAKVAIVARHPDQAEAAAAEIGHGAFGVVGDVTSLASIESALAVVAARNGSIDVLCANAGIFPQARLEDMTSQQWDEVVDTNLKGTFHAVKAAVPYLKTSNQGRIVLTSSITGPITGFPGWSHYGATKAGQLGFMRTACIELAKYGITVNAVMPGNIVTEGLVGLGEDYQKTMAASIPLKRLGTVEDIGYAALYFASKEAGYVTGQTIIVDGGQILPESLEALA

SEQ ID NO: 12226 - protein, 412 aa, Mesorhizobium loti
METKFGVHSEVGQLRKVMVCAPGRAHQRLTPSNCDALLFDDVLWVDNAKRDHFDFMTKMRDRGVEVVEMHNLLAETVAVPEGKKWILDNQVVPNQIGLGLVDEVRSYLEGLSNRDLAETLIGGLSTHEFPESIGGEQLELIRDAAGVNEYLLPPLPNTLYTRDTTCWIYGGVTQNPLYWPARHEETILTTSIYKFHPDFAGKVNVWWGDPTKDWGLATLEGGDVMPIGKGNVLIGMSERTSRQAISQLAATLFEKGAAERVIVAAMPKLRAAMHLDTVFTFADRDCVLLYPDIVNGIEAFSYRPDGKGGVELHKDKGTFVETVRDALGLKKMRVVETGGNAYMRERTQWDSGANLVCASPGVVYAYDRNTYTNTLLRKEGIEVITIIGAELGRGRGGGHCMTCPIIRDAVDY

SEQ ID NO: 12227 - protein, 477 aa, Mesorhizobium loti
MTGKSEQKLSLFALIGMVVGSMIGAGIFNLPGRFATATGPFGAIIAWCIAGTGMYMLARVFQALAEKRPDIDSGVFAYAKAGFGDYMGFLSAFGYWLGSCLGNVFYWVLIGSTLGRFFPGIFGDGSTAIAIIVSLVGIWAFHFMILRGVEQATFINSVVTVAKIVPIIVAILAMAIAFNYTQFSENFLGGVGMPEKTLVAQVRDTMLITVFVFLGIEGASVYSRFAQKRSDVGTATILGFVGVTGLMVAITLLPYATAPRAAIAGVQQPSLAGALELVVGHWGAVFISVGVLVSVLGAYLAWSLICAEVLFAAAKSQDMPKLFAAQNGNRVPANALWLTNIVVSLFIISTYWSRDAFNFMLDMTSVTALLPYLLVAGYGVLIARRGEGYQTTPGERGRDQLFAWIAVVYTLIMFVAAGLKYVLLVAVLFVPGTILYLWARREQKARFFTSVELIIFAVTLVAGLAGFVGLLTGAITP

SEQ ID NO: 12228 - protein, 511 aa, Mesorhizobium loti
MLHDYLAHSARRLGDKVALVCGKQRVTYGELEARANAIATDLAASGVARGDRVMIFADNTVETVVSFWAVLKANAVVCIVNPLTKSDKVDYLLNDCRPAALITDAHLHAIFREPARGCQSLLRMIVSGSIDDPELSRLPRAVRWDTAVGNGGDAPPARRCIDIDLAAIIYTSGSTGEPKGVMLTHRNMMTACTSIASYLELAEDEVILNVLPLAFDYGLYQMIMAFRTGARLVLERSFAFPAQVLGLIRQEGITGFPGVPTIFAALSELRSLKDQDFSSIRYVTNTAAALPLKHILMLRELFSSARIYSMYGLTECKRCTYLPPEDLKRKPLSVGIAIPNTEMWIVDEHDRRVGPGVVGQLVIRGATVMKGYWGKPEATARKLKPGPLPGEQVLYTGDYCRMDAEGYLYFVGRGDEIIKSRGEKVAPKEVENVLMDIPGVREAAVIGVPDELLGQAVKAFVVMENGRTIGEKQLQMECQKRLENFMVPKSIVVVASLPMTDTGKLKKTALS

SEQ ID NO: 12229 - protein, 334 aa, Mesorhizobium loti
MSYSGKKVLVTGADGFIGSHLTEALVRNGADVTALALYNSFDSHGWLDDLPDKIRSQLKLVRGDVRDSAFLNRIVRGQAVVFHLAALIAIPYSYAAAQSYVETNILGTVNVLEAARQWETERVVHTSTSEVYGTAQTMPIRETHPLQGQSPYSASKIGADMMAESYARSFDVPVVIMRPFNTYGPRQSERAIVPTIVRQALDPKCPSIMVGDTSPIRDLTFVEDTAAAFLTAGLAGLEFGHAYNAGSQRAATISDVLDLVLELSGSKKPVHRDERRLRPQNSEVRALLADSSRFEGETGWRAQTSLRDGLERTIAWWRARLSEGRVRREMGYMT

SEQ ID NO: 12230 - protein, 607 aa, Mesorhizobium loti
MCGIVGIVGHSQVTSLILTTLKRLEYRGYDSAGVATIEHGELARRRAEGKLINLERRLKEEPLDGTIGIGHTRWATHGVPNETNAHPHFSDGVAIVHNGIIENFAELRDELVRDGYAFSSQTDTEVVAHLVARELAKGLKPVEAAHQALKRLEGAFALAIMFKGDEDLIVGARNGPPLAVGHGDGEMFLGSDAIALAPFTNSITYLEDGDWAVVRRDSVAIFDIDGKKVERKRQQSLSTSFMVDKGNRRHFMEKEIHEQPEVISHTLAHYVDFVSGVSKPLDLPFDFAKIGRLAISACGTAYLAGLIGKYWFERYARLPVDIDVASEFRYREMPLSANDAAFFISQSGETADTLASLRYCRKAGMKIGAVVNVRESTMARESDVVLPTLAGPEIGVASTKAFTCQLSVLASLAVRAGVARGVISQEQEKTLVRALSEAPRYANQVLKLEEQIERIARELSRYKDVLYLGRDTNFPLAMEGALKLKEISYIHAEGYAAGELKHGPIALIDENMPVIVIAPHDRIFEKTVSNMQEVAARGGKIILITDSKGAAQVSVKTMETIILPDVPEIISPIIYALPIQMLAYFAAVFMGTDVDQPRNLAKSVTVE

SEQ ID NO: 12231 - protein, 310 aa, Mesorhizobium loti
MRCKIVGAPVQDGAGRMGCEMGPSALRTAGLAEVLSGLGHTVEDMGAVQPMPARRVVHGNLALKALPEISAWTSAIAAAAYAASEDAMPIFLGGDHSISAGTVSGLARRAAEAGRPLFVLWLDAHPDFHTLDTTASGNLHGVPLAYASGQPGFSGYFPDLPAAVDPKRICTMGLRSVDPAERSALNQAGVTVHDMRAIDEHGIAPLLRAFLARVSDEDGLLHVSLDVDFLDPSIAPAVGTTVPGGATFREAHLVMEMLSDSGLVSSLDLVELNPFLDERGRTATLMVDLTASLMGRRIMDRPTRSHSGSF

SEQ ID NO: 12232 - protein, 520 aa, Mesorhizobium loti
MADGVRMTRAKVEHAPNCDIVIVGGGSAGSLLAARLSEDPDSRVLLIEAGEEPTDPDIWNPAAWPALQGRSYDWDYRTEAQAGTAGRAHHWARGRLIGGSSCLHAMGYMRGHPSDFQAWVDASGDRRWGWDELLPVFQAIEDHPLGGDGIHGKGGPLPIHLPADEVSPLARAFIEAGASLGLPRLEGHNSGEMIGVTPNSLNIRDGRRVTAADAWLTKAVRGRKNLTILTGSRVRRLKLEGNQVRSLEVVGRQGSAEVFADQIVLCAGALESPALLMRSGIGPHDVLDAAGVGCLIDMPDIGRNLQDHLLGAGNLYAARKPVPPSRLQHSESMAYMRADSFTAAGQPEIVVGCGVAPIVSESFPAPAAGSAYSLLFGITHPTSRGSVRISGPELGDRLIIDPAYLQTGRDRERFRRALEASRTIGHRDELAGWRERELLPGTPNSAAEMDDFIARSVITHHHPCGTCRMGKDPDAVVDANLRLKALDNLFVVDASIMPNLTAGPIHAAVLAIAETFARQY

SEQ ID NO: 12233 - protein, 543 aa, Mesorhizobium loti
MPHAESYDYIIVGAGSAGCVLANRLSADPRCSVLLLEAGGWDRDPMIHIPLGWGKILTERRHDWMYFCEPEDNVGGRRVECARGKVIGGSSSTNAMAYVRGNRGDYDRWAATGLSEWSYDKVLPYFRKQESWEGGANQYRGGNGPVSTQFCRYKDTLIDAFAQASVQAGYAQTKDYNGERQEGFGRLQMTISKGRRASTASAYLRPVLKRPNLTVLTEASATRIVLEGARATGVTINHRGGERTVLARKEVLLAGGVINTPQLMMLSGIGAQDELAAHGVQTRVNLPAVGKNLQDHVSVILMYRRRAPGGPFLRNMRADRIGFDFVKTYLTGRGFSGDVPGGVVAFLKSGPARPLPDVQLLFTAAPLAAWPYFKPFKAPFADGFATRIVATQPESRGAVKLASADPSAAPLIHQNFLASPKDWESLRAGFRVARDLAAQPSMQPFIEAEFFPGPKCQSDDEIDEHIRKTSITVHHPAGTCRMGADAASVVDPQLRVRGVDRLRVVDASVMPDLVCGNINAAVIMIAEKAADLIASSKEGRAVQ

SEQ ID NO: 12234 - protein, 309 aa, Mesorhizobium loti
MIRNIAIIGLGTMGPGMAARLARGGLQVVAYDVAPAAIERARSMLSVAETVLDALGIALPSAGVGTVRFTDDIGDAVSGADLVIENVPENISIKADVYRTIDGLIGQDTIVASDTSGIPITKLQAHISYPERMVGMHWSNPPHIIPMIEVIAGEKTAPQTVATIRDLIRSIGLLPVVVKKDVPGFVENRVLYALLREAVDLVERGVIDPEDLDTCVSWGIGYKIAVIGPMALLDMAGLDIYKSVSSFLNADLSNRDDVAPMVLEKTSASKFGIKSGEGMFCYTPEQTKALQAERARKLVAVRRILEGRE

SEQ ID NO: 12235 - protein, 539 aa, Mesorhizobium loti
MICSPLRLITILWCRAFMSGSSSSSVAGRDIVALEGVTKRFPGIVANDSVDLSIRPGEVHVLLGENGAGKSTLIGMLSGLQQPDEGRILVDGKPTPITSPRHALALGIGTVFQHMMLVPTLTVAENLLLGGPWWQRPRTEELEARVAEITRSLGITVKLHAKVSELSLGEQQQVEILRAMVRNSRLLILDESTSMLTPKGIDELGALMRRLVEQGLAIVFITHKLKEAAAFGDRISVLKLGRKVGEIPPERFRALDEQAIISEIVELMFGKQKDDPEAVGRPVRTVQAEAAPLLQVVDLAVAPTDNAPGLSSISFDIRPGEILGIAGIDGNGQKQLAEALAGQRAATSGSVRLEGVAIEALSVGERRRRGLRYLTDDRLGEGTVGTFPVSINFFLKQVGAAPFWRHGVEQRGEIDRRAVELVREYDVRTPSLKTPVARLSGGNIQKVLLARELAEGAKVVIFNKPTYGLDLANTLASRQRIRDTAARGLAVLLISTDLEELLVMCDRVAVIASGALVGTVENTDDARTRIGRLMIGLAA

SEQ ID NO: 12236 - protein, 320 aa, Mesorhizobium loti
MTANVFSGCMPALMTPCTQDRQPDFDALVRKGRELIAAGMSAVVYCGSMGDWPLLTDEQRMEGVERLVKAGVPVIVGTGAVNTAKAVAHAAHAQKVGARGLMVIPRVLSRGPSVTAQRHHFKAILAAAPGLPAVIYNSPYYGFATRADLFFALRAEHPNLVGFKEFGGPSDLRYAAENITSRDDEVALMIGVDTAVFHGFVNCGASGAITGIGNVLPKEVLHLVGLSQAAAKGDVEARQRALELDAALAVLSSFDEGPDLVLYFKHMMVLKGNPEYKLHFNETDALTDSQRGYAEAQLKLFDSWYAQWSRQPGVIARSAA

SEQ ID NO: 12237 - protein, 287 aa, Mesorhizobium loti
MQAGARKYPEPPFPEQHHPKPGDEWAIDPAPLYDAPFYLGSKKLEDKVALITGGDSGIGRSVAVLFAREGADIAIVYLAEDRDAKATKSAVEAEGRRCILVKADVSERDQCRNAVAQTVKAFGRIDVLVNNAAFQIHSSEFAELTEEHFDTTLKTNLYGYFHMAQEAVPHMKPGSAIINTGSVTGIDGSKALVDYSMTKGGIHAFTRALSGNLLGKGIRVNAVAPGPVWTPLNPSDKEAGDVSKFGADTPMKRPAQPEELAPAYVFLASPHCSSYITGEILPVVGGY

SEQ ID NO: 12238 - protein, 261 aa, Mesorhizobium loti
MSDFENKVALITGTTGIALATARRLAQGGAAIIACGIDRAANAAMQESLAKAGADALVQTVDVSISDQVRDAVVAGVAKFGGIDVIVNSAAVHPYGTATTTDWETWNRAMSVNVGSIYLTAHFGIPEMIKRGGGAIVNVASVQGFACQQNVAAYATTKGAIHTLTRSLALDYAAAGIRVNSVSPGSIRTPILEKAARGDHGSDADVEEAYKRFGAAHPLGRIGEPEEVAEFIAFLCSSKASFCTGADYKIDGGLTAGIGVR

SEQ ID NO: 12239 - protein, 366 aa, Mesorhizobium loti
MPACSIGWVFRTEISSNIRKALGKELDMPRIVPVLDLSRLEQGASERRTFLADLRSASRDIGFFYLAGHGISWAEISEVLTASRQFFALPEADKLAIEMVKSSQFRGYTRAGGELTKGREDWREQLDIGVERQAIAQGPGTPAWTRLQGPNQWPAALPDLKPALLAWQSKVTAVAIRLLKAFAQSLDQPEDAFDPIYSSEPNHRMKIVRYPGRDTTGGDQGVGAHKDGGFLTLLLQDDNKGLQVDYDGSWVDVDPIPGTLVVNIGELLELASNGYLRATVHRVVTPPAGVERISVPFFFSARLDATIPLLGLSEELAAQARGPASDPDNPLFRDVGTNVLKSRLRSHPDVARRHYADLLKGESRVG

SEQ ID NO: 12240 - protein, 475 aa, Mesorhizobium loti
MRIIVPGEGVVDAANAMRAFESDGLTAYRQLPLVVVLPETVAQVSRVLKYCNDRNIRVVPRGSGTSLSGGALPLEDAVLLVMSRFNRILAIDFPNRIVVAQPGVTNLGITTAVEQEGFYYAPDPSSQIACSIGGNVAENSGGVHCLKYGLTANNVLGIEMVLMNGEVVRLGGSHLDAEGYDLLGVMTGSEGLLGVVTEVTVRILKKPETARALLIGFPTSEQGGQCVADIIGAGIIPGGMEMMDRPAIHAAEDFVHAGYPLDVEALLIVELDGPGVEVDHLITAVEAIAISNGSTTCRISQSEAERLSFWAGRKAAFPAVGRISPDYYCMDGTIPRKELPRVLAGMRELSEKYGLGVANVFHAGDGNLHPLILYDANVPGELDKAESFGADILRLCVKVGGVLTGEHGVGVEKRDLMPEMFNQVDLDQQMRIKCAFDPNHLLNPGKVFPQLRRCAELGRMHVHRGQVAFPDIPRF

SEQ ID NO: 12241 - protein, 306 aa, Mesorhizobium loti
MSLPDDSRYLKGGPVAQRIIAAVREDAAIAKAEGFPPKLISITVGDTDAVDVYVRNQRAKAQLAGIDFEERRFPATITSGELEAAIHGLNADPRVTGIIIQRPVPAHISVKTLQAAVHPLKDVEGMHPASIGNIVYNQLDLAPCTAAASVELLKETGLDLKGLEVVVVGHSEIVGKPIAFLLMSEGATVTVCHHLTRSVAAHARRADALFVAVGKPRLIKADMVKPGAAVIDIGINSEIGPDGTSRIVGDVDTDSVKDVASWITPVPGGVGPITVAILLRNTMVALSRQRALYEATYGTADRLAAE

SEQ ID NO: 12242 - protein, 590 aa, Mesorhizobium loti
MPVNLDELKNATNLRGRAARAGSVFIAPVDGRAHVSGDRKVPLLDKTIPALFSDTASKYATQDAAVFVGQDKRFTWSELSDTVDALAAGFLALGLEKGDRVGIWSPNRWEWLVTQFATARIGLILVNINPAYRLTELEYALNKVGCKALVTAASFKTSDYLGMIETLAPEIAKATPGKLKAQKLPALKIVIRMGEDNSPGMFNFADVLAMAGRDEHDSLDRISEGLKPGDAINIQFTSGTTGAPKGATLTHHNIVNNGNFVTSAIKLTVDDRLCIPVPLYHCFGMSMGTMGCVTKGATMVFPGEGFDPGATLKAVAQERCTGLYGVPTMFVGMLDHADFATFDLSSLRTGIMAGSPCPIEVMKKVVSLMHMSEVTIAYGMTETSPVSFQSGVDDPLEKRVSTVGRIHPHVEVKAIDADGATVAVGAPGELCTRGYSVMKGYWDDAEKTREAIDSDGWMHTGDLATIDAEGYCNIVGRVKDMVIRGGENVYPREVEEFLYRHPKVREVQVFGIPDAKYGEELCAWIVLKPGQIATEQEIKTFCAGQIAHYKIPRHIRFRTELPMTVTGKPQKFLMRQAMVEELGLVAQKTA

SEQ ID NO: 12243 - protein, 756 aa, Mesorhizobium loti
MRSPVGPKILAKNQIKPRQNRSSDMDAKTDDNSAGKCPVAHGSAGRTNRDWWPNQLNVQILHQQSSLSDPMGEAFDYAEEFKSLDLDAVIKDLHALMTDSQEWWPADFGHYGPLFIRMAWHSAGTYRIADGRGGAGAGQQRFAPLNSWPDNVNLDKARRLLWPIKQKYGRKISWADLLILTGNVALESMGFKTFGFAGGRADVWEPEQDVYWGPEGKWLADERYSGDRDLQNPLGAVQMGLIYVNPEGPNGNPDPLAAARDIRDTFARMAMNDEETVALIAGGHTFGKTHGAGDASLVGVEPEGADIEQQGLGWASKFGTGKGGDAIGSGLEVIWTTTPTKWSNNFFDNLFGFDWELTKSPAGAHQWTPKGGAGAGTVPDAHNSAKRHAPSMLTTDLALRFDPSYATISKRFHENPDQFADAFARAWYKLTHRDMGPVARYLGPLVPKEELPWQDVIPVVDHVLIDEQDAEALKAEILASGLSVSQLVSTAWASASTFRGSDKRGGANGARIRLSPQKDWAVNQPAELAKVLDKLQAIAKDFNAAQTGSKKVSLADLIVLGGNAGIEKAAKAAGHSVDVPFWPGRMDASQEQTDIHSFAPLEPTVDGFRNYVSGKQRLTVEEALVDRAQLLTLTAPELTVLVGGLRVLGANAGQSKHGVFTKQPETLSNDFFVNLLDMGTEWKATSDAKDVFEGRDRKTGEVKWTGTRADLIFGSHSQLRALAEVYATADAKAKFAKDFVVAWTKVMNADRFDIAG

SEQ ID NO: 12244 - protein, 466 aa, Mesorhizobium loti
MVEPALSLNETGAPTNERFHLIQAAPLAGSIGAEARELITSSEDIFVTDQSGRKLIDGPAGMWCINVGHRNQALADTLRDQAMSMTYSTPWYTSNAPAEKLAQMLAERAPGDLNHVFLTTGGSSAVETAIRLVQFYNNVRGLPQKKLLISRQGSYHGSTYLTASLNGRPRDHDWMDGAGDLVRKLTCPNPFHRPANLSLEAFEDFLVNEFRALIEHEGAQQIAAFIAEPIQASGGVLMSPPNYLKRMRALCTENDILFITDEVVTAFGRLGHIFASQDVFGIQPDMITFAKGVTSGYFPLGGVMVSDRLLSELRRLNHPKANFVHGLTYSSHPIGCAVAIRNIELLEDGLLHHAREIGPYFQEQLRTLEELPLVGEVRGAGLMAGIECVADAKTEDRLDLDLTVGKRIDFHCQENGLLVRPLINMCVMSPPLTISRSQIDMMTDALRKGIEATADDLIREGLWKPA

SEQ ID NO: 12245 - protein, 496 aa, Mesorhizobium loti
MPSAAEPMARTNNNLTGASMQSDNASKFYIDGQWVMPGGAGRMDVVNPATEQSFMQIAIGTTEDADLAVQAAFEAFPTFSQTSRTERVELLRNVLRCYNDRYDDIARAVSTELGAPLKFAREAQAWAGQIHLESTIAALEAFSFDELHGSSMITWEPIGVCALITPWNWPLNQIVCKVAPALAAGCTVVLKPSELAPLSAIIFAEVLEEAAIPKGVFNLINGTGPEVGQYLAGHPRVDMVSFTGSTRAGIMVAKTAAETVKRVAQELGGKSANIVLADADLENAVVKGVEACFSNSGQSCDAPTRLLIPADRHAEALDIARRVAAATRVGDPSSEDTDMGPVISQQQFDKIQRMIGLGIEEGATLVAGGPGKPEGLDVGFYVKPTIFGGVTPEMTIAREEIFGPVLSIIPYDTEADAIRIANDSIYGLAAYVQGGSLEGARAVARKLQAGSVYVNYAPWDTHAPFGGYKQSGNGREYSHWGIRDFMEVKGIVGWGA

SEQ ID NO: 12246 - protein, 541 aa, Mesorhizobium loti
MRQHYEAALRDDANCVALSPLSFLKRAELVYGARSAVTYGDVRRTWAQTGARCRSVAAGLAALGVGPGDTVSVLSPNIPELFELHYAVPLLGAVLNTINTRLEPETVAYILAHSDSTLVIADTAFAPLLREAFRLNGNTLPVVDVVDAQAQASAEFGERSYEDLAAHPPMGWELPKDEWQALALNYTSGTSGRPKGVIYHHRGAYLMAMGTIAAWALPQHPTYLSVVPMFHCNGWTHPWSMAIVGANMVFTRDASPGKLLEAMAAHRVTHMGAAPIVLQMLCDGRGASAQPFNPQIRVMTAGAPPPPAVLEKAAQMGLDVMQVYGLTETYGHISQCLWQDEWEALSVSARAEKQAMQGVAFPMVEDIRVVDRDTGTDVPRDGLTQGEIAIRGNTVMKGYYKDATSTAAAFESGWFWSGDAAVVHPDGYIQIRDRLKDVIISGGENISSVEVESVLYRHPAISVAAVVARPHPKWGESPCAFVELREGASATEAEIIAFCRANIAHFKAPKTVVFGPLPKTATGKIQKFILRAAARDLGPQA

SEQ ID NO: 12247 - protein, 508 aa, Mesorhizobium loti
MTMSTNSKDLSRRLAAGADDAPAILAPDRATLTHGGLRRLIAATAERLHALGIGRGDRVAIVLPNGPEMATAFVAVAAAASTAPLNPAYRADELDFYLTDIGAKAILVAENETGPAVAVAERLGIGVLRLVVQPDTPAGSFTIEGVAIGPQAAPDMAGDGDIALLLHTSGTTSRPKLVPLSHANIAASAAHIGATLGLSADDRCLNIMPLFHIHGLIAAVLSSLAAGGSIYCTPGFNALRFFQWLGDAKPSWYTAVPTMHQAILPRAARNEEILAAARLRFIRSSSASLPAQVMGELEATFGCPVIESYGMTEAAHQMASNRLPPGLRKPGSVGAGAGPEVAVMAPDGRLLTTGETGEIVIRGPNVTAGYEKNPDANATAFAHGWFHTGDQGVLDEDGYLRVTGRLKEIINRGGEKISPLEVDDVLMDHPAVAQVVTFAMPHDKLGEEVAAAVVLREGMIATESDIRSHAATRLADFKVPRKILILDEIPKGATGKLQRIGLAAKLGL

SEQ ID NO: 12248 - protein, 495 aa, Mesorhizobium loti
MATVIVEAREATSESGIPHIENAGQYPRMMELLNRQGRAEAVRRLRQACRFPVYGALSKDGEHLTYDYDVLRHEREAHLGPIWHFYAKPLHITRARGAWMYAADGTAYLDVYNNVPQIGHCHPHVAKAIYRQASALNTNTRYMCDVAVEYAARLTADLPDHLDTCIFVNSGSEANDLAMQIAMSLSRQDGGLIIDQAYHGCTELTTALSNESWRHLPADEHPKRIETLTAPDMYRGPFSRDRQAAAKYAADADRAIAALRERGHRPAAFMVDTALCSSGVLRAPENYFNLVAEKVRATGGFVIADEVQAGCGRMGAFWGFRANGLKDENIDFITMGKPVGNGHPLGVVILSSELMKRFLNGTYPLLFSTFGGNTVACAAGMAVLDVLEREDLIKRGAAIGEYLRQELGRLAEQHPAIGDVRGLGMMAGVELVTDRLTKEPAITLTERLIADMLARNILIGKGTPNTLKLRPPLIWSRDEVDIFVDAFDDSLRKHQ

SEQ ID NO: 12249 - protein, 416 aa, Mesorhizobium loti
MITLTYRIETSESIEALAAKIASDQSTGTFVALPGETEELKARVAARVLAIRHLPDAVQPSIPEASNGPFKRADVDIAFPFDAIGTDLSALMTIAIGGTYSIKGLSGIRIVDMKLPDDYRGAHPGPQFGVAGSRKLTGVEGRPIIGTIVKPALGLRPYETAEMVGELIAAGVDFIKDDEKLMSPAYSPLAERVKAIMPLVRDHEQKTGKKVMYAFGISHADPDEMMRNHDLVLKAGGNCAVININSIGFGGMAYLRKRSGLVLHAHRNGWDILTRHPGLGMDFKVWQQFWRLLGVDQFQINGIASKYWEPDASFIESFKAVTTPIFSPDDCALPVAGSGQWGGQAPETYQRTGRTVDLLYLCGGGIVSHPDGPGAGVRAVRQAWQAAVDGIPLAKYARSHAELARSIEKFGDGKAA

SEQ ID NO: 12250 - protein, 457 aa, Mesorhizobium loti
MLANSLIELDRAHLIHPVSSYRGHEALGVRVLKSAKGATVTEASGRQLVDGFAGLWCVNAGYGHDSIVEAAARQMRELPYATAYFDLGAEPAIRLASELAERAPGDLNHVFFTLGGSDAVDSTVRFVRYYWNARGAPKRDQFISIEQGYHGSSVVGAGLTALPAFHAGFGIPFEWQHKIPSPYPYRNPVGEDANAIIAASLAALKAKIEELGPERVAAFYAEPIQGSGGVIVPPKGWIKAMRELCREYGILFIADEVITGFGRTGPLFACTDEEIVPDFMTTAKGLTSGYVPMGAVFMADHVYDVIADGAGASSVGHGYTYSAHPVSAAVALEVLKLYEDGLLENGIKAGARLMAGLSGLSDHPLVGDVRGRGMLAAIELVVDKEKKTPLPASAMPARRIFDRAWDNGLIIRAFANGVLGYAPPLCCTDADIDAIIERTRRTLDQTLADPDVRQALA

SEQ ID NO: 12251 - protein, 485 aa, Mesorhizobium loti
MKTLKDKNLFREAGLIGGEWVAAGSGKTVDVIDPATQAAIGTVPDMAGSDTRAAIDAAASAYGDWKKKTNAERADLLEAWHGLMLAHLDDLALILTTEQGKPLDEAKGEIRYGASFVKWFAEEARRINGHTIPSPTQDRRIIVLKEPVGVCGIITPWNFPNAMITRKVAPALAAGCTVVIKPSEFTPYSALALGVLAERAGIPAGVINIVTGMPAEIGNEIMANETVRKISFTGSTRVGSLLMRGAADSVKRLSLELGGNAPFIVFDDADLDLAVEGALVSKFRNGGQTCVCANRILVQAGVYEAFAAKLSARVNAMTVGPGTQPGVAIGPMINMAAVEKINRHVEDALAKGAAIITEKPALPEGPQYVAPLVLSGATKDMQLAGEETFGPVAPLFRFETEEEAIALANGTPYGLASYFYTENLKRAWRVGEALEFGMVGLNTGSVSMEVAPFGGIKQSGLGREGAQAGIEEYLEMKSFHIGGLG

SEQ ID NO: 12252 - protein, 347 aa, Mesorhizobium loti
MKSYSIAMIPGDGIGRDVTAAAWTVLEAAAKHAGFALTGTEFPWSCKFYKDTGRMMPEDGIETLRGFDAILLGAVGWPAEVPDSVSLHGLLLPIRKAFVQYANIRPHRLLPGVTGPLRAEGFDILCIRENTEGEYSGAGGRVHQGTLDEVAVETSIFTRAGVERILRFGFEQARTRNGKLASVTKSNAQKYSMVFWDEITRKLAAEYSDVAVTSYHVDALAARMIMAPESLDVVVASNLFGDILTDIGAAIQGGLGYAASANINPDHSAPSMFEPVHGSAPDIAHLGIANPIATIWSGAMMLDHLGEKPAADRVMKAVEVATARGIGTIPAKDRTEAITAAVVAALT

SEQ ID NO: 12253 - protein, 487 aa, Mesorhizobium loti
MGLSFDPDTVSLPVGHFIGGELIAAEGAIEMRRPSDGKAYAASPVADVDMVDRAVASAKAALKASNWGGVRPRERTKALQAWADLIEAEAEALAKIEALCSTRPVGQLVAGDIAITAEQIRFFAEFADKEGSELVPTDDSSLGMIMSEPYGVVGAITPWNFPISMAGWKLGPALAAGNAVVLKPSEMTPFSAVYMAQLALRAGLPAGLVNVVLGDGPTTGTALTGHSEIAKVSFTGSTRAGSAIMENVARTGVKPMTLELGGKSPQIVFADADLDKAATAIAGSVTFNAGQACVAGTRLIAEKSVADRLTATILEKMKAARPGPTWDDATQYSPIISERQRARVDGIVRAAVEAGGECLTGGHTMDGPGYFYEPTLITDVDQANPAIVEEIFGPVLTVQTFETEEEALALSTHPTYGLASGLFTADLSRTIRFARKLEAGTVWVNRYSRSRDHILPTGGYKRSGIGKDLGREAYLANRRSKSVLISL

SEQ ID NO: 12254 - protein, 248 aa, Mesorhizobium loti
MSTPVVLITGALTGIGRETAIAFAKEGSRLVIAGRHEEAGRKLATELQSFGAEVEFIRADVRHDDEVRDLIDRAVARFGRLDVAVNNAGTEGKPGPVTEQTAETYAATFDTNVLGTLLSLKHELRIMLTQGGGSIVNISSTYGHEGAKGASIYAASKHAVEGLTKSAALEAAASGVRVNAVAPGPTNTGMLDRFTGTSEVKASLALTVPMGRVGQPSELARAIVFLASKEASFITGHVLTVDGGKTAG

SEQ ID NO: 12255 - protein, 248 aa, Mesorhizobium loti
MTKLSGKTALVTGASRGMGRSAALALARMGAQVLIHYSTGLKEAEAVVAEIREAGGRADSLAADLSAPDGAHKLAKQVRSVIGDRLDILVANAGTSKSATIEQTTVEDFDRLFAVNVRAPFFLVQQLLPIMGKDSSIVLISSLAAHAAVGTLPAYAATKGAIDTLVKHFAAVLGERGIRVNAVAPGVVGTDMSSFTKTDAGRDFTLGIQALKRLAQPDDIGGVVAFLATDDARWISGDIVRVDGGSKL

SEQ ID NO: 12256 - protein, 537 aa, Mesorhizobium loti
MSETSPFGDYDYVIVGAGSAGCVLANRLSADPRNRVLLLEAGGSDRYHWVDIPIGYLFCMGNPRTDWMMKTEPEAGLNGRSLNYPRGKVLGGCSSVNGMIYMRGQAADYDGWRQAGNVGWSWDDVLPYFRKSEDYHGGKSAMHGSGGEWRVERQRLSWPILDAFRDAAEELGIPRTGDFNTGTNEGSGYFEVNQRLGVRWNTSKAFLRGIAARQNLRVVTGAETERLEFDGRRVTGLLFRQGDRLHRVSAGQTILAAGAINSPKILELSGVGRPDLLSSIGVDVRHALPGVGENLQDHLQIRTVFKVANAATLNERYHNLISRAAMGVEYALKRSGPLSMAPSQLGIFARSDARLATPDLEYHVQPLSTDRLGEPLHRFPAVTVSVCNLRPESRGTVHMASSDPREATKIRPNYLSTAGDRSVAVASLRHVRSLMKARAVARFAPEEMLPGTQYDSDEDLIRKAGDIGTTIFHPVGTCKMGSDSMAVVDDRLRVHGLAGLRVVDASIMPTIVSGNTNSPVVMIAEKAAEMILLDPRR

SEQ ID NO: 12257 - protein, 367 aa, Mesorhizobium loti
MSKASDMVRTEVTRPSPYNSGLTITEVMQRYAPARIAKLGSNENPLGPSPTLATMLQAGAEMFRLYPDPAGRELRQAIAAKYGFGEDQIILGNGSEDLLSVISRAVLRPGDSVVTLYPSFPLHEDYATLMGASVKRVTVNDDLTINADALIDAVRERPRMLLFSNPMNPVGSWLSAGDLSKVLDAVSDETLIVVDEAYAEYAEGDDYASSLPDLCERDQPWIVLRTFSKAFGLAGLRIGFGIVGDPELRALLDRVRTPFNANGMAQAAALAALADEEHLAKVVALAKAERTQVESLLRNMGFDVAPSRGNFLFFNCRQNASAFAEGLLREGVIVKPWKQEGFDSYVRVSIGSPAENDHFMAALSQLL

SEQ ID NO: 12258 - protein, 257 aa, Mesorhizobium loti
MRNASLFDLAGRKALVTGASRGIGRSIAEALSAAGADVAVTARSLASLDGTTAAIRAAGGVAHAVALDVTDVNRCRTATAEAAGLLGGLDILVNNAGMEEVRPSLDVDEALWDRIVDTNLKGAFFCAQAAARQMRDAGHGGAIINLCSLTSEVGIPTAVPYGSSKSGLLGMTRALAAEWAGLGIRVNAIAPGYFRTAMTDVFYSNEAWQQSMLAKIPQHRFGDLGDLHGVAVFLASDAAAYITGQSIPVDGGFLASI

SEQ ID NO: 12259 - protein, 440 aa, Mesorhizobium loti
MSDVSFHDLSSLDATQRSSLLKRAEADLSVFVEKVRPIIQAVKDEGDAALIRFARELDKANVAEGGLQVSEAEFDAAFDKVEKDVVESIGFGIDNIRRFHEEQKPETMWLKEVRPGAYAGDRYTPIASVALYVPRGKGAFPSVTMMTSVPAVIAGVPQIAIVTPPTSDGSVDAATLVAARLAGVHTVYKCGGAQAVAAVAYGTETVKPALKIVGPGSPWVVAAKSELSSIINTGLPAGPSEAIIFADDSVDGGLAALDLLIEAEHGPDSSAYLVTHSRKVAEAALAALPQHWSRMTEQRVEFSRAVLTGKRGGIVLTASLEDSYRFINDYAPEHLEILSKEPFAHLGHITEAAEILMGPHTPVTLANFVLGPNAVLPTSRWARTYGPLSVTDFVKRSSVGYVTSAAYPELAKHARRLARYEGFSSHENAVSEIRDRYLAG

SEQ ID NO: 12260 - protein, 631 aa, Mesorhizobium loti
MMSTRDDDEKDDKSGRPTKAVVGSHRDEEEVFGKAYDPRIIRRIWSFVRPYQGRIFISVAAVLVFTLTQLAIPLVIRYAIDHGMAPGRLDRSVMISAIITFTVIILINYAASYVQESVVGKVAENVLSDLRRAMFSHLQLVSLSFMDKTEVGRLMSRLQGDVNSMQEFLETSVMSVGDIVLLFGIVTVLLWLDFRLGLLTLSTMPMLFIVRLFWLPRAKVAFMAAHETNSIANGALAEGIHGVRTVQSLERQHVNFDLYDEKVLANLNAHLRSARYAQVMVPIVDTLTGMAMATVIVVGGSMVLSHSLDVGVMVAFLFYIQRFFDPIRSLTMQYSVMQRAMASGQRISEVLDVPVDVSDKDNAVALSRETDGSVEFRNVTFGYRPNQPVLKNISFRVNPGETVALVGPTGSGKSSSMALVHRFYDVWSGQVLVGGHDVRDLTQDSLGDQVAMVLQEPFLFSGTVLENIRYHKTGASRDEVVRAAQAVGAHDFIEQLPDGYDTQLEQRGGNLSLGQRQLISFARALVADAKILVLDEATASIDSYTEMLIQKALIKLLEGRTGLVIAHRLATIRGADRIIVLQNGEIVESGNHEQLMQRKGLYARLYNMNYASFDDISEEEMGMDAALGKAT

SEQ ID NO: 12261 - protein, 627 aa, Mesorhizobium loti
MSGLDWIFSLPTDAASGAAKRGKSFAHVAEASWGKGLSTLLRIVRMTLRHPWQVAITLVSTFIAATLQLFIPRLLGRAIDQAQGVIAASGGAVAEQALWHTALTLLFVSILRGLFTMAQNYYGEAVGHQTGYELRLAFYEKIQRLSFSFHDKVHTGDLITLGLLDLDGVRMFFSTGILRVVLLGVLIGVGAYLLISTDFVLGLLSLSFVPFVAWRSSVTQLRLRSTWLTLQERLSVLSRVMDENLGGIRVVRAFAAQRHELKKFDRAKQDALELANQRVDIRVSNTSAMNFSFLAAMGLVLWFGGQKVIAGQISVGTLAQFLTFMTILQMPVRQLGLMVNSFARASTCGTRLFELLDTELDIEDAPDARELVITEGVLRFDNVGFRYEGAGDRPTLSGISFEARSGETIGIVGPPGSGKSTIAHLIPRFYDVTSGAITIDGQDISKVTLQSLRKVVGVVQQDAFLFTTSIENNIAYGNPWARETRIGQAAEYAQLHNYIIGLPAGYTTVVGERGASLSGGQRQRLTIARSLMLRPSVLVFDDSTAAIDAGTEQRIRAAMKRFAKDRVTLIISHRLSSLMHADQILFVEGGRIVERGTHEELLALGGRYRALYDLQLRPDDDRLEGAA

SEQ ID NO: 12262 - protein, 498 aa, Mesorhizobium loti
MTARIVLLDAKPLGVADVAEIARRNARLMLGEEAMRRIRASRALIEHLTGLGKPMYGVTTGLGACVDTPLAQADLIAFQHSVPLSHSMGIGPALPTEAVRALMTARISGMAAGGTGTSERVVMGLVAALNAGVHPVIPTWGSIGAADLAHLGHMARSLRGDGEAEFQGRIMPSAEALALARLEPLDLREKDGHAIIVANSLSTGTACLYLEDVAHLIDWALAAVALNYEAFRSSLTAIDEQALAARPAFGQREIGARLRAELAGSGLWQDKAARRLQDPLSYRCVPQVWGGLLNAFEQARLATEIELTHSGDNPVILAEGERVISNGNFDLTAMTLAWEQLGQALAHCAVGTANRCMKLMSPTTAELPRFLSARGGSRQGYAELQKPLSALEAEIRHLANPMSLSPLAVSDGIEDQSSMAPRVVAKTAEIVERMRYLVAMELIFAATGVELRGVVDTMGEGPQRTFAAVRALVSPLDDDREMSTDMTRVARMVAGPRC

SEQ ID NO: 12263 - protein, 356 aa, Mesorhizobium loti
MAAVLLTGHGGPEKLVYRTDVKVPSPDPGEVLVEVSACGMNNTDVWVRQGAYGTEEDAAAVSTWRRQGNTLVFPRIQGTDTVGTIVSVGEGVSPERIGERVMVDFSIYNRDDDSLADIDYMGHGRDGGYAEYQTVPAENAHVVDTDMSDVELATFCCAYLTGEQMLERAGLKAGERVLVTGASGGVGSGIVQLARARGAIPYAVVGKGKEQAVLDIGAEAVITRGVADLPRAVAEVTGGQPIDVVADLVGGAIFNDLLRILRPEGRYTTAGAIAGPVVQLDLRTMYLKQLQLHGSSQGTRADFRRIVGYIEAKKIRPLVGGVYRLSDFHRAQADFVAKDFVGKLVVVPDAIAERQA

SEQ ID NO: 12264 - protein, 459 aa, Mesorhizobium loti
MLNQSNELNAWDRDHFFHPSTHMGTHARGESPTRIMAGGEGVTVWDNNGRKSIDAFAGLYCVNVGYGRQKIADAIATQAKNLAYYHAYVGHGTEASITLAKMIIDRAPKGMSRVYFGLSGSDANETNIKLIWYYNNVLGRPEKKKIISRWRGYHGSGVMTGSLTGLDLFHNAFDLPRAPVLHTEAPYYFRRTDRSMSEEQFSQHCADKLEEMILAEGPETIAAFIGEPILGTGGIVPPPAGYWEKIQAVLKKYDVLLVADEVVTGFGRLGTMFGSDHYGIKPDLITIAKGLTSAYAPLSGVIVADRVWQVLVQGSDKLGSLGHGWTYSAHPICVAAGVANLELIDEMDLVTNAGETGAYFRAELAKAVGGHKNVGEVRGDGMLAAVEFVADKDDRVFFDASQKIGPQVATALAASGVIGRAMPQGDILGFAPPLCLTREQADIVVSKTADAVKSVFANL

SEQ ID NO: 12265 - protein, 497 aa, Mesorhizobium loti
MSAHFARSHRHEALDRLADRRLLRELAYVDGHWTASEAAESFEVTDPATGSTVAFVAALDARQTTQAIDAAALAFPAWRSLLPQERSRILRKWFELIITAKDDLALLMTLEQGKPLQESLGEIDYAASFVEWYAEEAKRLNAESVTSHLANAEMMVRREPLGVVGIVTPWNFPSAMLTRKAAAALAAGCTIVAHPSSETPLSALALAELGERAGLPAGVFNIVTGKAATIVGRMCEDTRVRAMSFTGSTEIGRLIAAQSAPTMKRLVMELGGHAPLIVFADADLDKAVSIAIDAKFATSGQDCLAANRIYVQRPIHDRFCAAFAKRIEALRTGNGLDDMTDIGPLLHERAVQKVEEQVADALAHGARCLAGGKRHQAGPLFYQPTLLADVSDAALIMREETFGPVAAVTPFDSEDEVIARANATEYGLVAYVVTDNGARQQRMGRALDYGMVAINRVKITGAPIPFGGVKQSGIGREGSRHGLEAFTDLKYLCLDVA

SEQ ID NO: 12266 - protein, 436 aa, Mesorhizobium loti
MHVSQSSPYQANADSTASEQALLERRARLLGPTYRAFYRNPIHLVRGSGVWLYDATGRKFLDAYNNVASVGHCHPRVVEALSGQAATLNTHTRYLSEIILDYAEKLLGTVPSHLGHAMFTCTGSEANDLAIRIAQHSSGGTGVIITDFAYHGATIATAQLSPAAVGAKGVPVHHRTVAAPDTFRDHGRAAKDFAKNVAAAIEDMRAQNIRPAALLLDSAFSSDGIFFPDAAVMREAGDHVRKAGGIVIADEVQSGFGRLGQGMWGFANYGLEPDIVTMGKPIGDGHPMGAVLVRPRLVSSFGSNTGYFNTFGGNPVAAAVGIAVLDVIEGEGLIENARNVGAYTADLLRALQGRHGMVGDVRHNGLYFGVELTADGGEALAASKTSSVVEAMREDGVLISSCGPRGNVLKIRPPLPFARDNAEQLAETLDRALSNW

SEQ ID NO: 12267 - protein, 467 aa, Mesorhizobium loti
MSPETQRLLSALGDRLGAGGVLAGSDVDQRYRDDPDGKLGVLPEVVLRPRDAVGVAAALAGCHAVGQPVVVQGGRTGLAGGTRVQPGEIVLSLERMSGLAAPDTQAASIVAEAGATLQAVQEAADDAGLMFGVDIGARGSATVGGNIATNAGGIRVLRYGMYRAQVLGLEAVLADGSVLSSLKGLPKDNSGYDLGQLFIGAEGTLGVVTRAALRLHPKPASEVNAFCALASLDAAIALLGLLRQRLGPLLSAYEVNFAPLYDVMAASMAMPAPLPVGSPVYVLAEIQGNEPERDGERFAEVLMQAVEDGVVDDVVVSQSPREFRALWDVREDANRVLFSIKGLIGVDISIPLARMGAFLQEADAAIHAVDPSADIYVFGHLGDGNLHYQVLTADPAAAYGIVYRGVAAAGGGVSAEHGIGLDKKQWLHLVRSDAEIATMRRLKTALDPKNILNPGRVFDLDPAAVPR

SEQ ID NO: 12268 - protein, 258 aa, Mesorhizobium loti
MTDEIGYAIYPSLKGRSVFITGGGSGIGESLVRHFCAQGSRVAFVDLSEEPSRHLVEAIAAEGHPAPLFIPCDLRDVEQLQAATAQAMQHNGPIQVLCNNAGNDDRHQTKDVTVAYWDDRMAVNLRHQFFAAQAVRPQMSAQGGGSIINFGSITWMVGDPDCPAYVTAKAAVYGMTRALARELGPERIRVNCMVPGWVMTERQMRLWLNPAGERQIAERQCLPDRLQPADIARMALFLAADDSRMCTSQQFIVDAGWV

SEQ ID NO: 12269 - protein, 481 aa, Mesorhizobium loti
MDIGLLIDGDKRDASGAAAYERLDPFTGKLATRAAAASVADANAAVEAAAAAFATWSKTGPGERRALLSRAADVMASKVGEFTKLMMEETGATAPWAGFNVMLAANMLREAAAMTTQISGEIIPSDKPGTLAMAIRQPAGVCLGIAPWNAPVILGTRAIAMPIASGNTVVLKASEMCPGTHRLIGQVLVEAGLPKGVINVVTNDPKDAAAIVEALVAHPSVKRVNFTGSTKVGRIIAELAGRHLKPALLELGGKAPLLVLDDAAIDAAVNAATFGAFMHQGQICMSTERLIVDERIADEFVSKLAARASQLPAGDPRGHVVLGSLISSQAADKMEELIADAVAKGAKLVAGGKRTGTVVEATLLDHVTPAMRVYAEESFGPVKPVIRVKDEDEAVRVANDTEYGLSSAVFSRDIKRAMAVAARIEAGICHINGPTVGDEAQMPFGGVKGSGYGRFGGKASIAEFTDLRWVTIEDPGQHYPF

SEQ ID NO: 12270 - protein, 317 aa, Mesorhizobium loti
MKKLVCAGEILVEIMAERIGQSFLAPGPLVGPFPSGAPAIFIDQAARLGQPAGLIAAVGDDDFGHLNIERLRADGADISAIKVHRGAATGTAFVTYETDGSRHFVYNIKHSAAGLIEIGAEARALLAGADHFHVMGTSLFSPEVIEVARKGIETVKARGGTVSFDPNIRKEMLDLPGLRDALHFVLSKTDVFLPSGPELFIFARATDEESAVREMLDRGISAVVIKKGAQGAVHYDKTGRTASPGFVVEEIDPTGAGDCFAAAFVSFWLRGAAPEKALRIANGCGALAVTRKGPMEGIASLAAVEAYVATARTGAPA

SEQ ID NO: 12271 - protein, 316 aa, Mesorhizobium loti
MPAVPSILGFGAIAIDDIVYVDQPLSAGKGRVRQSARAFGGNVATALAAVARLGGSAGFVGWLGTAADDPVLCDLIESGVETAFAPRHADARPVRSRITVGSDGERFIAYDDDAMLGTTPDFSDDILNRAAVLIVDSYAIRSMDVVTRARDLGLAILGDIEWSGGPATERLIGLCDHLILPLGFARTATGCRLPAEMLEALWSPSRSAVVLTDGGRGVYYRGREETRLWQLPPHRVAVVDSTGAGDCFHGAYAHALTRGADTAGRVAFAAAAAALSITGRGGREALPTEDQVTELLASANAPSAVELKYAQLDTGT

SEQ ID NO: 12272 - protein, 442 aa, Mesorhizobium loti
MHIADQSGAAAAQRKPLYAQLYVQVLVAITVGILLGHYYPSIGESMKPLGDAFIKLVKMIIAPVIFLTVATGIAGMSDLQKVGRVAGKAMLYFLTFSTLALIIGLVVANVVQPGAGFNIDPATLDASTVNTYAAKAHDQSVTGFLMNIIPGTIVGAFADGDILQVLFFSVLFGIALALVGDKGAPVLNFLQALMAPMFKLVSVLMKAAPIGAFGAMAFTIGKYGIGSVINLAMLVGTFYATSLLFVFVVLGAVCRYNGFSILSLLRYIKEELLLVLGTSSSEAALPSLMEKMEKAGAKRSVVGLVIPTGYSFNLDGTNIYMTLAALFIAQATNIHLSMGDQILLLLVAMLSSKGAAGITGAGFITLAATLSVVPSVPVAGMALILGVDRFMSECRALTNFIGNAVATLVVARWEGELDEAKLARALAGTADDSLPADIVPAE

SEQ ID NO: 12273 - protein, 581 aa, Mesorhizobium loti
MTLLSVRDLCVGFGRDPHANEVVRGVSFDLADGETLAIVGESGSGKSVTALSINRLIDFGGGRITGGAMKLKRADGSLFDLISATEPQLTGIRGAEIGMIFQEPMTSLNPVLTIGTQIEESFRLHRGLTGRQATAAAKDALDRVRIPDAARRLKYTPNQLSGGMLQRVMIAIALACNPRLLIADEPTTALDVTVQAQIMALLAELKRETGMSVIFITHDIGLVAGIADKVLVMQNGQAVEQGELNHILDRPRHPYTQHLLQDVPHFARGSATRADGQRDKDERMEPALKVEGLVVRFPLKSNFFSRATGAVHAVDGVDFDLMPGETLAIVGESGSGKSTTAKAVLGLVRSTRGSFSVGARAASAERSAKPVQMVFQNPYASLNPRLTIESILAEPVIANGGRVNAETRARMAGLLERVGLPRNSLERYPHEFSGGQRQRLCIARALMLNPSVVVLDEAVSALDVSVQAKVLELLVELQREFGLAYLFISHDMAVVERIAHRIAVIFAGQIVEIGDAASVLSEPKHSYTKKLIAAVPTIERRREHFELDTRQVPSLVRPQGFEPAPAQWEQFGSDHMARVEA

SEQ ID NO: 12274 - protein, 517 aa, Mesorhizobium loti
MRDILIGIDAGTSVIKSIAFDTLGRQIAAAALPNHYETLPGGGAEQDLARTWSDAATTLRQLADKVPNLANRTVAIAVTGQGDGTWLIDAKGEPVAKGWLWLDARAAAVVEEIRARPEDRLRFEKTGSGLAACQQGSQFVFMKRTMPAMLGKAATAFHCKDWLYFKLTGERATDPSEGTFTFGDFHTRDYSDEVLDVLGVADLRHLLPPIVDGTRHSTALSQAAADATGMLAGTPVVLGYVDVVCTALGAGLLDRQRKPGCSIIGSTGMHMRLAETPDDVQLNDAATGYTMAMPAPGVFAQMQSNMAATLNIDWVLGLASGILASQGISRSNGEMIALVDAWIAAAQPASLLYQPYVSEAGERGPFVDANARAGFVGISSRHGYADLVRAVFEGLAFAARDCYTAMGPLPREVRLTGGAARSPALRKILGAALGADIRTSAREEAGAAGAAMIAAVCVGLYPSMDACVGEWVTPLLGEAEPSDRNLAAIYDKMTPSYTLAHQALRPVWRAMASVQAN

SEQ ID NO: 12275 - protein, 505 aa, Mesorhizobium loti
MNGGPEIVDLFVIGGGVNGAGIARDAAGRGLSVILCEKDDLAEGTSSRSGKLVHGGLRYLEYYEFRLVREALIEREVLLESAPHIIWPMRFVLPHSPDDRPAWLVRLGLFLYDHLGGRKRLPATRTLNLRTAPEGAPIKDAFRRGFEYSDCWVDDARLVVINALDAAERGARVFTRTACTAARRESGLWVVEMRDGRTGIRTVVRARALINAGGPWVNDIVNRVAGQNSTRNVRLVKGSHIVVPKFWEGRQAYLIQNSDKRVIFINPYQNDLALIGTTDIPYDGRPEDVAADESEIDYLIAVVNRYFKRGLARGDVVYSFSGVRPLYDDNADNPSAVTRDYIFELDAPDAQAPLLSVFGGKITTFRKLAEHALDRIAPFFPHMGKPWTAKAHLPGGDIANADFEQFLGDLGGEYPWMPASLLKHYGRLYGTRTRALVGPARSLDELGRCFGKDFFEREANYLFDREWAATSADILERRTKHGLHLSAEERAAFEHWCANRLARAG

SEQ ID NO: 12276 - protein, 354 aa, Mesorhizobium loti
MARITLRQLLDHAAEYGYGVPAFNMNNMEQGLAIMEAAEETKSPVILQASRGARAYANDVVLAKLIDALVEIHPDIPVCMHLDHGNNEATCVTAIQYGFTSVMMDGSLKEDGKSPADYAYNSGITKRVVDMAHWGGVSVEGEIGVLGSLESGGGEQEDGHGVEGAISHDQLLTDPEQAVEFVKDTHVDALAVAMGTSHGAYKFSRKPDGAVLAMNVIEEIHRRLPNMHLVMHGSSSVPEDLQEIINKYGGQMKPTWGVPVEEIQRGIKHGVRKINIDTDNRMALTGAIRKVLTENPSEFDPRKYLTPAMAAMRKLCKERFEQFGTAGNAPKIKPLPVSEMAKRYKSGSLDPKFG

SEQ ID NO: 12277 - protein, 254 aa, Mesorhizobium loti
MRVVYWVGTSWKMNKTLAEALDFAERLAGFIPGFDDRIQPFVIPPFTAVREVKRALSSTRIKVGAQNMHWADAGAWTGEISPPMLRDCGLDLVELGHSERREHFGETDRTVGLKTAAAVKHGMIPLICVGETLAERESGQADAVLSAQVEGALQFLEGEAKTAKILFAYEPVWAIGDKGIPASADYADKQQALIKTVAGALLPSVPPVLYGGSVNPGNAAELVGQPNIDGLFIGRSAWQADGYIDILGRASAAI

SEQ ID NO: 12278 - protein, 337 aa, Mesorhizobium loti
MPVQTKKIINDGNRAVDEMLEGILAAHPRHLRSADGSPRSIIARDGPRPGKVGLVIGGGSGHEPTFLGFVGKGLADAAAIGNVFASPPPDPILECAKAVSGGAGVLFMYGNYAGDVMNFDMAAEMAAMDDIEVRTVLTTDDVASALRDQRQKRRGVAGNFFIFKAAGAACDRMLSLDEVERIARKANDHTFTMGVALSPCSLPQTRRPNFEIGAGEMEIGMGIHGEPGIARGKLGSADAITDEMLDKILAEMAPTRGDKVAVLVNSLGSTPLMELYIMNRRVKQRLDDIGVTIHATWVGNYCTSLEMAGASVTLFHLDEELQTMLDHPCDCAMFRAG

SEQ ID NO: 12279 - protein, 546 aa, Mesorhizobium loti
MANSYEQDLDRNAANHQPLTPLTYLERAAKTYPDHIAIIHGRQRISYRDFWRRSLKVASALQKRGIGKGDTVTVMLSNTPPMLEAHFGVPMTKAVLHSLNTRLDAAVIAFQLDHAETKVLIVDREFSGVVRQALDLAKVTPLVIDYDDPDYAADAPYPKGERIGALDYEDFVAGGDEDFAWSMPDDEWDAISLNYTSGTTGNPKGVVYHHRGAALMAYTNTIHAGMAKHAVYLWTLPMFHCNGWCFPWTLAVQAGTHVCLRWVRPKPIYDAIADHGVTHLCGAPVVMSVLINARDEDKRTFAQTVTFNTAAAPPPEAVLSGMADAGFAVTHLYGLTETYGPAVVNEWHGEWDDLAKGERSAKKARQGVRYAALEGLTVMDPETMQATPADGETIGEVMFRGNIVMKGYLKNRKASDEAFAGGWFHSGDLGVMHPDGYIQLKDRSKDIIISGGENISSIEVEDALYKHPSVASCGVVARHDDKWGEVPVAYVELKPGKTASEAEIIEHCRALLARFKVPKAVIFAEIPKTSTGKIQKFRLREMAKLA

SEQ ID NO: 12280 - protein, 268 aa, Mesorhizobium loti
MAQRIPSLKRGGLSMDLFKLDGDVALVTGAGSGIGQAIAIGLAEAGADVACFGHASKGGLEETAQQVTTLGRKALVLTGTVTSQSDLAAAIDRVEAELGALTVAVNNAGIAGSEPAETLSLEKWQKVHEVNVAGVFLSCQAEARKMLARRKGSIINIASMSGTIVNRGLTQAHYNSSKAAVIHMSKSLAMEWADRGLRVNVVSPGYTLTPMNKRPEVAEEIKIFKRDTPMGRMAAPEEMVGPTVFLASRASSFVTGLDLIVDGGYVCW

SEQ ID NO: 12281 - protein, 252 aa, Mesorhizobium loti
MMTNLSGKVVLLTGGLGSLGRAQAAALARAGARVLLLDRPENAEGPGIAAELAAANKGTIVYVGCDLNQLAEAEAAVKALADKEGTIDILINNAALIINRPFEEFSLGEYEDQIRVNSSAAFALARACAPGMKKKGQGRIVNFCSVTLNGRWDGYVPYVASKGAMLGLTKSLARELGSHGITVNAVSPGAVVSEAEERVFGERLEEYNDWILANQCLKRRIEPQHIANLVLFLVSPASDMISGQNINIDGGW

SEQ ID NO: 12282 - protein, 301 aa, Mesorhizobium loti
MDRGERQPGFVFDAQDIVGESLIWDENRKALVWVDIIGQRIHQLDPVTRDHQSWSTPDLATSIGLRRDGGAIVGLRKDVVLWDFAEAFRTIATIEPDSPDTRLNEGVVAPDGSFWVGTMENNIGPDDRPRDISRDAGRIYRVDTAGIVEALGADRFGITNTMVWTADDTFITADTMKNQIFRYHWDRVRSRITDRRPFFSDFSRGLPDGSCMDAEGYVWNCRVAGGGCLVRISPDGVLDKVVELPCSWPTSCTFGGENFDILFVTSARFTMSERHLRANPREGGLFAVRAGVGGTPTKRFG

SEQ ID NO: 12283 - protein, 295 aa, Mesorhizobium loti
MDTDIGSRTWHAHAKINLALHVTGRRADGYHLIDSLAVFTRFGDRVEIALADSDDFTVSGRYAPAVPLDAGNLVLKARDALRREAGSGRTPPVSIKLEKNLPIASGVGGGSSDAAAVLRGLAQTWALDIDDAGLARIGLSLGADVPMCLAAKPLVARGIGDELSMVPDFSALGLVLVNPGTPVSTADVFAALSRRDNEPLPPLPRSIDFHSLRNWLEVTRNDLEPAALALQPAIGRALSWLNKAGSGFSRMSGSGATCFGLFETGNVAKRAAAEIRSRQPDWFVAATRSMSSEAE

SEQ ID NO: 12284 - protein, 338 aa, Mesorhizobium loti
MGVVLNIENGKREPASIKDLIDLTAADMGRVNELILSKAGSDVEMIPEVANHLISSGGKRLRPMLTLAAAQMFGYAGEGHVKLATSVEFMHTATLLHDDVVDESGMRRGKKTARMIWGNQASVLVGDFLLGQAFRMMVDVGSLEALDILSSAASIIAEGEVMQLAAAKNLETTEDEHFAVIKAKTAALFSAAAEVGPVIAQATRNDRAALRSYGMNLGLAFQLIDDALDYGGTSKDLGKNVGDDFREGKVTLPVILAYRRGTKAERTFWKRAIEDNVVDDAGLEKAIGLMTRHGAIADTIGRARHFGEIARDALAPLEETRQKSALIDVIDFCISRVN

SEQ ID NO: 12285 - protein, 476 aa, Mesorhizobium loti
MTEILQKLDPALIDRFAAIVGDKYALRDEQDIAPYLIERRGLWHGATSLVLRPGSVDEVSRIMRLATETGTPIVPQSGNTGLVGAQVPDKSGREIILSLSRLNRIREIDILSNTVTAEAGVILQTLQEAADAADRLFPLSLAAQGSCQIGGNLSSNAGGTGVLAYGNARELCLGVEVVLPTGEVFDDLRKLKKDNTGYDLKDLFVGAEGTLGIITAAVLKLFPNPKGREVAFAGLSSPEAALSLFSLAMDRAGASLTAFELIGKRPYDFTLKHGQGVVRPLADDWPWYVLMQISSGRSEADGRALIEEVLADGLQQGIVGDAVVAASLAQGDAFWNFRETLPECQKPEGASIKHDISVPIASIPRFIAEAAGAVASVSAGARVVCFGHMGDGNLHYNISRPIDGDDEAFLALYHPMNKAVHDVVRSFHGSISAEHGIGQLKRDELIATAPPMAIDLMRRVKAAFDPAGIMNPGKVI

SEQ ID NO: 12286 - protein, 589 aa, Mesorhizobium loti
MYRAPVEDIAFTLKHVAGMKSALDAGRFGDLGEDLVDAVLGEAGRFATEEVAPLYKIGDEHGAVLRDAAVTMPPGWKELYRRWIDGGWNALSGPEDYGGQALPTMLGVAALEMWNSAAMAFGIGPTLTMGAVEALDKHASEALKAKYLAKLVSGEWMGTMNLTEPQAGSDLAALRARAEPAGDGTYRIFGQKIFITYGEHDFTDNIIHLVLARLPDAPAGTRGISLFLVPKFFVNDDGSLGARNDVFCSGLEHKLGIHASPTCTMIYGDGFRGATPGAIGWLIGEENKGLACMFTMMNNARLAVGMQGVAVAEAATQKAIAYANERRQGKAADYAGAGMAPIVHHPDVQRNLLTMKALTQTARAISYSCAHAIDMARVSDGDQAAHWRDRANLLTPLAKAFSTDVGVEVASLGVQVHGGMGFIEETGAAAFYRDARIAPIYEGTNGIQAIDLVTRKLPLGGGEHVHGFIGELAGAANAVRTSNLQGFGRTADALDAALGDLTQATRFLQKLSADGRMEEALAGATPYLRLISLAAGGAYLARGALADQDRIALCRFFAENLLGEARALRERVIDGAESLAAAGKTLISA

SEQ ID NO: 12287 - protein, 272 aa, Mesorhizobium loti
MAGGQGLMAGKRGLILGIANNRSIAYGIAKACVDHGAEIALTYQGEAFKKRVEPLAAELGAFVAGHCDVTDSASLDEVFANVAKHWGKLDFLVHAIAFSDKDELTGRYVETTRDNFLRTMDISVFSFTTIAKRAEALMTEGGSLLTLTYYGAEKVMPHYNVMGVAKAALEASVRYLAVDLGGKKIRVNAISAGPIKTLAASGIGDFRYILKWNEYNSPLKQTVTQEEVGDSGVYFLSDLSRGVTGEVHHVDSGYHVVGMKAVDAPDISTVKE

SEQ ID NO: 12288 - protein, 195 aa, Mesorhizobium loti
MYPLVYIVRHGQTAWNAEARLQGQADTDLNALGREQATGNGRRLAELVGDPGDFDFVASPMRRTRETMERIRAAMKLDPLAYRTDTRLIEVNFGDWQSFTFAELETQSPGAKRSRARDKWNFQPPGDGAESYQMLLERVKPCFDEIDRKTVCVTHGGVMRTLFRFVLDMAEDEAANLEIPQDRVLKLEGQSLEWL

SEQ ID NO: 12289 - protein, 371 aa, Mesorhizobium loti
MSHNTFGHLFRVTTWGESHGAALGCVVDGCPPGIRFTRDEIQAELDKRRPGQSRFVTQRREPDEVKVLSGFVLDEDGETMITTGTPVSMLIENVDQRSKDYGEIARQYRPGHADYTYDVKYGIRDYRGGGRSSARETAARVAAGALARKVVPGMVVRGALVSMGEKSIDRANWNWNFIGDAENPFFTPDPASVPVFTQYLDGIRKAGSSVGAVIEIVADGVPPGLGAPIYAKLDQDIASGLMSINAVKGVEIGNGFEAARITGEQNADEMRIGNDGKPVFLSNNAGGILGGISTGQAIVARFAVKPTSSILTPRKSIDKDGNDVEVMTKGRHDPCVGIRAVPIGEAMVACAIADHYLRHRGQTGKGIGSRE

SEQ ID NO: 12290 - protein, 637 aa, Mesorhizobium loti
MNATPHTPLLDKVRIPADLRALDESELPQLASELRLELVDAVSRTGGHLGAGLGVVELTVALHYVFNTPDDRLIWDVGHQAYPHKILTGRRDRIRTLRQEGGLSGFTRRAESEYDPFGAAHSSTSISAGLGMAAARDLSGGRNNVIAVIGDGAMSAGMAYEAMNNAGALDARLIVILNDNDMSIAPPTGAMSAYLARLASGKAYAGLRDFGKKLTSYLGKRADRAITRAVEHARGYVTGGTLFEELGFYHIGPIDGHNLEHLIPVLKNVRDNGEGPVLIHVVTQKGKGYAPAEAAADKYHGVNKFDVITGAQAKAPANAPAYTKVFAESLIREAREDDRIVAVTAAMPSGTGLDLFGEVFPSRTFDVGIAEQHAVTFAAGLATEGYKPFAAIYSTFLQRAYDQVVHDVAIQKLPVRFPIDRAGFVGADGATHCGAFDTTFLASLPGFVVMAAADEAELRHMVRTAAAYDDGPIAFRYPRGNGVGVDMPERGEVLELGKGRVVREGSKVALLSFGTRLQDCLIAAEELGAAGLSTTVADARFAKPLDEDLIRRLARSHEVLVTVEEGAIGGFASHVLQFLAHEGLLESGLKVRPLVLPDVFTDHAKPEKMYADAGLDAAGIVRTVFTALDHTARAQRA

SEQ ID NO: 12291 - protein, 430 aa, Mesorhizobium loti
MGVEVSRLSNGLTVATETLPSIESVALGAWVKSGARNERDEEHGMAHLLEHMAFKGTKRRTAFEIASEIEDVGGEINAATSVETTSYYARVLSDDVPLAVDILADILQESEFDPQELEREQHVILQEIGAAHDTPDDIVFDRFTETAFRHQTIGRSILGTPDTVKSFTSKQLHDFIERQYGAERMVIVAAGDIKHDNFVREVEKQLGGFRSKADSTIPQYAQYVGGDFREDRDLMDAQIVLGFEGRAYHVRDFYASQVLSMILGGGMSSRLFQEVREKRGLCYSVYAFHWGFSDTGIFGVHAATGQSDIAELVPVIIDELQKAGENILQEELDRARAQYRAGLIMSAESPASRASQIARQLLLFGRPIAKEELMERLSALTVERLTDLSSRMFSTKPTLTAVGPVGTLAPYEAILDSLPGTQTTARRLAV

SEQ ID NO: 12292 - protein, 1152 aa, Mesorhizobium loti
MKFSRLRLLGFKSFVEPGEFVIERGLTGIVGPNGCGKSNLVEALRWVMGESSYKNMRASGMDDVIFSGSGTRPARNTAEVTLFLDNSDRSAPAAFNDADELQVSRRIEREAGSLYRINGKEARAKDVQLLFADQSTGARSPSMVGQGRIGELIQAKPQARRALLEEAAGISGLHTRRHEAELRLKAAEQNLERLDDVVGELESQIESLKRQGRQASRFKNLSADIRKAEATLLHLRWTLAKTQEGEARSALAVATALVGDRAAAQMNAAKEQGISAHRLPDLRDAEAAAAAAFQRLSIARSQIEEEAGRIRNRQAEIERRLQQFDGDIAREERMVRDNADVLERLRTEEATLNSENAGAAEREATTRAAFEQAASTLAQSEARLAALTAERAEAAASRHQIERTLRETAERRDRFARQLAEVDRELSDILSKVAGLPDPAEKRVLVEQAMALLEESEAAVAQAEQSVIDARTAESGARPPLQDAKAELARIETEARTLAKILNAASGDLFPSVLEQISVERGFETALGAALGEDLDVPLDRSAPAHWGESQIQPGDAALPEGIKSLASVVRAPAQLARRLAQIGIVEVADGRRLQALLAPGQRLVSREGALWRWDGLTASADAPTAAAQRLAQKNRLAELDAEAVQATLVLRQAEEALAQAEQALRQASEAERNTRQAGRDAQHRLDAARTALAEAEKAGGELASRRAALDEGRARIVDSHEETSAAFVEAEMLLQDAPDLGDLQLQLEQSTANVSRDRAALADARAVHEGLRREAEARTRRLDAIGAERSNWLVRAENASTQIASLGERKAEAEAERERLADAPDEIDAKRRALLSQLTEAETLRKAAADRLQEAENRQAELDKLATSAIQSLAEARETRVRAEERLTAADERRLEVEARIQETLNTPPHLVIRHTGLEADDPMPEMAEIERQLDRLKIERERLGAVNLRAEEEQKELSDRLEAIVTEREDIIEAIRKLRQAIQSLNREGRERLLAAFDVVNSHFQRLFSHLFGGGTAELQLIESDDPLEAGLEILARPPGKKPQTMTLLSGGEQALTAMSLIFAVFLTNPAPICVLDEVDAPLDDHNVERFCNLMDEMAKTTETRFVIITHNPITMARMDRLFGVTMAEQGVSQLVSVDLQAAEAMREAS

SEQ ID NO: 12293 - protein, 892 aa, Mesorhizobium loti
MTKWVFTFGDGAAEGRAGDKNLLGGKGANLAEMCSLGLPVPPGFTITTEVCNAYYANGRAYPAGLEADVAVALDHIGRLTDRRFGDPSKLLLVSVRSGARASMPGMMDTVLNLGLNDETVEALATDSGDARFAYDSYRRFIQMYSDVVMGLDHEVFEEILEDQKASLGHELDTELTAIEWQGVIALYKAKVEEELGRPFPQDPQEQLWGAIGAVFSSWMNNRAITYRRLHDIPESWGTAVNVQAMVFGNMGETSATGVAFTRNPSTGEKQLYGEFLVNAQGEDVVAGIRTPQNITEAARIAAGSDKPSLQKLMPDAFQSFVSISDSLEKHYRDMQDLEFTIERGKLWMLQTRSGKRTAKAALKIAVEMARDGLITKEEAVARIDPASLDQLLHPTIDPKAARDVIGVGLPASPGAATGEIVFSSGDAEDLKAQGRKAILVRIETSPEDIHGMHAAEGILTTRGGMTSHAAVVARGMGKPCVSGAGSLRVDYKAGTLLSMGQTFRKGDIITIDGGNGQVLKGAVAMLQPELSGDFAAIMEWADAVRRMKVRTNAETPLDARMARSFGAEGIGLCRTEHMFFDGARIVAMREMILADTEKDRRIALAKLLPMQRSDFLELFEIMAGLPVTIRLLDPPLHEFLPKTEAEIAEVAAVMDVSPDKLRQRTEALHEFNPMLGHRGCRLAVSYPEIAEMQARAIFEAAVEAGQKAGALVVPEIMVPLVGLVKELDYVKARIDAVAKSVMEESGVKIDYLTGTMIELPRAAIRAHVIAATAEFFSFGTNDLTQTTFGISRDDAASFLETYRQKGIIEQDPFVSLDVDGVGELVRMAAQKGRATRPDIKLGICGEHGGDPASIRFCEEVGLDYVSCSPYRVPIARLAAAQAAVQVSKAGRG

SEQ ID NO: 12294 - protein, 542 aa, Mesorhizobium loti
MLGLMQEWPLLCHKLIDNAERQHGVREIVSRSIEGPIVRTTYADIHRRSLKVAQRLERDGYGLGDRIATLAWNTARHLEAWYGIMGVGAIYHTLNPRLFPEQIVWIMNHAEDKAVFVDLTFIPLLEKIAGAVKSLKKVIVLTDKAHMPQTTLPNAVAYEEWLDEVDGDFAWKTFDEGTAAGMCYTSGTTGDPKGVVYSHRSNVLHAMIAAMPDAMGLSSRDTVLPVVPMFHANAWGLGQSGPMVGANLVMPGCKMDGASIYELLDTEKVTFSAAVPTVWMMLLQYLEETGKKLPYLNKVVIGGSSCPRAIMTKFQDNYDVQVIHAWGMTEMSPLGTLCTLKPEYAGLQGEARLDVKQKQGYPPFGVEMKVTDDENNAQPWDGKTFGRLKVRGPAVARAYYGGAGAEQFDADGWFDTGDVAHIDAGGYMQITDRAKDVIKSGGEWISTIDLENLAVGHPDVAEAAAIGVHHSKWGERPLLVVVAKPGKEPTKADILGFMDGKVAKWWMPDDVAFVGEIPHTATGKIQKTTLRQQFRDYRLPTD

SEQ ID NO: 12295 - protein, 293 aa, Mesorhizobium loti
MKGIILAGGSGTRLYPLTLAVSKQILPIYDKPMIYYPLSVLMLAGIREILIVSTPRDLPAFRDLLGDGSEFGLAFSYAEQPHPNGLAEAFIIGRDFIGKDSVSMILGDNIYFGDGLSQLCRAAAARDAGASVFAYHVEDPERYGVVSFDKATGTALTIEEKPQKPKSNWAVTGLYFYDNEVVDIAPTIRPSARGELEITAVNNVYLERGKLHVHRLGRGYAWLDTGTHDSLHEASSFVRTIEHRQGIKVACPEEIAFEQGWLTAEQVLQRATRLGKNEYAAYLRRRVADLLEG

SEQ ID NO: 12296 - protein, 645 aa, Mesorhizobium loti
MRHIMAKSLAPTDSVRDYLAAQEKKSLLRFLTCGSVDDGKSTLIGRLLSDTKQIFEDQLAALERDSRKHGTTGDDIDFALLVDGLEAEREQGITIDVAYRFFATPKRKFIVADTPGHEQYTRNMATGASTADLAIVLIDARQGVLRQTRRHSIIASLLGIRHIVLAVNKIDLVDFDQAVFDRIVEDYGQFSRDLGFQTIVPIPMSARYGDNVSGRSDNMQWYSGPTLIEHLETVSVEEAAVEQPFRFPVQYVNRPNLDFRGFAGTIASGAIAQGDEVVVAKSGKSSHVKRIVAHGGDLKQAVAGQAITLVLDDEVEVSRGNMLVSPAARPQVADQFAANIVWFDEHALLPGRSYILRTETDQTSATVTDLKYRINVNDFAHEAAKSLEMNEVGICNVSTRAPIAFDPFAENRTTGAFILIDRISNATVGAGMIVHSLRRAENIHWQSLDVGKRVRADMKNQRPAVFWFTGLSGSGKSTIANLFEKKLFATGRHTYILDGDNVRHGLNRDLGFTDADRVENIRRVAEVAKLMADAGLIVIVSFISPFSAERRMARELMADGEFIEVFVDTPFEECARRDPKGLYARALNGEIKNFTGVDSPYQAPEHPEIHLKTLGKSAEEMVDALEHWLNERDIAEDQYESGGGI

SEQ ID NO: 12297 - protein, 307 aa, Mesorhizobium loti
MILCCGEALIDMLPRITTQGEPAFAPYVGGAVFNTAIALGRLGAPAGFFSGLSSDLFGGQFRDALGASKVSSTYAHTSPRPTTLAFVRLTNGQATYTFYDENTAGRMLTIDDLPSLGNEIEAMLFGAISLISEPAGGAYEEFMRREHASRVMMLDPNIRPNFIPDKAKHLRRIREMMAMADIVKLSDEDLHWFGEAGSHEDVIRNWLDRGPKLIVVTHGSEGAVGYTKDHTVTVMPEKVEVVDTVGAGDTFNAGILASLHEQGLLTKAAIGGLPQDAIRKALALGAKAAAVTVSRAGANPPWRHEIA

SEQ ID NO: 12298 - protein, 838 aa, Mesorhizobium loti
MNGESRYDRGNRTRGSMTRAMTSETLPPLLENPDPKTLAREVLVVLKYRVGKDTTVATQYDWLTASIKVVRDRIVDRWMQATKEAYDQQEKRVYYLSLEFLIGRLMRDAFSNLGLMDNMREALSSLGVDLDLIAALEPDAALGNGGLGRLAACFMESMATVDIPAHGYGIRYANGMFRQEIHDGWQVELPETWLDHGNPWEFERRERSFEVGFGGSVESITSKDGRLERHVWKPTEHVLAVAYDTPVVGWRGNRVNTLRLWSGMPVDPILLDKFNAGDHIGALAESNKADALSRVLYPADSHMAGQELRLRQEYFFSTASLQDIVQRHLSQYGDLKSLPDKAAIHLNDTHPAIAVPELMRLLMDVHGMDFDLAWDITKRTFGYTNHTLLPEALESWPVPLFERLLPRHMQIVYAINAQVLLEARATDQFSGEQISHISLIQENGDRRVRMGNLAFVGSHSINGVSALHTELMKETVFADLHKLYPDRINNKTNGITPRRWLIQCNPGLTSLAREAIGDRFLDDIDAIKGLDSFADDSAFREKFAGVKRQNKARLANLVADRLGIKVDPSALFDIQVKRIHEYKRQLLNILEAIALYDQIRSHPERDWMPRVKFFGGKAAPSYHNAKLIIKLANDVARVINRDPAVRGLLKVVFVPNYNVSLAEVMMPAADLSEQISTAGMEASGTGNMKFALNGALTIGTLDGANVEIKECVGDDNIFIFGLTTAEVAERRNNGYNPRAVIEGSPELSQAVAAVSSGVFSPDDPDRYRDLINGLYDSDWFMVAADFDDYSAAQRDVDAVWRNSPDWYARAIRNVARVGWFSSDRTIRQYAKEIWNVPA

SEQ ID NO: 12299 - protein, 737 aa, Mesorhizobium loti
MRKPRVTAATSGPDGLAPASDVAAIVAGTHGDPFAVLGVHEVGKGLFARCFVPHAETVTAYTLTGIEAGALSRRDDAGFFEGKLSIKKRQPLRYHAHNAGGDWWLTDPYSFGPVLGPMDDYYIAEGSHLRLFDKLGAHVIEHEGATGVHFAVWAPNAKRVSVVGDFNDWDGRRHTMRDRRDTGIWEVFIPDIGAGRPYKYEIIGPDGVRLPLKADPFAFKSELRPATASVVAVPPAHDWGDEAHRNYWRNADPRREAVSIYEVHAGSWQLHDDGTFLSWDELADRLIPYVVETGFTHIEFMPISEHPYDPSWGYQTTGLYAPSARFGDPDGFARFVDGAHRAGVGVILDWVPAHFPVDAHGLAHFDGTALYEHADPRKGFHPDWNTAIYNFGRREVVSFLVNNALFWAEKYHVDGLRVDAVASMLYLDYSRKAGEWIPNEKGGRENLEAVSFLQKMNKEVYGHHPGVMTIAEESTSWPKVSAPVHEGGLGFGFKWNMGFMHDTLEYFSKEPIFRKHHHNDLTFGLTYAFSENFVLPLSHDEVVHGKGTLLSKMAGDDWQKFATLRAYYGFMWGYPGKKLLFMGQEFAQRREWSEARALDWNLLDFRPHRGVWQTVRDLNYLYRSRPALHGRDCEPEGFSWLIVDDSQNSVFAWVRNAPGGSPVAVISNFTPVPRDNYRVPLPKAGKWREIINTDASEYGGSGMGNGGMVEARAEGKNISATMLLPPLSTIMLELVAD

SEQ ID NO: 12300 - protein, 421 aa, Mesorhizobium loti
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYEMMLRQHVDANADVTVGCLEVPRMEATGFGVMHVDAKDNIIAFVEKPADPPGIPGNPDFALASMGIYVFKTKFLMEQLRRDAAEPGSSRDFGKDIIPYIVQHGKAIAHRFTKSCVRSTAENEAYWRDVGTVDAYWEANIDLTDITPELDLYDRDWPIWTYAELKPPAKFVHDEDGRRGSAVSSLVSGDCIVSGATLKKSLIFTGARINSYSTLEEVVMLPDVHVGRNAKLKRVVIDHGVRIPEGLVVGEDPALDAKRFRVSEKGICLITQDMINKLGL

SEQ ID NO: 12301 - protein, 481 aa, Mesorhizobium loti
MQVLSVTPEIFPLIKTGGLADVTGALPVALAAKGVTMRTLIPGFPAVMEGFKKRKAVYQYPLLQGGKASIHAVQIAGLDLFVLDAPHLFDRPGGPYGNASGADWPDNWRRFAALSQAGADIAGGAISGYLPEIVHAHDWQSAMTLAYMRYGKAVGTPSMMTVHNLAFQGQFGAGIFGELGLPAVAMALDGVEYYGGVGFLKAGLQAAWAITTVSPTYAQEIRSPEFGMGLDGLINMRSSDLYGIVNGIDTAIWDPETDKHLVSNYTATTLKARAPNRAAVEERFGLDRDDSPIVCVISRLTWQKGMDILATVIDGIVATGARLAILGSGDAGLEGALLAAAARHRGRIGVVIGYDEGLSHTMQGGCDAIIIPSRFEPCGLTQLYGLRYGCVPVVARTGGLADTIIDANEAAMAAGVATGLQFAPNNGGAMLHAIRRLVDAYADPAAFETIQRQGMKADVSWDKSAEKYLELYRLLLSKRVA

SEQ ID NO: 12302 - protein, 542 aa, Mesorhizobium loti
MIRTVPTKPYSDQKPGTSGLRKKVPVFQQEHYAENFIQSIFDALDGFQGKTLVIGGDGRFYNREVIQKAIAMAAANGFGKVMVGQGGILSTPAASHVIRKYKTFGGIILSASHNPGGPHEDFGIKYNAGNGGPAPEKLTDAIFAKTKAISSFKTSDIDTIDIDTIGTVKAAGMTVEIIDPVADYAELMESLFDFDALRRLFKSGFRMRFDAMHAVTGPYAKEILENRLGAPSGTCRNFKPLPDFGGHHPDPNLVHAKHLYDEMMGPDAPDFGAASDGDGDRNLIIGKGIFVTPSDSVAMLAANARLAPGYKDGLKGIARSMPTSGAADRVAEKLGIGIYETPTGWKFFGNLLDAGMATICGEESAGTGSNHVREKDGLWAVLLWLNILAARGESCKQVVTEHWAAYGRNYYSRHDYEEVESDRANALVDELRAKLGSLPGTSVRGLKIAKADDFAYHDPVDGSTSEHQGIRILFEGGSRVVFRLSGTGTSGATLRVYIERYEPDKARHDLDTQAALADLIAAADDIAGIKSHTGRNKPSVIT

SEQ ID NO: 12303 - protein, 672 aa, Mesorhizobium loti
MTPLGATVTPEGIRFAVWSSSARRLWVSLFDGQGNRELDRLELQSEGEGMHALFVPRLAAGTRYGFRADGDYAPDRGLWFDPDKLLTDPYAVEIDRPYAYHWRLAARRNEGADTAPLMPKTVAKTLPKTVPALPPLFRPGGLIYEVPVRAFTKLHPDIPEAQRGTIAALAHPVIIEHLQRLGVSAVELMPVTASIDERHLPPLGLSNAWCYNPVTFMALDPRLAPGGLEELRDTVAALRKASIGTILDLVFNHTGESDRLGPTLSLRGLDNQAYYRHQPDGRLVNDTGTGNTVACDHPVVRDMVLDTLRHFVRHTGVDGFRFDLAPVLGRVDGAFDPTAPLLEAITGDPVLADRVLIAEPWDIGPDGYQLGNFPPRFLEWNDRYRDDARRFWRGDAGAVGALATRLAGSSDIFGKAGQAASRTVNFIAAHDGMTLADIVAYERKHNEANGEQNRDGHNDNLSWNNGAEGETDSAAIANARFDDQCALLATLFASRGTIMLTAGDEFGRSQKGNNNAYAQDNAITWLDWAGRDHALERYASVLGMLRRAVPALSATDFLTGQSADATGTPDVAWLTETGMPLAETDWNDPARHRLVMLLGDAGGDRLAVMINGDRRQCVFTLPEREGFRWQPAIETQAIELARPLPGRSVHFMAEHRTEKWQSVFGQSDASKK

SEQ ID NO: 12304 - protein, 544 aa, Mesorhizobium loti
MMADDNAGQGADWWRGCVIYQVYPRSFQDTTGDGSGDLRGITTRLGHIASLGVDAVWLSPFFKSPMADMGYDVSDYRDVDPMFGSLEDFDALVTEAHRLGLKVVIDQVLSHSSDKHEWFVQSRASRDNPKADWYVWADTKPDGNAPNNWLSVFGGPAWEWDSTRRQYYMHNFLASQPDLNFHNPEVQDALLDTVRFWLERGVDGFRLDTVNYYVHDRWLRSNPPLASSVAGTNGETNTYLYQEHLFDKTQPENLAFLRRFRGLLDEYPDRAAVGEIGDEGRSLQTLAAYTSGGDKLQMCYTFDLLGPQFSAAHVRGCVEAFEQAVTDGWVCWAFSNHDVVRHVSRWTGPDGDADAVARFSIMLLACLRGSICLYQGEELGLEEAELAYEDLRDPVGIRFWPGMKGRDGCRTPMVWEAGADNAGFSTARPWLPVPASHRARATDVQNGSEQSVLSAYRSTLALRRRHPALVSGSIRFLDAEGDVLAFIREGDGQRLLCVFNFAGEPGNWPLPPDIGVAAVLAGAAVVEEEALSLPALGCFLGRLD

SEQ ID NO: 12305 - protein, 487 aa, Mesorhizobium loti
MRAQPTASHYVNGRYIDDEQGAPLPVIYPATGETIAMLRSATPNVLELAIEAARAAQPAWARLKPVERGRILRRAADILRARNADLARIETLDTGKAIQETLVADAPSAADCLEYFGGAVAAYNGEAVDLGGPFAYTRREALGVCVGIGAWNYPIQIAGWKSAPALAMGNAMVFKPSENTPLSALALAEIYSEAGLPDGLFNVVQGYGDVGAGLVGHDVVAKVSVTGSVPTGRKVLSLAGSKMKHATMELGGKSPLIVFDDADIENAIGGAMLGNFYSTGQICSNGTRVFVQSGIHDRFVERLVERTKKIRIGNPLDPETQMGPLVSKAQHEKVVGYIGIGKQDGAVLACGGNVPSLQGFDGGFFVEPTVFTGVTDTMRIAREEIFGPVMSVLKFDGEDEVIDRANDTEFGLAAGVFTRDLPRAHRVIAELQAGTCWINAYNLTPVEIPFGGFKQSGIGRENSLAALALYSQLKSIYVETGDVASPY

SEQ ID NO: 12306 - protein, 550 aa, Mesorhizobium loti
MLEADFVIIGSGSAGSAMAYRLSEDGKHSVIVIEFGGSDIGPLIQMPSALSIPLNMSLYDWGFASEPEPHLGGRVLATPRGKVIGGSSSINGMVYVRGHARDFDHWAEEGATGWGFADVLPYFKRMEDNDGGEDGWRGHGGPLHVQRGSRKNPLYGAFVEAGRQAGFELTDDYNGSKQEGFGPMEQTISGGRRWSAASAYLKPALKRKNVSLVKGFARRVIIENQRAIGVEIEAHKQIQVVKARREVIVAASSINSPKILMLSGIGPAEHLRENGIAVVADRPGVGRNLQDHMELYIQQESTKPITLNSVLNPFSKALIGAQWLFFKSGLGATNHFEAAAFVRSRAGVDYPDIQYHFIPAAVRYDGKAAAKSHGFQAHVGPMRSKSRGSVTLRSPDPKAKPVIRFNYMSHPDDWTEFRHCIRLTREIFGQSAFDAFRGQEISPGSHVQSDDDLDVFIRDHAESAYHPCGTCKMGRADDVTSVVDPECRVIGVDGLRVADSSIFPRVTNGNLNAPSIMTGEKASDHILGRTPLAPSNQEPWINPRWQVSDR

SEQ ID NO: 12307 - protein, 509 aa, Mesorhizobium loti
MTAKRPNFLIVMVDQLNGTFFPDGPAAFLHAPHLKALAARSARFRNNYTASPLCAPGRASFMSGQLPSRTEVYDNAAEFASSIPTFAHHLRADGYHTVLSGKMHFVGPDQLHGFEERLTTDIYPADFGWTPDYRKPGERIDWWYHNLGSVSGAGVAEISNQMEYDDEVAFHAVQKLYDFARVSDDAAHRPWCLTVSFTHPHDPYVARRQYWDLYEDCPALEPEVGFIPCDSQDPHSQRLYKASDYNSFDITAEQIRRSRRGYFANISYLDDKVGELLSVLERTRMLDDTIILFCSDHGDMLGERGLWFKMCFFEGSARVPLMIAGKDIPAGLIKAPVSNLDVTPTLCDLAGIDMSAIAPWTDGQSLLPLLEGKQRYAPVLMEYAAEGSNAPLVAIRDGRYKFVHCEIDPPQLYDIEADPHELSNLATDPAHADLVAAFLEKVRARWDMAAFDTAVRANQARRWVVYPALRNGTHYPWEFQPLQKASERYMRNHMDLNVLEEQKRFPRGE

SEQ ID NO: 12308 - protein, 392 aa, Mesorhizobium loti
METAMTACIVGWAHSRFGKLEGETLENLIVKVATDALDHAGIGPDEVDEIVLGHFNAGFSAQDFTASLVLQADDRLRFKPATRVENACATGSAAVRQGIRAIDANAARIVLVVGAEQMTTTPGPEIGKNLLKASYLPEDGETPAGFAGVFGKIAQAYFQRYGDQSDALAMIAAKNHKNGVDNPYAQMRKDFGYDFCRQESEKNPFVAGPLKRTDCSLVSDGAAALILADTATALKMRRAVAFRANEHVQDFLPMSKRDILAFEGCEQAWTRALKNAGVTLDDLSFVETHDCFTIAELIEYEAMGLARPGEGAKLALDGTTAKDGRLPVNPSGGLKAKGHPIGATGVSMHVLTAMQLVGEAGGIQVPGAKLGGIFNMGGAAVANYVSILDRIR

SEQ ID NO: 12309 - protein, 239 aa, Mesorhizobium loti
MSVTYDFTGRTAIVTGGARGIGRAIAHKLSLSGADVWIWDIEPVELEGTRSLSVDVTKRDNVMQALTIMGEVGVDILVNNAGWLGGYKPFEEFEPAEWQRILQVNLLGTFEVTHRVLPLMRRAGKGRIVNMGSLAGKEGLPSLAAYSAASAGVIAFTKALSREVSDTDIRVNCIAPGPIDTRLIRDLGNETVDAMISASPLKRLGDPNEVAALVVWLCSDASAFNTGAVFDMSGGRARY

SEQ ID NO: 12310 - protein, 694 aa, Mesorhizobium loti
MPNCKAASGEAKAYPYRLARQRGREGTPASLSASPRYGGSMFSKILIANRGEIACRVIRTARKMGVRTVAVYSDADAKSLHVEMADEAVHIGPPSVGESYLRGDRIVAAALSTGAQAIHPGYGFLSENPDFVDQVVAAGLTFIGPSAASIRAMGLKDAAKRLMEKAGVPVVPGYHGEAQEIVLLASKAREIGYPVLIKARAGGGGKGMRRVEHPDDFSEALSSARREAKAAFGDDRVLVEKYVDKPRHIEVQVFGDNFGNAVHLYERDCSAQRRHQKVIEEAPAPGMTPALRKAMTEAAVKAAKAIGYSGAGTIEFIVDASQGLKPDRFWFMEMNTRLQVEHPVTEMVTGTDLVEWQLRVASGEKLPNTQSEIALTGHALEARIYAEDASKGFLPATGTLHHLKFPEAAPEGATMRVETGVRTGDAISPYYDPMIAKLVVHAKDRLAALEALGAALARTEIAGSTVNTGFLAALAADPDFCAGDVDTGLIGRHQAALTGVAPPTGEIVSAAALAASGAAALPLSNDPWSSLSGYAHFHGVARRTRLKFGETDILAKVSVRPDGRFQVAFDAPYDSTNSHDFRAAPRLARWPGHITVFEGAVGYTFAVPDPLARSDEAAAASGSLRAPMPGLVKLVRVAKGDAVIKGQPLLILEAMKMEHTIAAPHDGVVAEIATEGAQVTDGTVLVRFVEEQNA

SEQ ID NO: 12311 - protein, 387 aa, Mesorhizobium loti
MYTNTLSFGHDEDIEALRDMVRRFAQDRIAPIAGDIDRQNEFPAHLWRELGALGLLGITADPDFGGSGMGYLAHVIAVEEISRASASVGLSYGAHSNLCVNQINRWATPAQKEKFLPPLCSGERVGALAMSESGAGSDVVSLKLRAEKRNDRYVLNGTKMWITNGPDADTLVVYAKTDPERKSRGITAFIVEKAMTGFSVAQKLDKLGMRGSSTGELVFENVEVPFDNVLHEEGRGVEVLMSGLDYERTVLAGGPIGLMAACLDVAIPYVHERKQFGQPIGEFQLVQGKLADMYTVMNAARAYVYAVAAGCDRGQTTRKDAAGCVLFAAEKATQMALDAIQLLGGNGYINDYPTGRLLRDAKLYEIGAGTSEIRRWLIGREIMAEGV

SEQ ID NO: 12312 - protein, 94 aa, Mesorhizobium loti
MNDRKRAVQARVYGRVQGVGYRIWTRSEAAGLGLVGWVRNERDGSVTAWLAGADAAVSAMIERLRQGPAGASVSRVEVEEIETWTAPGDFRIVA

SEQ ID NO: 12313 - protein, 370 aa, Mesorhizobium loti
MRQRPALSPIIEALPSTVPFVGPEAQERERGRAFRARIGANESSFGPSPRVIARMSGIARDMWMYCDPDNFDLKVAAAAHHDVAVENVVVGEGIDGLLSLVARMYVAPGDAVVTSLGAYPTFNFHVAGVGGRLVTVPYENDRESLDDLLKAVVKEKAPLVYLSNPDNPMGSWWDADEVIRFIEALPETTMLVLDEAYGELGPASALPPIDISRPNVIRMRTFSKAYGLAGIRCGYAIAEAQVIRDFEKIRNHYGVSRMAQIAGVAALADQPYLETVVARVAAGRRRIAAIAEQNGLKPLASATNFVTIDCGHDGAFALKVLQGLLSRDVFIRKPMAPKLDRCIRVSVGLDHELDIFAEELPGALAAARGN

SEQ ID NO: 12314 - protein, 305 aa, Mesorhizobium loti
MHKQTSPKELDDMLRGSLTALVTPFEKSGRFDEKAFRAFVEWQLGEGTTGLVPVGTTGESPTLSHDEHRHVVKVCIEVANGRAPVVAGAGSNNTAEAVGLVQYAEKAGADAALVVTPYYNKPTQRGLYEHFAAVARATKLPIIIYNIPPRSVIDMMPETMGRLAHDFKNIVGVKDATGKVERVSEQRMTCGKDFIQLSGEDASALGFNAHGGVGCISVTSNVAPRLCAEFQEATLSGDSVKALELQDRLLPLHKAIFLEPGVSGAKYALSKLGKVENVLRSPLVTVEESTAAKIDAAMKHAGLIN

SEQ ID NO: 12315 - protein, 627 aa, Mesorhizobium loti
MAEKTVSADTSTLTTLRNLWPYMWPADRADLRARVTWATLLLVVAKLTLVAGPYFFKWATDALAGGFKTPPPLPSFMLAPVMLVVAYNVLRLVQLGFNQLRDALFARVGQHAVRQLAFRTFVHMHQLSLRFHLERRTGGLSRIIERGTKGIETIVRFIMLNTAPTILEFALTAGIFGFTYGWKYVAVVAITVWVYVWFTVKASDWRISIRRDMNDSDTDANTKAIDSLLNFETVKYFTNERMEADRFDRSMARYEIAATKTWTSLGWLNFGQGVIFGLGTVVVMCMSALEVQAHTQTVGDFVFINAMLVQLSVPLNFIGFIYREIRQGLTDIEHMFDLLDVPQEIVDRPDAKPLSVSAGKVEFRDVHFSYDPNRKILKGVSFEVPAGKTVAIVGPSGAGKSTISRLLFRFYDVQAGQVLIDGQDIRDVTQDSLRSMLGMVPQDTVLFNDTIAYNIRYGRVGASEEEVRKAAELAQIGPFIEKLPDGYKSMVGERGLKLSGGEKQRVAIARTILKAPPILMLDEATSALDSHTEQEIQAALDLVSKGRTTIVIAHRLSTVISADEIIVLKDGQIAERGTHVELMRKHGLYASMWDRQREATEAEERLRLAREGDELGVIVRRRTSEVN

SEQ ID NO: 12316 - protein, 296 aa, Mesorhizobium loti
MMTRNKEFPMQMQSVTPARLVTTGLAFGESPRWHGGRLWVCNWGTSEIIATDAHGNREIMLIVPAVLPYSIDWLQDGRLLVVSGREGLLLRQEVDGKLVTHADLRGLSKSPWNEIVVDGRGNIYVNGGGPAPAAGEYFGPGTVVLITADGAVRQVADDIAFANGMAVTPDNKTLILAESHGNRLTAFDIAADGSLSNRRAWADLDGYPDGICLDAEGAVWYADVPNKHCVRVREGGEVLQTVTVDRGCFACMLGGADRRTLFIVAAEWRGFEHMVGDARTGQVLSVDAPAPGVGWP

SEQ ID NO: 12317 - protein, 740 aa, Mesorhizobium loti
MILTLALLAGLALAWLLIGVVEKFRLGLRFGQALLYVPFKLAYRIDDSHIRIARKAQAPVIYVISHQSRFEPALMLSLLPDDTLHILDEVSARSPWLEPWRELGRTIAFNAEHLFVSRRLVRVLKGKGRLAVYLPDAVEPDVKTFRLFRAVTRIAMQADARIVPIFVAGARSLPVSLTPAARAPRHWFPQLSMSVLEPMTIAELVARNPDQASNTNALFDRVAEARLFGNDLDRGLFLAMRDAAARVGASHPIIEDVISGALSYRKMFIGARVLGRRFEAVTAPGEAVGIMLPNANGVVLSFVGLLSAGRVAAMINYTSGPASVTAAVRTAVIRTVISSRAFVEKADLGDIVAAVEMGGARLLWLEDVRTSVTALDKLAAALLWRLPLQRQDAAKPGVILFTSGSEGTPKAVVLSQKNLLANAMQAEARITISPADILLNVLPVFHSFGLTGGTVLPLVTGVKLFLYPSPLHYKIIPEIARKVQPTIMFGTDTFLANYARTAKDGDFSSLRFVVAGAEAVKPETRRIYRERFQAEIIEGFGLTEAAPVVAVNTAIHGRDGTVGRLLPAMRMKLEPVEGISDAGQLWLDGPNLMMGYMTADRPGELQPLSGWHDTGDIVAVDRDGFITIRGRAKRFAKIAGEMVSLGAVEMLVQSLWPEERHAAVAVPDKRRGERIVLVTTADDANPEELRQFGKKAGAAELMVPNDIVKVEEIPVLGSGKTDYVSTRKLAIDRLGLGVAA

SEQ ID NO: 12318 - protein, 246 aa, Mesorhizobium loti
MTLDLTGRVAVVTGASRGIGYFIARELAAAGAHVIAVARTVGGLEELDDQIKAAGGQATLVPLDLADMAGIDRLGGAIHERWGKLDILVANAGVLGVISPIGHVEAKTFEKVMTINVTSTWRLIRSVDPLLRLSDAGRAIILSSNAAHSARAFWAPYAASKAAVETMMRSWAHETQSLPLRVNAADPGATRTAMRAQAVPGEDPETLPHPSEIAKRIVPLASPELKETGLIFQAKHNRFVAYRQPE

SEQ ID NO: 12319 - protein, 315 aa, Mesorhizobium loti
MAVAFTFPGQGSQAVGMGKDLADAFPEARRVFQEVDDALGENLSKLIWEGPEETLTLTANAQPALMAVSLAAIRALEARGFSLKDKVAYVAGHSLGEYSALAAAGFVSVADAARLLRIRGNAMQAAVPAGEGAMAAIIGLEQPDVEAACIEAAQGASKVCQIANDNGGGQLVISGAKAAVELAAKLCTEKGAKRALMLQVSAPFHSALMAPAANVMREALAGVTKHAPGVPVVSNVTVTPTSDPDEIARRLVEQITGRVRWRETVEWFGANGVTTLYEIGAGKVLSGLARRINRDIATSAVGTPADVEAALATFA

SEQ ID NO: 12320 - protein, 245 aa, Mesorhizobium loti
MFELTGRKALVTGASGGIGEAIARVLHAQGAIVGLHGTRIEKLEALAAELGDRVKLFPANLSNRDEVKALGQKAEADLEGVDILVNNAGITKDGLFVRMSDADWDSVIEVNLTAVFRLTRELTHPMMRRRHGRIINITSVVGVTGNPGQTNYCASKAGMIGFSKSLAQEIATRNITVNCVAPGFIESAMTDKLNDKQKEAIMAAIPTRRMGTGAEVASAVAYLASNEAAYVTGQTVHVNGGMAMI

SEQ ID NO: 12321 - protein, 78 aa, Mesorhizobium loti
MSDTAERVKKIVIEHLGVDADKVTEQASFIDDLGADSLDTVELVMAFEEEFGVEIPDDAAETILTVGDAVKYIDKASA

SEQ ID NO: 12322 - protein, 420 aa, Mesorhizobium loti
MRRVVVTGLGLLSPFGMGFEHSWKELLTGRSAAKRITEFEVEDLACKIAHVVPRGDGSNATFNPESVLEPKELRKIGDFILYGIAAADEALKDSGWEPKTHEEQCATGVLIGSGIGGIEGIAENAMILKERGPRRISPFFIPGQIINLVSGQVSIRHGLKGPNHAVVTACSTGAHAIGDAARLIMWGDADVMVAGGAEAPVTRLSIAGFAACRALSTERNDTPQTASRPYDRDRDGFVMGEGAGVVVLEELEHAKARGAKIYAEVTGYGLTGDAYHITAPAEDGDGAFRCMTAALNRAKLTPADVDYINAHGTSTMADTIELGAVERLVGNAASKISMSSTKSSIGHLLGAAGAAEAIFSILAIRDNVAPATINLDNPERETAIDLVPNKPRSRQIDVALSNSFGFGGTNASLVFQRYNG

SEQ ID NO: 12323 - protein, 254 aa, Mesorhizobium loti
MSKATAAALVTGGAKRIGKAIVEDLAGHGFAVAIHANRSQGEADALAAGINQSGGRATVVGADLTDTNAVAGLVGQAEAALGPISLLVNNASLFVDDSIEDFDWQAWDRHFAIHVKTPALLARNFARALPEGREGLIVNIIDQRVWRPTPRYFSYALSKSALWTQTQMLAQALGPRIRVNAIGPGPTLKNVRQDDSDFDAQLAGLILKRGPELPEFGATIRYLWDARSVTGQMIALDGGQHLAWQTPDVTGMTE

SEQ ID NO: 12324 - protein, 140 aa, Mesorhizobium loti
MALERTFSMIKPDATRRNLTGAITKMLEDAGLRVIASRRVWMSRREAEGFYAVHKDRPFFGELVEFMSSAPTIVQVLEGENAIARNREVMGATNPANAAEGTIRKVHALSIGENSVHGSDAPETAAQEIKYWFSDTEIVG

SEQ ID NO: 12325 - protein, 697 aa, Mesorhizobium loti
MNLAAHDSTFLESAVAPAYLARLNDAQRQAVEHGDGKIAGPLLVIAGAGSGKTNTLAHRVAHLIVKGADPRRILLMTFSRRAASEMAKRVERIAGEVLGRDAAVITDALTWAGTFHGIGARLLRDYALEIGLDPAFTIHDREDSADLMNLARHELGFSKTEARFPTKGTCLAIYSRAVNAQAPLNEVLGSAFPWCAGWAEQLKQLFAGYVEAKQAQNVLDYDDLLLYWAQMTAEPEIAEHLGSRFDHVLVDEYQDTNRLQASILMALKPDGAGLTVVGDDAQSIYSFRAAEVRNILDFPRQFAQAADVVMLERNYRSTETILAAANAVIGEASERFTKNLWSERKSTDKPRLVSVRDEVEQANFVCDTILAEREAGTALKSQAVLFRASHHSGPLEIELTRRNIPFVKFGGLKFLDAAHVKDVLAVLRFAENPRDRVAGFRVLQLMPGIGPSAAAQIVETMTTALDEAMGLAGWRPPQRAADDWPGFVSLYSGLRAGAKWPADLEQVRLWYEPHLERIHEDAITRRADLLQLEQIGSGYASRERFLTELTLDPPDATSDQAGPPHRDEDYLILSTIHSAKGQEWKNVFVLNTVDGCIPADLGVGTKEDIEEERRLLYVAMTRAKDSLNLVMPQRFFPHGQAARGDRHLYASRTRFIPASILSAFQQMSWPGAQAAQGRAPRPDVRVDIGARMRGMWK

SEQ ID NO: 12326 - protein, 264 aa, Mesorhizobium loti
MEIAEIMAQPPIRIAIAGALGRMGRQMVEAVQADPRLALAARFHRPDSVGDGLVSRDEALAMADVVIDFTTPAASADLARVSANRGGPALVIGSTGFDAAELADIADAAKTVPIVRSGSFSLGLNMLVGLVEQAARAFAPEDWDAEIFEAHHRHKIDAPSGTALMLGQAVAGGRGAELDAVARRVRDGVTGARPPGEIGFAVVRGGSIVGEHSVSFCAEGELVTLSHAAGDRIMFARGAIAAALWVSGRPPGEYDMRDVLGFDR

SEQ ID NO: 12327 - protein, 465 aa, Mesorhizobium loti
MTVAKTRTETDTFGPIEVAADRYWGAQAQRSLGNFKIGWEKQPASIVRALGVVKRAAAEVNMEMKRLDPVVGKAIVDAAQEVIDGKLNDHFPLVVWQTGSGTQSNMNANEVISNRAIEMLGGVMGSKKPVHPNDHVNMSQSSNDTYPTAMHIACAEQVVHHLIPALHHLHKALDAKARAFNHIIKIGRTHTQDATPLTLGQEFSGYAAQVASSIKRIEMTLPGLQELAQGGTAVGTGLNAPVGFAEKVADRIAAITGIAFVTAPNKFEALAAHDSMVFSHGAINAAAAALFKIANDIRFLGSGPRSGLGELSLPENEPGSSIMPGKVNPTQCEAMTQVCVQVFGNNAALTFAGSQGHFELNVYNPLMAYNFLQSVQLLSDASVSFTDNCVVGIEAREDNIKAALDRSLMLVTALAPTIGYDNAAKIAKTAHKNGTTLREEALATGLVSEVDYDRLVRPEDMTHPG

SEQ ID NO: 12328 - protein, 257 aa, Mesorhizobium loti
MRLLHKRTLVTGGSDGIGLAIAEAFLSEGADVLIVGRDAAKLEAARQKLAALGQAGAVETSSADLATSLGVATVVEQVKETGRPLDIPINNAGVADLVPFESVSEAQFQHSFALNVAAAFFLTQGLLPHFGAGASIINISSYFARKMIPKRPSSVYSLSKGALNSLTRSLAFELGPRGIRVNAIAPGTVDTAMRRKTVDNLPAEAKAELKAYVERSYPLGRIGRPDDLAGMAVYLASDEAAWTSGGIFAVDGGYTAG

SEQ ID NO: 12329 - protein, 336 aa, Mesorhizobium loti
MRSYRLDGSSGTECLVMRDEPEPQPKPHEIVVRIRAASLNRRDTMILNGTYPLQPRQSVVPLSDGAGDVVAIGDAVTRFAVGDRVTGSYFARWIDGRINAGLIDQLGCTLDGMLAEYAVLDEQWAARLPDHLDWHEAATLSCAGVTAWNAVTGAGIPKPGQWVLVIGSGGVSLFALQFAKLLGCRVAAVTSRGEKADRLRTLGADLVISTSDMPEWGAAVRDQTGGVDLVVETGGPATFAQSLIASTLYGHIVLLTLQDAKGGSIQIPAALYQRSLATISRLFVGSRSNLEAMLRAVSQHRLRPVIDKVFAFTQARDAYRYFQQGDVFGKVVVDGA

SEQ ID NO: 12330 - protein, 551 aa, Mesorhizobium loti
MAAKDVKFSRDARERMLRGVNILADAVKVTLGPKGRNVVIDKSFGAPRITKDGVTVAKEIELEDKFENMGAQMVREVASKTNDIAGDGTTTATVLAQSIVQEGHKAVAAGMNPMDLKRGIDLAVSEVVAALGKAAKKIKTSEEVAQVGTISANGDESVGKMIAEAMQKVGNEGVITVEEAKTAETELEVVEGMQFDRGYLSPYFVTNADKMVADLEDAYILLHEKKLSNLQAMLPVLEAVVQTSKPLLIISEDVEGEALATLVVNKLRGGLKIAAVKAPGFGDRRKAMLEDIAILTGGQVISEDLGIKLENVGLNMLGRAKKVSISKENTTIVDGAGKKAEIQGRVAQIKQQIEETTSDYDKEKLQERLAKLAGGVAVIRVGGATEVEVKEKKDRVDDALNATRAAVEEGIVAGGGVALLRASANIKAAGANADQAAGINIVRRALQAPARQIASNAGAEASIVAGKILENKGATFGYNAQTGEYGDMIAMGIVDPVKVVRTALQDAASVAGLLVTTEAMIAEAPKKESAGGGMPGGMGGGGMGGMGGMDF

SEQ ID NO: 12331 - protein, 98 aa, Mesorhizobium loti
MAKSKFRPLHDRVVVRRVESESKTAGGIIIPDTAKEKPQEGEIIAVGSGARDESGKLVPLDVKAGDRILFGKWSGTEVKLNGEDLLIMKESDIMGIIG

SEQ ID NO: 12332 - protein, 462 aa, Mesorhizobium loti
MISRAEWLRTTLLATSLAFTFTGPVLADSTALPDKTPAEFKVTDFLLDNGMEVVVIPDHRAPIVTHMVWYKIGSADEPPGKSGIAHFFEHLMFKATTNHAAGEFDRAVSDIGGSNNAFTSYDYTAFHETVAPSALEQMMGFEADRMRNLILTDDVIKTERDVILEERRSRIDNNPQAVLDEEVDATLWQNQPYRIPVIGWMQEMEQLNRTDAVAFYDKYYRPNNAVLIVAGDVEPETVKALAEKTYGKVARGPDLPPRIRPVEPEQNTKRTVTLADARVSVPSFSTQWVVPSYHTAKPGEAEALDLLAEILGGGNRSRLYQALVVKQGIASNAGAYFQGTMLDDTNFTVYGAPRGDAKLADVEAAVDAEVARIASGGVTPDELEKAKDRYIRSMVFARDKQDSMAEIYGSTLATGGNVQDVQQWPDRIRKVTADEVKAVAARYLVLARSTSGYLLPQQQAGN

SEQ ID NO: 12333 - protein, 458 aa, Mesorhizobium loti
MTNQHRASFPSPTRGEGRTRTALATLFLSILFLILPALAARAMDIQQVTSPKGITAWLVEDYSVPIVAVRFVFGGGSTQDPVGKEGLTNLMTGLFDEGAGPLDSEAFQVRLDDAGAEMSFEETRDGVYGSMRMLAEQRDEAFDLLRLAVNEPRFDQAPIDRIRAQILSGIIANENDPDTVAQHRWARAVYGDHPYSRSDQGTRQSIAAITKDDLKALHKAVFARGGLHVAVVGAIDAETLKKKLDMVFGDLPQNQALTPVADVEPKLAQRVEVNYDLPQTSLQLAWPGVKRKSADFFPAVLMNEILGGGTFTSRLFAEVREKRGLAYSVNSSLVNQDHADALIVTTGTRSDRAAETLGIVRDVARQLAEEGPTEAELAATKKYLIGAYAITNLDSSSSIAATLVELQLDDLGIDYMQRRAGYINAVTLDQVKAAAKKLLTAEPTIMVVGPPLAGAGKG

SEQ ID NO: 12334 - protein, 627 aa, Mesorhizobium loti
MPIRQLSETMINQIAAGEVIERPASVVKELVENALDAGASRVEVVTAGGGLNLIRVTDDGSGIPEPELALAIARHCTSKLAEDINDIRSLGFRGEALPSIGSVSRLSIRSRTALGDSAAEIGIEGGRVLPVRPAAANRGTTVEVRDLFFATPARLKFMKGERAESSATSDVVKRIAIAFPAVRFTLAGSDRSTLELPATDDSPEGSLRRVAQVMGAEFPDNSIAIDAMREGVHLTGHVSIPSFSRANALQQYAYVNGRPVRDKLIAGAIRGAFADVLPRDRHAVTVLFLTLDPAIVDVNVHPAKADVRFRDPGLVRGLIVGAIRQALADAGIRSATTGAAGMMAAFRPGAASYNHGGPANGHRSYEAAYRASGSAGFDPARSPQRPLDMQFGDFERAGARHGGFSEPGQAAFDTGPLVSADARVGQNETTETLLGTVLGAARAQVHENYIVAQTRDSLVIVDQHAAHERLVYEALKNALHSRPVPSQMLLLPEIIDLPEEDAERLAMHSETLARFGLGIERFGPGAVAVRETPSMLGETNVQQLVRDLADEIADNDTVETLKERLDKIAATMACHGSVRSGRLLKAEEMNALLRQMEATPGSGTCNHGRPTYIELKLADIERLFGRR

SEQ ID NO: 12335 - protein, 395 aa, Mesorhizobium loti
MTAAFLSHIDSELAGLKSAGLYKSERVISSMQSAQIEVGGEKVLNFCANNYLGLADNADLRKAASQALDRYGYGMASVRFICGTQEEHKELEATISSFLGLEDTILYGSCFDANGGLFETLLGEEDAIISDALNHASIIDGVRLSKAKRFRYANNDMADLEARLKEARDCRFRLIATDGVFSMDGIIANLKGVCDLADKYDAMVMVDDSHAVGFVGRQGRGSAEHCGVEGRVDIVTGTLGKALGGASGGYTSGKRQVVDWLRQRSRPYLFSNTLMPAIAGASIKVFELIRNGDALRERLYANAARFRSEMGKLGFTLAGADHPIIPVMLGEATLAQEMAARMLKRGIYVIGFSFPVVPKGQARIRTQMSAAHTSADIDRAVEAFGAVGRELGVIA

SEQ ID NO: 12336 - protein, 344 aa, Mesorhizobium loti
MSNMMKALVKAKAEPGIWMEEVPVPEIGPNDVLIKIRKTAICGTDVHIYNWDQWAQKTVPVPMVTGHEFVGTVADFGAAVTEYKVGQRVSGEGHIVCGHCRNCRAGRGHLCRNTLGVGVNRPGAFGEYLAIPQHNVVPIPDDVPDEIAAIFDPLGNAVHTALSFDLVGEDVLVTGAGPIGIMGALVAQCVGARKVVITDINPVRLALAKKLGVQHVVDASKEKLRDVMPVLGMTEGFDVGLEMSGAAPAFRDMIDTMNNGGKIAILGIAPTGFEIDWNKVIFKMLHLKGIYGREMFETWYKMIALVQGPLDVSGLITHRIGIDDFQEGFDAMRSGSSGKVVMDW

SEQ ID NO: 12337 - protein, 457 aa, Mesorhizobium loti
MVNTGRLGFVKLGAGIKEDRMAFSYMPGFGNDFETETLPGSLPQGRNSPQRPAYGLYAEQLSGSPFTAPRGTNERSWLYRIRPSVKHTGRFKAASYPLWKTAPNVGDHELALGQYRWNPVPMPKEPTDFIQGMRSITTAGDVLGQTGMAAHVYVANRSMVDDHFFNADGELLVVPQVGALRFVTEMGVIELRPGEIAVLPRGLVFKAELVDKDVRGYVCENYGAKLTLPDRGPIGANCLANPRDFKTPCAWFEEKETPCRLIVKWCGNFHVTEIGHSPLDVVAWHGNYAPYKYDLATFSPVGAILFDHPDPSIFTVLTAPSGEEGTANIDFVIFPPRWLVAEDTFRPPWYHRNIMSEFMGLIHGQYDAKEEGFVPGGISLHNLMLAHGPDAPGFEKASRADLKPVKLDNTMAFMFETRFPQMLTRYGAELETRQDNYIDCWADLKKRFNGTPEGDWS

SEQ ID NO: 12338 - protein, 371 aa, Mesorhizobium loti
MGPFPHDAPPAKISKDNPAGTDGFEFVEFAHPEPQKLAELFTRMGYAAVAKHRTKDITVWRQGDINYVVNAEPGSHAMKFADKHGPCAASMAWRVVDAKHAFDHAVSKGATPYEGEDKALDVPTIVGIGGSLLYFIDAYGKKGSAYDAEFEWLGARDPRPQGVGFYYLDHLTHNVYRGQMDKWWDFYRELFGFKQIHFFDIDGKITGLVSRAITSPCGKIRIPLNESKDETSQIAEYLKKYNGEGIQHIAVGTDEIYAATDKLAANGLKFMPGPPETYYDMSYDRVNGHDEPIERMKKHGILIDGEGVVDGGMTKILLQIFSKTVIGPIFFEFIQRKGDEGFGEGNFRALFESIEQDQIKRGVIKVDGKAA

SEQ ID NO: 12339 - protein, 513 aa, Mesorhizobium loti
MTELTLKPGNATLADWRAIYRGAVPKLDEACRPKIKASAEAVARIVAKGEPVYGINTGFGKLASVRIPAGDLETLQRNIVLSHAAGVGEPMPVAIARLMMALKLASLAQGASGVRPETIDLLQAMLANDVIPVVPAQGSVGASGDLAPLSHMTAVMIGVGECFTPHGRFPAKVAFVSHGLEPVTLGAKEGLALLNGTQFSTAYALAALFEAEVLYQSALVAGALSTDAAKGSDAPFDPRIHLLRKHRGQIETAEALRNLMAGSAIRESHRVGDERVQDPYCLRCQPQVMGAALDVLRKAADTLGTEANGVTDNPLIFAEDDTALSGGNFHAEPVAFAADMIALAVCEIGSLSERRIAMLVDPALSGMPAFLTPKPGLNSGFMIPQVTAAALVSENKQKAYPASVDSIPTSANQEDHVSMAAHGARRLIGMVENATAVIGIELLAAAQGCDFHQPLASSDALEAVRKLVRAEVPHLDNDRHFHPDMEKAIAMVRSGATVRAAGAVALPSIAGAA

SEQ ID NO: 12340 - protein, 590 aa, Mesorhizobium loti
MSLLQIYWRALGYLAADKRRVALICGANVALAAIAILEPIMFGRVIDAISEHGSVFSTLAVWAGLGAFNVIAFVLVARGADRFAHARRSEVLCQSFERVITMPLAWHHQRGTSNALHTLLRAVETLFSLWLEFMRQHLSTAVALVLLVPTALSMDVRMSMVLLGLGVLYVGIGRLVMKRTKAGQAAVERHYHKVFAHVTDSVSNVAVLQSYNRLGHEAETLRRYVKNLLDAQNPVLDWWAIANALNRLSSTISMMVVLLIGAYLVTHGQLRVGDVIAFTGFATLLISRLDQMSAFANQISEARAKLEEFYKLEDSAADAAEPDGLRDLTNVTGHVRFEDVGFEFANSGQGVSGVSFEVQAGQTVAIVGPTGAGKTTLINLLQRVFSPSTGRILIDGIDTRTVTRKSLRHSIATVFQDAGLLNRSIEDNIRVGRADASNVEIHAAAVAAAAQDFILAKSGGYDTVVGERGGQLSGGERQRIAIARAVLKDAPILVLDEATSALDVETEDRVKEAIDELRRDRTTFIIAHRLTTVRDADLVVFMDKGRVVEMGGFAELSLRNGRFASLLRAGGLLNDEEVRRLSRSVQGEAA

SEQ ID NO: 12341 - protein, 481 aa, Mesorhizobium loti
MALACCGATKRSGAEGRGTMDYDMLVIGSGPSGRRAAVQSAKLGKSVLVVDRGRRLGGVSVHTGTIPSKTLRETVLNLSGWRERGFYGRGYRVKQDISVGDLIERLHKTLDHEVEVLQHQFMRNTVKSARAAVKFLGPNKVSLTSDNGDYSEVGFANALIAVGTRPHRPRDVPFDKTRIFDSDEMLEIDRLPRTLTVIGGGVIGVEYATIFSALDVPVTLVEPRNSILDFVDREIVDDFIHQMRDRGMTIRLGSAVKEIRSKPEAAEVELADGRTIRSEVVLYAAGRTGNVGSLGLDVVGIDADSRGRIKVDPQTFQTNVPNIYAAGDVIGFPSLASTSMEQGRVAACHAFGVTLPPPPETFPYGIYAVPEISTVGQSEEQVRESGAAYEVGVARFRETSRGHIMGVNTGFLKLLFSIETRRLLGAHIVGEGATELIHIGQAVINLGGTVDFFVNNTFNYPTLAEAYKIAGLDAWNRMGRG

SEQ ID NO: 12342 - protein, 343 aa, Mesorhizobium loti
MNKFTPTKPAGARSVDDVTGSRRLRRMRKADWSRRLVQENRLTVDDLIWPIFVVEGRNVREPIAAMPGVFRLSVDLAVKEAERAAKLGIPALATFPNVELALRDQTGSHILDPENIINRATRAIKDAVPGIGIITDAALDPFTSHGHDGILRDGIIVNDETVEQVAAAAVIQAAAGADIIAPSDMMDGRIGAIRDALDANGFQDVAIMSYATKFASAFYGPYREAVGTAGLLKGDKKTYYIDHANSDEAVREAEQDIAEGADMLMVKPGLPYLDIIRRLKDEFQMPTFAYQVSGEYSMIKAAGANGWIDGEKAMLESLLAFKRAGCDGILTYFAPEVAEMLKG

SEQ ID NO: 12343 - protein, 323 aa, Mesorhizobium loti
MIRSVVRGMGAALPRRIMKNADFEGMVETSDEWIVQRTGIRQRHIAADDETTASLGEAAARAALANAGLTPGDIDLIVLATSTPNNTFPATAVEIQNRLGMHHGFAFDMQAVCSGFVYAVTTADLYIRGGLAKRVLVIGSETFSRILDWNDRSTCVLFGDGAGALILEAGEGAGTIADRGVLAASLRSDGVHKDKLFVDGGPSTTGTVGHLRMEGREVFKHAVGMITDVIEATFSAAGISADDLDWFVPHQANKRIIDASAKKLGIAEQKVVVTVDLHGNTSAASVPLALSVAVADGRIKKGDLVLLEAMGGGFTWGAVLVRW

SEQ ID NO: 12344 - protein, 362 aa, Mesorhizobium loti
MSKAAEIDIVSVSKVYGTTTAVEDISLKIPAGTYCCLLGPSGCGKTSTLRMIAGHESISSGDVRLGNTVVTDLPPAKRGTAMMFQSYALFPHLDLIDNVAFSLKMKGVDKEKRRAKALDMLKLMQMEAYAKRRPAQLSGGQQQRVALARALITDPEALLLDEPLSALDPFLKIRMRAELKKLQTSLGITFVHVTHSQEEAMALADLIVVMNDGRIEQAAPPREVFERPATAFVARFMGDHNVISGRVTSSRDAMVVFEVNGGGSLAASGKPQQAGAPIDIAIRTDHVRIGEAPAPGLGFTGIVANIEYRGATVKLSVTGAGIDDFTVIVDDSDFFAKPVAIGDAVPLAWDAEDAIVLGRLHS

SEQ ID NO: 12345 - protein, 308 aa, Mesorhizobium loti
MKPKIFIDGEHGTTGLQIRALLAERGDLEIISIPTERRKETAARAEFLNAADIAILCLPDDAAKESVSLITNDTTKVIDASTAHRVAEGWAYGFAEMDKEQAKAIATAKRVANPGCWPQGPIATLRPLVTSGLLPADFPITVNGISGYSGGGRPMIEDYVAKGEDASEFLPYGLTLQHKHVPELRAYAKLSHDPIMQPAVGNFAQGMITVVPLQLGGLDSVPTGAELHAAIADHFAAIKGGVVEVAPYAHLERMPEIDPEIYNGTNRMKVYVFANDKRAQALLLAVYDNLGKGASGAAVQNMDLMLGL

SEQ ID NO: 12346 - protein, 335 aa, Mesorhizobium loti
MATKNIDHAFTARSKTGGALEPTYSGALSFMRRKYTKDVKGADAVVWGIPFDAAVTNRPGARFGPQAIRRASAILDNDPQYPFSRDLFEHLAVVDYGDCLLDSGNHQKTPGTIEREAAKILKSGAFLLTLGGDHFVTWPLLKAHAAIHGPLALVQFDAHQDTWEDDGKRIDHGSFVGRAVKEGIIDPDRSIQIGIRTHAPDTFGIKILYGHEIEEMRASDIAYAIVDRTGGKKTYLTFDIDCLDPAYAPGTGTPVAGGPSSAKILSTLRQLNQVDIVGADVVEVAPAYDHADITAIAGSMVAMQYLGLLAERKARQEEMNNGNHNGAAVNHGNGI

SEQ ID NO: 12347 - protein, 426 aa, Mesorhizobium loti
MTRTPGFNTLAVHAGAKPDPATGARATPIYQTTSFVFDDADHAASLFGLKAFGNIYTRIMNPTQAVLEERVAALEGGTAALAVASGHAAQVIVFHNLMQPGDNFVAATRLYGGSINQFGHAFKNYGWEVRWADTNDLSTFESQIDDRTKAIFIESLANPGGTFVDIEKIGDIARKHGLPLIVDNTLASPYLIRPIEHGADIVVHSLTKFIGGHGNSIGGVIVDGGTFDWSKSGKYPMLSEPRPEYGGLVLHETFGNFAFAIAARVLGLRDLGPAISPFNAFLILTGLETLPLRMQRHCDNAVTVAGWLSNHPKVAWVNYPGLPSDKNNALQKKYSPLGAGAVFTFGLKGGYEAGVKFVEALELFSHLANVGDTKSLVIHPASTTHRQLSDEQKVKAGAGPDTVRLSIGIEDVTDIVADLEQALAKV

SEQ ID NO: 12348 - protein, 424 aa, Mesorhizobium loti
MSKVGNNSGDSKNTLYCSFCGKSQHEVRKLIAGPTVFICDECVELCMDIIREENKTSMVKSREGVPTPQEILKVLDDYVIGQPYAKRVLSVAVHNHYKRLAHAGKNNDVELAKSNILLIGPTGCGKTLLAQTLARIIDVPFTMADATTLTEAGYVGEDVENIILKLLQSADYNVERAQRGIVYIDEIDKISRKSDNPSITRDVSGEGVQQALLKIMEGTVASVPPQGGRKHPQQEFLQVDTANILFICGGAFAGLDKIISDRGRKTSIGFGATVASPEDRRTGDIFRQVEPEDLLKFGLIPEFVGRLPVLATLEDLDEPALIQILTEPKNALVKQYQRLFEMENVDLTFHENALSAIAKRAIERKTGARGLRSIMEAILLDTMFELPALEGVREVVISEEVVTGSARPLYIYSEQKEKKGNVSA

SEQ ID NO: 12349 - protein, 808 aa, Mesorhizobium loti
MKGWTMAKISKAPSDGVFAVLPLRDIVVFPHMIVPLFVGREKSIKALEEVMGQEKQILLATQMNAADDDPEPDAIFDIGTLANVLQLLKLPDGTVKVLVEGASRAKIVSFTDRPDFHEARATALVEPEEEEVEVEALARSVVTDFENYVKLNKKISPEVVGAASQIDDYSKLADTVASHLAIKIPEKQEMLATLSVKERLEKAMGFMEAEISVLQVEKRIRSRVKRQMEKTQREYYLNEQMKAIQKELGEGEDGRDEAAEIEARIKKTKLSKEAREKAEAELKKLRTMSPMSAESTVVRNYLDWLLSIPWGKNSKVKQDLAYAQNVLDTDHFGLDKVKDRIVEYLAVQSRQKKLKGPILCLVGPPGVGKTSLGKSIAKATGREFIRMALGGVRDEAEIRGHRRTYIGSMPGKVIQSMKKAKKSNPLFLLDEIDKMGQDFRGDPSSALLEVLDPEQNSTFMDHYLEVEYDLSSVMFVTTANTLNIPAPLMDRMEIIRIAGYTEDEKIEIAKRHLMPKVIRDHALQPKEFSVGEDAIRAIIQTYTREAGVRSLERELMKLGRKAVTEILKTKKKTVSITAANLADYLGVQRYRFGQVEADDQVGVVTGLAWTEVGGELLTVEGVMMPGKGRMTVTGNLRDVMKESISAAASYVRSRALDFGIEPPLFDKRDIHVHLPEGATPKDGPSAGAAMATAIVSVLTGIPVRADVAMTGEITLRGRILPIGGLKEKLLAALRGGIKKVLIPEDNAKDLAEIPDNVKNGMEIIPVSRVGEVLRHALVRMPEPIEWVEPVNPPATTDSADDAGKSLAH

SEQ ID NO: 12350 - protein, 309 aa, Mesorhizobium loti
MAAGKPVVILGVFVADTAYRADRQPRMGETILGNSFKLGPGGKGSNQAVAAGKLGADTTFLTRLGVDAFADMAKRTWQDAGVKSAVIDTPDSYTGAAYIFVEEGSGNNAIIVSPGAAMLISPTDIEANAALIRGAGVFVTQLEQPIDAAMRALEIARGAGVTTILNPAPAAKLPDRVYTLCDYLTPNETETEELTGLKVSSVDEARTASGKLLEKGVGTVIVTLGDKGALLHSKGRSEHVPAISAGPVVETTGAGDAFNGGFAAALSRGVEPLQAVRFACAVAGISVTRPGTAPSMPTLQEVEALLAKG

SEQ ID NO: 12351 - protein, 256 aa, Mesorhizobium loti
MTGRLKDKVALIIGSARGIGKGIALRFAEEGARLVLADSEAEAGQATADELGVPFIGTDISQMRDAEASVALALKRHGRLDIIVQNAGIYPWQLIENTSTDDWDRVMAVNLRGTFNATRAALVPMKAQRSGRMLYTSSITGPHVTSPGHGHYSATKAGINGFIRAAALEFSGYGITVNGVEPGNILTEAIQQHRGAAYIKNMEDSIPLGRLGSPRDVANAFLFLASDDAGYITGTTIVVDGGQLLPEGNDFRMVPP

SEQ ID NO: 12352 - protein, 479 aa, Mesorhizobium loti
MTIHGISPDVLAALEHVLGQSGVAADTADMAKYLVDWSGDHHGGALAVLKPASVAEVQAAVRLCGTLGLAMIPQGGNTGLVAGAIDIGTAGGAVVISLERLNRIRSVDADNFILQADAGCILQHIKDAADERDCLFPLALGAQGSCQIGGNAASNAGGVNVLRYGMARDLIVGLEAVLPDGELWNGFSGLRKDNRGYDLKQLFIGAEGTLGIITGVEMKLFPKPGRVETAYLGLPSFEAAISLFRRARRQCCDLISAFEIIGAECMELARLADPNIVTPVTGPVHVLIELSSSAEIDLRALLMNFLADTMEEEIVTDAVLAESGAQARAFWGIREGLVEGQAKRGYHVRTDLSVRISDIPTLIAQARQFIELQHPGWISQAYGHAGDGNIHFNVLPPLDLADPDARARGATITTGLYDITNALGGSISAEHGIGRTRQRVYWAGMSAVQRRLVSTLKDALDPGGLMNPGCLFPATETFS

SEQ ID NO: 12353 - protein, 402 aa, Aspergillus nidulans
  unsure (1)..(402): unsure at all Xaa locations
LLQWVMIIPAEITTAVSVLQFWPATDAIHLAAYITIFWLMALANVFHFKVYGYFEYYMGFIKCAVVILMICFLFIMASGGIPAAHGPLVFSYWKNPGAFNNGIKGIAKSFVQAAFSFGGGEHIAVIAGEVAPPRSTIRKTVRPVFWRMFTFFGVDIWLVGMCVPYDDSDLINGSGTLGSPFVIALKRADVWGLAHAINGFIFLSVISCGVTSVYVASRSLTALADLGLVHRTLGKKDATGRPWVAIAVSLAIGVGLRYLNVDGTGSIVYDGSSSLVALPLTRSLSCFPFPFSSFPGYRANTMXVAIVTLFQWASIYIAHLRFRTGLLAQGRNLADLPLKGLLTPYAQCFSLLIVLFIFGCEFYLACFPFGEKGSAKSFFSTYLAAPLFFFDYGVYKVRESTY

SEQ ID NO: 12354 - protein, 1285 aa, Aspergillus nidulans
  unsure (1)..(1285): unsure at all Xaa locations
LGKRGKPGLSRDQAPLPKRVVHLSASAIKGMSVEEETARADLTVLPVILTQQEKSLSSYAMLDTGADGKRFIDQEWAEDNHLELLPLKNPIHLESFDGRESEGGPITHYVRINLTIHDHHEKKACFLATQLAHYPIILGMPWLETHDPRWGFAEHTLIFDSAYCRQNCNIPAQPARSRPCVTCLPEAARRTXLPVPKDWRNKICPSLPPRLLSLRPXVHALFTATIGNIDEVLAKRSGDGNPEDLLLPEYKDYADIFSPKEADKLPPHQPYDYLITLIDGKTPPFGPLYGMSRDELVALQEWIMENLRKGFIRPSSSPTASPVLFVKKPGGGLCFCVDYQALNVILVKDQYPLPLVKETLNNLKGMRYFTKIDIISAFNNIRIKKGQEYLTAFRTCLGLYESLVMPFGLTGAPATFQHYINDTLRDYLDIFCTAYLDNILIYSQTRSEHIQHVRKVLQKLREAGLFAKLVKYEFTVHETKFLGLIVARDRIKIDPEKVQTIAAWATPTCITDIQAFIRFANFYRRFIKDFSKIIAPLVNLTKKDVEFQWTPTCQLAMDALKKAFTSAPVLKPFDWTQDIILETDASDFVSAGVLSQYDDNGVLHPVAFFSKKHSATECNYEIYDKELLAIIRCFEEXRPELEGTPNPIKVITDHRNLEYFMSTKLLNRQQARWSEFLSCFNFRIVYRPGKQGAKPDTLTRRSEDLPKEGDEHLLHQSQTVLKHENVDPACLPEPAEPAEPAEPAEPAEPAEPAEPAEPAEPAEPAEHAEPAKHAEPMGTRQSVSFRDEVELQLPPEIQDLICIAYETDPVVRSILKALATRQAQHPDITLADCERKGSLLFYRNRLYIPDNNDLKAKLTCLAHDKPTSGHPGRACTYKLLAREYYWPNMYXYVSQWIKNCHTCQRITPSYKARQGILRPLPVPEHAWQDISMDFITHLPTSQGFDSILVVVDRLTKMRHLIACQATINAEGVAHLYTQHVWRLHGLPRTITSDRGPQFVAEFWKHLNKHLDIQSLLSTAFHPETNGQTEWVNAMLEQYLQAYITYLQDNWSTWLPLAEFALNATYSEAIRTSLFFANYRFHPRMGFEPVPVPDCPASQDAENFAQKMQAISDYVRSQMTSAQARYEEQSNKTRQPARQYKAGQRVWLDARNIRTLRPSKKLDWKFLGPFTIKRMINAHAYELDLPASMRIHPVFNVSLLRPAADNPVPRQRADPPPPIEVEGLEHWEVESILDSRWERRGRGGPRLKYTVKWVGYDDPTEEPAEYLTHAKQLVQNFHRRYPHKPR

SEQ ID NO: 12355 - protein, 918 aa, Aspergillus nidulans
PAGAAVQFFDPGLLRGNLDGTARNDRYPLHLIHETLNQIGQARWFTKLDVSAAFHKIRIAKGQEWMTAFRTRYGLFEWLVTPFGLANAPSTFQKYINWTLREYLDEFCSAYIDDVLVYTNGDLRQHRKHVRMVLKKLEEAGLYLDIKKCEFECKETKYLGFIIQAGKGIKMDPEKVKAIKEWETPTTIKGVRGFLGFANFYRRFIPNFSGIVRPLNNLTKKGTPFLWTKECQDSFDLLKEKFITGPVLATFNPSYRTVVETDSSGYNTGGVLSQYNEKGELHPCAYFSKRNSPAECNYEIYDKELLAIVRCLEAWDAELRSCGEFQVITDHKNLEYFFSPRKLTERHVRWSLFLSRFNFKLVYRKGSANQRADALSRRDQDMPDDEDDRVKSRTMQLFTEKHLGKTVVATLRPAEEQPWEPYEKSDMWKEALKQDERYSEAVLCLKDGARRFPPHLQLKVGISECQLDAQDHILFRGRRWVPDSEQLRTSIIQAAHDSILTGHPGREQTYLLVSREYFWPNMSRDIRRFVRNCDICGRTKSWRDQRRGLLKPLPVPDRPWQEVSMDFITDLPESEGCTNIMVITDRLTKGVILEGMSETDSESVAWALVRVLISKHGIPKAITSDRGSQFTSDTWARICTLTGINRRLSTAYHPQTDGSTERMNSTVETYLRMYTCYDQKDWNRLLPLAELAINGRTSTATGVSPFYLSHGYNLSPFTPTEEVEHLAEEPTKSPIQKGEAIVRKVKEALDWAQASMAYSQQNTENQANKHRSPATNYQVGDKVWLSLKNIRTDRPSKKLDWKNAKYEVIGLVGSHAVRLNTPPGIHPVFHVDLLRLASSDPLPSQKNDDSQPPSIMVNGEEEYMVEKILDERRRRYGRGHRLEYLVKWSGYAQPTWEAATALEEVQALDEWLDRTKQY

SEQ ID NO: 12356 - protein, 274 aa, Aspergillus nidulans
ILDHASKNNYAVPAMCVYNVEGILATVRAANKKRSPAMIQLFPWALHYADGLLVHAAAEAAKSAEVPVTVSMDHAQTPEIIRRAADIGGFDSIMVDMSHYEKEENLRLTRELVAYCHERGIATEAEPGRIEGGEDGVADTAELEGLLTTPEESEEFVDTGIDWLAPAFGNVHGEYGPRGIQLEYERLKSINEKVGDRVRLVLHGADPFTEEIFRKCIECGVSKVNINKVLNNEYVKVQREKAGRVPLTQLLEEATDEMQKAVEKCMDMLGSTGR

SEQ ID NO: 12357 - protein, 359 aa, Aspergillus nidulans
  unsure (1)..(359): unsure at all Xaa locations
QTTDAVNSLCXSLPDNCCSLQGFLVFHSFGGGTGSGFGALLLERLSTEYGKKSKLEFAVYPSPRVSTAVVEPYNAVLSTHSTIENSDCTFLVDNEAVYDICRRNLDIPRPSFEHLNRLIAQVVSSITSSLRFDGALNVDLNEFQTNLVPFPRIHYPLISYAPVISSNRSSHESFKVQDLTLQCMFSLWLLTYSVAYITEIXXLILHLGAEPNNQMVVCDPRNGKYMAVALLYRGDCVPRDCTQAIASLKAKASFNLVEWCPTGFKVGINYQKPARVPGSELAPVDRSVSMLSNTTAISEAWSRLDHKFDLMYSKRAFVHWYVGEGMEEGEFSEAREDLAALEKDYEEVAGDSLDMEGEE

SEQ ID NO: 12358 - protein, 294 aa, Aspergillus nidulans
ANGVVLHNFRFCIAPLDVVKIRLQLQIHSLSDPTSHAHITGPVYKGTLSTIKTILREEGLTGLWKGNIPAELLYVCYGGIQFTTYRTTTQLLAQLDPHRLPQPIESFISGALGGGIATAATYPLDLLRTRFAAQGSGDNRVYESLFASLRDIAKTEGTVGFFRGCSAAVGQIVPYMGLFFATYEALRPVMATAPELSPIPLPPGSGDAAAGIVASVLAKTGVFPLDLVRKRLQVQGPTRALYVHRNIPEYRGVFNTMGLIFRTQGLRGLYRGLTVSLVKAAPASAVTMWTYERA

SEQ ID NO: 12359 - protein, 257 aa, Aspergillus nidulans
FLPPSIDKPRLLAGESYAHFSPAPPAISTQTIATNPEHDYLILGIDEAGRGPVLGPMVYSAFYLPSSLHHSLLSEEYSFNDSKVLTAGVRANLMRILCTQGSPLHESCGWATKLLSARDISSGMMRPAAGVYNLNAQAMDATIELIRGVVEERKLNVREVYIDTIGNPASYQKKLEMVFPSLRITVAKKADSLYPCVSAASVVAKVTRDVALDVCYEVLKENGGVGDGWGSGYPSDPKCVGWIRTNMRSVFGVGIQC

SEQ ID NO: 12360 - protein, 659 aa, Aspergillus nidulans
VIVQAAYAIGGLESGFPDNLNELKDLCAKAFAASPQVLIERSMKVWKEIEYEVVRDARDNCITVCNMENFDPLGIHTGDSIVVAPSQTLSDEDYNMLRTTAVNVIRHLGVVGECNIQYALNPYSKEYCIIEVNARLSRSSALASKATGYPLAFIAAKLGLNIPLNEIKNSVTKVTCACFEPSLDYCVVKIPRWDLKKFTRVSTQLGSSMKSVGEVMAIGRTFEEAIQKAIRSVDFHNLGFNETNALMSIKTELQTPSDQRLFAIANAMAAGYSVDDIWKLTNIDKWFLTRLKGLSDFGKLMTNYNASTVTAPLLRQAKQLGFSDRQLAKFLSSNELAIRRLRVEAGIIPIVKQIDTVAAEFPSVTNYLYLTYNASEHDVRFDDNGIMVLGSGVYRIGSSVEFDWCSVRTIRTLREQGHKTVMVNYNPETVSTDYDEADRLYFENINLETVLDIYQLESSSGVIMSMGGQTPNNIALPLHRLNVRILGTSPEMIDGAENRYKFSRMLDRIGVDQPAWKELTSIEEAREFCDKVGYPVLVRPSYVLSGAAMNTVYSEHDLASYLNQAADVSREHPVVITKYIENAKEIEMDAVARNGVMVGHFISEHVENAGVHSGDATLILPPQDLDPETVRRIEEATRKIGNALNVTGPFNIQFIAKDN

SEQ ID NO: 12361 - protein, 281 aa, Aspergillus nidulans
YKTEVIPLLHSMSPHARAIGAVNTLIPIRNLEGSTDNALDLEKNRAGPIKGLHGDNTDWIGIGICIRRGLSPANAIRPSTTGLIIGAGGMARAGIYAMIHLGVQNIFIWNRTVANAEKLAQHYMRLNLCTLGGSGSASYTIHVLKSLQESWPANYKQPTIVVSGIPAHRIGDQPAPNFQLPPQWIESPTGGVVVDLAYKPLNTPLMRQIRSLSHQRWAALDGLDVLPEQGFAQFELFTGCRAPRRLMRTVILQEYKEEEQGEEYDQSAMRTRLENLDGQPM

SEQ ID NO: 12362 - protein, 350 aa, Aspergillus nidulans
  unsure (1)..(350): unsure at all Xaa locations
YSIFHFYVCFSEVIFGAQAAGSVFSYAPGMSKAKHAAGELKALYSRKPKIHGHNVMRGRWSGVAASAAMRNVLPLPPRSLQGSIEFRNVYFRYPTRMTVPVLSGLSFSIRPGQFVAFVGASGCGKSTTIALLERFYNPLPGSGGIYVDGRDISSLDLQSYRRQLAFVGQEPALFQGTIKENILLGMEEGEVDDGQIIAACKDANIYDFIISLPCVQSLLLSTLLYSHCDTGXHASRQGFNTEVGSKGGMLSGGQKQRIAIARALLREPRILLLDEATSALDSESEQVVQAALDTAARGRTTVAVAHRLSTIQRADVIYVLANGRIAEEGTHAELLRRRGHYYDLVNLQSL

SEQ ID NO: 12363 - protein, 482 aa, Aspergillus nidulans
MPRSAIVQEYNPTPTLSVDRKSAQHQHEGIIARPSGYRVSWHANPAVELHHFGQSHPMKPWRLTLTKQLVLAYGMHHAMDLYHCRAATVEELSDFHTSDYLDFLQTVVPGDMNDAQASKDFSENIVRFNFGDDCPIFDGLFQYCSLYAGASLDAARKLCNNQADIAINWSGGLHHAKKAEASGFCYVNDIVLAILQLLRIHPRVMYIDIDVHHGDGVEQAFWSTDRVLTVSFHKYDKENFFPGTGPLDSTGPTHPLNPGAHHAVNVPLHDGIDDESYVQLFKDVVGACVSKFRPAAIVLQCGADSLGCDRLGCFNLNVAAHGACVAYTKTFGLPMLVVGGGGYTPRNVSRAWAHETSILIDAQDKINPVIPSNVAFRNHFGPDFSLFPPLSEMRKLENKNSRAYLATIVQTITEQLRYLQAAPSVQMSVIPPDLLGLREETEKEIEEEIAKLEEKREEAEGGKNSRRRDAEKGAGLRGELYS

SEQ ID NO: 12364 - protein, 426 aa, Aspergillus nidulans
  unsure (1)..(426): unsure at all Xaa locations
DYIIIGGGLAGCTLAGRLAEKNRSLQILIIEAGPNVAGHTLTEYPLACFGAHFSPLDWAYTTVPQTHLDNRMCYNSAAKALGGGSAINYGTWTRGNAADYDRWAAMVDDESWGYEALLPYFKRMENCLDCKGTETGAHGVSGPIHNVSVSGGSADRIYPLREPLRRAWERLGVKEVLDANAGSPLGLGELVENWREGRRQITADVFNILERPGITTLTETMVQKILIEKDQQGKKVAKGVQVVQGPVFLADGEVIVSAGAYRTPQILMLSGIGPKDELAKLGIAAVADAPGVGQNLHDHFALRAVVEAATPRKRGYQSXTPLWDSLAYGMGLPCDWIATLQAPRNELVQALHQDGATDVGSHPYLAPDACHVETLIVYAPAGAAVSRIEIPMDGTHIASAVLGMATTSRGRITLASADATTAPVLQ

SEQ ID NO: 12365 - protein, 148 aa, Aspergillus nidulans
DVALYLKLERLVLHLLERSDLRNQDNIWETMAHEAAVNGYELLLDKLVKQPNWDLVVNKRSKGKPTPLYEAAKNGHRRIVSTLLEKGAKVNEKDKSERVPLHEAAANGHDDVVHFLLENGAKVDEGDKAGRVPLHEAAAHGRNAVIKF

SEQ ID NO: 12366 - protein, 516 aa, Aspergillus nidulans
MAPAVGIDLGTTYSCVGVFRDDRIDIIANDQGNRTTPSFVAFTDTERLIGDAAKNQVAMNPHNTVFDAKRLIGRRFGDAEVQADMKHWPFKVVDKSGKPIIEVEFKGETKQFTPEEISSMVLTKMRETAEAFLGGTVNNAVITVPAYFNDSQRQATKDAGLIAGLNVLRIINEPTAAAIAYGLDKKVEGERNVLIFDLGGGTFDVSLLTIEEGIFEVKATAGDTHLGGEDFDNRLVNHFVTEFKRKHKKDLSTNARALRRLRTACERAKRTLSSAAQTSIEIDSLFEGIDFYTSITRARFEELCQDLFRGTMEPVERVLRDAKIDKSSVHEIVLVGGSTRIPKIQRLVSDYFNKEANKSINPDEAVAYGAAVQAAILSGDTSSKSTNEILLLDVAPLSVGIETAGGVMTPLVKRNTTIPTKKSETFSTYSDNQPGVLIQVYEGERARTKDNNLLGKFELTGIPPAPRGVPQIEVTFDLDANGIMNVSAVEKGTGKTNKITITNDKGRLSKEDIERM

SEQ ID NO: 12367 - protein, 442 aa, Aspergillus nidulans
  unsure (1)..(442): unsure at all Xaa locations
DVPSIVRSVIEDIRQNGDKALRSYSEKFDKWSPDSFKLSKEQIDEIVSTVPAQVIEDIKTVQQNVRTFAEEQRKSIRDFEYQIQPGVFLGQKNIPISAVGAYCTYPCQTXXRSCMDSSCALRYIPGGRYPLLASAHMTIVTAKAAGVSRVIACTPPIQGKIPASTVAAIHLAGADEIYILGGVQAIAAMALGTESINKTDFIAGPGNPFVAEAKRQLFGEIGIDLPAGPTEVLIVADAKADPFVVATDLLSQAEHGPDTPAILITDSRDVAEKTIKEVERLLPILPTRALAAVSWERFGEVQLVEDLNEAYKLADEYASEHVQILTENPREALVKMKNYGALFLGEKTCVSYGDKVCLLSPSRTIPKFYSDCMDNXRTPXCIGTNHVLPTKSAARFTGGLWVGKYLKTVTYQEVTDAKASGELGRLCGRAARAEGFEGHARS

SEQ ID NO: 12368 - protein, 534 aa, Aspergillus nidulans
  unsure (1)..(534): unsure at all Xaa locations
NIYVITTIAVIGGALFGFDIASMSAMVCPSASSRPIVPSVGXELTQHLLTSILSLGTQQYKCFFNQGGIGEDGKCAGPTSSNQGGISASMPGGSFAGALCSGILTDWLGRRRAIQVGAVIWCIGSAITCSSFSIGQLVVGRFINGVSVGICSAQVPVYVSELAQPSKRGTVVGAQQWAITWGGQSDQPLKQKEDADYSQIMIMFYIFYGSSYMEGPAAWRLPWGLQMIPAVFLFFALFFMPREPRWLGKKDRWEECHETLALVHAKGNHNDPFVGRSLREIPEMCEFERANADASYLDLFKPNMINRTHIGMFTQIWSQLTGMNVMMLYITYVFGMAAFPATPNLVASSIQYVINVVMTIFALVFIDRWGRRIPLLIGSTLMMTFMFANAGIMASYGKPAPPGGVDNVPEESWDMSEAKSAAKGVIACTYLFVASFAPTWGPVSWIYPPELFPLRLRGKAVAVTTASNWIFNFALSYFVPPAFENIKWKVYIVFGVFCAAMTLHVFFLFPETAGKTLEDVDAMFHTNVKPWQTR

SEQ ID NO: 12369 - protein, 355 aa, Aspergillus nidulans
  unsure (1)..(355): unsure at all Xaa locations
DVVRRKAESCDCLQGFQVTHSLGGGTGSGMGTLLISKIREEFPDRMMATFSVMPSPKVSDTVVEPYNATLSVHQLVEHSDETFCLDNDALYDICIRTLKLSSPSYGDLNHLVSAVMSGITVSLRFPGQLNSDLRKLAVNMVPFPRLHFFMVGFAPLTSRSSSSFRTISVPELTQQMFDSRNMMTAANYQNGRFLTCSTLLXVSLSAPLPFILFCSRSNSCFQDTNGTSSRGKVAMKEVEDQMRNMQNKYSSYFVEWIPNNVQTALCSMPPKGLKMAATFVGNSTSVQELFNRVSNQFTAMFRRKAFLHWYTGEGMDEMEFTEAESNMNDLMSEYQQYQEATVSDGEGAYDAEEGE

SEQ ID NO: 12370 - protein, 362 aa, Aspergillus nidulans
  unsure (1)..(362): unsure at all Xaa locations
WISMLTNDADVDLVLDHIASSGHKILRIWGFNDVNTEPSTGQVWFQKHQGGVSTINTGQYGLQRLDAVVSSAEKRGIKLIINFVNNWDDYGGMSAYLNAYGGSTKTDWYTSATIQAAYRTYIKAVIDRFIDSPAIFAWELANEPRCNGCDTSILYDWIADTSAYIKSLDPLHMVCIGDGEXDKSTANKATTDRTLQEGFGLDEGSDGSYPFSYNEGLDFAANLAIDTIDFGTFHLYPGSCSYPEFSFLKYRLANXKLTSTIGGVSYDWGNLWAITHGAACATAGKPCLFEEYGAPSDHCAIEVPWQTTAVSSTGIAGDLFWQWGDTLSTGQTHNDGNTIYYGSDEYTCMVTEHMERIAARXQ

SEQ ID NO: 12371 - protein, 391 aa, Aspergillus nidulans
  unsure (1)..(391): unsure at all Xaa locations
LGQWLKEQGVPAIHGVDTRALTKRIRQKGSMLGRLLLHKADVAETDAALAQDTWKSSFEQIDWVDPNTKNLVSEGELPSIPACXXFLTCSCXVSIREPKLFSPPENVALKHPSSRPIRVLCLDVGLKFNQLRCLVARGVEVLVVPWDYDFPTLAGKDYDGLFVSNGPGDPATMTTTVNNLAKTMQEARTPIFGICLGHQLIARSVGAQTLKMKFGNRGHNIPCTSLVTGKCHITSQNHGYAVDSSTLPSDWQELFVNANDGSNEGIRHVSRPYFSVQFHPESTPGPRDTEYLFDVFINAIKDTIASPEALQKPVNFPGGAVAENIKASPRVSVKKVLILGSGGLSIGQAGEFDYSGSQAIKALKEEGINTILINPNIATIQTSEGLRDKVY

SEQ ID NO: 12372 - protein, 378 aa, Aspergillus nidulans
  unsure (1)..(378): unsure at all Xaa locations
SIVGRPRHHGXISLNCISINRDVAADVRISIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMVCITLSLALLHWAALTNRXSGGTTMYPGISDRMQKEITALAPSSMKVKIIAPPERKYSVWIGGSILASLSTFQQMWISKQEYDESGPSIVH

SEQ ID NO: 12373 - protein, 455 aa, Aspergillus nidulans
  unsure (1)..(455): unsure at all Xaa locations
VASLVWIIGAVIQCSAQNVAHLVAGRVISGLSGASVSRVNVVXNSNRRLVGVTSSQVCVYLAELAPARIRGRIVGIQQWAIGKTASLLPYFSFSCTRLMGPEWGILIMYLISWGCGKGIAGPSAFRVAWGVQAVPGLVLFLALFFFPESPRWLASRERWEEALDVLAALHGKGNRNDPVVQVEFEEVKERARLAAEAKDVSFFALFGPRIWKRTLCGVSCQVWQQLLGGNVAMYYVVWIFQMAGMXVAHARRPASAGDRSNTTXSGDTSLYSSIIQYVIFVATTGVILPYIDRIGRRLLLVSGAIICMIIHYAIAAVMATRGNPVDEINGNASLKWEITGASGKAVIAMSYIFVGVYGLTWAPAAWIYASEVFPLKYRAKGVGLSAAGNWIFNFALAYFVAPAFTNIQWKTYIIFGVFCTVMTFHVFFMYPETAQRSLEEIDLMFDTHVKPWQTA

SEQ ID NO: 12374 - protein, 417 aa, Aspergillus nidulans
  unsure (1)..(417): unsure at all Xaa locations
QRHLNYRQVQIMAMGGSIGTALFVNIGGGLAKGGPLSLLLGFTIYSLILSCVNNCIAEMTVLHPAPGGFIRMAGIWVDDAFGFMAGWNFFLYEALTIPFEITALSMTLSFWRDDIPAGAVAAVCIVSYSYGSLPFSGRFQFPLFLNCPFARVRTKXCLSSCLSVFAVKVYGEAEFWGSGGKMLLISILFAFTFVAMVGGNPQHDAFGFRHWRDPGPMAEYLSAGNLGRFEGFLGSLWMASFTTVGPEYVTLIAAETKHPRTYVKKAFQTVFWRFLLFFIMAAVSVGILVPYDDPALIANFVTNTADGSKSGSSPFIIAMGNLQISGLPHVMNALLVTTIFSAGNTYMYCASRSPYALSLEGRAPRILSKCTGQGVPIYCVLVTICFPLLSLLQLGDASSQVLTWLTNILTAGGLINY

SEQ ID NO: 12375 - protein, 401 aa, Aspergillus nidulans
  unsure (1)..(401): unsure at all Xaa locations
AFATVQQDIFKPTKYGGKYTVTLIPRYGHXIHTISATLRDAYLIHRPTNVLLCPSGDGIGAEVAESVKTIFKADNVPIEWEQVDVSGVDTGNKHSEELFKESIASLRRNKLGLKGILFTPVERSGHQSFNVALRQELDIFASVVLIKNIPGYKTRHDNVDLCIIRENTEGEYSGLEHQSVQGVVESLKIITRAKSERIAKFAFSFALANNRKKVTCIHKANIMKLADGLFRSTFHKTAENYPTLEVNDMIVDNASMQAVSRPQQFDVMVMPNLYGGILSNIGAALVGGPGVVPGCNMGRDVAVFEPGCRHVGLDIKGKDQANPSAMILSGSMLLRHLGLDDHANRISKAVYDVIGEGXVYCAQSHCLARXQVXXNRTRDMGGQATTHEFTRAVLDKMEAAL

SEQ ID NO: 12376 - protein, 543 aa, Aspergillus nidulans
  unsure (1)..(543): unsure at all Xaa locations
MAVIHPGYRCVHGWFHLRLLYWLASSSXLCXCSRXLAGQISGFTTMADFKKRFAERQANGEYVFSNVRNGLIVGLLCIGTMIGALVAAPIADRIGRKLSMSFWSIIHIVGIIIQIATDSNWVQIAMGRWVAGLGVGALSSVVPMYQSEAAPRQVRGAMISAFQLFVAFGSSSLISSTTVPSRSNPLPRGESPWASVSLGPLILGLGALFLPESPRYAYRLGRIDEARKVMAKLYGVEVNHRVVVQEMKDMKDKLEEERAAGVAPWHEVVTGPRMLYRTLLGIALQSLQQLSGANFIFYYGNSIFTSTGLNNSYVTQIILGAVNFGMTLPGLYIVEHFGRRASLMVGGAWMAICFYIWASGKNNPSCHSNERHRLTSLIVGNSVLDLDNPQNTPKAGAAMIVFTCFFIAGFATTWSVTSYIRYKSNILTXPPRGPIVWSICSEMYPNRSRATSIGIATCANWTWNFLISFFTPFISGSIHFAYGYVFASCCVVGVLIVFFFVNETQGRTLEEVDTMYVLHVVPWKSASWVPDESIVVISTLVPM

SEQ ID NO: 12377 - protein, 393 aa, Aspergillus nidulans
ETTLEIEYVRALIPPLHIASFEHDDWVSSIDVLSTSSPASAGSDAIARGQERILSGSYDGFLRVWNMSSQVIATSPSPTDGGHISSIKAAKFISPSSIASAGLDRTVRLWKYTEAEDGFSGKIVPQVELYGHKSGINSLAVHASTNRILSASADHNVGFWSTKKSDAPAAPESLLPSAASRTSKRRKLNASVSVSQRGPLALLSGHTAPVSDAIFDARDSTVGYSVSWDHSLRTWDLVTAALVDTRTTSHSLLSLQHLPDHNLLATGTSARHITLIDPRASAATISAMTLRGHTNAVVSLARDPHSIYGLISGSHDGTCRIWDLRATKTDKGGAVGESVYSISRKSLEEEGKANSKRVGGEGVKVFSVCWDREVGIVSAGEDKRIQINRGEGV

SEQ ID NO: 12378 - protein, 458 aa, Aspergillus nidulans
NPGDLVDIAGIFLPTPYTGFRAIRAGLLTDTYLEAQHITHHKKSYNDIGIDSRTLRKIEQHQKSGNMYEYLARSIAPEIYGHLDVKKALLLLLIGGVTKEMGDGMHIRGDINICLMGDPGVAKSQLLKYIAKVAPRGVYTTGRGSSGVGLTAAVMRDPVTDEMILEGGALVLADNGICCIDEFDKMEDGDRTAIHEVMEQQTISISKAGITTTLNARTSILAAANPLYGRYNPRVSPVENINLPAALLSRFDVMFLILDTPSRDADEELASHVAYVHMHNKHPENEDAGVMFTPHEVRQYIAKARTYRPVVPSRVSDYMVGAYVQMRKRQKRDEANKKQFSHVTPRTLLGVVRISQALARLRFSEEVVTEDVDEALRLIEVSRASLSNDGQSHLDQSPTSKIYNLIRGMLESGAAAVGDGEDGELSMRRIRERVLAKGFTEDQLTMTIDEYENSHVRL

SEQ ID NO: 12379 - protein, 421 aa, Aspergillus nidulans
  unsure (1)..(421): unsure at all Xaa locations
GKDPKVDYSGHFEFGGSPGVLAMMIGFPLLMYYMWIGATYYDGKFPSPSEGQSMSEFFAHMGHLVYDGAFPTLKAWTMYWVFFIFEGLLYLLAPGITVMGRPLPHLGGKQLPYYCSALWSFWTTLAVACTLHFTGVFKLYTIIDEFGSLMSVAILSGFLVSFVAYFSALARGAQHRMTGYPIYDFFMGAELNPRMFGILDFKMFFEVRLPWYILLLVTMGTAARQYEVYGYVSGEVGFLFMAHFLYANACSKGEECIVSTWXVCPEVXRTLLIDXDMYYEKWGFMLIFWNLAGVPLSYCHCTIYLANHDPATYHWNRYFLVFLYVAYLFVYWVWDTTNSQKNRYRQMERGTRVFRKAFPQLPWQTLHNPKTITAADGSKILVDGWCCFPLEILXSILTSTNGKARKIHYTCDLYFALNWGL

SEQ ID NO: 12380 - protein, 475 aa, Aspergillus nidulans
  unsure (1)..(475): unsure at all Xaa locations
FTNDVKGMGMNLXTGQIGVNLMSTNSLIKEDKTVKRTGEIVCHTRCNHQLCLSSITYKPYRLDVPVGPELLGRVVDALGNPIDGKGPINASTKSRAQLKAPGILPRRSVNQPVQTGLKCVDSMVPIGRGQRELIIGDRQTGKTAVALDAMLNQKRWNNTSDESKKLYCIYVAVGQKRSTVAQLVKTLEENDAMKYSIVVAATASEAAPLQYLAPFTGCAMGEWFRDNGRHAVIVYDDLSKQAVAYRQMSLLLRRPPGREAYPGDVFYLHSRLLERAAKMNDKHGGGSLTALPVIETQGGDVSAYIPTNVISITDGQIFLEAELFYKGIRPAINVGLSVSRVGSAAQVKAMKQVAGSLKLFLAQYREVAAFAQFGSDLDASTKQTLNRGQRLTELLKQKQYSPMAVSDMVPLIFAGVNGYLDNIPVAKILQWESDFLAYLKSNHPEVQETIEKEGQVSKELEAKLKDIIPSFNKSF

SEQ ID NO: 12381 - protein, 789 aa, Aspergillus nidulans
  unsure (1)..(789): unsure at all Xaa locations
QPLSRPAHTLSPDEILRELKVNSEEGLTAAEAKKRLELFGPNELEGGEGVSLAKIIIRQIANAMMLVSCFPLLSLAPLRFSXLTSWXVLIIAMAVSFGIESWIEGGVIGAVIGLNIVVGVYQDYAAEKTMDSLRNLSSPTGVATRDGKTNTIPATEIVPGDMIELKVGDTVPADVRYVFHVLDAGLDXYQTRLVDAMNFETDEALLTGESLPVQKEVDVTFAEDTGPGDRLNIAYSSSTVTRGRARGVVIGTGMKTEIGAIAAALHANDSKRRPVKRGPGGETKKRWYVQAWTLTATDAVGRFLGINVGTPLQRKLSKLALLLFGIAVVFAIVVMGANEMRNDKEVIIYAVATGLAMIPACLVVVLTITMAVGTKQMVERHVIVRRLDSLEALGAVTNICSDKTGTLTQGKMVAKRAWIPSLGTYSVGSSNNPLDPTEGELSLLPDPPVKLDADARGDPADPAELIKDNKILEDYLNVASMANLAVVHRSEGNEWQARGEPTDIAIQVFAHRFNWGRERWTKGEKPIWRQKAEYPFDSTVKKMSVIFAREDDSEKGRQMVFTKGAVERVIDSCTTILWTRNEDPIPMSEDIKSQILQNMEALAKEGLRVLCLASREFDTPIANSEEVPPREEVEKDLVFCGLVGLYDPPRPETAGAIEECYRAGISVHMVTGDHPGTARAIAAQVGIIPANMDGIAKDVADAMVMTASQFDKLTDEEIDDLPTLPLVIARCAPTTKVRMIDALHRRGRYAAMTGDGVNDSPSLKRANVGIAMGEAGSDVAQDASELVLT

SEQ ID NO: 12382 - protein, 219 aa, Aspergillus nidulans
  unsure (1)..(219): unsure at all Xaa locations
LFAFATEVMATPVAYPMTTASPTLAKRDSCTFSGSDGAASASRSQTDCATITLSDITVPSGTTLDLSDLEDDTTVGXCSSSQLFGXGXLQSRVIFEGTTSWEYEEWDGPLLQIKGNGITIKGADGAKLNPDGSRWWDGEGSNGGVTKPKFFYAHDLTDSTIQNLYIENTPVQAVSINGCDGLTITDMTIDNSAGDDAGGHNTDGFDIGESSNVVITGAK

SEQ ID NO: 12383 - protein, 342 aa, Aspergillus nidulans
  unsure (1)..(342): unsure at all Xaa locations
GAGVLGRRFAVVLIVCGHTVHIRDPLTQALSDAASFIDAHLHEFTAITPTPHPVPGTYKAFAEISSAVAGAWLVIEAVPEKLSLKIDTFAEVDRHAPADCVIASNSSSFKSSLMVEKVGEQRKERVLNVHFTMPPQIRTVELMTNGQTRPELFESLSKMLKGCGMIPVTARKESTGXVSAISFFWVGPLLTFFICSFIFNRLWAAIKREIMLILAEDVSTPEEIDLLWTNMFQLPTSSPPCQLMDKIGLDTVAFIEDNYIQERGLDGSMTVDWLRKSYIDQGRLGLKSEKGGLYGPSAAAAPAAATKAAQSLYILDVGLGSNNKVDQIPTAGKILYFDQSTG

SEQ ID NO: 12384 - protein, 453 aa, Aspergillus nidulans
VAAGNSSAYIFETISANVGKVPMMPEYGLGFWQCKLRYQTQEELLQVAREYKRRELPIDLIVIDFFHWPLQGDWRFDPTYWPNPAAMVKELRGMGIELMVSIWPTVDKRSENYRKMLEKGFLIRTDRGVRTAMDFQGDTIHFDATHPGARAYVWEKCKTNYYDYGVRAFWLDEAEPEYKAYDFDNYRYYQGPNTAIGNIYPLEYARAFYEGMEQAGQKNIVNLVRCAWVGSQKYGALVWSGDIASSWESFQHQLVAGLHMGLCGIPWWTTDIGGFHGGNPSDSKFRELFVRWFQWATFCPVMRLHGDREPRQPVQGTTGGASCASGADNEVWSYGLEVYEICKKYMLLREALRDYTRGLMRSAHLKGSPVMRTLFYEFPEDPECWRIGTQYMYGDRYLCCPVLQDGQRQLKSYLPALRSGKWVPFQNDDAVKEAYPGGQWIEICAPLHWMPVF

SEQ ID NO: 12385 - protein, 340 aa, Aspergillus nidulans
KCPSGEISSLLEQRIRGLKGSPNLAESGHVLSVCDGIVRARGLTNVQAEELVEFESGVKGMCMNLESNHVGIVLFGSDRLVKQSEPVWRTGEIVDVPVGPKMLGRVVDALGNPIDGKGPIETTERSRAQIKAPGILPRRSVNQPVQTGLKAIDAMVPIGRGQRELIIGDRQTGKTAIALDTILNQKIWNKSDDESKKLYCVYVAVGQKRSTVAQLVKTLEENDAMKYSIVVAATASEAAPLQYIAPFAGCAMGEWFRDHGRHAIIIYDDLSKHAVAYRQMSLLLRRPPGREAYPGDVFYLHSRLLERAAKLNDKHGGGSLTALPIIETQGGDVSAYIPTN

SEQ ID NO: 12386 - protein, 217 aa, Aspergillus nidulans
GFFLNSHCAVIGIVIPFAALQAKFGPVEEVEVFTEQAVSGAGYPGVPSMDIMDNVIPFISGEEDKLENEAQKILGSLTADATAFDEQQGLRIGATCTRVGVTDGHMAFVSLRFKNRPAPSAEQVVQAMREYQSEAQKLGCPSAPAEAIKVFDEPDRPQPRLDRDINRGYTVSVGRVREGNQGGYFDIRFAALSHNTVIGAAGSSILNAEVAVIKGYI

SEQ ID NO: 12387 - protein, 276 aa, Aspergillus nidulans
  unsure (1)..(276): unsure at all Xaa locations
SQIGGELTVDERNLLSVAYKNVVGTRRASWRIISSIEQKEESKGSEQHVSIIREYRQKIETELEKVCQDVLDVLDESLIPKAETGESKVFYYKMCVQSYSAIEXSVXCDKXKGDYHRYLAEFASGNKRKLAATAAHEAYKVXLDSNSAPVIRAXAKXTXXNATDVAQTELTPTHPIRLGLALNFSVFYYEILNSPDRACHLAKQAFDDAIAELDSLSEESYRDSTLIMQLLRDNLTLWTSSDGNEPENVSAPKEEKPEEDAAAPEEKPEEAKAPES

SEQ ID NO: 12388 - protein, 410 aa, Aspergillus nidulans
PMNVTWVPSFPTGHETGRYLAIDMGGTNLRICDVTLTEEKGAYTIEQDKYRLPIHLRKGKGVELWEFIAAKLEDFLAKHKLAREDGEKLPLAFTFSYPVTQDHIRHGVLQRWTKGFDISGVEGEDVVAHLEEVFEKRNVPVRLVALVNDTVGTLIASAYKNPAIKIGSIFATGCNAAYMEKVSRIPKIADHGSEFESDALVSINCEYGAFDNAHKVLPMTRFDEEIDQTSARPGQQAYEKMVAGMYMGELLRLLLLHLHESSGFFTDAEIDRLRGYGTMDSASLSRMEAGGSEAERMSDAKCILKDLYGIEATDEEARVCCLLGEIVCTRAARLYACGIAALCRKQGISECAVGVDGSTFEKYSQFRERAVDALGEILDWPEGQQLVKLVTAEDGSGVGSALIGAITLNQ

SEQ ID NO: 12389 - protein, 813 aa, Aspergillus nidulans
  unsure (1)..(813): unsure at all Xaa locations
QDRVCSTVGAVPGSDVVQGADFVRSSYGYEYSHRWRNFGIIVALTVFLTMCHLVTSELVSSQRSKGEVLVFRRGKAQKMREKRHHTDEEQIAAPAAQNEKVIQEEPGLVSGVEQQSSIFHWEDVTYDIKIKGETRRILDRVDGWIRPGTLTALMVSSLALHKDXDXSSXGVSGAGKTTLLDVLASRTTIGVVGGNMLVDGRSRDESFQRKTGYVQQQDLHLHTSTVREALKFSALLRQPPQYSRAERLAYVETVIDLLNMREYADAIVGVPGEGLNVEQRKRLTIGVELAARPKLLLFLDEPTSGLDSQTSWSICNLMETLTKNGQAILCTIHQPSAMLFQRFDRLLLLAKGGKTVYFGEVGQGARTLMDYFVRNGGSACPPGANPAEHMLEVIGAAPGAQTDIDWPEVWRSSPEYQQVRSELARLRELANRPSPVSDPNDKSSYAEFAAPFSEQLLQVGRRVFQQYWRSPSYIYSKALLTVGCVVVSQSLELAFPXLDQSLFIGFSFFKADNTRQGLQNQMFGVFVFLFVVVQLVMQVIPSFVTQRTLYESRERQSKTYAWQAFVLSNIIVEFVWNTVRSSLRLLXLPPSMAPTNVMPRSMAIFCYLVWFYPVGLYQNARYTDTIHSRSTLTLLIIWAVFLFASSFAHMLIAGVDSAEMASALSNIFFIMMYAFCGILAGPNALPGFWIFMYRVNPLTYLVSSLLSATLGDAPMHCANNEVLTFFAPPGLTCREYMEDYRSVNGGYLLNPDAQGSDQCQFCSLEYTNQYLSSLSIDFNNRWRDFGLLWVYVIVNTVGAIVFYKLFRVPRAKK

SEQ ID NO: 12390 - protein, 813 aa, Aspergillus nidulans
  unsure (1)..(813): unsure at all Xaa locations
SSPEILLNKDKQEATIKFSETISAGSSAQLKLTFTGTLNDNMAGFYRSSYKTPQGETKYIASTQMEPTDARRAFPCFDEPALKAKFTVSLIADKSMTCLGNMDVASEQELEGGKKIVKFNTSPVMSTYLVAFIVGHLNYIETKNFRVPIRVYATPDQDIEHGRFSLELAAKTLAFYEKAFDSEFPLPKMDMVAVPDFSAGAMENWGLITYRIVDVLLDEKTSSASRKERIAETVQHELAHQWFGNLVTMDFWDGLWLNEGFATWMSWYSCNSFYPEWKVWQTYVIDNLQSALSLDSLRSSHPIEVPVKRADEINQIFDAISYSKGSSVLRMISKYLGEDIFLQGVRNYIKKHAYGNTQTGDLWSALANASGKPVEEVMDIWTKNVGFPVVTVSENPTSSSIKVKQNRFLRTGDVRPEEDTTIFPVMLGLRTKQGVDEDTLLSEREGEFKLPDLDFYKLNADHSAIYRTSYTPERLTKLGEAAKAGLLTVEDRAGMIADAGALAASGYQSTSGLLSLLAGFDSEPEFVVWNEILTRVGALRAAWVFEDAQTKDALEGFQRALVSDKAHTLGWQFSENDGHIIQQFKALLFSAAGNAGDKTVVQAAQDMFQRFAAGDISAIHPNIRGSVFSIVLKNGGKKEYDVVYDRFRNAPTSDEKTTALRCLGAAEDPELIQRTLGLALGDEVKNQDIYMPLGGLRNHAAGIDARWAWMKDNWDTLYQRLPPGLGMLGTVVQICTASFCTEEQLKGVQNFFANKDTKVSSYVFFFFFWCIXLTKLXGYDRAIEQSLDAIRAKISWVQRDRADVGSWLKSKGY

SEQ ID NO: 12391 - protein, 530 aa, Aspergillus nidulans
  unsure (1)..(530): unsure at all Xaa locations
RRILDHIDGWVKPGTLTALMGVTGAGKTSLLDVLADRVTMGVITGEMLVDGRLRDDSFQRKTGYVQQQDLHLETSTVREALIFSAMLRQPASIPRKEKLAYVEEVIKMLGMEEYAEAVVGILGEGLNVEQRKRLTIGVELAAKPDLLLFFDEPTSGLDSQTAWSICSLMRKLADHGQAILCTIHQPSAILMQQFDRLLFLAKGGKTIYFGELGENMGTLIEYFEKKGSTPCPKNANPAEWMLEVIGAAPGSHADRDWSEVWNQSPEREQVRAELARMKAELLQKPEPPRTPEYGEFAMPLWSQFLICLKRMFQQYWRSPSYIYSKATMCVIPVCSLLCFERERKLMMXPIFIGFTFWREPLSLQGMQNQMFAIFMLLVIFPNLVQQMMPYFVTQRALYEVRERPSKAYSWKAFMMASICVELPWNILMAVPAYFCWYYPIGLYRNAGPGETVERGGTMFLLILIFMMFTSTFSSMVIAGIEHPDTGSNIAQLLFSLCLIFNGXEIFLDAIAHCKQLSVLATPQQMPRFWI

SEQ ID NO: 12392 - protein, 361 aa, Aspergillus nidulans
  unsure (1)..(361): unsure at all Xaa locations
EFELARTWETLVEGADGTISSTVGGLLEASKRKRXVSKCSSQASPASQVWALWRFADGWVKLLKDTTPLQRGIIRHIILILDLSQSMMEKDLRPTRYLLTLRYAQEFVREFFEQNPISQVGVIGLRDGLALRISDMSGNPTEHISAIQDLRSQDPKGLPSLQNGLEMARGALLXGSFTSRDTLPSMTRTNDCAIPAHTPSHGTREIFIAFGSLLSSDPGDIHQTITTLIDDKIRVGIVGLAAQVAICRELCSRTNGADDTYYGAAPNEHFFHEFMLPVTTPPATFLQKHSHSLLLMKAFPSXIIKLSPISLARYFNPTLGGTFYLLYLLILCFMLISFPLFSLPHYLLLSFPILFISHSLF

SEQ ID NO: 12393 - protein, 348 aa, Aspergillus nidulans
  unsure (1)..(348): unsure at all Xaa locations
MADRYSFSLTTFSPRXADVXXXGTTACXQPSSGKLVQIGMSLNCQSXATVLIDIEYALNAVNQGVTALGIKGAVGXPPTRRDSYXSLAAATNGIVLATEKKSSSPLIDPPSLSKISLITPDIGMVYAGMSPDYRVLVDKARKVSHTGYKRIYNEYPPTRILVQDVARVVQEATQSGGVRPYGVSLLIAGWDEGVEPETAQAQKGEEEEPKKATGKTGGILKGGPSLYQVDPSGSYYPWKAPAIGKHATSAKTFLEKRYTEGLELEDAIHIALLTLKETIEGEMNGDTIELVSVWKSIRNSGREKLIVAIGIVGPPADHLLGYEGVEGARGPRFRKLTKEEIEDYLTSL

SEQ ID NO: 12394 - protein, 316 aa, Aspergillus nidulans
LSRPFGVQLWPHFSRAFTALSGKSPADFQLVPGETPMTTLQGTLLSLATYYVVVLGGRQLMKSQAPFKLRIPFIIHNFILTVISGVLLALFLEQILPTLSNDGVLHAICDARGGWTDELVLLYYVRFTPAKKTNEIESWPMLKRLALNYLTKYLELADTVFLVLKKKPLTFLHTYHHGATALLCYVELVGRTSVSWVPITLNLMVHVVMYWYYFQSARGIRIWWKRYITLLQIAQFVIDIGIAPVSNSQLYPLLIVVDRVIYFASYTYFASTYFPWVPNAGYCMGEEYAAGFGVFIISSYLLLFISFYLTTYREKA

SEQ ID NO: 12395 - protein, 457 aa, Aspergillus nidulans
  unsure (1)..(457): unsure at all Xaa locations
NPSTGEPLYEVPWATEEDVDRAVEHARTAFKSWSRLPFQERSRLLVAYADAVEAERAPLAKLLVLEQGKPLSLAQTELDMSVQWLRTFVTMEVKDELLDDNEERSITQTFPPLGVCCGIVPXNWPVLLALGKVGPALITGNTMIIKPSPYTPYCDLKLGEIGMRIFPPGVLQVLSGGDELGPILTQHPGIDKITFTGSSATGKLVMQSCAKTLKRVTLELGGNDPAIICEDVDIDAIVPKITSLAFLNSGQICMLIKRVYIHESIYDAFRDAMVAFAKSIKTADGFEPDAFVSTIQNSMQVSFCRIFIPXSXIFWRLHANRNKRYEKVKDMYSEIGKRNWKQALEGKVFENSKGYYISPAIIDNPPEDSRIVLEEPFGPIVPLLKWSDEEDVIARANSLKDGLGASVWSKDLDRAERIGRQLSAGSVWLNSHFDVAPNVPFGGHKWSGLGSEWGMTG

SEQ ID NO: 12396 - protein, 220 aa, Aspergillus nidulans
  unsure (1)..(220): unsure at all Xaa locations
PSQCPQHIWVVTGPAGSGKSTVGRYLQQELGVPFLEGDDVSSSLPDYTCTFRQELNEEXISIVHPAANKAKMSAGTPLTDADRWDWLISLRSAATTLLSTPAPTSTNPTSTSTRAQAPTGVVVACSALKKKYRDVMRVAAYGSPNVRIHFVYLKLEPATLYARVSAGQAHYMKQGMVESQLRDLEEPGQGEWDVITVPVQVGMGMGEVQREVMNAVEKVI

SEQ ID NO: 12397 - protein, 611 aa, Aspergillus nidulans
  unsure (1)..(611): unsure at all Xaa locations
HEWRNLGILIAFWIFFIVVYLVATELNSATSSKAEFLVFRRRHVPPQMRILGKSQGDASPENVALAEKPTEVAPNTSAIPEQHSIFTWRNVCYDIPVKGGQRRLLDNVNGWVKPGTLTALMGVSGAGKTTLLDVLAKRVSIGVVTGDMFVDGRPLDTSFQRKTGYVQQQDLHLPTTTVREALQFSAVLRQPKTVPRAEKYAYVEEVIDMLNMQDFADAIVGTPGEGLNVEQRKLLTIGVELAAKPALLIFLDEPTSGLDSQSSWSICSFLRKLADRGQAVLSTIHQPSALLFQQFDRLLFLAKGGRTVYFGDIGEDSRTLLDYFEANGARACGSSENVRPSCKNCYKYXLQQPAEYILEVIGAGASGKSDLDWPSIWKESTEAREVLQEIDRIHKDRASASSVEDKNTHREYAMPFTDQLWQVTSRVFQQYWREPIYVWAKLILAIASGLFIGFTFFKPDSSQQGFQDVLFSAFMLTSIFSTLVQQXVHPYRTLPSNSYXQKPRIMPKFVIQRSLYEVRERPSKAYSWAAFIIANVLVEIPWQILAAIVSWASYYFPVYGASQPPHRQGLILLFVIQFFIFTSTFATLIISSLPDAETGGTIATLMFMMTL

SEQ ID NO: 12398 - protein, 386 aa, Aspergillus nidulans
  unsure (1)..(386): unsure at all Xaa locations
LHHIKHFSRSSCKSDYADTLPNLKIGAHTRVLFQGFTGKSTHGVYHYLANKHCRQTGRLESKLQQWRLTSXATANVKESLEWGTKIVGGVKPGVEGEHLGLPVFPSVKAVRIHCFVPESITDTVIGPSASKAGASAIYVPGSQTAKAIEEAIEAEIPLVVAVAEHVPLHDILRVRTVSPXNRLGMCLQLTGPLHLKTQSKTRLVGANCPGIISAIGKCRIGFQPLPCFAPGKIGIVAKSGTLSYETVASTTRAGLGQSLCISMGGDPLAGTNFVDALKIFENDPDTEGIILVGEIGGTAEMDAAEWIRDYRRRTTSPKYVLRSATLHRTDRKDRLWALVGGRQAPPGRIMGHAGAWTAPGEPGPEEKYRALERAGAVMVNHPEKFG

SEQ ID NO: 12399 - protein, 507 aa, Aspergillus nidulans
  unsure (1)..(507): unsure at all Xaa locations
VLYTKIDTRPPEVIHSRGNYLHTSDGRTIFDASGGAAVACLGHNEPQVKQAIMAQLDKVAYIYSPFFTVPAAEEIATFLTESTGGAMSKVFYCQLWWVPFSSLPSXMFLIETIGARXLTGTGTEAIEAALKMTRQYFTELSKPQLQRTKFIARRQSYHGNTLGSLAAGGHKARRAIFEPILAASTSHVSPCYPYREMKKGESNEEYVSRLAEELENEFQRVGPDTVCAFIAETMSGTVGQQLGPIRACKXTNXKKTLGCIPAVPGYLKAMKQVCDRHGALFVLDEVMSGMGRTGTLHAWQQEGVVPDLQTVAKGLGAGYAPVGALLVGNRVADVLSKGTGSFTHSQTYQGHPIACAAACAVQKIIQKENLLDNVRRQGEYLGRLLNERLGGHRNVGDVRGRGLFWACKYISYLYLRRVLDXQITAXLEFVRDKETKEPFPAEAGIAQKVHLTGLQKEHSISVIPGAGVADGRNGDIIQIAPAYNVSKEDIELIVERVEGVVHAAFGA

SEQ ID NO: 12400 - protein, 1026 aa, Aspergillus nidulans
SEKVLIAQERSAGNTVQVFKKAPPSPTPYVAEIRSAVEKGSRLLSQLSLKLFGKGDSAKGGFGPTIRSTLPYIKADIPIVIVFRALGVVSDEDILNHICYDRNDTPMLEMLKPCIEEGFVIQDREVALDFIAKRGSSQSSMNHERRVRYAREIMQKELLPHISQSEGSETRKAFFLGYMVHRLLQCALGRRDVDDRDHFGKKRLDLAGPLLANLFRVLFTRVTRDLQRYVQRCVESDREIYLNVGLKASTVTQGLRYALATGNWGEQKKAASAKAGVSQVLSRYTYASTLSHLRRTNTPIGRDGKIAKPRQLHNTHWGLVCPAETPEGQACGLVKNLALMCYITVGTPSEPIIDFMIQRNMEVLEEFEPQVTPNATKVFVNGVWVGVHRQPSHLVETMQALRRRNMISHEVSLIRDIREREFKIFTDAGRVCRPLFVVDNDPKSENCGNLVLNKEHIRKLEEDKELPPDMDPEDRRERYFGWDGLVKSGVVEYVDAEEEETIMIVMTPEDLEISKQLQAGYALPEEQDPNKRVRSILSQRAHTWTHCEIHPSMILGVCASIIPFPDHNQSPRNTYQSAMGKQAMGVFLTNFDQRMETMANILYYPQKPLATTRSMEFLRFRELPAGQNAIVAIACYSGYNQEDSVIMNQSSIDRGLFRSLFYRTYSDSEKMVGLTVVERFEKPMRSDTIGMRKGTYDKLDEDGIVNPGVRVSGEDIIIGKTAPLAPDAEELGQRTKNHTKLDVSTPLRSTENGIVDQVLVTTTPDSLRSVKVRMRMTKVPQIGDKFASRHGQKGTIGITYRQEDMPFTREGVTPDLIINPHAIPSRMTIAHLIECQLSKVSALRGFEGDATPFTDVTVDSISRLLREHGYQSRGFEVMYNGHTGRKLVAQVFLGPTYYQRLRHMVDDKIHARARGPTQILTRQPVEGRARDGGLRFGEMERDCMIAHGASAFLKERLLDVSDPFRVHICDDCGLMTPIAKSPSVPELFRALLTERRKLKKGLFECRLCNNKHRISQVHIPYAAKLL

SEQ ID NO: 12401 - protein, 381 aa, Aspergillus nidulans
  unsure (1)..(381): unsure at all Xaa locations
MPATTADTLSLVTRTVTVAPLVLLSVADHYGRSAKGTRKRVVGVLLGEHIGGNVRVSNTFAVRSSVSAGLSIDXHASVPFEEDEKDPSVWFLDHNFVESMRDMFKKINAREKLIGWYHSGPKLRASDLEINELFKRYTPNPLLVIVDVQPKEVGVPTDAYFAVDEIKDVGTTAPQPRHTLTLVRTGTTTSRTFVHTPSTIEAEEAEEIGVEHLLRDIRDVAVGTLSTRITSQLQSLQGLHLRLRDIGQYLQKVLDHELPVNHAILGNLQDVFNLLPNLSTPSTTARVGGEPEQSTDNAELARAMSIKTNDQLMAIYLSSLVRAVTAYHDLIENKIQNRQQQEEVEQKREQEANSAKNEKEGAKKVTNTSEPKEESKEKTKR

SEQ ID NO: 12402 - protein, 441 aa, Aspergillus nidulans
  unsure (1)..(441): unsure at all Xaa locations
AGDLDIWLPSEANIARTALLDLIGDKGRWAEGAAAGVLVASPSRSDPDLXVDPGFMSIXTSFXLLIHEDFYTWTRDSSLVFKTLVEMFRAGDSDLLPIIQDWISSQARIQGVENPSGGLADGRGLGEANFTAEETAFAGSWGRPQRDGPALRATTMIEFGWWLLVRTVLFRVPMXLTPGRARDITSWLANTVWPVVHNDISYLTEYWNQSGFGEFRSDXLIKXYSYLGRLVEDLYGRSFFTLAVTYRALTEASLFARSIGSSCAECESQAPQVLCLLQSFWTGRFIRSNLDTGRTGKDASTLLGVIHTFSPRSECDDVTFQPCSARALANHYRVVDAFRDLYDINADRSQDQAIAIGRYPEDQYFGGNPWFLCTIAAAEQLYSAIYQWTHLGSITITAVSLPFFQTLHPTAVPGTYSSSTEIYHQLIDAVRTYADGFMRIV

SEQ ID NO: 12403 - protein, 655 aa, Aspergillus nidulans
  unsure (1)..(655): unsure at all Xaa locations
RXRRMSLARFKHLPRATQGPIKCPYKGAALLGNANYNKGSAHSERERREFNLHGLLPPNIQTLDEQVERAYQQYKSRPDDLAKNTFMASMKSQNQVLYYRLLQTHLKEMFSVIYTPTEADAIQNYSRLFRKPEGCYLSIRDHGEKEIDECFANFSGGDDVDYIVVSDGEQVCPRQGFCXHSGKGXRCXQWQILGIGDQGVGAILISVAKLVITTACAGIHPSRQLPVVLDCGTNNEELLNDKLYLGLRQRRAQGEEYDKFVDKFVRMARKRFPNAYIHLYATLTRRGRXDXQMQEDFGLQNAKRILDRYRSQLPCFNDDIQGTGCVTLAALMAGLHVSNVKLKDVRVVCYGSGSAGTGIADQISDAIATEAGFSKSDALKQIWYSQFASSTRVXHNPVTDIFRCIDKQGLLLKSQGDALTASQKYFAKEDNEWPEGQDIDLYSVIKHVKPHVLIGTSTKPGSFTEETIREMAKHVDRPIIFPLSNPTRLHEAQPQDITKWTDGKALIATGSPFPPVEYNGTKTENRYAFXISPILIIRFMYLRLIVSAECNNSTAFPGIGLGAVLSRASRLSEKMVVAASKALAAKAPALEDPNKPLLPDVENVRELSLNVAKAVIQTAVKEGLAQEEGIPEDEKDLEDWIRAQMWEATYRDLEK

SEQ ID NO: 12404 - protein, 411 aa, Aspergillus nidulans
  unsure (1)..(411): unsure at all Xaa locations
MSAKSIFEADGKAILNYHLTRAPVIKPTPLPPSNTHNPPPKLASLYFPDDLSVKDVLDQAEVTYPWLLTPGSKFVAKPDQLIKRRGKSGLLALNKTWAEAREWIEARATKEQQVETVVGVLRHFLVEPFVPHPQETEYYINIHSVREVRNILPHFLKLRSXSNFSXGDWILFTHEGGVDVGDVDAKAEKLLIPVNLKNYPSNEEIASALLSKVPKGIHNVLVDFISRLYAVYVDCQFTYLEINPLVVIPNADATSADVHFLDLAAKLDQTAEFECGTKWAVARSPANLGLAALPTSDKVNIDAGPPMEFPAPFGRELSKEEKFISDMDAKTGASLKLTVLNPNGRVWTLVAGGGASVVYADAIASAGFVSELANYGEYSGAPTETQTFNYARTILDLMLRSPIHPDGKVLF

SEQ ID NO: 12405 - protein, 348 aa, Aspergillus nidulans
PHAIPPRISSNRMSGASTRDKAALMGNFEKDWLSKGDKLQTNTDLSKRHTRNQSSLDGTKYKDGKWSQENEEVIMGPYDYMLQHPGKDLRRQMINAFNVWLKVPSESLAIITKVVAMLHTASLLIDDVEDNSLLRRGIPVAHSIYGTAQTINSANYVYFLALQEVQKLKSPAAIDIYVQELLNLHRGQGMDLFWRDTLTCPSEDEYLEMVGNKTGGLFRLAVKLMQAESSTGKDCVALVNVLGLVFQICDDYLNLSDTTYTQNKGLCEDLTEGKFSFPIIHSIRSNPGNHQLINILRQRTKDEEVKRYALQYMESTGSFKHTQDVVRQLRARALQLIEEIENSENGEQ

SEQ ID NO: 12406 - protein, 130 aa, Aspergillus nidulans
EHVLRSTWIIWYRPPTPKYSDYEKSTAPLASIHSVESFWSVYSHLKRPSLLPTVSDYHIFKKGIRPVWEDEANKKGGKWIVRLKKGVADRYWEDLLLAMIGDQFAEASDEICGAVLSVRSGEDVLAVWTR

SEQ ID NO: 12407 - protein, 479 aa, Aspergillus nidulans
YASGKVLGGSTGRNLMTYHLPTKGSLDRWAEDVSDESWNFDNMLPYIMKSQRFTPPNNNLRFRNATPTYDPAVLGRRGRLDVTYPNYANGLASWLVRGFRDIGLAAIRGLNGGQLIGSAYTLSTIQPGNQHRASSKTAYLDPLIGRNLNLIIYQSTHAKRILFSNDTVATGVRVSSEGQEYTLSARNEVIVSAGAFKTPQLLMVSGIGPAANLERYGIPLVADRPGVGQNLQDHTLAGPSYRVNAITGSSNSIPEFITEAQRQYNSNPPRGVLTNTGVDILGWEKVPEQLRGNFSTETEDALASLPEDWPELEYLPVYGYFGDQNNYMVTPNDGFNYLTIAAAVVSPLSRGTVDIASNDTEVNPIIDPRWFAHPGDIQVAVAGFRRSRALMASPAMAGITLGGESYPGTDVQTDDEIVEWLREASNTVHHACCTAGMGPRDNPDSVVDTQGRVIGVSGLRIVDASIMPFLPPGHPISII

SEQ ID NO: 12408 - protein, 449 aa, Aspergillus nidulans
PPPQGPPQGGYYPGPQYNGPPQHGYGPHPGSFQPPPGPPGPPGPHGPHSYSPHPPPQPGYAPSGPPGPSPGGYQPQQYGYNAQGQYPPPPHSPQPPPQHPQHFQPPPGPPGPPGPPHGYGQGFGAPPMPAPSMPSLGYAPGQVAPGDFRREADALRKAMKGFGTDEKALIQVLSKLDPLQVAAVRATYSSHIRRDLYSDIKSETSSYFRQGLLAIVDGPLMHDTASAREAVQGIGTKEWLLHDVLLGRSNADLNAIKLSYERTYRRSLERDVEGDLSFKTKSLFAHVLRAARHEENAPIDYRTIESEAQNIHGATAARMVNNADEVCSIFARSSNNELRALSQAFSARYHTSLEAHIEKEFSGHMKDALLHMLRTALDPAMRDAVNLEECMRGMGTKDERLVVRVVRVHWDRQHLENVKRAYQHKYKQDLVKRVRGETSGDYQRLLVAM

SEQ ID NO: 12409 - protein, 209 aa, Aspergillus nidulans
  unsure (1)..(209): unsure at all Xaa locations
PFFGSLGCTSAIVFTCFGAAYGTAKAGVGVCSMGVLRPDLIVKSTLEPGVPAKHNAEXAYXDIVPVVMAGIIGIYGLVVSVLIANNLGQKVPLYTALVQLGAGLAVGLAGLAAGCVYMLPDSHSXSXPSELSFAIGIVGDAGVRGTAQQPRLYVGMILILIFAEVLGEXQTWVVSHNESYXSWFSSVAGLYGLIVALLMNSRATLEASC

SEQ ID NO: 12410 - protein, 647 aa, Aspergillus nidulans
  unsure (1)..(647): unsure at all Xaa locations
RTRQIYETIDRQSFQWIVVLVAGVGFFLDGYTVRSFHSSTGDSIDPISDAVILFASNIALPMISYVYWREDTSSFRLTCINIATLSGTLLGQVLFGYLADRNGRKKMYGVELALLIASTLGVAMSSEGTHGSMSVFAWLIWWRIIVGIGVGADYPLSAVITSEYVQRLFQISKLWWLGDSYXQRLPTRFAPTRHRARMIASVFFMQPLGQIAGNIVSLIVAVLSKKQGHDDVTRAVDIMWRWVVGIGVVPGVIATFFRFFIPESPRFLLEIEDDPVQAEFDATTLFSDPAPLSSLGSPEIAVEEGYRYPGSASTALTSMTTATANQFNDINLIAPWNEIILAAPALPATATTMGTGKGTSTAAGPDTSGTGAGALTIRSMSIDDFTDRTPSQYHDSLPEGTFLTPATLNSHWRLTKVDITQYFWHEGNWRTLLATSLSWLLLDFGFYGIGLSSPQFLAKTWDSLKLSGPAPPWMTDDTGATDIYDMFRDTSIHCLIILNIGSFVGGVLMLLTIHKLERVSLQKYGFLALAAHFIALGTMFITVHKEGPVAVTLYIIGQILFNFGPNTTTYMIPAEIFPTRYRATCHGISAGAGKLGSILIQLLSAYYKFGTGPGNEQTVRHGYMLIVFSACMVIGAAVTHFWIPPTQ

SEQ ID NO: 12411 - protein, 404 aa, Aspergillus nidulans
  unsure (1)..(404): unsure at all Xaa locations
VSKSHDQFAQIAVDAVLSVADLERKDVDFELIKVDGKVGGALEDSLLVKGVIVDKDFSHPQMPDEVTDAKLAILTCPFEPPKPKTKHKLDITSVEEFKRLQEYEKEKFTEMIQHLKDSGANLVICQWGFDDEANHLLLQNKLPAVRWVGGPEIELIAIATNGRIVPRFEDLSADKLGTAGRVREMTFGTTREKMLVIEECANSRAVTVFVRGSNKMVRSPIYTRPCITDLLLIIDEAKRSLHDAICVVRNLVRDNRVVYGGGAAEIACSIAVEDAAVKVRGVPVSYSHLLTLPSEPWIEQYAMRAFADALDAVPLALAENSGLSPIETLAAIKSRQVKENNSRLGVDCMLTGNNGKYSXXRQXNXYXLGYRYREHFVIDPLIGKRQQLLLATQLCRMVLKVSXI

SEQ ID NO: 12412 - protein, 561 aa, Aspergillus nidulans
  unsure (1)..(561): unsure at all Xaa locations
TVGIIGGGITGLTAAYRLSRDPKCSKVTVYEKGPRVGGWIQSEKINVDGEHIVFEYGQRTLRASTITAFPLLDLVXLAPLGIYLLNWSLRANNWKFWXSTELGLEDEMLITKTSSAVSQNRYIYYPDRLVRMPGPQKGASLLSQLITTLKSLLQEPVFESVLPSLLKEPFVKRPLNLPSDESAMEFVSRRWSTKIADNLASSVFQGIYAGNIDKLSAETLLGPLRAHELSGSVAKGITEMKGKQYWISDDFISMLLISEAKKASHLDYLRSLAKDSSTLTFKNGVGQLADALVAELKRSPKVEVLTHANVTSILQDHESSNLTVCXFQSSSISKRAFMRKNXPVYLTGKSRRWSESCSQPSHCYQPALRPRKTTSVFTGAREAAHRNNKCPQRHNYATTTMVVNLYYSNPDLIPVEGFGYLIPRSIPFAQNPERALGVIFASESSVGQDTATGTKLTVMMGGHYWDGWKESDYPDHDTAVSMSQALLKRHLGILDSPKVAHTRLQRDAIPQPTVGHLERMQDISTSIKSELKNRVTLAGAWYSMHGTGVVDSIRQAYLAAK

SEQ ID NO: 12413 - protein, 370 aa, Aspergillus nidulans
RAHGDKLGLPGRNLLSPPYSIKNAAGALSQNTIQTNIGHAGGYVEYDTHNLYGTSKSAYYAIVSLSDLLFSDSSASRIAMQQRRPDVRPLIITRSTYAGAGAHVGHWFRHLYYGLDLALTLYRLGDNLSTWKLYRASIAQVLAFASMFQIPMVGADVCGFGSNTTEELCARWASLGAFYTFYRNHNEIGNIPQEYYYWESVTESATKAINIRYQLLDYVYTAFHRQSKTGEPFLQPLFYLYPEDKNTFAIDLQFFYGDAILISPVTEKNSTSVNAYFPKDIFYDWYTGAVIQGQGANIILSNINITHIPIHIRGGNIVPIRSSGAMTTTELRKKGFQLIIASGIDGTASGSLYLDDGDSLEQTDTANIEF

SEQ ID NO: 12414 - protein, 471 aa, Aspergillus nidulans
  unsure (1)..(471): unsure at all Xaa locations
AVAAAQTYTDCNPLEQSETSARXWGLKCXYFEGCPADPALGGSANYDFTQGASDDFTEVMSPSYGSDGASFTVAKQGDAPLIQSDWYIMFGHVEFVIKAAPGVGIVSSAVLQSDDLDEIDWEWLGGNNEYVQTNYFGKGNTATYNRAATHANSGNHDSFHTYTIDWTSSHVVWQIDGNTVRVLTPDSAESNQYPQTPMMVKVGVWAGGDPNNNEGTIREFISLCVPVRAIYITEFANILVEWAGGETDYTAGPFTMYLKSIKVTDYSTGNSYTYSDNSGSWQSIISDGGKINGNSAAQSMTDIGTVPSITATADSGPIPFEGTHRETTSFSTPSIYPWVPRPSSDDDSDSSPSTNLPGDWHFAGSGKPQPPSRSSMSEHCPQFRFIPSSNFMLKRCLFTTQYMRPSMSASYHFWSGLYSPSDLEPTDESPRWVFPETDPAELSDATTDEFRRVSATSGQDRNGLTISAANR

SEQ ID NO: 12415 - protein, 836 aa, Aspergillus nidulans
  unsure (1)..(836): unsure at all Xaa locations
EKNWKIYRRLXRYIHTKDASELSFEQLYRNAYSIVKIQRAEDLYERTKELEKEWLCGEVQKRVVAAITPRLLLAKEAVDMQDQFTEATERRETGERFLSALSEVWEDHQICMKMITDVLMYMVSQLVCADWIPLTQESTHRIRVVALRKVSIYAAAMALFRDHVLRSPVSSSNNAVVADVLKSTVLFMIQLERSGHMIDRALIHSCIKMLEGLYETEAEEESSKLYLTSFEPDYLEASAAFYRAEGKRLLETVDAATFCAVVSARIAEEKERCQYTISLLSESKIKEIVDNELIRNNLAEVVNFEGTGVRVMLDHDRIDNLSKIYALSARVDPKKTHLTAAVQKRIVEMGNEINNASFALAQAPAQPKSTGTDAGQKKEKEKEKPVNQVTSSAIKWVDDILALKKKFDGIWKDAFGSDQVLQSAITASFSSFLNSTPRSSEFLSLFFDENLKKGVKGKTDNEVDALLENGITLLRYIKDKDRFEAYYKKHLSRRLLMKRSMSMDAERQMISKMKMEVGNQFTQRLEAMFRDMTISEDLTASYKQFVREQGDPDKKRFELDINVLTSTMWPMEIMSSSRDGQVELPCIIPKEVETVKQSFEKFYLDKHSGRKLSWQPSMGTADIKATFHRSNGKVQRHELNVSTYAMFILLLFNDIPIGESLTFEEIQARTRIPDNDLIRNLQSLAVAPKTRVLKKVPMSRDVKPTDKFYFNNDFQSPFMKVRIGVVSGGANKVESQDQRKETEEKMNNERGGSIEAAIVRIMKYVASALLTSGADITLYRQRKTLIHSNLISEVLSQLSARFVPDVNMVKRRIESLIDREYLERVSEDPPTYGYVA

SEQ ID NO: 12416 - protein, 277 aa, Aspergillus nidulans
KQLFIGSEGTIGIITGVSILCPPRPKAVNVAYFGLESYDKVRQAFGEAKKQLSEILSAFELMDGRSQKLVHASTGNKFPLEEEYPFYCLIETSGSNAEHDMEKLETFLESVMGEGIVADGVLAQDETQFQSIWRWREGITEALSHLGGTYKYDVSIPLPELYQLVDDCRERLTKMGFVGDDDSFPVRAVVGYGHMGDSNLHLNIAVRQYNKDVEKAIEPWVYEWIQKRNGSISAEHGLGLAKKEFIGYSQNDTNLKLMKQLKELYDPVSAPIPTSHI

SEQ ID NO: 12417 - protein, 417 aa, Aspergillus nidulans
DTSLARLAAQQEHHLGFWEAVRCYPNAVLWSVLLSTSIIMEGYDIVLIQSFFAQPSFREKYGQYDAGTSSHQITAPWQNGLSNAVSVGTIIGAFANGYFVHKFGYRKVLLASLVTICGFILISFFTPNLPVLLVGQFLCGIPWGVFATMAPAYASEVCPLALRGYLTVYVNLCWAFGQLISAGVQSGFSEKTGQWSYRIPFAIQWAWPCLLFPILWFAPESPWYYVRVGNHDLAEASINRLGSASQRAHSKETLAMMIHTDEIERSIDEGTSYLDCFRGVDLRRTEIACMAFAAQPFCGSAMGGTPTYFFVQAGLPESISFRMSVGGLGIASVGTIFAWFLMRGCGRRTLYLWGLGLLTLVLLAVGFCSVGSNSNASNYAQAGLMLCWLGVYYSTVGPICYAVITEVSTTPLKNKSV

SEQ ID NO: 12418 - protein, 815 aa, Aspergillus nidulans
  unsure (1)..(815): unsure at all Xaa locations
MAPTVATQPPPPKLRRIGVLTSGGDAPGMNGAVRAVVPMAIHSDCELYAVYEGYEGLVEGGDMIRQLHWEYVRGWLSQGGTLIGSARCMSFRERSGRLRAAKNMVLRGIDALVVCGGDGSLTGADVFRSEWPGLLDELVKNGELTAEQVEPYRVLNIVGLVGSIDNDMSGTDATIGCYSSLTRICDAVDDVFDTAFSHQRGFVIEVMGRHCGWLALMAAISTGADWLFIPEMPPKDGWEDIMCANITKVENFWILTRLSQLTISQNRRERGKRRTIVIVAEGAQDRNLNKITSDRVKDILTERLGLDTRTTILGHTQRGGAACAYDRSLSTLQGVEAVRAVLDMTPDSPSPVITIRENKIMRTPLMDAVKATQEVTAHIKNREFEKAMLLRDSEFKEYHFAYLKTATPDHPKLSLTQERYVVSYRXAXPLSNAXQRMRIAIVHVGAPAGGMNQATRAAVTYCLTRGHTPIAIHNGFPGLIRHHADQPISSVREVKWQETDAWVNEGGSDIGTNRGLPSEDYDEVARCFKEHKFDALFVVGGFEAFTAVSQLRQARDKYDAFKIPMVVLPATISNNVPGTEYSLGSDTCLNALIDFCDAIRQSASSSRRRVFVIETQGGKSGYIATTAGLAVGAVAVYIPEEGIDIKMLARDIDFLRENFARDKGANRAGKIIMRNETASSTYTTQVIADMIKEEAKGRFESRAAVPGHFQQGGKPSPMDRIRALRMAIKCMMHLEGYAGKSKDEIANDEMSATVIGIKGSQVLFSVMGGEHGLEKVETDWARRRPKAEFWLQLQDTVNILSGRAGAKAMWTGYED

SEQ ID NO: 12419 - protein, 373 aa, Aspergillus nidulans
  unsure (1)..(373): unsure at all Xaa locations
GKYASDSEWASIDPIPLNDGSESGAMPLATIAYSEEYLEATSYLRAVMAANEMSDRALKLTEDIISMNPAHYTVWXVILEDIWTQLNPTGIYRAKIVFALNKDLLEELEWLNGVSLRYLKNYQIWXAALQPGEVLXTTNPARHHRQVIMSSREHFPSLPPKEMDFLMEMFAQDSKNYHVWTYRHWLVRHFELWDSPRELADVNSLLNSDVRNNSAWNHRYMLRFGPRSNEPDAGMVNTGGSPAEKGRLAVVDEDLVDEELRYAQDQILRAPENRSPWSYARGILRAASRPLSEWTEFAQKFVVDKRDDQGQIVDVSVKSSHAVEWLADVYADAEENGRAEAVRMLNLLKDKYDPIRKNYWNYRIRTIEAEEVP

SEQ ID NO: 12420 - protein, 904 aa, Aspergillus nidulans
TRLSLQRTKSTTKDAHRLRSRASQHQDPEKALQEEDLEKEGESEYGGFDLTDFLMGGHLERRTTAGDPAKKVGVVFKNLTVKGVQTGASFVRTLPDAVIGTFGPDLYNIICRFVPQLRFGKKPPVRDLIHDFTGTVREGEMMLVLGRPGAGCSTFLKAIANDRGAFAAVEGDVSYGGLSAAEQDRHYRGEVNYNQEDDQHFPNLTVWQTLKFSLINKTKKNDKESIPIIIDALLKMFGITHTKNTLVGNEYVRGVSGGERKRVSIAETLATKSSVVCWDNSTRGLDASTALDYAKSLRIMTDVSKRTTLVTLYQAGESIYELMDKVLVIDSGRMLFQGPAHYARQYFVNLGFYCPEQSTTADFLTSLCDPNARQFQEGREASTPKTPEELEAAFRQSEYYKLIQNEVQAYEDQLHDTNCADTQRFQKTVQSSKSKTVSKKSPYTVSIARQVAACVRREFWLLWGDKTSLYTKYFIIISNAFIVSSLFYGEAMNTNGAFPRGGALFFSILFLGWLQLTELMPAVSGRAIVARHKDYAFYRPSAVAIARVVVDFPAILCMCIPFTIVVYFLAGLDATASKFWIYFLFVYTTTFCITSMYRMFAALSPTIDDAVRFSGIALNVLVLFVGYVIPKQGLIDGSIWFGWLFYVNPLSYSYESVLSNEFSDRVMACDPSMLVPQGPGVSPEYQGCALTGSKLGSTDVAGSDYLSTTFQFTRHHLWRNFGVVIAFTVLYLLVTVIATETLSFVGGGDGALVFKRSSNAKQIKAATEKPNDEENGQGDAVTQSGGNNEAAFNRISSSERVFTWDNVEFTVPYGNGTRKLLNGVSGYAKPGLMIALMGASGAGKTTLLNTLAQRQTTGVISGDMFVDGRPLSTDFQRGTGFCEQKDLHDATATIREALELSALL

SEQ ID NO: 12421 - protein, 331 aa, Aspergillus nidulans
  unsure (1)..(331): unsure at all Xaa locations
PNLPGKPFVPEWNPPPVTKQTESFATLKSIDLSLLDSEDPVVVNRLIQQVKIAIRDDGFLFLENYGVSLEQLHRQFALAQYLYNNMSEEIRSAFCLTPRQGGGQGISIRTGSRXSYIPSPLFITRTSTXLGFVLXYSATAAPQTESNSLTSTTREWNDPSRIPTCLHPFMDEITAFCNYLTQSVNRRLLTLFSRVLELPDDYLWENVQSHGFPTGEGYFRHALFRPVQKETQEASKGLRMHGHTDFGLTTLLFSVPVSCLQIWGRDEKWYYVPYKPGALVINIGDTLEIVSGGHFKATRHRVYKPPADQLNEERLSLVLFNSSVGELRMQP

SEQ ID NO: 12422 - protein, 450 aa, Aspergillus nidulans
  unsure (1)..(450): unsure at all Xaa locations
ASLLTASVLLGYASAEVHKLKLNKVPLTEQFVSIXAQSSYDMMFVYGCDXFIQITRNIADHANALGQKYMGQFQQHVLEDEPVNAMRGHDVLVDNFMNAQCMFLGLCVAEXYXFLLDFSEIQLGTPPQTFKVVLDTGSSNLWVPSSECGSIACYLHQKFDSSASSTYKKNGSEFAIKYGSGSLSGFVSRDNLQIGDLKVKGQDFAEATSEPGLAFAFGRFDGILGLGFDTISVNRIVPPFYNMIHQGLLDEPVFAFYLGDANKDGDSSVATFGGIDKDHYEGELIKIPLRRKAYWEVDLDAIALGDEVAELENTGVILDTGTSLIALPSNLAEMMXVISLPFHAISRYXHXHLKVNTEIGATKGFTGQYTIDCAKRDSLPDLTFTLTGHNFTIGPYDYTLEVQGSCISAFMGMDFPEPVGPLAILGDAFLRKWYSVYDLGNGAVGLAKAK

SEQ ID NO: 12423 - protein, 351 aa, Aspergillus nidulans
ILLLDGGLGTTLESYPFNITFTSETPLWSSHLLISSPSTLQSAHRAFYDAGADILLTATYQSSIEGFARTDASHTINDAGDYMRSAIPLVRGAIPSSARQRPQQCRVALSLGPYGATMSPVAAEYTGAYPPEMDGEDALRQWHAGRLNVFVDDRESWDQVDFVAFETLIRADEVCAVRGAMKDVCVGPEIHRRRKPWWICGVFPAEEVDRTQVRQWVDAAVGQRPGLPRPWGIGLNCTRIENVAKIVAIMRDELHCLLSRGKEDGFVDEWDAASGKPWLVLYPDGTKGEKYDPVTKTWVARETVVRCPWDESLWDVVQGQSEGDWEGIIVGGCCRAGPADIAALRRRIDSS

SEQ ID NO: 12424 - protein, 314 aa, Aspergillus nidulans
SDVHFWHAGCIGPMIVTGDHILGHESAGDVIAVAPDVTSLKVGDRVAIEPNVICNACEPCLTGRYNGCEKVAFLSTPPVDGLLRRYVNHPAVWCHKIGDMSYEDGALLEPLSVSLAAVERSGLRLGDPCLITGAGPIGLITLLSARAAGATPLVITDIDEGRLKFAKELVPEVRTYKVEIGFSAEETAEGIINAFNDGQGAGPDALRPRIALECTGVESSVASAIWSVKFGGKVFVIGVGKNEMKIPFMRLSTQEIDLQYQYRYCNTWPRAIRLVKNGVINLQKLVTHRYALEDALKAFETAANPKTGAIKVQI

SEQ ID NO: 12425 - protein, 516 aa, Aspergillus nidulans
  unsure (1)..(516): unsure at all Xaa locations
KHXSIIAIGSAINSGLLIGLGDALLTVSLLVMQRYFPDLDLLDQEXYCRPSYNSKCXFQQPASILISYTFVGFIVFLVLSALGEVASFSREPITLHTQAKRFCGPSLGFTLGWMXVASIWPXRPGAHLGQIWLKYMMVIINQITAGVLVLSFWTNLGIGQKAAYITVFLAVILSMNYWSGRFLGRYEVLLSSFKILVVLGLMMLSLVIALGGGPNHKKGFHYWRMPGAFANEEDRSALGVFRAIFRTFPPTTLSYLGTELIGMAVLHTQDSKKAAARAIQQTFYRILAFNLVVVTLLGMAIPYDEDILELSIYTSKRRAMAFVVAVQVAHVTVLPDILNACILIFVVSSASRALCMATRIIRELSLEENAPHFLRRVNKRGVPVYALGVSFAPVLSGFLNLFSTSGRLWTYLVNLVTMFSILTWVSILVVHISFVHFRRVNQIPPEGVPFKAPLGILGSWVALVLCISIPIMRAIELSDHNFYSQGLDVGAFVTSFLGIPLYLGLVVGYKAVYKRK

SEQ ID NO: 12426 - protein, 538 aa, Aspergillus nidulans
  unsure (1)..(538): unsure at all Xaa locations
DRQIPSILSYIGGEQYHGTQAKAQLIRNPSNTVAYFRDYLGKEXVAALKTRTGSECTCXRTTAASSQXTPPHCHNSAHPIQSDSTVAFSIRDTESETPNTVTVSEITTRHLLRLKQSASDFLGREVNAAVVTVPTDFNDAQREALTAAAKAAGLDILQLIHEPVAAALAYDARPEAVVTDKLIVVADLGGTRSDVAVIACRGGMYTILATAHDYELGGSTLDQIIIDHFAKEFIKKHKTDPRENARGLAKLKMEGEATRKALSLGTNATLSIESLTDGIDYGSTINRTRYELLSSKVFAQFTGLIEQVIKKAELDVLDIDEVIFSGGVSHTPKIAQLARNLFPEKTRILAPSTLASAINPSELSARGAAIQASLIQEFETEDIEQSIHPMVTATPHLSKAIGVEFTSGDAVEFLPLLNTETALPARRVAQYSVPAEGGDVLIRVCEGSREIKVTKPEPKPKEEKSKAEDDEDDSDFDSDEEEEDIREIVWKTEQPIAELAVKGVKAKGKVELMIHINADLGLQITAREVGGQSAVRGA

SEQ ID NO: 12427 - protein, 430 aa, Aspergillus nidulans
  unsure (1)..(430): unsure at all Xaa locations
GFDEYHPVTKKGKQMIEGGMGWQIVDALDTLMIMNLTSRVQHARTWIHNSLQYDQDHDVSTFETTIRMLGGLLSAHYLSTEYSNLAPIPDDDVGSPGEDLYIEKATDLAERLLGAFESETGIPYASVNLNTSTGIPSHSDRGASSTAEATSVQLEFKYLAKLTGEAEYWRVVEKVMQVVDANQAPDGLLPIYIYPDTGTFRGANIRLGSRGDSYYGTXCQSSEVDRCXXHSEYLVKQYLQTSEEIYKDMWDEALVGIRKHLITFSKNAKLTVLGERQAGLDGPLTPKMDHLACFLPGTIALGATEGIPLSEAKKSAAWTRRKDEEILLAKELMKTCWATYLATRTGLAPEITYFDIDTPHVSELDRYPDSTLAAGNADKKPADKDLPLKSQALYPLADSNSDPNSWRRDIIIQPQDRHNLQRPETIESLV

SEQ ID NO: 12428 - protein, 352 aa, Aspergillus nidulans
  unsure (1)..(352): unsure at all Xaa locations
RLXRSSGGFRVGWQLVPSGLMFIGLWFLKESPRWLMKQGRREEATASLAFTRRADPNSDEVQQELAEIRASIEEELRSTEGVTWREVLLPGNRLRFLNAFLIMFWQQFSGTNSIGYYAPQLFQTIGVASTDTSLFTTGIYGVVKVVSTGLFLLIGIDRFGRKWSLVGGGWAMAVFMFILGAVLVSYPPVNTDTISNASIAMIVMIYLYVIRYVIYPFPPESXSALSXLXHSYSASWGPIPWVYISEIFPTRLRAYGVGMGSATQWLFNFVVTKFTPSAISNIGWRTFIMFGVFCFAMGLWVCIFIKETKGKRLEDMDDIFGGKTVEQMQKDIEQADVEEQTEVEKTQTRHEE

SEQ ID NO: 12429 - protein, 378 aa, Aspergillus nidulans
  unsure (1)..(378): unsure at all Xaa locations
DLHEYLSGPIAIPTTPHPLTGAQLPVTLGHEFSGTIEEVGQGVTGFKVGDRVAVRPNLSDGTCASCVYGRPNCCRSLGFIGFKQXVSLRGCATGAGVDNXLILPEXVNSGGLSDYVTVPAKHAILLPESVPLDLGGESAKCTFHXPSXSRAQALVEPLTVAWHAVARSPHETARTALVVGGGPIGLAVVQVLKARGVQTVVVAEVSTQRREYALTLGATHVFNPLTDDVVARVRSLTDNAGADISFECSGVQAGFDTAMNGIRVRGTTTIVSLWEKKPMIDAFDVVSYEKHVIGAAICDDGDFEAVIGAIKDGVLLILSRLAYYSVPLRRQHADWSPTRSRQTNPRPMITSKIRMEDVEEKGFKALVDEKDKHVKILI

SEQ ID NO: 12430 - protein, 459 aa, Aspergillus nidulans
  unsure (1)..(459): unsure at all Xaa locations
MRIIPSALIALGFGYGVVAAPTLKQAERRSFKVETVRRSNTIYGPAALRKAYVKYGIVAADIGLDLDDFEPSVKVAAAADTDAEVAEPDLTGAVSAKSVEGDASFVSPITIGGQELTITFDTGSSDVYVLRFFPHARXCXSSFQWVVNTLLPKDSIEGQTAFDPSKSTTYKKMTGSTFNITYGDDSYAYGPVGTDTINVGGVTVTGQAIGLPTAVASSILEDTHSNGLVGLGFSSLNTVKPTQQKSFFETIAGVLDEPVLSASLVSDGVGEYEFGTVDKSKYKGNLVNATVDSSGGFWKFESSYYRVGDGTLKKHDDATWTIADTGTSLMLLEQTVVDEYYAQVRGAQYATSASGYIYPCSAELPNLSIAIGPQHLATVPGNLINFSEVGTNTTTGEAGMXQSFFXRLIYRXYFRSLYGGVQSNSGLDMQILGDAFLKAFYVVFDLRGPSIGVASPVXS

SEQ ID NO: 12431 - protein, 543 aa, Aspergillus nidulans
PDVAFLPPAEDQKALWEHLSTIDIFSIGSIPYQLAGEKGSPAAGIAEALPLLFTAVSEGRLTVEDIIARLYENPKKIFELHDQSDSSVEVEIDRPYLFQSAQAWSPFSGKSVKGLVQRVIFQGKTSCLDSEITPDAPKGSDMSGHRIVPASPSLKAMSPRVDGALDRRQSISIAGTPARLGRKPVDHFPAATGAELGPPLYTPVPRASSPLLQMLSRSPFKQKHVLSVNQFNRADLHLLFTVAQEMRLGVQREGVLDILKGRLLCTLFYEPSTRTSASFDAAMQRLGGRTIAISTEHSSTKKGETLQDTLRTLGCYGDAVVLRHPEPSSTEVAAKFSPVPVINGGNGSVEHPTQAFLDLFTIREELGTVGGLTITFTGDLKYGRPVHSLIKLLQFYDVRVQLVAPKDLSLPADIRQQLLATGQLLTESEELTPEIVARSDVLYSTRVQKERFADLEQYERLKNSFIIDNALLKHAKSHMVVMHPLPRNAEVSEEVDFDQRAAYFRQVSLQSRGPSSEFDMLMWMQMRYGLYCRMALLALIMAP

SEQ ID NO: 12432 - protein, 721 aa, Aspergillus nidulans
RLEDLLRHPEDLDKINGLKAEYTRKKAAVDAQLREGLRDQLASVQRSLSALTEGQRQVSKTRDELQGIDRLCAESQNSVDDFSRIDQLAKIQRNFEATLMMKKGLENFSSDLAEIEELLREDDEDLENQPNLLRTHMRISRLRDFRDEAMDQVRRAQDASNEATLEEYFQGLDAVIDWFDDHLGTLCMNLIPLVQSDNPSMVVRLAVVVANEEKNDETVKALQEAQKDHQDLAGRFKSMNVGPKTVRGYKEKFIQAIEFYAQNQFEDTKEKFLDDPEGLEKSFRWFFNDLFVVQQGMQSLMPKKWKIFKTYTDIYHRMMHDFLIEMVNDPALPADNLLAILHWREKYYKKMKKLGWQASDLELDILDNREPDLIRRWQNVIINAVEDWMDKITETDRKALTERIPDSLDTTADGYFRTQTLPDMWRMLHEQVTVSSSSSRPDLLEGIMDAMFRVLKARQNAWQTLLEEECAKYKAPGGEQLDGLQLLQDWLIAVANDQIACIDDNDETGQYGHLTRFRRDIEQYVDPKYMASRAIPEIDALRDGYVDLSTYCISQFVNVIFAVDLQGTIRDFFTQRWYGDFAVKRITSTFDDYMADYSPVLHPSLTDILVEELSDELLVRYLSSVRNKGVKFRRQTDPYTDKFKDDVLTVFAFFQKYPDSFAGTIKQKWRLVDWLVRLLEAEKGPAVVNVYEDFKNEYWDLQLSWVETVLRARDDFERSMI

SEQ ID NO: 12433 - protein, 313 aa, Aspergillus nidulans
  unsure (1)..(313): unsure at all Xaa locations
GTWQSAPGEVSAAVYHALKVGYRHIDAAQCYGNETEVGEGIKRALSEGIVKRSEIFVTTKLWCTYHTRIQQALDLSLSKLGLDYVDLYLVHWPLAMNPNGNHDLFPKLPDGSRDLVREHSHVTTWKGMEELITNNPDKVKAIGVSNYSKRYLEQLLPQAKIVPAVNQIENHPALPQQEIVDLCKEKGILITAYSPLGSTGSPLFKAEAIVAVAERRGVTPASVLLSWHVRIPIPYRTNFGPEHIXCEXEMLMCACTVARGSSVLAKSVTPSRIEENRKLVKLEPEDVELIGKYSAELAATNGFQRYVYPPFGV

SEQ ID NO: 12434 - protein, 541 aa, Aspergillus nidulans
  unsure (1)..(541): unsure at all Xaa locations
DLVMGFLRNLVSGKREGRGGVPLKAVVMSATADMESLQEFFVEGYKARELQKEEKSEKDGIAVCHIKGRQFPVKTIYSPEPVHDFVDAALKVIFQIHYKEPIPGDILVFLTGQETVEALENLVNEYATGMDPSLPKIQVLPLFAALPQAAQQRVFVPAPPRTRKIILATNIAETSVTVSGVRYVVDCGKAKIKQFRTRLGLDSLLVKPISKSAAIQRKGRAGREAPGQCYRLYTEKDYLALDEVNTPEILRCDLSQAILNMKARGVDNVIEFPFLTRPPREALEKALLQLLSIEALDETGKISETGSHIAKLPLTPTLGRVLLAASDFGPDCLTDVIDIISCLSVENIFLNTTSEEKKEAAEAARRDLYRREGDHLTMLATVRAYASENTDRKAWAERHLVSHRAMQSVMVSLLPYLDTMSLSNPHGXYSGPXDVRKQLTAQCRQAKLLPSPTESRDSDSSSIREPSPVFILKSFLRGFATNTARLVPDGSYRTVVGNQTVAIHPSSVLFGKKVEAILYNEFVFTNRSYARGVSAVQMDWV

SEQ ID NO: 12435 - protein, 396 aa, Aspergillus nidulans
  unsure (1)..(396): unsure at all Xaa locations
VRQHNVVPEPSLVSDVTHVALAFMQSSIFNRNSTSSWPLFTTVDAVRTEFSNGTSILISIGGWGDTQGFSTAARTDESRKLFAENIRRMVDDTGADGKSSFITGVFAYXRSAGVDIDWEYPGYVFPAYRPLXSGLILTLKLYRGNGEDYKRIPNSEKFWETAAYPQLLAEIRAAIPDKLITAAVPGLPRDMLAFTKETIPSISASVDFLNVMTYDLMNRRDTVTKHHTGVQLSLESIDAYIEAGMPPEKLNLGLAYYVKWFKDRARRTVRKTANWMSDCFNGGPGYGCGSWTSGAFSWNDRVPQELAASFEKAKISGEYDPFGGGYYFWDSNENIFWSWDTANAIKRKFPAILEKRKLGGVFAWGLGEDAPEFAHLKATTAGLGDSSAAPGGKLST

SEQ ID NO: 12436 - protein, 568 aa, Aspergillus nidulans
  unsure (1)..(568): unsure at all Xaa locations
YXLYWCIGVAMLNSCINGYNGSLMGSINSYRQYREYFGFDLEEGTSTTGIVYAIYTIGNIVGSFFAGPFTDFRGTXPHPSTLPILPEPGLLSTDXAGRRMGMAIGALWIIAGTIVQATCHNLGGFMAGRFLLGFGVATSATAGPAYVSEMAHPAYRGAMTGLYNVLWFGGGIPGTFIPWRTSTIDGTQSWRIPVWLQMVFSGLVLLLCFTIPEVYCPFLYPGSVELEXRASNHWTRMPXSPRWLISCDRHEAAIRVLAEYHGEGDRNSPLVQLEYREMLEDISNVGADKRWWDYRELFDSRETRYRSMLVVFMGTSPNPSLQTYTEEVVCXXVIFAFFGQWSGNGPVSYYYPQMLAGAGISSNHTRLLLQGLQNIVQFTGAIFGALITDRVGRRPQLLVSTSIIVFLFVIITALNATNVQVAGDGGGVVAKSSVTRRAQIAMIFIFGFVYSAGWTPNQAMYPVECLRYESRAKGMGMNNVRTLSSLSGSVFIHVKYLCHDGHGXQRRXFFINIASFYNTFVTGIAFTRIGWKYYFLFIFWCTFEVLIIYFLFVETSKRTLEELTVIFQ

SEQ ID NO: 12437 - protein, 758 aa, Aspergillus nidulans
  unsure (1)..(758): unsure at all Xaa locations
DAPSDSEQDVFGSQEDESTWWEETFGGNSDSKPRGPKSVGVDISFPGYTHVFGIPEHADSLSLRETRXAARLLFHKLPKLIISSGGPGNHEEPYRLYNSDVFEYELNSPMTLYGAIPLMQAHRKDSTVGVFWLNAAETWIDIVKSKTDTHSHWFSEAGQLDVFVFLGPTPGEISKKYGELTGYTQLPQQFAIAYHQCRWNYVTDEDVKEVDRNFDKYQIPYDIIWLDIEYLDDRKYFTWDPLTFPDPISMEKQLDESERKLVVIIDPHIKKQDKFEISKELNSKGLATLNKDGNVYEGWCWPGASNWIDCFNPAAIKWWVGLFKYDRFKGTLPNVFIWNDMNEPSVFNGPETTMPKDNLHHGNWEHRDVHNVNGITFVNATYQAMLERKKGEIRRPFILTRSFYAGAQRMSAMWTGDNQATWEHLAISLPMVLNNGIYGFPFAGADVGGFFHNPSKELLTRWYQTGIWYPFFRAHAHIDTRRREPYLIQEPFRSIITQAIRLRYQLLPAWYTAFHEASVNGTPIVRPQFYVHPTDEAGFTIDDQIYLGSTGILAKPVVTEGATSVDIYIADDEKYYDYFDYTVYQGAGKRHSVPAPMEKVPVLMQGGHIIPRKDRPRRSSGLMKYDPYTLVVVLDKNGQAEGTLYVDDGETFDYQRGGHIHRRFHFQDSSLVSEDIATHGPQTAAYLKTMASVSVERIVVIDPPKELQDRSTVTVIEDGAKTSSSAQLEYHAQEGGKAPYAVVKNPRVGISKTWRIEF

SEQ ID NO: 12438 - protein, 474 aa, Aspergillus nidulans
  unsure (1)..(474): unsure at all Xaa locations
ASMLIISNRLPLSLQKVDGKYESTLSSGGLVTALSGVSKSTNVHWFDWPGSNIEDPEERKTANEALAENNAVGIFLDEALAHSHYNVFSSCFLPHTPPVLGKXAEMLTCLDGIAWPILHYQSGVDFNEDAWKSYKKVNEIFADSVAESASDGDLIWIHDYHLLLLPAYLRDRLEKQGKKCPIGFTLHTPFPAEDFWRALPVQKELLAGVLACDLIGFHTDEYKRNFIECCSRGLDVSVKDDSIVYQGHTARTGTFVVGVDPAKFTDGLQTTEVKNRIKELEDEYKHKTVILGVDRLDYTKGLVQKLQGYDYFLRQHPELKNKVRLIQVAIPSREDVKEYQELERELSMLVGKINGEHCTYPNLSFPSDRPSLLAGDGVLTVIATPDGTPIIYLHHSVPFTDLTALYRIADICLITSRRDGMNLVAAEYVACQKDRFGVLVLSELAGAASFMSKGSITFNXSSAQQLADAVTRSD

SEQ ID NO: 12439 - protein, 600 aa, Aspergillus nidulans
  unsure (1)..(600): unsure at all Xaa locations
NPSVAALYEDALVYETGTAITSSGALTAYSGAKTGRSPSDKRIVKEESSEKEVWWGPVNKPMTPDVSQAFCFIPCLALSSSIMHKLPSTFPPSGYICXXMPHALLGXGILKLCYLTNXPGLGLSLSWVVCRSACRCLAGLVXRHYTXVPLLTGFLQVWRINRERAVDYLNTRNRIYVIDGFAGWDERYRISVRVVCARAYHALFMRNMLIRPSAEELKHFHPDYVIYNAGSFPANRFTEGMTSATSVAINFAEKEMVILGTEYAGEMKKGVFTILFYEMPVKHNVLTLHSSANEGQNGDVTVFFGLSGTGKTTLSADPKRALIGDDEHCWTDRGVFNIEGGCYAKCIGLSAEKEPDIFNAIRFGSVLENVVFDPISRVVDYDDSTLTENTRCAYPIEYIENAKVPCLSDSHPSNIILLTCDARGVLPPISKLTTEQTMFHFISGYTSKMAGTEDGVTEPQATFSSCFAQPFLALHPMRYARMLADKISQHKANAWLLNTGWVGAGATTGGKRCPLKYTRAILDAIHSGELAKAEYETYDVFNLHVPKSCPGVPDELLNPKNSWTATTSFSDEVNKLAKLFNENFQKYADQATKEVIAAGP

SEQ ID NO: 12440 - protein, 383 aa, Aspergillus nidulans
  unsure (1)..(383): unsure at all Xaa locations
NFRALDSILIANRGEIALYCARSTSLTSLTTYRRVGRTAAQHGIRVTTLYTDPDSQAQHALSTPYAFNLGSVSAYLDGDRIIEIAKAQGCQGIHPGYGFVCIICSEVSMMLMDCSLIASENSEFARKCTEAGLVFIGPPWKAIEDMGDKRCSTSLRLLYDILTLYFCSQSKHIMTAAGVPCVPGYHGENQDPNFLEAEADKIKYPVLIKAIKGGGGKGMRIARSKEEFQAQLQSAKSEAMNSFGDDHVLVEKYITTPRHIEVQVFADKHGNCVALGERDCSIQRRHQKILEESPAPHLPDATRKDIWAKARSAALAGSLEGAGTVEFIFDNDTGEFFFMEMNTRLQVEHPVTEMVTGQDLVQXQLKVAEGAELPLTQEEVENN

SEQ ID NO: 12441 - protein, 523 aa, Aspergillus nidulans
SRPMYIDALSGEQYTYGDVIQRTRSLANGLQQLFGLREHDVVALFSPNTIDYPIACHAIIGSLAVVAPTSAALTAQELHAQLKTSRARFIIAHSSLLSTARAAAKGTSIEKVIVLDGQSSAPGHLTCQQLASTYAPTALRQIPAHEAGSRIAFICFSSGTSGPAKGVITTHRNITSNLQQWRAQLLDSGSAAQRVDRTAAIAFLPFSHIYGLNLYMCQCLTWGTPVVILPRFDLDTYLSCVEKYKPQELALVPPIALMLVKDDRIRNYNLRSVRRILSAAAPLTIELSSALETRFKDIFGTEVFCTQSWGLTETSPIATGIPNDRMDKRGAGVGCIVPNMEFRFVDPETMLDADVGKDGASQPGEIWCRGPNVTPGYYNNLEATRGAFHVDDDGVSWFRTGDIGVIDAEGYITIQDRIKEMIKYKGLQVIPSELEGKLVDHPDVVDVAVIGVWVDARATELPTAFVTLRQGIDDEGSGKVIEDIHLWFNARVANHKRLRGGIYVVENIPKSPSGKILRRVLKQ

SEQ ID NO: 12442 - protein, 425 aa, Aspergillus nidulans
  unsure (1)..(425): unsure at all Xaa locations
LGDCLGRGAFGSVYRALNWNTGETVAVKQIKLADLPKSELRVIMVCLPTTSLALRANNTMLQLEIDLLKNLDVXHCLLGTSGPYSCDIYXLNXQXHPNIVKYQGFVKSAETLNIILEYVLDGIGXEIVQQLTIQILRNGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPVSFASWPCFCTGWLMNDQAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPS

SEQ ID NO: 12443 - protein, 519 aa, Aspergillus nidulans
YARPSTARSSSASDLKGSDKRAGIFGGKKDVRQPDTESKPHGHMAELKRFFKMGHKHKRGESPTSKKSSRSSGKNTPYQMATDNVPFADDHGLNSKYGKLGKVLGSGAGGSVRLLKRNSDGVTFAVKQFRERHSWETMKEYSKKVTAEFCIGSTLHHGNIIETLDIIQEGSHWYEVMEYAPYDLFAIVMTGKMSKEEVACSFKQILSGVAYLHGMGLAHRDLKLDNVVVNEHGIMKLIDFGSAVVFRYPFENDIVPASGKSVQQFQMLVESSTDFFQGIVGSDPYLAPEVYDEKKYDPRPTDIWSLAIIFCCMSLRRFPWKQPRVSDNSYRLFVSTPTPGTPVPDADPRRHRPVKSAPDLHSAAIEDKPPQYAANISEEPSKIMATPPRSPVKPTTGNQEENLPPETTQEKPPTKDTNCDKANTQNKPTRTTSKEAPPLPPGSAQAAGQRQEVIKGPWRLLRLLPRESRYIIGRMLKVSVKDRATLDDVLTDEWVRNIRACQQEVTGEVIKAPGHTHVL

SEQ ID NO: 12444 - protein, 535 aa, Aspergillus nidulans
  unsure (1)..(535): unsure at all Xaa locations
LHIGQAGTQMGNAAWELXVFITLXSFWQRLIARLLSSYLLEHGLTADGHVNPDITTDIHRNDSYVTIFTELGNGKFVPRSIFVDLDPSVVTGEXGAGIXADRLMVVXPIDEIRTGTYRHLFHPEQLISGKEDAANNCLTSEYLRAAWXAKLMRSRCRGHYTVGKTLVRGVVDRIRRVAGVHWNPSLSPGLYTNFLGDSCSSLQGFMIFHAFGGGTGSGFGALLLEHLSSEYGKMSKLEFAVYPSPRTSTAVVEPYNAVLSTHSTIENSECTFLMDNEAVYDICKRKLDIPRPGYNNLNRLNARVVSSLTTSLRFNGDLNIDLNEFQTNLVPFPRIHYPLILYAPVISSSCSTYKSFKVKDLTLQCMCPVFSSKISLQSNCLAGFEPRNQIVICNPQTRKYIAVALLYQGDVMPHNCARAITDIKAKASFNLVKWCPTGFKLGINNQKPMFVPNSKLASINCLVTMLSNLTAIAEAWSRLGHKFNLIYSKHAFIYXYVGEGMEEGEFSEARKNLAVLEKDYEEITGDTVGLDGYVE

SEQ ID NO: 12445 - protein, 500 aa, Aspergillus nidulans
  unsure (1)..(500): unsure at all Xaa locations
RGLSSRHVQLMAIGGSIGTGLFVGIGAYLRDAGPLSLLLGYLIWGIAFILPINLSVGEMCAYLPIRGSIFELAARYVDPAFGFAMXGPSAFRVQGTRSDNIRLGDWVYFYAGLMLVCTEYSAVAFIMDYWQIDVNPAAWVAMAMVICLALNLVAVKYYGEAEFIMASTKILLLLGLIFLTFITMVGGNPKRDVYGFRHWTDGVMYEYYTDGATGRFLGFFSVMVYAAFTIAGPDLPALAAGEIQHPRRTIPRVVKMTFWRIVGFYVVGVLGVGIICDSHDSRLMSAIDSGASGSAASPWVIGIENLGITGLPDLINVLILFSGWSCGNAYLYSSSRTLYSLARDGQAPKFLTKCTKDGVPVYCVIVVTLLSCVTFLVADNASISVFYWFVALTTIGLVLTYTSMACTFLGWYRALRAQGIDRKSYLPWISPFQPYMAILAVILGFSTALFNGYAVFKPFNAQGFVTSYFGLAFFVVMFVFWKVLKRTKWVDPTTKDLYTG

SEQ ID NO: 12446 - protein, 453 aa, Aspergillus nidulans
  unsure (1)..(453): unsure at all Xaa locations
ISIQTKMTDSSNVSNLPTTDMAESAQTEGEKREENSVPKQEESRPNFPEGGLRAWSVALGNAGVMFCTLGYINSWGYVKRCPXLLKTNVCSVYQAYYEANQLRSETPSAISWIGSLQTFSILSASLVGGPMFDRYGAKVIYPPAVAFVFTIFMTSLCKEYYQFMLAQGVLGGVTQGLTMTPAMAATPQYFFKKRGVAMGLGVAGASVGGVIHPIVLNQLLTRTDLGFGWSVRIEAFLISVVLLISCPAIRARLPPRKSKFLLPKAFKEAGYTSLIIGSVSTFMGMFTPLFYLPSYGISKGMSPTLAFYLSAILNAASFPGRIVPAILSDRFGKLNAFAAAGVATGILTLCWQRVEGNAGVIVFTALFGFVSGAIISGGTVALAMCAKDPKDIGTYMGMGMAWTSLVSLIGPPVSGRLVDTDMGYTAVAIFAGTASLVGGLFVLLIVKPLSGFK

SEQ ID NO: 12447 - protein, 515 aa, Aspergillus nidulans
LPPLPIPELRAIINRHLSYLRAFATDQEFQETVRFASDFQTPGSIGRRLYDRLQVMKAANPDTWYHDLYLQNQYLVRNGPLAPYMTFFFTHPVNIGRHSQAERAALIASTVIRYKFCLENGQIQPRLVNEQPQCMDLYKYMFNTVREPTLGVDLMSRYPGNDYFVVLRRGHVYKVEFDSSAQHAQYERLERIFQTILDTRIDEVDWLGVLTTADRISWAKVYFLLAPIICKCKTADNEGRLGMNLMHLSEENASYIRTIEQSAFVVCLDDGSPETPEERGRHFHFLDGSNRWHDKPIEFIIAANGASGVLGDHTGLDAGTVHELNTEIAEAIRRHQDRRTLSNGTSCEVTVHPVRYSAISPGIEARIHETRSIYTAAISSREHRYTTWTGYGSSLMKAYKIPANSAFQLVVQLAGRYYFGQTSPCWETVLQSNFHTGRVEINQVVTAQVAAFVDAAAEAVPLSDCRQLLLEAARAHSSAVLACTRAGGSDRFLSMMREIVEADEQEPEPYHDPVY

SEQ ID NO: 12448 - protein, 353 aa, Aspergillus nidulans
  unsure (1)..(353): unsure at all Xaa locations
AHGHTCLGQKSIAWRFPLALQILFAWILFFGMFLFPFSPRWLMSKHREEEAVVALSKLRRLDPNDPLIKAEVLEIKAAVMFDEESDREAVQRGGKLAPWKALFAPNMFKRLVLGCGMSSAFSLFLTDADAGREGMMICQQFTGINAVLYYAPQIFASFGFSSSKQTLLATGVTGILQIVFTMPAVLFLDKFGRKTFLIVGAAGMFCCHIVVATVEGLYEDDWALNEGLYKAQGWVAIAFIWLFAVNFAYSWGMHPLTSLLPPFIMHXCXRCRNPVAWVLAQEIFPNSARSRGVSIVASTNWMFNFVIGLTTKDMLNSMKYGTYIFFAIFSALGGAFIWWFAPETKDKTLEELD

SEQ ID NO: 12449 - protein, 720 aa, Aspergillus nidulans
  unsure (1)..(720): unsure at all Xaa locations
FLLNSNGMDIKIDKNSDNIQFLEYNILGGVLDFYFFAGPSPKDVSVQYAEVAGLPAMVPYWGLGVCLPARKLYMVSITDFSFHQCRYGYRDIFEVAAVVHNYSDRXIPLETMWTDIDYMDHRKVFTLDRERFPLDTVRALVQYLHQRDQHYIVMVDPAVAHSENGAFTRGLEKDVFMRKQDGTLYKVLSQPRLNNXLRIXTXWYKGAVWPGATVFPDWFHPNTSDYWINEFALFFNAESGVDIDALWIDMNEAANFCDWPCTDPVAYAEENNLPPEPPAVRPNPSSLPGFPAEFQPVNSNNNNSSRKRETQVVIAARQGFVKVGNDNGNGRRLGLQGRELIDPPYKIANAAGSLSNKTMNTDIFHANGLAEYDTHNLYGTSMPFCPLISGVYVNQAQXXVRFHEDAMLYRRPEKRPLVITRSTFAGAGSYVGHWXEAFQSNCPEPDYXLRAGSATTLSTWTKYRISIAQMLAFASIFQIPMVGSDACGFTGNTTEELCSRWATLAAFNPFFRNHNEYGMVSQEFYRWNSVAEAARKAISIRYSLLDYLYTEFHEQTVTGEPFLLPLFFVYPNDPNVVGIDSQFFYGDAILVSPVIEEGKTEVHAYFPGDLFYDWYTGLPLRGNGEVITLTDIGYTDIPLHVRGGKIVPVRTGSAGMNTTTEVRKSGFRLVIAPGLDGRAAGRLYIDDGESLEQTAMVDVVFTYEDGRVSVDGVFTLQTDL

SEQ ID NO: 12450 - protein, 532 aa, Aspergillus nidulans
DLEQARIATAQEHSLSFTEGLRTYRKAVMWSMLFSLAIIMEGYDTTLLQSFFAFPEFVRKYGSPIYTSTSNASSSPGPGEEVETHELSAAWQSALTNGAYIGEILGLFITGLVIEKTGYRRLMFASALSLGGFIFILVFAPDLPTLLVGEILCGIPWGVFQTVTTAYAADVCPVLLRGYLTTYVNLCWVLGQFVATGVLRACLHIGPVQDAGQGDEWSYRIPFMIQWVWLPFILVIVWVGPESPWWLVRKGKLSEAKSVLERLSASTLSSSLHTRQALERGQTETTLALMLYTIQMENEYVSQSHESYLSCFHSTNRRRTEITCLTWAIQALCGSSFMGYSTYFYQQAGLSVSQSFNMSLGQYAFGIVGTLVSWLLMTRFGRRTLYVVGLLLLVIILFSVGFTSLSDTKTASWAIGSLLLLFTFTYDCTIGPGCYSIVSEIPSTQLRGKTIVLARNVYNMFMIVNGIIVPRMLNPTAWDWRGLAGFFWGGITLVLLCWSYFRLPESKGRTFAEMDILFERRVNARRFRKEKV

SEQ ID NO: 12451 - protein, 221 aa, Aspergillus nidulans
  unsure (1)..(221): unsure at all Xaa locations
MAGFDFSNYNRNAALHAKGAPLPKATSTGTTIVGCIFDNGVVVSLFGXWWHHSXWGXPSAQIAADTRATSGPIVADKVSXRAHILVXKGLIQYFPFYRNCEKLHYIAPKIWCAGAGTAADTEFTTALISSNIELHSLSTGRPPRVITCMTMLKQHLFRYQGYIGAYLVVAGVDPTGYRPYTVHAHGSTDKLPYVTMGSGSLAAMSVFESTWKPNLNKEEAI

SEQ ID NO: 12452 - protein, 292 aa, Aspergillus nidulans
  unsure (1)..(292): unsure at all Xaa locations
VVREKVQDGLTGETKEIQYSQCKIVGNGSFGVVFQTKMMPSGEDAAIKRVLQDKRFKVCAHCWSSPSCSPGHSPLTLSRNRELQIMRIVRHPNIVELKAFYYSNGERVCSPINSVXLHVSANPCMVSPQKDQSYLNLVLEYVPETVYRASRYFNKLKTTMPMLEVKLYIYQLFRSLAYIHSQGICHRDIKPQNLLLDPATGILKLCDFGSAKILVENEPNVSYICSRYYRAPELIFGATNYTTKIGKHPRHLGFSWTSXHLXTVWSTGCVMAELMLGQPLFPGESGIDPFSE

SEQ ID NO: 12453 - protein, 428 aa, Aspergillus nidulans
  unsure (1)..(428): unsure at all Xaa locations
RQRRPFFYLSGCLLPDSSLVYNIDSDQLTLFIPPINPDDVIWSGLPLSAAEALERYDVDNVLETTEVNATLANIAASHANNSTAFAIAEQVSEGTKFEGFSETNFNVLKGVIERTRVVKDSYEIALLRKANDISAKGHIAAIKASKSATNEREIEAAFIATCIANGAREQSYHPIVACGQNGATLHYGKNDEDLIDPVTNRRKDNVLIDAGAEYRTYCADITRAFPLNGKFLPETRQIYEIVLRMQLECIDMLKEGVQWEDVHAHAHRVAIRGLLELGILRGSEDELFDKRISVAFFPHGLGHYLGMDTHDTGGNPNYEDTDTMFRYLRVRGRLPAGSVITVEPGCKIPYPSFFYLCCXLSPVQIYFCRFIIEPFLKNPDLQKYIDVGTLNRYWRVGGVRIEDNVHITKDGHDNLTTAPKTIEEVESL

SEQ ID NO: 12454 - protein, 545 aa, Aspergillus nidulans
  unsure (1)..(545): unsure at all Xaa locations
GSFLFAYDTGIIGGILTLDSFKQSFRYSEAERADIASNSTSLLQAGGMSLSRLPGSSGSLLTCVLDLAFFSCFFAWPFTKKFGRRWSIALASLIFCIGGIIQVAPTHSIGAFYAARVISGVGVGMATVMVPMYRXSSAALYXSXTKLTSRRGQREMSPKEIRGQLGSLFQFFFTLGVMTSYWIDYAVEKYVASSDRQWQIPIGLQLVPAGILGLGMLFLKESVRWLASVGRHDEALQSLIWVRGGEDTEEVRTEMAEILDGISAEVAATEGVTWKELNLPANRFRIFIAISIQIGTSPCXIATLNWVYADNCSRAMHWKHLAGILYACSSKTCLRPGLTVADAPQIFGAVGTSENDTLLITGFFGVVKVVACGTFVLFLVERIGRKWSLALGAFMMGALMLIVAILAKVFTPDSTAYXNIVSYRCIDCDDLSGGGLVXHVLGMLTARASPYWTASTASXQFDXGPVPWLYMSEIFPTRIREIGIAVGTATQWLFNFVFSQATPHAVNNMGWRTFLMFCIFNWAIVVYVFLFIRETTGKSLEEMED

SEQ ID NO: 12455 - protein, 455 aa, Aspergillus nidulans
  unsure (1)..(455): unsure at all Xaa locations
MPGSKYAIKDPFSYHTGLNSYHEYAPPAQQPMAFLTWATRSTAIEDALPRPQSLPQRHGLGLYPERISGTSFTAKRAVNKQTFLYRILPSTAQSSWNRLSDHPLNHRSHSAELNFVPDQLIWPPAQVQEDKTFLDGLQMIGGAGDPTVKNGVAYYVYTCGLSMDEKQAFYSADGDMLIVAQTGILDIQTEMGDIRVRPREICVVPRGIRFRVSLPKGPSRGHVIEAYSGHFDLPELGPIGSLGLANVRDFEIPRARYVDTEEITEVIAKFGGGVYSAEMKGSAFNAVAWHGTYYPFKYDLGKSSQRPNNKFERLNSCVYQGKFMPMGSTLYDHQGPSSLXQFFVQPKXPPQDPSIYVVLTCPSDKPDHAAVDFLVLGPRWMVMEDTFQIPYFHRNTMSEFSSVISGGFDLSRVPTPMYGMSGLHNVLSPHGLSAPETENAIKKVLRPERVPDDTM

SEQ ID NO: 12456 - protein, 548 aa, Aspergillus nidulans
AENLTKKHAEFGPLGDPSHLYTSVVFGGEIPDPVVDEPPYFIILTTYISFLVLIFLGHFQDFVSRWFQPHTYLRLRSQNGYASLYNGFESFFSRRMKQRINDCFERPTTGVPGRHVVLLDRISKDNIHFELTGKATDTLNLSSYNYLGFAQSEGPCADTVEETIYRDGISMAGPYPGTTKLLVEVEDQISRLVGKDAAIVFSIGFVTNSTVFQALVQRECLILSDEFNHASIRFGARLSGAAIEVFAHNNMTSLDEKLRQAISQGQPRTHRPWKKIMVTVEGLYSMEGTMCNLPQILELKKKYKFYLFIDEAHSIGAIGSRGRGVCDYFKVDPADVDILMGTFTKSFGATGGYVAANQPIIDKLRCTNAGQAYSEAPTLPVLAQISSSLRLIADEDPLYPGQGLERMQRLTFNSRYLRLGLKRLGFIVYGHDDSPIVPLMLYHPAKMPAFSREMLRRKISVVVVTYPATPLELSRARLCVSAAHTKDDLDRVLEACDEVGEALQLKFSSGKAGGLKQPRPCVTISPDKITEPPRWTLTEIIKWGVRDA

SEQ ID NO: 12457 - protein, 314 aa, Aspergillus nidulans
  unsure (1)..(314): unsure at all Xaa locations
LITGTSSGFGHEFVTQLLSRGDKVIATARILSRISDLKQLGPDVVTLELDVTASQRELNDKAAEAIQVFGKVDVLVNNAGFVKFGFLEDLRFVYASYPSLYMRDAKPRQXRXLYKQFKPNVFGPINVARAFLPHFRSQRSGTIVNIGSMSAWETYPGVGPYSASKAALRCMFSSLQFVIFCNHYXGXIQMATEALSQELGPTGIKTLLVEPGQFRTELLGPSNSVFVETKIPEYQDAANASFGAFRSAHSRQRGDPVKGVARIIDVVKGEGEAAGREWPGELVLGQDAIRVIKKKCDGMLRLLSDWEGFSSSTD

SEQ ID NO: 12458 - protein, 314 aa, Aspergillus nidulans
  unsure (1)..(314): unsure at all Xaa locations
QITIITAALNTESKFAKFYEKGINKADXGEPTFDDAISLLAKIPRVAALVFRPNEIDVVGRQKLDPAQDWSYNFAELLGKGGANNADFHDLLRLYLALHGDHEGGNVSAHATHLVSSALSDPFLSYSAGLLGLAGPLHGLAAQEVLRWILAMQEKIGTKFTDEDVRAYLWDTLKSGRVVPGYGHGVLRKPDPRFQALMDFAATRKDVLANPVFQLVKKNSEIAPGVLTEHGKVPYRPYHKTLQLILCLDKNPHPNVDAASGVLFYHYGFQQPLYYTVTFGVSRALGPLVQLIWDRALGLPIERPKSINLLGLKK

SEQ ID NO: 12459 - protein, 464 aa, Aspergillus nidulans
  unsure (1)..(464): unsure at all Xaa locations
KRAGLASERVLVLGATNPGGAATTTVQFMSSVPSEPVGPVHIEPDDIAFLVYSSGTTGLPKGGDILLDTVPEAVLVIDYXPLPSRVMVSHRNVVAAVVLQAAIESPHVHWKKDRTLAVLPTYHIYGTSPSGPSRTSTDPLGLICLVHLPVWLGTTTVFMDKFDLQRFCKLIREHSIAHAYVAPPIVLHLAKNPSIDKRDLSSLRMLTSGGAPLGEALIRETYDRWKVPIRQAYGLSETTSVSHIQVSPSIRAPCLAQSESIIYXLHQRWDSWNTAIGSNGAVLPGLEARIVLNNDPSKKAAVKEEEGELWIRGPTVFTGYMNDRASTDACLTASKWFKTGDIGYEDAMGNLHITDRAKDMIKFKGFQIAPTELEDILIEHPAVRDVAVIGVWNGEMHSEVPLAYLVAKESMAERERETAALSVMAYLRGKVVHYKHLRGGVIWIDQIPKSASGKILKRALRDRV

SEQ ID NO: 12460 - protein, 499 aa, Aspergillus nidulans
PGPKPALLIGNIHQLPKSLQWLHLYHLSKEYGPIMHFSMAGQPLIILSTHQVAHDLLNRRSGRYSDRPRMVMAGELVTKNMHMLLRPYDERYKLHQRMEAPLLVLRSASNYRPLQDLESQQLLFDVLGEWDKFGEKGVDFHHHFERAMASTIYCLNYGYRLQTGYEKELMDGKKVQAEFARTGQVGAYLVDSFPSLNYLPKFLAPWKKEGEGLYELERQLHVGNLKKGLSNRGWNFTKYMKDSPEAVTMPEEELAFDLGILADAGLDTSTVALDWFIVAWITSGSTWVKKAQQLLDEVVGKDRMPTFEDRPKLAYIDAIGMLPLSFPWNQQYLTDNTASETLRWRPVVVSGVPHFTKVQDEYMGYHIPANSTVLPNAFAISHDESIFGEDVDSFIPERWLAEDPPSEPSIDACGFNTSALKDLPHIGFGWGRRICTGRFIARNQLFIQMARMLWAFDVDAGVVDEKTGRRHNVDDMDCTEGFVTLPKPFRAVMRPRGEW

SEQ ID NO: 12461 - protein, 563 aa, Aspergillus nidulans
WNENLIMSYCPADGRVLGSGIKPATADDVDRAIQAASRAQEQWATTTFAERRRVLKTLTQVRSNFPIMNLRIGRIDLDRYVLEHQDEIVIACCLDSGKTKVDATFGETLVTAEKLKWTIDHGERALSPESRPTNFLMMYKKNQVIYEPLGVVSACVSWNYPFHNFISPVISAIFAGNGIVVKPSEQTAWSSVYFLNIIRGALENCGHPRDLVQSVVCLPKVADHLTSHPGIAQITFIGSRPVAHKVCESAAKALTPVTVELGGKDPSVILDDSRTISEVTSVASVLMRGVFQSAGQNCIRVERVIALPGVYDKLLDTVTSRIKALRLGSVLLDTKPNNPNNKSGAPDVGAMISPASFSRLEFLIQRAVSQGARLVAGGKQFEHPTYPLGHYFTPTLLADVTPSMEIAQTELFAPVFLMMRASSVSDAITIANSTQYALGASVFGYNTRDVNACVSGIKAGMVSVNDFGSYYTVQLPFGGVKGSGYGRFAGEEGLRGVSNIKAICVDRFPRLMATRIPPRVDYPIMKGEAEKENGDGAFEMCKGVVETGYQITLAGRVRGILRL

SEQ ID NO: 12462 - protein, 278 aa, Aspergillus nidulans
  unsure (1)..(278): unsure at all Xaa locations
SSSTIENSECTFLMDNEAVYDICKRKLDIPRPGYNNLNRLNAWVGSSLTTSLHFNSDLNIDLNEFQTNLVPFPCIYYPLILYTPVISSSCSTYKSFKVKDLTLQCMYPVFSSKISLQSNHLAGFEPRNQMVVYNPQTGKYIAVALLYQGDMMPHNYARAVTDIKAKASFNLVKWCPTGFKLGINNQKPIFVPNSKLTSINCSVTILSNSTAIAEAWSCLGHKFDLMYSKHAFIYXYMGEGMEEGKFSEARENLAVLEKDYEEIAGDTMGLDSYIEHEY

SEQ ID NO: 12463 - protein, 241 aa, Aspergillus nidulans
  unsure (1)..(241): unsure at all Xaa locations
MASRKTVLITGCSDDGIGSGLALTFQQRDYHVFATARNIQKMSKLHGLPNVTLLTLDVCNKDHITAAVEAVTKHTGGKLDYLVNNADAITSMPILDEDIEVTKKLYETNVWGPVALTQAFAPLLIAARGTIAFITSIAGYLNVPYMGTSSLIYIAXKLLEGTMSLTVGKGWKLTLAXYQARYAGSKRSIELIAETLRLELAPFHVRVLSVVTGAVKTMGQTYFGDFKLPEDSLYKPIEQTI

SEQ ID NO: 12464 - protein, 911 aa, Aspergillus nidulans
  unsure (1)..(911): unsure at all Xaa locations
RNPYVAGAPPVVDLAGEKVQQAFEELLENYQEEAPPKSSHTPQSSAPMTNKYYIAQIHGMAKWELSTLYVDFTHLTSLDNPILAGSIANQYYRFQPFLVKALHNLIAKYEPEYFVSHRQATSRVIVTSWHVLMAGNSSVADDPKLDRTIREKTRHQQTDKLFALAFYNLPLVSRLRQLRTSQIGKLLSVSGTVTRTSEIRPELSLGTFICEACRTVITNVEQTFRYTEPTRCPNTLCGTRVGWRLDIGKSTFVDWQKVKLQESSHEIPTGSMPRTMDVILRGEMVDRVKAGERCIFTGTLIVIPDVSQLGLPGVRPEAVRDNSGFRSNDVGGGGVSGLKALGVRDLTYRLAFLTCMVTPDTTTPGQQSNQQLSGQSNRILGSLNQNPDPEPDDDKAQEAFLQSLSPAEVEDLKTMVHSEYIYSRLVDSMAPMIYGHRQIKKGLLLQLVGGVAKSTEQESLQLRGDINICIVGDPSTSKSQFLKXVTCLLKCSLLTSQIHCSLHPRAVYTSGKASSAAGLTASVVKDAETGEFTIEAGALMLANGGGICAIDEFDKMDISDQVAIHEAMEQQTISIAKAGIHTTLNARASILAAANPIGGRYNPKTTLRGNLNFSAPIMSRFDLFFVIRDEPNEDVDRNLADHIVNVHMNRDAPVEPEFSTEQLQRYIRFARTFRPVFREEAKAVLVEKYKELRANDAQGGMGRSSYRITVRQLESLIRLSEAIAKVNCVEEIVPKFVREAYDLLRQSIVTVEKDDVEVEDDEGAANADEDMPDRDRDGDSPMREEPQSAAAAEPVEPRAKTKITYDKYMKILNLVVRRIREDEAQAGEGVEQEDLLVWYLEQIEAELNNEEDLQRERSLAVKVLKRMVKDNILMPIRGEGLVDEASEVQTDRTIYVLHPNCAIDEEXSSYD

SEQ ID NO: 12465 - protein, 582 aa, Aspergillus nidulans
  unsure (1)..(582): unsure at all Xaa locations
RLQLVVLVCFLLIILQRVVNVLVPLQVGIITNKLSKQGDEFRVPWFEICLYILFRWLQGNQGLIGSLRSTLWIPVSQYSYMELSTAAFEHVHGLSLDFHLGKKTGEVLSALSKGSSINTFLEQVTFQVVPMLVDLCVAIVYFLVALDAYYALVVTIVTFCYLYVTIRMAQWRAEIRRQMVNSSRQEDAVKXVKQPNSLHLFGFTHITLLGMDSMVSYETVKYFNAEEYEFGRYRGAVSDFQRAEYHVLFSLNLMNTSQNTIFMLGLLIACFIAAYQVSLGQRDVGQFVSLLTYMAQLQGPLNFFGTFYRSIQSALINSERLLELFREQPTVVDRPNARPLAVCKGDIKFDNVEFSYDARKPALNGLTFHCEPGTTTALVGESGGGKSTVFRLLFRFYNSERGRILVDGHDVESITIDSLRRHIGVVPQDTVLFNETLMYNLKYANPSATDEDVYEACRASSIHDKIMSFPDGYNTKVGERGLRLSGGEKQRVAIARTILKNPRIILLDEATAALDTETEEHIQGALSTLSRGRTMLVIAHRLSTITTADRILVLSEGKVTESGTHDQLLAMKGRYASMWRKQ

SEQ ID NO: 12466 - protein, 478 aa, Aspergillus nidulans
  unsure (1)..(478): unsure at all Xaa locations
ALKKRKITEKQPETNSDSEAESVSSRGSAKDETQTSGEEPAPAKSFKELGIIDQLCEACENMGYKAPTPIQSQAIPLALEGRDVIGLAETGSGKTAAFALPMLQGMFVMIHTMTLADKLXLLWEAPQTLFGLVLAPTRELAYQISQAFETLGSTIGVRCAVIVGGMDMVAQSIALGKKPHIIVATPGRLLDHLENTKGFSLRNLKYLAIDEADRLLDMDFGESLDKIIRILPRTRHTYLFSATMSTKVESLQRASLSNPVRVSVSSKYQTVSTLQSSYICIPHKHKNLYLVYLLNEFAGQSAIIFTTTVHETQRVAFMLRALGFGAIPLHGQLSQSARLGALGKFRSRSRDILVATDVAARGLDIPSVDVVFNFDLPMDSKTYIHRVGRTARAGKSGVAISFVTQYDVEVWLRIEHALSKKLPEYQVEKDEVMVMSERVAEASRQATIEMKSFDEKKGARGKKFGKGKRSRDDMDQEE

SEQ ID NO: 12467 - protein, 291 aa, Aspergillus nidulans
  unsure (1)..(291): unsure at all Xaa locations
RSLAGKCAIVTGAGCAGDGIGNGRAIAIFLASDGCNVLCVDKNLEWAEKTVSIIQEHSRSSSQYGQAVSFQADVTCETDCSSIISQAISTFKRVDILINNVGIAGAPGTAVTVDMESWSKSLEVNVNSMVLMAKHAIPAMQKNSGEIKGSIVNMGSVAGLKGGTPHLLYPTSKGAVVNMTRAMAAHHAEDGIRVNCVCPGVCPLFLLSSCALHRVRADLIRVXMLYTPMMYASGNGMSEEAREARRRRSLLGTEGNGWDCATAVVFLAGPHARWITGAILPVYAGTTRSVG

SEQ ID NO: 12468 - protein, 227 aa, Aspergillus nidulans
ELENAVTLIDPQRDSLYRYDEETHKYLSDTRPWTKDPHYFKSVRISAVALLKMVMHARSGGSLEVMGLMQGYILPNTFVVTDAFRLPVEGTETRVNAQDEANEYMVSYLQSCREAGRMENAVGWYHSHPGYGCWLSGIDVSTQDMQQMSGPFVAVVIDPERTISAGKVDIGAFRTFPKDYTPPKEEQEEDEYQTVPLNKAEDFGAHASHYYSLEVSLFKSALDTEIL

SEQ ID NO: 12469 - protein, 500 aa, Aspergillus nidulans
SVLAARTDAWKTRSVYQTMTDRFARTDGSTTHSCNLTEGLYCGGTWRGTIDHLDYIQGMGFDAVLISPIIKNVEKKAKYGEAYHGYWAQDMYSLNPHFGTHEDLLDLSQALHNSGMFIMMDTVINNMAYTMNGGNPAPDVNYTSLNPFNEKSFYHPYCKIDDWNDYPQSQYCWTGDNIVALPDLNTEDERVQTILEMWIQEMIATYSIDGLRIDAAKHVTPDFIGKFEKAADVFMFGEVYERSVDIICGYQSNIMPSVTNYPIYFALLDAFTIGDTESLPNQVESMKSKCPSVTSLTIFSENHDLPRFASLKDDINVSRLKPSASPIRLNNFSLAKNILTFTLLFDGLPIIYQGQEQHFSGSTDPHNREALWPSAYDTSSPLYNTIHTLNTIRKHAIQIDPDYYINYNTYPVYRGSSEMAFRKGREGRQIIMVLSTQGSNSGAYTIRMMNGFQPSVVARDVFSCRTWTVNDMGELRLDMDKGEPRVLFPEALMRGSGLCG

SEQ ID NO: 12470 - protein, 168 aa, Aspergillus nidulans
PPLMALFDPEDHNRRFVGTPDYLAPETINGVGQDEMSDWWSLGCIMFEFLFGYPSFQAATPDEVFENILHRRINWPGEVEELASPEAIDLMNKLMAINPRERIGANLEEKYPNGGAEIRSHPWFADIHWDTLLEDKAQFVPNLENPEDTEYFDARGAHSQAFTEEDES

SEQ ID NO: 12471 - protein, 472 aa, Aspergillus nidulans
FQEMSDFLERYGELQSDGSYSFSHVRSGLIVSLLSIGTLIGALCGAPLADKLGRKWSITVWCIILMVGIIVQISAPSGNWVQIVMGRWTTGLGVGGCSPVVPMYQGESAPKHVRGAMISSYQLFVTLGIFLAYCINLGTESLDGSAQWRITLGLTFLFALILGLGMAMFPESPRFNYRHGKIDTARTTMARLYGVPENHVVIVRELAEIQSQLDAEKEQSQKWNEFITAPRMLYRILLGIVLQALQQLTGANYFFYYGTTIFQGAGISNSFITQVILGAINFGTTFGGLYVVENFGRRKSLIAGASLMFICFMIFASIGHFMLDVEHPENTPGPGKGMVVVASFFVLFYATTWGPIVWSIVAELFPSKYRAKGMALATASNWLWNFLIGYVYKYLLIRTRTNSCLSFFTPFITGAIDFAYGYVFAGCLLVAVFVVYFFVIEGKDRTLEELDWMYVNHVKPWESSKYEIPRIT

SEQ ID NO: 12472 - protein, 434 aa, Aspergillus nidulans
  unsure (1)..(434): unsure at all Xaa locations
ASTPGSYAETVNNLRINADTKVLFQGFTGKQGTYVAPPRTLDXXMDLMLICANSFHAEQAIAYGTYCHFPCSCFAHCVVLDRTLTHSRYKVVGGTNPKKAGSTHLDLPVFANVSEAVKETGATASAIFVPYAMISSKLLPESRRXCLEFSPPLAAKGIEEAIEAEVPLVVWXASPDLRNXFTCYXMFRYLTVSTEGIPQHGMREQPRFARIAHIYTNXARHVRITDILKTQNKTRLVGPNCPGIIAPVSISXCSSSADGSFXRGINIXGQCKIGIMPGFIHKRGRVGIVSRSGTLTYEAVNQTTQAGLGQSLVVGIGGDPFSGTNFIDCLRIFLEDEETDGIIMIGEIGGSAEEDAAEFFKANNKHNKPAVGFIAGISAPPGRRMGHAGAIVSGGKGGADSKISALESAGVVVERSPASLGKSLLAEFVKRDLV

SEQ ID NO: 12473 - protein, 413 aa, Aspergillus nidulans
YFNQTHAALRAEVREWVEKEIEPYVTEWDEAKEVPAKIYKQMGERGYLAGLLGVKYPTQYTPHRVQSVAPENWDLFHEMLLTDELSRAGSGGLVWNLIGGYGIGCPPLVKYGKKALVDRILPGILAGDKRICLAITEPDAGSDVANLTCERNVSEDGKHYIVNGEKKWITNGVWSDYFTTAVRTGGPGMNGISVLLIEREAGGVSTRRMDCQGVWSSGTTYVTFEDVKVPVENLIGKENQGFKGKSSQPYFVVASVLTEYLVIMTNFNHERIGIIIQCLRFSRVCYEESMKYAHKRRTFGQKLVNHPVIRMKLAHMARQIEASYNWLENIIFQCQSMEETEAMLKLGGAIAGLKAQSTTTFEYCAREASQIFGGLSYSRGGQGGKIERLYRDVRAYAIPGGSEEIMLDLSMRQ

SEQ ID NO: 12474 - protein, 397 aa, Aspergillus nidulans
  unsure (1)..(397): unsure at all Xaa locations
MVQQMPPQGGSRKISFNVSDQYEIQDVIGEGAYGVVWXEXRCKPCRLFTDFSQSAIHKPSGQKVAIKKITPFDHSMFCLRTLREMKLLRYFNHENIISILDIQRPRNYESFNEVYLIQVNCTSAAHIXEPADXLVLKELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDCRYSIGGWWRNAGXRMADHHQLTLILDVLGTPTMEDYYGIKSRRAREYIRSLKIKKKIPFKALFPKSNDLALDLLEKLLAFNPTKRITVEEALRHPYLEPYHDPDDEPTAPPIPEGFFDFDKNKDALSKEQLK

SEQ ID NO: 12475 - protein, 313 aa, Aspergillus nidulans
  unsure (1)..(313): unsure at all Xaa locations
LLLKTKSTPHDGYDEFFSAAHTKPTFIPVLSHNFHTQNLSSIKHLFENGSLAPGRDRQYGGLIFTSQRAVEAFGETLSGVEGMFPTAHYRSLEYLVXSXRQYRIILDSSSRNLPLYTVGPATARSLTTLRDRYLPHATIHGAETGNGENLAQFMLEHYNALFFQQEGQQAQKKPLLFLVGETRRDIIPKTLMGASVNPERRIGVEEVVVYETGVVEGFEGDFERVLQDCYNDIEDGMIWVVVFSPTGCDAMVRVLRQKEARIAGENGKGARKLFVATIGPTTRDHLVKEYGFEPDVCAAKPSPEGVGAGIEEF

SEQ ID NO: 12476 - protein, 366 aa, Aspergillus nidulans
MSKPVILHLGDPIKYNPALYSTFSSHFTIVRPSLSELRRDEFKTALRENRFGSFHALFRPFWNTGGEMGRWDKELIDLLPKSVKIFASAGAGFDWVDTQYLAEKGTSPVPYPVLCSFVRRRGDVLEYLILTKIGILYCNGRRASSESVADMALFLILASFRNLAWSHSAAVSQNPRAFLDAHQNSPLTARNPRGHSLGIIGMGQIGFMIAKKVYAAFGMQILYHDIVRKSQDIERSVNATFFESLDDMLAESDCVIVATPFAGKTLLTAELFDKFKRGSRFVNIARGSLVDEGALVGALESGILMGVGMDVHADEPNVHPRLASHPKVMMMSHNAGGTVDTHIGFERLAMENILAFFKEGRAMTPV

SEQ ID NO: 12477 - protein, 549 aa, Aspergillus nidulans
  unsure (1)..(549): unsure at all Xaa locations
MASRRLAYNFNQGSRSRAALKSIQPVKRGFASPVALPSTTQSTTLSNGFTVRRRIGSXDCVLALLTTIDATEYSPWAQTSTVGVWIDAGSRAETDKTNGTAHFLEHLAFKVCFLKTHNXMMANRSXGTSKRSQHQLELEIENMGAHLNAYTSVRSDXWNDRWFCVIANXQCFXRENTVYYAKSFNNDVPKAVDILADILQNSKLESAAIERERDVILREQEEVDKQLEEVVFDHLHATAYQHQPLGRTILGPKENIQTITRDNLTDYIKTNYTADRMVLVGAGGIPHEQLVKLAEQHFGSLPSKPPTSALAALTAEQKRQPEFIGSEIRIRDDTLPTAHIALAVEGVSWKDDDYFTALVAQAIVGNWDRAMGNSPYLGSKLSSFVERNNLANSFMSFSTSYSDTGXAPCPALLALSLILQSWGIYLVSENMTGLDDLIHFALREWSRLSFNVTAAEVERAKAQLKASILLSLDGTTAIAEDIGRQIITTGRRLSPEDIERTIGQITEKDVMDFANRKLWDQDIAMSAVGSIEGILDYNRIRSDMSRNAY

SEQ ID NO: 12478 - protein, 351 aa, Aspergillus nidulans
VIGYWEGWSTQRSCGTMSAGEIPVNLLTHLNIAFGYINSAFQITNMDGLSADVYKQVGNLKSRNPSLKIMIALGGWTFSDPGPWQAIFPTLASTAANRATFIQNLLGFMSEYGYDGVDFDWEYPGADDRGGSDSMVDGENYTLLLKELQEAITASGRNYLVTFTAPTSYWYLRHFDLKAMMEYVDWVNLMSYDLHGTWDSENPIGNQILAHTNLTEIDLALDLFWRVDVDPSSIVLGIGFYGRTFQLSSGSCWKPGCPFDGPGAGGRCTATPGILSYMEIMELLENSGATAHLDEEAAVQYLVYADNSWVSYDDATTFAAKIDYAKRIGLSGLMIWAIDLDDSYLTALRSI

SEQ ID NO: 12479 - protein, 311 aa, Aspergillus nidulans
  unsure (1)..(311): unsure at all Xaa locations
RPKTLDDVAAQDHTTKVLQRTLQASNVWHSLADMGKNXSGGSTLPHMLFYGPPGTGKTSTILALAKSLFGPALYRSRILELNASDERGIGIVREKVKGFARVQLSHPTGLDAEYFEKYPCPPFKIIILDEADSMTQDAQSALRRTMEQYSRITRFCLVCNYVTRIIEPLASRCSKFRFKPLDNSAAGDRLAQIAQLEKLSLENGVVDKLISCSDGDLRRAITYLQSAARLVGAAKAAKDGDEDEEMKDQGSDMITVSTIEEIAGVVPESVLDGLIQSLQPKRMGSPYEAVSKVVTEIVADGWSATQILLQV

SEQ ID NO: 12480 - protein, 797 aa, Aspergillus nidulans
  unsure (1)..(797): unsure at all Xaa locations
MVRFLHLAGTLPVLASGAVQDALRPVAESAATVTATATVAGQQAQFTLSDYVDVGADLIANVDDPEAVNAQSVCPGYKASDIQQTDLGFTASLRLAGEPCNVYGTDVESLTLEMQYQDTDRLNIQITPTYVDASNASWYILPEEFVPRPKPAAVASESHSDFAVTWSNEPTFNFQVTRKSTGEVLFDTAGSVLVFENQFIEFVTSLPEEYNLYGLGERINQLRLLRNATLTSYAADIGNPIDAYVRLLSSLPHANGMQQHYGQHAFYVDTRYFSVDEAGKHTYVKSSEADLRQTYTSYSHGVFLRNSHGHEDVPHPQGLTWRTKEGSIDLTLYSGPTVAEVTKQYQRSTVGLPAMQKYDTLGFHQCRWGYNNWSVFADVLANFEKFEIPLEYLWYARIRTYLNPSLHLXGRHXYMHGYRNFENDEYRFPYNETKVFLDKLHAGGRHFVPIVDAALYIPNPQNASDSXVFRFYCRVLLTILVMKRTTRGAARDVFLKNPDGSLYIGAVWPGYTVFPDWHHPDAADFWANELVTWYEKVKFDGVWYDMSEVSSFCVGSCGSRNRTLNPVHPPFRLPGEPGNVDYEYPEGFELSNATEAASASAASSSQAATTATETTTSTSSYLRTSPTPGVRNVNYPPYVINHVQTGHDLAVHAVSPNATHVDGYHEYDVHSLYGHMGIQATYRGLTQIAPRKRPFIIGRSTFAGSGKWAGHWGGDNYSRWSSMYFSISQALQFSLYGIPMFGVDTCGFSGNTAEELCNRWMQLSAFFPFYRNHNVLGTIPQEPYQWASKIDATKKAM

SEQ ID NO: 12481 - protein, 1224 aa, Aspergillus nidulans
  unsure (1)..(1224): unsure at all Xaa locations
LATHGFDLILXLQQPELAPSATFLATAPVSFPINGLLSFAHFCVACHVLGLHPGQFRDALTGTTGHSQGIIVATAVSGSGSWEVFLRAVDVAMKLLFWLGWESHXGKPHQKSNCLSGATSMLSVCGMKKEVVERVLRECNFHLSEDEKGMILEQHGTTINTNQNRIPYPDRLPVLDCQFLPISAAFHSPHVYEAYRRICERPDSAGLFKRLDFTIPIYHTYTGEDIHLYLRDDCVPILARAILCEPVDWAKTXCATSTTHILDFGRVNSLLAHDHLTGSGRRISSLQESMAPSHSVGGKHELFSPQPPIMNENWAKCYGPRFITDESGRTRLITRMCPTLGAPPVMDAEMTPTTSAPNFVACIMNAGYHVELATAGSPAGHEELVASMPKARGITCNVIYANPRAISWQIPLLRRLQAEGYPIGGLCIGAGVLSPRSPKEYIETLGLKHIAFKPSSVDSILHQVLDIAKMNHSTPVLLHGRAEGPGGHHSYDDLHEPLVKTYGSIRKYTNVALIIGSGFGDGQGMMIYLTGECAETWGYPRMPVDEVLLGSRMMVAKEAHTSNAVKALIAQMQGVTDVEWHKTYSGPAGGMITVRSEMGEPIHKIANRAVMLWDYFGXIFVQVKDGEQYMQILKKCRTKIISRLNSDYAKPWFAVNSLGSLSSXRIXTYAECLQRVIALMYMHPQKRWVHGSYRAFSVDLMDRIRERFNVVDEHCMDGSLNPSDFPEKLFTVCPAMITDILYPEDVAFFMSLFKRRGQKPVNFIPVLDANFETWFKKDSLWQMKKLESVIDQDPERVRIIHGPVVARLSTAVDESAADILNRIHDEIVDAMRPIVSISCNFELDGESSHLDIPGSGLSTRLDFADISSHATELGIQVDYHFTKPLPNGGSRLLLDVLGIGRSLAERLLQXGTVFVDRQRRPNRVLAAFLLRAGDRVTVQCPSARSGCLSLSLFSNIPGQTDAHSTLSLASTDGSLIRFDLRGPKHLTSALSFDLELXCAGASRTLHDTTQDSEAKLRRFYASCWSVDAEEPTKDSIGVKLTTGPVVLSSQVVLNFVSLISRAKGHXVRPHVLNMASLDVGIIVAWEALLRSLLSPGLGGDLSRLLHISNTFEPVPGMEPLRVGDLLKTTLRITAVTIKPLGKLVEVTVVIKREEASIMKITSEFLIQGQFPHHHQSFPSSEANEWALPLDSPKAVVLLRSRPWFKPDAKCPELLDKTLLFRITS

SEQ ID NO: 12482 - protein, 355 aa, Aspergillus nidulans
FETPVRMWVFEEEITVPSDSPHHSKYGDKPQKLTQIINETHENVKYLPGIKLPDNLIATPDIKEAVKDASILVFNLPHQFIGKTLDQIKGHHLPYARGVSCIKGVDVSDGKVTLFSELIMQKLGIYCGALSGANIAPEVAAERLCETTIGYDPPPMDLTSSDGSPEDNLPHVDGQRQKDLSSTDIKLERVPQDYPHVNDELLEKMFERPYFLVHVIKDVAGVALGGALKNIVALAAGFVAGKQWGENTKAAIIRQGVGEMIRFGRTWFPSSVNEKTFTEESAGIADLVASCYGGRNVRSATHAVEKGVSVAEIEKTEMNGQKLQGVSTAQTVSGFLEKHGKTDEFPLFCAVYSKL

SEQ ID NO: 12483 - protein, 438 aa, Aspergillus nidulans
  unsure (1)..(438): unsure at all Xaa locations
LLHLILALSVCINVWLWEVVANLXLGGVLTLESFQRDFRYTESQKTTVNSNAVSILQAGAFFGCFLTTPVASRFGRRSGLIISSLVFTVGTILQIINAHTLATFYTGRVIAGVGIGAATVLIPMYSAEMAPKEIRGRLGACFQLFFALGVMIAYWVTFAVSETQPPKPKQWQIALGLQLLPSTLLLIGMVTVKESARWLAVKGRNEEAWESLKWVRGGEDTPELQQEFDEILAGIAEEARVKENFTWRELLLPANRYRIFIAITIQLCAQLSGNTSLAYYATQIFSAVGAGSSAKLVTGFFGVVKVVGVSIFQLFVIDKIGRRVPFMAGAFAMGSFMLIIACVLATHPTSSDGADSGATPAGIAMIIMVYAEAFSFNMSWGALPWLYVGEIFSSRLREVGVTVGAASQWLFNFMMSQVTPHAISNIGWRMFLMFAIFN

SEQ ID NO: 12484 - protein, 355 aa, Aspergillus nidulans
SSLSPVLITGGNGFIAYHIIAKLLAEDPNCTIHCIDINTTRNIHASDSVTYHQGDLSSLADVSRIMELARPVTIFHTASPEFSEAPESAYHDVIVTGTHHLLNSAASIGTVKALINTSTSGVINDNHTDLVNGTEDMPILRPPVQKRLYCLAKADAEEAIQAANRQHGFLTCALRPCLAFGERDTNSMGKMVAVARAGRSRFQMGYGKNAYDFVYVGNLADAHLLAAHALIDAHANPPLPADRRVEGEVFNITNGEPWLFWDFQREISKQLGFPIQEKDIVVIPKWVGLLIGFVSEWLVWLLSGGSKVANSTREGIRFSTLERTLNCEKARRVLGYQPRVGMQEGIERGVRWFKE

SEQ ID NO: 12485 - protein, 351 aa, Aspergillus nidulans
  unsure (1)..(351): unsure at all Xaa locations
GTFARVWLARLRDDKTRPEKVYALKILRKADVWTIKCHPTVTVLANKPGLYSVIKLKQVEHVRNERKTLADVSGHPFITTLIASFSDSQSLYMLVLSNSASTVFGRXLTSLELDYCPGGEIFSYLRRARRFNENTSKFYAAEITMTIEFLHDAEGVVYRDLKPENILLDADGHIKLVDFGFAKQIGDRETYTLCGTPEYLAPEVIHNSGHGLAVDWWALGILIYEFLVGQPPFWDQNPMRIYEQIVEGHIRYPSNMSPAAQNIISLLCKTNPAERLGHISGGSARVRTHPFFENINWDDLFYRRIKGPIIPRVDHPADTGNFEEYPDPDPKSQTIYTEDMRSKYETLFSDF

SEQ ID NO: 12486 - protein, 289 aa, Aspergillus nidulans
  unsure (1)..(289): unsure at all Xaa locations
GTFLFTSESVGRGHPDKIADQISDAILDGTSTRIHXSKRVDAYREIACLAEDPLSKVACETATKTGMLSSLAXPHNRVPCXFLQVMIMVFGEITTQARLDYQAIIRGAIKDIGYDDSEKGFDYKTCNVLVAIEQQSPDIAQGLHYEEALEKLGAGDQGIMFGYATDETPELLPLTLVLSHKLNAAMTTARNDGSIPWLRPDTKTQVTVEYAHDNGAVKPLRVDTVVVSAQHSDDVTTEELRAVIKEKIIKKVIPAELLDDRTVYHIQPSGRFVIGGPQGDAGRTGRGLL

SEQ ID NO: 12487 - protein, 485 aa, Aspergillus nidulans
  unsure (1)..(485): unsure at all Xaa locations
ADSFKLAGNKFFKDGNYNRAIEEFTKGLYXVVFDFCELGCXLQAAIELNPNNSIYRSNRAAANLAAHNYLDALEDAERADELDPGNNKILHRLSRTLTALGRPAEALEVLERMQPPASAADRQNAEKMLRFINQAKETLAENRGASMAVFCIDQARQLLGPGVKEPRAWTLLTAEAQLKMATGNSFGKAQDIAINMLRDNNQDPDALLIRAKAYYGLGETDQALKSLKMCIGLDPDHREAIKLLRMLQKLTRTKEEGNNAFKAKDYRKAIELYTEALSVDETNKDVNAKILQNRAQAYINLKEYDEAIKDCTEALRLDPTYIKAQKMRAKAHGGAGNWQEAVSDYKAVAEANPGEKGIREDIRRAEFELKKAQRKDYYKILGVSKDATETDLKKAYRKLAIKYHPDKNREGEAGDEKFKEIGEAYETLIDPQYVSFTXCSKIAGYXXLQETRAYDNGDDLLDPADMFGGGGFGMGGMGGMGGMGG

SEQ ID NO: 12488 - protein, 263 aa, Aspergillus nidulans
TLWRGLSPTLMMGIPGNVIYFAGYDWLRTDDRSPIKRVVPGAYVPFVAGAVARVAAATAISPIEMFRTRLQATPGTGAGHFKATLEGLYQMTQAKGYGSLWRGFTLTMWRDVPFSGLYWWGYEEVKKSIIEVRKKARGHNPPQTAPSSTQLGTSDVEGNTFLDSFVAGSISGALAALVTTPFDVGKTRQQVFRHMGDDAPSTAGSKLPKGPLQPEQLSLPKFLLHIFREEGAAGLFRGWVARCLKVAPRCAIMISTYEVGKKF

SEQ ID NO: 12489 - protein, 419 aa, Aspergillus nidulans
  unsure (1)..(419): unsure at all Xaa locations
SNPKHTKWIAPILNIADGLLCAFIIWKVPCKLRSSIAYAILVSQPNSLITRTEIDWTTYMQQVKLYLSGERDYTLIKGSTGPLVYPAAHVYSYSLFHHLTDEGRDIVFGQIIFAFLYLICLTVVMACYRRVGAPPYLFPLLVLSKRLHSVYMLRLFNDGLAALAMWGSIWLFINRKWTPAVVLWSLGLGVKMTLILLVPAVMVVLALSLDIGRCIRLAGLALGIQVCDMFLVEYLRTKDXQGXILLAIPFLKTNPSGYFERAFEFGRQFMFKWTVNWRFVGEDIFLSKGFWAGLIVLHLLILVVLGFTCFLNPSGTSLPDFAGRFLTGQHRGIALHPSFIMSALLTSLSVGLLCARSLHYQFFAYLSWATPFLLWQAGYHPILVYALWLVQEWAWNVYPSTNLSSAAVVLLLGAQVLGV

SEQ ID NO: 12490 - protein, 411 aa, Aspergillus nidulans
  unsure (1)..(411): unsure at all Xaa locations
GIGAADITKLKANGFFTIAVILLPALLLSXRLLIAIESIHGATRKTLLKIKGFSEIKVEKIKEAINKCLGKIREGVFNIYLCXPXXPSASGFITAMELSHQRKRVVRISTGSKQFDSILGGCVSHSCEKLVFXQTAVVFQSMSISEVFGEFRCGKTQLSHTMSVVAQLPKDMGGAEGKVAYIDTEGTFRPERIGQIAERFGVDPDSAKENIAYARALNSEHQLELLNTLSKEFVGGEYRLLIIDSIMNCFRVDFCGRGELADRQQKLNQFLMKLAHMAEGEPVTHRQRTRLMFCNRVNVCVLMVSTTLCIXNVAHTTVKTNQVQSDPGASALFSGADGRKPVGGHVLAHASTTRVLLRKGRGEERVAKIQDSPGXLTFSXQVMDAYXIYTSDCPEREATYLITNGGIDDPD

SEQ ID NO: 12491 - protein, 538 aa, Aspergillus nidulans
  unsure (1)..(538): unsure at all Xaa locations
ADTVVKVPQMAESITEGTLKQFSKRRLFXSVAEPRXTLMIEVGDYVERDEEIATIETDKVYFGLYGLAVCRNSSHLHALIDVSVNAPESGVIKELLVNEEDTVTVGQDLVKLEAGGTPEKKSEEATEKPKEPASTGSEAEKPKEPESAPSSSAPEKSTSSTKAPQAETSKPTQEVASKSRPTEEAKPALGNREERRVSNVSDSRLMHGWCXRPSLKRSKMNRMRLRIAERLKQSQNTAASLTTFNEVDMSSLMEFRKLYTDEILKKTGVKLGFMSAFSRAXVLAMKDVPAVNASIEGPNGGDTIVYRDYVDISVAVATEKGLVTPVVRNAETMDLVGIEKSIADLGKKVGLDEPHLGDHNXRHXARDNKLTIEDMAGGTFTISNVRLLYFLIEQAMYXSAFRVAVFGSLMGTPIINLPQTGKLCVHDYXYNHQTNPLQLFSGLHAIKDKPVAIGGKVEIRPVCKILLKRAWFLLLTYLSDDVSALTYDHRLLDGREAVTFLVKVSFTSPFRVLSVEQFDXRYRQVKEYIEDPRRMLLG

SEQ ID NO: 12492 - protein, 211 aa, Aspergillus nidulans
ISNQGNKVDRGHYAPARPYSDSPQPIGHGATISAPHMHGHACEYLINYLRPGAHVLDIGSGSGYLTHVFANLVVDTSSSDGPKGQVIGVDHIQELVNLAHDNMMKSEDGRKLLENGGVKFVKADGRRGWLDGAPYDAIHVGAAAQELHPLLIEQLRAPGRMFIPVNAEDDQGTLFSTAFGGGQYIWVVDKKKDGTIHKEKVFQVSYVPLTD

SEQ ID NO: 12493 - protein, 723 aa, Aspergillus nidulans
  unsure (1)..(723): unsure at all Xaa locations
LPHFQHDDVLLRLNAIHRLSTIALALGPERTRDELVPFLDGXYLYTDENRCHGXELSIDFCNSDSVEDEDEVLTALSEELGSFIEYVGGPEYGHVLLSPLENLAAIEEPLVREKASRGQAIQVLRVQSNVLXAVESLNKIGEQLSEKQIEEYFVPMVQRLSKADWFTSKVSATGLYCVPYRKSSSSLQQTLRQFFAGLVRDETPMVRRSAGNNLAKFVKEMTTPIVIDEMIPLFQYLASDDQDSVRLLTVDILIAIAEEIPKEQQPSHGVLLTSLRSLFEDKSWRVRYMVADRYXKGILRISRRVLFXTVXRVPXIAKAVHEEVVTRDMVPSFVKLLKDTEAEVRTAVAGQIPGISTPSTSLXPDQAYXPLIRLCSLIDRETLLNEIMTSVEDLVSDPSQHVRAALGTQISGLAPILGKEEXVACKFTKLRVERRCXLDRCRTISHLLPMFLQMLKDEFPDVRLHIISKLELVNNGKLPANLXQFIXFLTITVIGIELLSQSLLPAIVQLAEDKQWRVRLAIIEYIPLLASQLGVKFFDEQLSDLCMGWLGDTVFSIREAATQNLRKLTEVFGVDWAKESIIPKVMAMGQHPNYLYRMTTCFAISVCTLXHCWXKLCXLFLSRRLHPVVTLEIIENSVLPILERLTSDDIPNIRFNVAKSYAVLIDTLRRLPAQGTLTDLEKEGKTEAPSPRGQELIQQSVLPSLEKLQGDDDVDVRYFATTA

SEQ ID NO: 12494 - protein, 531 aa, Aspergillus nidulans
  unsure (1)..(531): unsure at all Xaa locations
FQDHTKALEVLEKEYPIKDGLDVDTLLDSDKHGALTYNDFLILPGYIGKPRAGLLNHGPXLNFDGKVFLASDVTLDTPVTKRVTLKAPLLSSPMDTVTEHNMAIHMALLGGLGVIHHNCSPEDQAEMVRKVKRYENGFILDPVVLSPRATVREAKELKAKWGFGGFPVTGKFYFASLLPLFVMIPIYLLYNFRSTEATRVAMXRKRFYLISIXLHFWLKHLTGKSVMLTDFVLRNGTLRSKLVGIVSTRDIQFHNNLDDSVTAIMSTDLVTAPAGTTLAEANEVLRSSKKGKLPIVDENGSLVSLLSRSDLMKNLHYPLASKLPASKQLICAAAIGTREEDKHRLKLLVEAGLDIVILDSSQGNSMYQIEMIKYIKKTYPEIDVIGGNVVTRDQAAALIAAGVDGLRIGMGSGSACITQEVMAVGRPQALSVRRVTQFAARFGVPCIADGGIQNVGHIVKGLAMGATTVMMGGLLAGTTESPGEYFVSNEGQLVKAYRGMGSIAPWEDKKAGGNGKDSKASNAGTARYFSE

SEQ ID NO: 12495 - protein, 308 aa, Aspergillus nidulans
AKETPDWIETGPIVESHWSLCLQTLEGHDRAVGSVSFSHDSRLLASASGDGTVKIWDTATSFLQNTLEGHNEWVKSVVFSHDSRLLASASDDGTVKIWDTATGTLQRMLKGHNDSVRSVVFSHDSRLIASGSNDRTVRIWETTTGLLRHTFEDHEDSVMAVSFAHDSRRLASASDGGNVKIWDTRTGSLQNVLEGHDDCVNSVSFSPDSRLLASASDDRTVKIWHAATGSLQRTLEGHNDWVRSVVFSHDSRLIASTSDDMTVKIWDTAIVPLQNNLESHDNWVRSVVFPMTRALLASASDDMTVKIW

SEQ ID NO: 12496 - protein, 263 aa, Aspergillus nidulans
  unsure (1)..(263): unsure at all Xaa locations
ESNTGTGYLVKRKNVLNFCSRASDCAENEACQLFVCVESNHSQAQPDTEDEGNCKTDEDCGEGAECMGGFCIDRDVTVEASLTGDAMCQKDKDCGSVGRCLNGLCLAPSKLRFARRSPQLVCHTDRDCASPSGPGHCTHGGICIAPPINKVEARSPQIQCRTDQDCASPHGPGQCIAGGICIAPTRQLETRSPQVQCHTDQDCASPDGPGYCIGGGICVADPPSQFLVESAAADVXSRVSLLQESCRDDRVCSIRAXRGICRS

SEQ ID NO: 12497 - protein, 450 aa, Aspergillus nidulans
  unsure (1)..(450): unsure at all Xaa locations
LTALCSANDVLQQTGIVLQNTRAQLEEEEMLRCAHEETEHQLQDVGKGLISTLGQTVEDINSLQSKLDRKAELDATNAELWRASSTEVSDVTKRIDQRVEAFQTRHAKLLETTSVKVNEFIATEISNIERTRSDLSEYNRSLDAACNNAKAETSSAHEDMNNVLEEIKDLREEVKSKVGEGLNGLSAAAARISEEVIGEFTQLHSQVRINPSQWEYIITNIPSLHTSFNNLGKDLKSIFETMATHLSEQKNEINRLRAELQSSNRQNIETTHKASAHLAQAIEEEHVAAEAEREILMSQIKALVEESRQKQFARLRAKIDGVRTEISASGDMLEQATTQHDRQIDEWVFKSEQFAKDVNASKDEIRTKLQNDWEVSVFLVFGILFTKYVGFDQRNSTIRKATESVHKETVRIVDVQVDDMGRHMEALDDFVAXARSQNGRYVMAHIATLD

SEQ ID NO: 12498 - protein, 105 aa, Aspergillus nidulans
RIRTIAWNPTGQLVATGSQDRTLRIWNPERSQARYSTELRGHTAGVEKVLFNPARDSELASCSSDGTVRIWDVRSKTCVSRLEVGSDAFTLSWSADGKVLIAGRK

SEQ ID NO: 12499 - protein, 253 aa, Aspergillus nidulans
ITLKDKVIVITGANRGIGLAIAEVCLANEAAAVYSLDLFEPGEEFTAVQKKSANPSRLQYIHCDVTSEESISSAIDAVVSASGAVHGFVANAGMTKHQPALDFTRAEIDKLFNLNVFGAYFCATAVARKFIELGIKGSIVFTASMTSYRPNRAPSAPYGATKGAVRNMTHTLAMEWAHHGIRVNSISPGFIKTQMTYFVDQAPDWNLKMQYYGGMPRLADPKELGGAYVYLLSDGASYTTGIDIPIAGIVGAW

SEQ ID NO: 12500 - protein, 627 aa, Aspergillus nidulans
  unsure (1)..(627): unsure at all Xaa locations
YAPGRQISVKSSSSSFSMLTVVXTSSVAMFGKKYFGFRGRSLNLAISSLGSLDFLSVFVCLPMXLWLMATGLFGYDQGVTGGLLELPSFYKYFPEITADMCPEDENLSSCRSQRSTNQGIAVAAYNLGCFLGAILTVFIGNAIGRRRTIFCGCVTMTTGAILQCTAYSLPHWIVGRIVTGIGNGMNTSTVPTWQSESAKAHDRGKLVMIEGMLITGGICLSYWINYGTSISFLVCFVLARSNHXRSLAGFAFLPDHEVSWRFPIAFQIIFAVTIFISIMNLPESPRWLVMKGRDDEAVEILELLNEKPRDDPYIQNELLSIKETVMEMNKGSFRSLFKMSEYREFHRVALAYVNQMFQQISGINLITYYVSTCSALKRVHCXYVXAPNIYTDIGLGGGNTAKLMAAANGTEYLLAAFIPIFIIEKVGRRPLMLFGVRSLPIHFFARIXQSQAAGMSISMAILAGTHYRRETYDDTKAGVAQAVFLFVFNTFFAIGWLGMTWLYPAEIVPLRIRAPTNALSTSANWIFNFMVVMITPVAFENIKHNTYTIFAVMXASLFFSSAGSCTRARANIIFSNAFMFPVVYFCFPETRYRSLEEMDAIFKKSDGIWSAVQHSIKEPYRYDKHGQ

SEQ ID NO: 12501 - protein, 564 aa, Aspergillus nidulans
  unsure (1)..(564): unsure at all Xaa locations
LPQHDRTWLRIPHLLKLNLILLIPLLSSAVAGYDGSLPYLPLYRHQYXIANTETRLPDERSSIHFFMENLFRXPHGLDPRRCQRSPVDWEVISLPVVGILSDRIGRRWTLLSGAIVIIIASIIQAASVQYGMFVFSRVLVGIGSMLVVQPSPMLITELAYPTHRGKYTCAFWTMYYLGAILASWTCYGTQKHLSNDWTWRVPSIIQAGFPLVQVGLWWVVPESPRXTTEQFSLFSFILSXSVSNLLFLTVFFSLTFFRFYLWRKNSRNSNVSRWLVAKGRTEEAKGLLAKYHTAGDAFHPLIEFEMAEIVRTIELDNQAAEMGWSALVQTPGNRKRTFIAVCIGAFAQWNVRFAVEYTRDFLLLFTVFIDQCGSGRGSYYLTLVLDTVGVTDTDTQTLINGLLQIFNFIAALSAALFVDRLGRRTLFLWSAVGMLVSFIIWTACSAVFDSSQASALGRTVIAFVFIFYFHYDIAYTPLLLGYPTEIFTYSTRSKGLTAELLSVYGSLIILAFVNPVALDNIGWRYYIFFCCFDVLVLAVTYFVFPETKGYSLEEIAKVFDGPAA

SEQ ID NO: 12502 - protein, 506 aa, Aspergillus nidulans
  unsure (1)..(506): unsure at all Xaa locations
PKKAVGGKGSYLRLEDGTKFLDSTGGAAVSCLGHGHEKIIQAITEQFTKVEYCHTAFFGTEASENLASLLVDSTGGKLSKLFVVSSGMPSSPVSFLSTYWDTDTAYXGSEAVEAALKLARQYFLELPTPQPQRTRFIARKPSYHGTTLGALGVGGHALRRQPFEPILSQNVSHVSPCYAYRGKNDGESDADYVARLAGELDAEFRRVGPDTVCAFIAEPIVGAVRCSSLCIHKHPKICCVRSILTQIXALGCVPAVPGYFAAMKTICEKHGALFILDEIMCGMGRCGTLHAWEQEDVTPDLQTIGKALGGGYAPVSGLLISDKVVQTVDKGTGAFRHGQTYQGHPISCAAALAVQTVIVEEQLLDNVKSMGEYLEKRLRGTLEGMQYVGDIRGKGLFWGVSPTHIPCNFSPKSYGVDTNRAVLAGRVVKNKATKEPFSSETALAFKIQETGMKPEFGISLYAGTGTVNGTRGDHIILAPAYNVTKEEIDIIVDTTAKVLADVFAQL

SEQ ID NO: 12503 - protein, 680 aa, Aspergillus nidulans
  unsure (1)..(680): unsure at all Xaa locations
MDTTASEASTGNDGTSPSDNAYQTPSSMSTYTAPVTGTQNNTKTEASMSSNERPSYDDQVAKVTCFMMQPLQEGQKGYVVSMSWLKRVLARSSTHADNIDKSAAEGEIGPVDNSDLVLVTDPVNVGLKDEREQPFIPLRPGLQFGEDFEVVPQEGWDLIMQWYGLAEQSPAIVRYAHNTSPFGAAENIQYGLNPPVYTILKLSNPQKGVTPDTLRDKAKLPVKSLASRHDNFQTWLRKAKRSVNVDPLVKVRVWRILGGLGSAAASTNITPAASRSASPAPFSPLVSNAGSSYVLDLNTFLSLSEGSQRELLDVKDQSNNPKYNGKMTLDAAGLGEPSVIVLEEGVFGANSDAEWVSDLSQQAMNRLGVPSGSLKPNKLKSKSPATSGRSSPVPEPIRKTRKDGKPRGNTGLSNLGNTCYMNSALQCVRSVEELTXYFLSECXXSCCLSHCXLAKTDVYKKDLNPSNPLAHNGDVAKAYANLLRNIYDEAGHGSFAPRQLKNTIGRYGPAFSGYGQQDSQEFLLLLLDGLHEDLNRIQKKPYIENADSTDEMVHNKEALRNLPDMCWDIYKARNDSVITDLFAGMYKSTLVCPVCDKVSIIFDPFNNLTLQLPIENLWSKSIFYFPLDKKPIIIDVEIDTNSSIKALKEFIAKKAGSDPERLVMSEIYKSKFYRMLRNVS

SEQ ID NO: 12504 - protein, 1055 aa, Aspergillus nidulans
  unsure (1)..(1055): unsure at all Xaa locations
SPSSNRTRPSSRSQWISCXSHGHSVLLSRRNPKVLKSRLMITTLVLNNFKSYAGKQVVGPFHASFSSVVGPNGSGKSNVIDALLFVFGFRASRMRQGKISALIHNSANHPNLPFCEVEVYFQEIIDLPGGEHEVVPDSQLIISRKEFKNNTSKYYMNGKETNFTAVTTLLRDRGIDLDHKRFLILQGEVESIAQMKPKAANEHEDGLLEYLEDIIGTSKYKQPIEEAATELEALNDVCVEKNNRVQHVEKEKNALVDKKDKALAYLRDENELAQKQSALYQIYIDECADNLRVTEEAILQMQELLNLELEKHEGNESGIKELEKAYKRAMKEYERMEKETQELAKGMAKYDKETVKFEEKKKFLVGKQKKLEKAMTSARLAASECQSLVKRHSEAIENKSKETADYENEVEHEEQELTKIRESLKGKTQGLSDQIAAKQKSLEPWDEKINKKQSELAVAQSELDILKEKSNAGAVLLEEAQSKITSIEETIARKEEDLQECKTQRSTLEDEVEQLQHDLKKYSMKEPDVRAHVSNARQKAEEARATVASTQNRGSVLTGLMRLKESGRIEGFHGRLGNLGTIDEKYDVAISTACPALENMVVDTVEVGQQCIDYLRKNNLGRANFILLDRLPKRDLNKILTPDNVPRLFDLVKPKDPKFAPAFYSVMQNTLVARDLDQANRIAYGARRWRVVTLDGQLIDTSGTMSGGGTRVARGAMSSKQVGDITKEQLVQMESDLEEMERKYQHFQEKQRRVESALREKTEEIPRAETKIQKIMIEIDSAKRSLADAERRVQELSAAHKPSKTDASRVKVLEEQIVGLEEQIEDLRSQKGGIEEEIQALQNKIMEVGGVRLRSQKAKVDGLKEQISLLSEEISNAEVARSKNEKLIKKHENARAEAEKELANVAEELQKLNEDVANQANDASGWKEKVDEAQDVSTAKPAAGWKANNCXALESKKAELKTMKAELDEKVAELNETRATEIEMRNKLEENQKALAENEKRSRYWQEKLSKLTLQNISDLGEDQQPSEFQTFTKDELAEMNKDSLKATMVVLKKK

SEQ ID NO: 12505 - protein, 507 aa, Aspergillus nidulans
SFGLGTKQVADNEKSIATKTLGFGEEESTRRKLERLPTPPLDDADASKTAETNADDDDDVDMQDGETEEDAAAAARVAAERREERLQNESLTKTTNGNTTAKAEEADKMEVDAQEEELDPLDAFMSELAESAPPKKKAGAKFSKAQEPEAIFGDEHDVSMTAVGEGDAEDFLAIASKAKKKKDIPTVDHNKVEYEPFRRKFYTEPSDLAQMSEEEAANLRLELDGIKVRGLDVPKPVQKWSQCGLGIQTLDVIDKLGFASLTSIQAQAIPAIMSGRDVIGVAKTGSGKTMAFLIPMFRHIKDQRPLENMEGPIGLIMTPTRELATQIHKDCKPFLKALNLRAVCAYGGAPIKDQIAELKRGAEIIVCTPGRMIDLLAANAGRVTNLRRVTYVVLDEADRMFDMGFEPQVMKILSNVRPDRQTVLFSATFPRNMEALARKTLTKPIEIVVGGRSVVAPEITQIVEVCNEEKKFVRLLELLGNLYSTDENEDARSLIFVDRQEAADTLL

SEQ ID NO: 12506 - protein, 397 aa, Aspergillus nidulans
  unsure (1)..(397): unsure at all Xaa locations
PAYQLTPRPSLVDGIPDNILALILPVVAYWAVSMFFHVIDVYDLFPQYRLHTPAEVLTRNRASRWDVVRDVVLQQVVQTLAGLILAYFDEQEYIGREEYDVAVWARRIRFVQRGLPYLLALFGLDASGVAANFSRNGHKMLAGAVAGGYYPGATQSIVSSGGIETVVPAFTNWEMSLAAFISWYFIPALQFTWGICVVDTWQYFLHRAMHLNRWLDGKSCSSTLXGYEHXLCISHFHSSHHRLYVPYAYGALYNHPVEGLLLDTVAAGIGFLTSGMTHRQSMWFFTFSTIKTVDDHCGYAFPWDPLQHATTNNAAYHDIHHQSWGIKTNFSQPFFTFWDRLFNTQWKGEVKLRYERSREAAEKKLSEGGMQQDSDMENSSSDFAQPNGEAAVVSPEE

SEQ ID NO: 12507 - protein, 193 aa, Aspergillus nidulans
  unsure (1)..(193): unsure at all Xaa locations
PSYIDLLPSIQTCNITNLPENYFLKYYLYHALTWPQLSFVAVVRPRNGYPDGKIAGNYPKVVGYVLAKMEEEPTDGVQHGHITSLSVMRTHRRLGIAERLMRMSRTFTPYRRGVVGLXRLLLTVWFLERAMAESHRAQFVSLHVRVSNTAALHLYRDTLGFQVDSVESKYYADGEDAYAMRMDLSNMWLDWAE

SEQ ID NO: 12508 - protein, 678 aa, Aspergillus nidulans
  unsure (1)..(678): unsure at all Xaa locations
NEDDFLFARTMVGVFKNIEHMCSRTRSKTWGKDAWKKIVVCVISDGRAKINPRTRAVLAGLGCYQDGIAKQQVNGKDVTAHIYEYTTQVGMELKGNQVHLKPRSGVPVQMIFCLKEKNQKKINSHRWFFQAFGRVLDPNICVLLDAGTQPGKDSIYRLWKAFDVEPMCGGACGEIKVMLDHGKKLFNPLVAGQNFEYKLSNILDKPLESAFGFISVLPGAFSAYRYIALQNDKNGQGPLERYFLGEKMHGANAGIFTANMYLAEDRILCFEIVTKRNCRWLLQYVKSSTGETDVPDQMAEFILQRRRWLNGSFFAAVYAITHFYQLWRSDHSFIRKFMLLIETIYQTINMLFAWFGIVSPLFGYIGAYXLLXGNFFLVFHILTTYLGDADLLGTAGKVLGVVFEWLYLATLVTCFVLSLGNRPGGSNKLYMTMVYFWVFIMIYLAFAAVFVTVRSIQEEVKDGSFTFSTLFTNSTFFSIIVSLGSTYVMWFIASIIFMDPWHMFTCVSLDLXCSSIWFXHLQFIQYILLTPTYINVLNIYAFCNTHDITWGTKGDDKAEKLPSANLKPGGKVDVNIPQDDGDLNAQYEAELMKFAQKPPKEIKTISEEERQADYYKGFRSSVVLVWVFCNFALGAVVLSSAGLDRFSDDAEAAETDRNNRAMIYMAVVLWSVAGLSIF

SEQ ID NO: 12509 - protein, 760 aa, Aspergillus nidulans
  unsure (1)..(760): unsure at all Xaa locations
LMIDAWFALEPVGRIHISMSFGNFIYLTKFDSHANMPSSKHSKDRRPFDIGLNRQGAVRQRKEEVHEKQGHKFVTQQFYNIMRCALCGDFLKYAAGMQCSDCKYTCHRKCYPKVVTKCISKANYETDPDEEKINHRIPHRFEGFSNISANWCCHCGYLLPFGRKNAKRCSGKETCHNYGRKKWLIFLVRCGLTCHAHCTHLVPDFCGMSMEAANQILETLIRHKNHNKSPSVSSGLSGKTLRPGGSQDAGHAYPKPVESPSSYGQRPPSAEAVSAAATSYIPPPQSPTSQRQPLPPRTSSSSPAAAAAAVATGRMPGKXQGLALLLRRYXHLKNRCRPTCSAPGPCSLRPCCIRILPARRYAARLPASPGNAEGNAPAQYGMHAPPPPQQQQQQMQAMQQQVAAKEDIPQQPKVRIGLDHFNFLAVLGKGNFGKVMLAETKATKKLYAIKVLKKEFIIENDEVESTKSEKRVFLIANKERHPFLLNLHACFQTETRVYFVMEYISGGDLMLHIQRGQFGLXRAQYASPPSLNLAIQLTXFSRFYAAEVLLALKYFHENGVIYRDLKLDNILLTLDGHIKIGDYGLCKENMWYGSTTSTFCGTPEFMAPEVXSPRSIXILGCXXLADSPDKKYGRAVDWWAFGVLIYQMLLQQSPFRGEDEDEIYDAILADEPLYPIHMPRDSVSILQKLLTREPELRLGSGPTDAQEVMSHAFFRNINWDDIYHKRVPPPFMPTISSATDTSNFDQEFTSVTPVLTPVQS

SEQ ID NO: 12510 - protein, 897 aa, Aspergillus nidulans
  unsure (1)..(897): unsure at all Xaa locations
MATPFLVSYDPASASGGLSLQQIAYFGRVLIKATDLAQAETFIRQNFRLLDIYVDATGISATGDLVDILNAGAAKIFISLDQLNALSEEQSRPLVTARCLHFFQRPSGSVSEMGGXAHXARRGRPVHGLGRCPLYLCEARTEPGSPALYRTYSGDVTEDAVKDTMKQGGVSIVPAAALTISREESSGKIQAGSLILRRGVKDQGNGLYATTVTDERGTCLGFVWSSDESIAEALRTGTGVYQSRKRGLWYKGQSSGDVQELIRIGFDCDSDCLVFIVKQIGRGRTSRHLRTPSADFQVSATLGTASCFGPYTGLSRLQKTLQARKADAPAGSYTARLFNEPKLTQAKIMEEADELCRAETKEDIAFEAADLLYFALTRCVAAGVSLEDVERNLDLKSLKVKRRKGDAKGPWAEKAGLAEKPAEANAAPKPEEPKEDTSRIEMTRVATASTPAEKVQEYLKRPSQKSNDAIVGLVKPIIQDVREQGDAGVLKYTHKFEKATSLTSPVLKAPFPAELMKLSPEVQEAIDVSISNIARFHSAQKGSNDALSMETMPGVVCSRFSRPIERVGCYTPGGTAVLPSTAMMLGVPAMVAGCKKIVFASPPRADGSITPEIVYVAHKVGAESIVLAGGAQAVAAMAYGTESVSKVDKILGPGNQFVTAAKMLVSNDTSAGVSIDMPAGPSEVLVIADKAPTPAFVASDLLSQAEHGVDSQVILIAIDLNEQELKAIEDEVDRHARALPRMDIVRGSLAHSVTFVVRDLDEAMALSNDYAPEHLILQIQNAEAAVEKVQNAGSVFIGQWTPESVGDYSAGVNHSLRTFPTPMILLPPILTSLPSNIWLRKQYSGVNLGSFLKHITSSNLTADGLLRLSKTVETLAAVEGLDAHKRAVSIRVAAMKQ

SEQ ID NO: 12511 - protein, 293 aa, Aspergillus nidulans
  unsure (1)..(293): unsure at all Xaa locations
KLEHFSMAKNPLSSLPPSIGCLTELKYLNLRECNLRRLPQEIWYCLKLETLNVSSNVLDSFPKHGGPPPQLPGEATAGTTPAMTPGGSVTPSYDDLGTVEEQETRRPSQASGSAPSGSSPGGGSTRKPSVASSLSQGGRKVSTASKFAEGSPSSRKDSNFSQHVATTFGGSLRNLYLADNRLEDDVFRELSFIPELRIVNLSYNVLNEIPPGLLKRWPLLTELYLSGNELTSVASDDLXEGSLLKILNINANLFHVHSAELCIASKLSILDVGSTYWKYSVSDWSYDWNSHLN

SEQ ID NO: 12512 - protein, 523 aa, Aspergillus nidulans
FNATEDPRFYKPIDTYEGLHRWDPDFEWTEEEERRIVRKVSPQLPMAIKDNIKIINHQKTKEKKAKRDQIDARVCTFACVTFFALQLDRGNIGNALADNLLQDLHMTTNDYNTGQTIFLCCFLFAELPSQLISKRLGPDRWIPIQMVAWSLVAACQAFLKTRSGYLGLRALLGLLEGGFIPDTILFLSFFYKSSELPKRLTCFWVSYTVTTIIGAFLAFGLLHIKDSNGGGSWRYLFAYEGLLTGVIGIIAAFWMPASPTQTKGGFRGKGGWFTEHEEKIMVNRVIHDDPSKGSMHNRQAVTPRLLWDSLKDYHMWPIYILGFVWMIPYTPETNYLTLQLRSQGFTTFQTNLLTIPAAVVSITTMITTTWLAERTNQRLLFGAAIEVWYLVLLIALQTLPEKSMPWPRFAILTLIVGGPSLHPVLVALTSRNAGSVRTRTVASALYNMSVQVSSIAAANVLHSYSPLFTPDTSFAEQYCRVYRTEDQPYYRKGNKVLIALAVVSIFLFISAKVYYVWRNKYGD

SEQ ID NO: 12513 - protein, 538 aa, Aspergillus nidulans
  unsure (1)..(538): unsure at all Xaa locations
ITVKFEGEKLPAILNAIETENNGQKLVLEVSVCNXYQETDXXHQVLMADTFKQHLGENVVRTIAMDGKSLPFWRETSCDHHVFAQDIDISVLGTEGLTRGAPARDTGAPITIPVGPGTLGRIVNVTGDPIDERGPIKATKYAPIHAEAPEFTEQSTTAEILVTGIKVVDLLAPYARGGKIGLFGGAGVGKTVFIQELIVSFVSGTSHENVXFLFRTNIAKAHGGYSVFTGVGERTREGNDLYHEMQETGVIQLDGESKVSLVFGQMNEPPGARARVALTGLTIAEYFRDEEGQDVLLFIDNIFRFTQAGSEVSALLGRIPSAVGYQPTLAVDMGGMQERITTTTKGSITSVQAVYVPADDLTDPAPATTFAHLDATTVLSRGISELGIYPAVDPLDSKSRMLDPRIVGEEHYNTATRVQQMLQEYKSLQDIIAILGMDELSEADKLTVERARKLERFLSQPFTVAQVFTGIEGKLVDLKDTIASFKAIMNGEGDDLPEGKCILLFLFIDSITNFLIAAFYMVGDLASARAKGEKILAD

SEQ ID NO: 12514 - protein, 241 aa, Aspergillus nidulans
DVPTLLPTSCTLGPMMKREDSRDGLVIKKGLPNMSLAEMPAGSVVGTSSIRRTAQLARKYPHLKVMDVRGNIGTRLAKLDAEDSPYTCLILAAAGLLRLGLGDRIYQYLDSRNAGMLYAVGQGALGIEIRKGDKAMEDILNTIGHKETTFACLAERSLLRTLEGGCSAPLGVETEWIQDTNGSSKLRMRSVVVSVDGSEHAEVEIDGTVDSPQSAEEFGVTVAKALVNEGAGKILSEIQQN

SEQ ID NO: 12515 - protein, 910 aa, Aspergillus nidulans
  unsure (1)..(910): unsure at all Xaa locations
KARHDESLKAVQSAIEERQTELKELVPRFISAKDAEDAARAKLTEAETARQRLYAKQGRNSRFKNKSERDKWLQAEIKNNNASISSVQSVLSQTQEDINDIENDIALLEPETERLRQQIDGRGDTIQSVEQQVQAAKDERDRLMDQRKYVDWPRTSCATLTIHRELWREEAKLDSILINASNEVDRAERNLSQMMDHNTSRGIAAVRRIKRQHNLEGVYGTLAELFEVNDRYRTAVEVTAGQSLFHYVVDTDDTATKVLEILQHEKAGRVTFMPLNRLRTKPLNMPKASDTIPMIEKLQYDRAYEKAFQHVFGKTIICPNLQVASQYARSHGVNATTPEGDRSDKRGALTGGFHDSRQSRLDAVKNLAKWRDEYETKKSRGSEIRKELEELDQLITRAVGELQKLEQQRHQVQNSSGPLRQELRSKRDLLQKQNDNLDAKRRALRNIEGNLAALKDQVDAFEAELSSPFHKALTDEEEARLESLNSNVQEYRREYQELSGKRSELETRKSVLEVELRENLNPRLDQLLAQDADIADEDGQGNIKETQREQKRLTKVLDKLAQRLAQVDESMEQANSRVTELTQRNAESRRELEELAKSIEKHQRRMEKSMQKKAALTKQAAECAANIRDLGVLPDEAFTKYKNTDSNTVVKKLHKVNEALKKYAHVNKKAFEQYNNFTKQRETLTSRREELDASQKSIDDLISVLDHRKDEAIERTFKQVSREFATIFEKLVPAGRGRLIIQRKTDRTQRAEDDLESEDEEAKHSVENYVGVGISVSFNSKHDDQQRIQQLSGGQKSKSPVPISCSPLFXHRQVLCALALVFAIQACDPAPFYLFDEIDANLDAQYRTAVAQMLKTISDSTNGQFICTTFRPEMLHVAEKCYGVSFRQKASTIDVVSREEALKFVEEQKS

SEQ ID NO: 12516 - protein, 266 aa, Aspergillus nidulans
TQILALALSIASAEAVSKGFNYGANKPDGTLKVQADFEAEFRTAKNLETTSGFNSARLYTMIQGTGSTPISAIPAAIAEETTLLLGLWASGGNMDNEIAALKAAINQYGDEFAKLVVGISVGSEDLYRNSEIGVQANAGIGIEPEELVSYIQRVREAIAGTALSGAPIGHVDTWNAWTNGSNAAVAEAVDWLGFDGYPFFQNTMQNSIDDAKALFDESVQKTKAVAGNKEVWITETGWPVSGDSQNLAIASVENAKQFWDEVGCPL

SEQ ID NO: 12517 - protein, 566 aa, Aspergillus nidulans
  unsure (1)..(566): unsure at all Xaa locations
FIGAIDQGTTSTRFIIFDCVGNPVAKYQAEYRQLHEHSGYDSHGFGSPATLFANVSFPRLDWHEQDPYEMVDSVYTCIEEAMKTFLALGHSKSDIEAIGLTSQRETVLCWDWETGEPLCPSIAWPDTRTKALVRELKAQKGADELKNICGLPLSTYPSSVSLVWLLRNNEAVKQAYEEGRLAFGTVDSWLIYNLNGGLEGRHHVTDVTNASRTMLMNLETLDYDKRLLDFFGLDPKKIRLPKILPSSDPEGFGYVRSGPLEGVPITSDLGDQSAALVGHCAFTPGMAKNTYGTGCFLLYNVGEKPVISKHGLLGTVGFQLGKNRKPVYALEGSVAVAGSGVSFLMNNMGFFRDSRKVSDLAAMVPDNGGCVFVTAFSGLFAPYWIDDAKGTICXYILNYLLDCNXSALVGITQHTQRGHIARATMEAACFQTKAILDAMEMDSGHSLSQLAVDGGMSNSDICMQVSCELNFVLSVXNKLTSLPLRPKADIIQIPVERPAMHETTALGAAIAAGFAIDIWKEFDELKNMNRANRTSFTPAISREQSQKMYKQWTKAVEMSRGWVDTK

SEQ ID NO: 12518 - protein, 589 aa, Aspergillus nidulans
EEIRQSFDNDFASLLRDVEQRNRRGANGDAQGQQSFLELNIGFVSGVIPRDRIGAFERILWRTLRGNLYMNQAEIPDPIVDPTTNEETQKMVFVIFAHGKNIIAKIRKISESLGASLYSVDENSELRRDQIHEVNTRLSDVNNVLRNTKNTLDAELSQIARSLAAWMIIVKKEKAVYDTLNKCSYDQARKTLIAEAWCPTNSLSLIKSTLQDVNDRAGLSVPSIVNQIRTNKTPPTYVRTNKFTEAFQTIVDAYGISKYSEVNPGLYTVVTFPFLFAVMFGDFGHGFLMALAAAAMIFWERQLSKTKLDELTYMAFYGRYIMLMMGIFSMYTGLIYNDIFSKSFTVFSSSWKWPDNIEQGQSVEASLKGSYRFPFGLDWNWHEAENSLLFTNSLKMKMSIILGWAHMTYALILQYVNARHFKSKVDIIGNFIPGIIFFQSIFGYLVLTIIYKWSVDWPARNQSPPGLLNMLIFMFLSPGNVEEELYPGQGGVQLCLLLLAVAQVPIMLFFKPFYLRREHNRARALGYRGLGEQSRVSALDEDGDLDGPRQSTASDGEGVAMIAQDLEEEHEEFDFSEIMIHQVIHTIEF

SEQ ID NO: 12519 - protein, 431 aa, Aspergillus nidulans
  unsure (1)..(431): unsure at all Xaa locations
MTSRDGYQWTAETGLVQGVPSISVISPPTNISPESRQYDVVVVGAGYSGLTAARDTCLAGECGFKTNESRGLIILGLKVLLLEARDRIGGRSWSSDIGGYPFEMGGTWVHWGQPHVWREISRYQMRNELESSFDFSRGVNHFELRTNQRTSDYEPTRKRXVCLRVRAAXRXRDPQDELLAAALHKFVDVDGDLGRRAVPFPHDSFHVPEARQYDQMSAKDRMTQIADSRVTRERAALESFVLLCSGGTLATTSFFEFLHWWALCGYSYQGCLDALISYKFKRGQSSFALRFFREALSTGNLSYAFNSPIQSIDDQGAKVVVTTREGHRYAGARLISTIPLNVLNTVTISPPLGTQRTAAANTGHVNQCVKVHAEIASRDMRSWTGISYPFTSSAYAIGDGTTPAGDTHIVCLVGFTTTIKAGEDFKQTQTA

SEQ ID NO: 12520 - protein, 575 aa, Aspergillus nidulans
RALPNAPDGYAPVNVTCPAVRPSIRSAASLSPNETKWLEPRRKEIISPMKNLLTRLNISDFDAAAYLGRVSADSSNIPTVGITVSGGGYRAMLYGAGALKAFDSRTANSTAESQLGGLLQSATYLSALSAGGWLVGSVFINNFTTIDALQSSDRIWDLRTNVLEGPNVKHFQLLSTAEYWSDLVEAVHSRKHAGFNTSITDYWGRALSYQFINASDGGPSYTWSSIALMDNFKNGQVPLPLLVADGRNPGELVVGSNSTVYEFSPWEFGTFDPAIYAFAPLEYLGSDFTANGSCVRGFDNAGFVMGTSSSLFNQGLLRLNSTSIPETFKKALASILEAVGQANEDIASYPNPFKGYQGSTAAISAISELNIVDGGEDGQNIPFHPLIQPARQVDVIFAIDSTANIHNWPNGKSLVRTYERSLNSTGVGNGTVFPTIPDTNTFINLGLNQRPTFFGCDAKNLTGPAPLIVYLPNAPYTHMSNTSTFDLSYSYADRDAMILNGYNVATRGNGTVDRQWPACVGCAILSRSANRTGTSLPDACTQCFQNYCWNGTIDSRQPQDYAPALMIKTSAAGTI

SEQ ID NO: 12521 - protein, 563 aa, Aspergillus nidulans
  unsure (1)..(563): unsure at all Xaa locations
TGRVWLAKHAVTGHFFAVKIVSKKCAAISQSDSIAAMDRNAGTFIGAGGRQMPSGIEREVVIMKLIEHPNVISLYDVWENRGELXVFVGPLPSNTADDKXYLVLEYVEGGELFDYVSNHGPLPEEEAVRLFRQIIAGLGYCHRFNICHRDLKPENILLDGEHNIKLADFGMAALQPAGHWLNTSCGSPHYAAPEIIYGRKYRGDKADLWSCGIILFALLTGFLPFDGEDLHATLQLVRKGDYMIPPHVSAEAADLIQRILQKKPDDRISMKDIWKHPLLKKVRKISPGYMQPLFGPSTSSVTPGLWSACGKTGIDVDLLRNLQTLWHDVKPERLIEKLISLEXVSVLMFFECFSDKLQTNARAAVLPCFSQVQERATRELRRPASQVFTSDYHHISRGQARLSKHLRSRSQNGSQRRSRAPSVKETGKRRPSTRELKPSASVETYDPYRSPFNRVPDKSPQYAHVTIHREAPETSPKPAEVEVDSSNPFLDDEQEIECQQSPPFTLVRKRKQNFNSVKSFQSKTSLISSRRALNSASTPRSVSYKRNVTFHHNRNRSQSSASA

SEQ ID NO: 12522 - protein, 1059 aa, Aspergillus nidulans
KVGERVIPSFAAEDDGGDALIHPRTANYADSKVRLLNPSDHSPGAYIYGDESKQASNTSRDFDGRSDAGYSAFNSGDMFHNLETREQMLEKGNEKQMEEVDEVPVSGSRKRWMAIVWLLTFYIPTPAIRYIGRMKRKDIQIAWREKFAINLLIWLACAIAVFIIVGFPSLICPTQHVYSPAELSSHDGKDGHSSYTSIRGLVLDLGEFMDSHYPGIVPDSALKKYAGVDSTALFPVQVSALCLGKDGNVDPKVLLDYKPTNFSGSVTSTSSGDPNSVYHDFRYFRDDYRPDWYAEQMIYLRANYYKGWIGYSSEYLHTLASKSQNVASINGKIYDLTSYIAGGRRIQGREGDDTTGIDTDFMDSLVVDLFQQKAGEDITKYWEDLPLTPKLRVDMMDCLNNLFIVGHVDTRNSTQCQFARYFILAISVLICSVIVFKFFAALQFGKKNVPENLDKFIICQVPAYTEDEESLRRAIDSMARMQYDDKRKLLVVICDGMIIGQGNDRPTPRIVLDILGVPESVDPEPLSFESLGEGMKQHNMGKVYSGLYEVQGHIVPFLVVVKVGKPSEVSRPGNRGKRDSQMVLMRFLNRVHYNLPMSPMELEMHHHIRNIIGVNPTFYEFILQVDADTVVAPDAATRMVSSCLNDTRIIGVCGETSLTNAKTSAVTMIQVYEYYISHNLTKAFESLFGSITCLPGCFTMYRIRSAESGKPLFVSKEIVEAYSEIRVDTLHMKNLLHLGEDRYLTTLLLKHHPKFKTKYNFRAQAYTIAPESWTVFLSQRRRWINSTVHNLVELIPLQQLCGFCCFSMRFVVFIDLISTIIMPVTVAYIVYLIVWLVRDTSTIPWTSFLLLAAIYGLQAIIFIVRRKWEMIGWMIIYILAIPVYSLALPLYSFWHMDDFSWGNTRIITGEKGRKIVISDEGKFDPASIPKKRWEEYQAELWEAQTSRDDRSEISGISYGTKYHPATQSEYGFPGSRPMSQLELPRHMSRMSLAPSEMMSRHMDMELEDVNLPSDDAILSEIRDILRTADLMTVTKKNIKQELERRFGVNLDAKRPYINS

SEQ ID NO: 12523 - protein, 249 aa, Aspergillus nidulans
FDVLTSALSFPTRDQEQWWRKTGPMFGQMLASSGYTLDQQYRHLTFYYNQLVPRLGPHPATFHSSLTVSGLPMEFSINYQQKGAHPMVRIGAEPIDSFSGTERDPFNQIPPAEMVKHFSRAGVKGFDPELYAYFEPKHSLTREQQARLPKEVPGGDKLKTQYAFGFDFKGDEVSLKGYSYPGLKATMAGQEVAKLVGDGVKDLKNQGKLDCTEAWAAVEAYMTELNNWGYHNLWAWDYVTPAKSRLKLY

SEQ ID NO: 12524 - protein, 540 aa, Aspergillus nidulans
  unsure (1)..(540): unsure at all Xaa locations
RYACLPGLFINNEFVPAASGKTLTTVNPYDESIIATVSSAGPKDVDRAVAAARQAFASEWRGLTPSERGLLLLRLADLCDRDKEILATIDAWDNGKPYEQALGEDIAEVIAVFRYYGGWADKIHGSTIDTGDAKFAYTRHEPLGVCGQIIPWNYPVMVFLLFEISPFXNMNRLISSADCVMAAWKLGPALACGNTVVLKAAEQTPLSVLYLATLIKEAGFPAGVVNLLNGEGASAGAAIAGHPGVDKIAFTGSTNTGRVIMKAAAGNLKAITLETGGKSPLLVFDDANIDQAVKWSHVGIMSECLGIXPLTGPKXKLIGRYIGNMGQICTATSRIYVQETIYDTFVEKFKQYTIENSKVGSQFDPSVTHGPQISKAQRDRILSYVQSAKSEGAQLVLGDEPVSEKGYFVPPTIFKNTTREMSAVREEIFGPFVVIQSFSTQQDAINKANDTEYGLGAAVFTENITRAHRVAAAIQAGMVWVSVWSLSILRICRSEWMLSXVDQQFSRLAFAIPFGGYKQSGIGRELGEYALAAYTQVKAV

SEQ ID NO: 12525 - protein, 274 aa, Aspergillus nidulans
DIVKVRLQTTTQYSSALDCASKILKNEGPLAFYKGTLTPLIGIGACVSLPKHALYIRAHKYPRLAFNSEPSTKRAGDWRSSTKKSTLTAPSATAQYYLAGGFASITNSFLSGPIEHVRIRFQTQPHGAGGLDNGPLDCIRKLTNQGGFLKGLYRGQAVTYLREVQAYGVWFLTFEYLMNQDAKRNNVKREDISSLKVATYGGLAGEALWLSSYPMDVVKSKMQSDGFGAQQQFKSMTDCFKKTYAAEGLAGFWKGIGPTLLRAMPVSAGTFAVY

SEQ ID NO: 12526 - protein, 494 aa, Aspergillus nidulans
  unsure (1)..(494): unsure at all Xaa locations
LGYDEGGYSASVRLYSFKADFNLLDSNWTNNETGLANRVANITSFNVLGAALGALVSLDLNDRLGRLRSWQLACAVWMSGTFIQAFASGMYGLLLFARIWGGLGAGALTVATPLYLSEIGLXSRPWDXVXLTVLAPARTRGLIVSIYMVVLLTVXLLVRRPFLHTHSFLIWHLGFFINYGANIHMSPTRSQYRLVQSIPLIPVGVAFGASTMIPETPRYLVSKSRLEEGRNVLARLRGLDALSPKIEEEFSLITTQARFRADTLSSISNWTAFKETQSNPNYRQRFWLLMAMQTISQWTGGNGITYYVSTIFESAGVTGNATSLVSSGAYGVVKLVFTMAFTWGLIDFLGRRYCVLLGLTLQLAAHVYLACYMGVLRPSDDTELVNKPASNTAIAAVFIYAIGWSIGLCTVPYLYGTEIFPTRIRNVSYAVSMSLHWFFQFAVVRVTPNMFVSLHDWGAYMFWAIICFVGLVVLGIWMPETKGVDIELMGELFE

SEQ ID NO: 12527 - protein, 429 aa, Aspergillus nidulans
  unsure (1)..(429): unsure at all Xaa locations
YVLGVGMTKFIKPRGKVDYNELGFEAGVKALLDAHINYDDVEQGVACYVYGDSTCGQRVFYQFGLTQIPIYNVNNNCSTGSTGLAMARTLVSHGAADCVMVVGFEKMSPGSLQSVYNDRANPTGLFGMMMAETRGVTNAPGAAQMFGNAGREYMEKXAASSPXFLTEKLTGXYGAKAEHFAEIARINHEHSKRNPYSQFQDEYTLEQVMKAPMIHEPLTKLQCCPTSDGARAAIIVSQAFLDARPHLKDQAILIAGQQLATDNTTLYNRSSIDLMGFGMSRAACRAAVAEAGVNIKNIKVCELHDCFSANEMITIDALELSEPGKAHEMVAKGDITYGGKMVINPSGGLISKGHPLGATGLAQCTELVWHLRGWANNRLVEGTDAALQHNLGLGGAVVVTVYKRADGKVAKPVSSADVAKINGLGYNPA

SEQ ID NO: 12528 - protein, 387 aa, Aspergillus nidulans
  unsure (1)..(387): unsure at all Xaa locations
GKYTVTLIEGDGIGPEISQSVKDIFSAANVTLPLVVIXLRCCYTKSPTGPIKWESVDVTPILKDGKTAIPDAAIDSVRKNYVALKGPLAVRKATSVAKRIAKSRPDPVGKGHVSLNLTLRRTFNLFANLRPCRSVAGYKTPYDNVDTVLIRENTEGEYSGIEHVVVDGVVQSIKLITREASERVRSSLFQYARSINKKKVRVVHKATIMKMSDGLFLNTAREVAKDFPDVEFDAELLDNSCLKITTDPTPYNDKVLVMPNLYGDILSDMCAGLIGGLGLTPSGNIGDECSIFEAVHGSAPDIAGKGLANPTALLLSSIMMLQHMGLNEHASRIQKAIFDTLAEGKVSISTTYXLRXYFXLTSLXTLTGDLGGKAKTHEYADAIIKRL

SEQ ID NO: 12529 - protein, 411 aa, Aspergillus nidulans
  unsure (1)..(411): unsure at all Xaa locations
MASTLRLSTSAVRSSTLAGKPVVQSVAYKSLRSYSTGKTKVRLCAALRLGHWRVFGXPXSPYLSLKETFADKLPGELEKVKKLRKVRYSXXFLSRNDRXSVIVQICREHGNKVIGELTLDQAYGGARGVKCLVWEVSRSQTNLRNLAMELTNNYIVGFRLDSEEGIRFRGLTVSNTISPLIKAFLTISXIPECQKLLPKAPGGEEPLPEGKNAAKSNQVAISDEWQVSSWLLLTGEVPSEQQVRDLSAEWAARSDLPKFIEELIDRCPSTLHPMAQFSLAVTALEHESAFAKAYAKGINKKEYWHYTFEDSMDLIAKLPTIAAKIYRNVFKDGKVAPIQKDKDYSYNLANQLGFADNKDFVELMRLYLTIHSDHEGENVSANTTHLGGRALSTHILSLADALIVVAGTLHG

SEQ ID NO: 12530 - protein, 262 aa, Aspergillus nidulans
  unsure (1)..(262): unsure at all Xaa locations
AAQQSDNIAHALAGAGGGILSMVLTXVIXSQSSPFMSTYSPGXFNQIPTYNTLNSSASRIQACAVSTIDAIRRIVQREGIVGLYSGLESALFGISVTNFVYYYWYEWTRSAFEKAAEKAGRSKKLSTLESMIAGAIAGSATVLLTNPIWVVNTRVTARKSAEDDQSLPGAPKKQRPSTFGTLMDLLQKEGPTALFAGVLPALVLVINPILQYTIFEQLKNIVERRRRMTPKDAFYLGALGKILATSITYPYITVKSRMHVAS

SEQ ID NO: 12531 - protein, 277 aa, Aspergillus nidulans
  unsure (1)..(277): unsure at all Xaa locations
YDYLFKLLLIGDSGVGKSCLLLRFADDTYTESYISTIGVDFVRLPCCRSVIGCQAIILRTGINXQPLXKKIRTIELDGKTVKLQIVWKADSFLLVHRIKLTAYIWDTAGQERFRTITSSYYRGAHGICVVYDVTDMDSFNNVKQWLQEIDRYATEGVNKLLVGNKSDMEDKKVVEYTVAKVGCYIPVTTSQHRSVVFFSCYFRKPSNFCVYLXEFADSLGIPFLETSAKNASNVEQAFLTMARQIKERMGTATVNNKPTVQVGQGQGVQSGSAGGCC

SEQ ID NO: 12532 - protein, 471 aa, Aspergillus nidulans
  unsure (1)..(471): unsure at all Xaa locations
HSKYTCXCCVLIYSVSAAGLHEAALAAGLEYFGTATDNGELTDIPYVTQLNNTADFGQITPGNTQKGRQPHPQYXPTPKRTIHENVMLTYAXXWDSTEPSQGTFSFTKGDVIADLADANGQYLRCHTLVWHNQLPSWGKMFHRSLXKRMEIKIXLKRLTXEQXTSGSWTNTTLTAALRNHITNVVNHYKGRCIHWDVVNEGKXSPYXPDSSRFSVGVXSCLLDXSTNEDGTYRTNIFYTTMGEAYIPIAFAAAAAADPDVKLYYNDYNLEYGGAKAAGARAIVQLIKNAGVKIDGVGFQAHFSVGTVPSRSSLASVLQSFTSLGVEVAYTEADVRIQLPTSATTLAQQSTDFQNLAGSCVDTAGCVGFTIWDWTDKYSWVPSTFSGYGAALPWDENFVKKPAYDGLLVGLGGTVTTTTTTTATSTTTSATATSTATSPHWGQCGGIGWTGPTLCASPWTCTYVNDWYSQCL

SEQ ID NO: 12533 - protein, 432 aa, Aspergillus nidulans
  unsure (1)..(432): unsure at all Xaa locations
DLCXHVDXMSFFTVVVTHSALVEGSTFARTVGASCPWCDSQAPQILCYMQNFWTGSYINANTGGGRSGKDANTVLASIHTFDPDAACDDITFQPCSSRALANHKVYTDSFRSVYSLNTGIAQGVAVAAGRYPEDSYYNGNPWFLTTLAAAEQLYDAIYQWQKARSISITSTSLAFFKDIYSSAAVGTYASGSSAFTAIIDAVKTYADGYVSIVKAHAMANGSLSEQFDKTYGTCVSARDLTWSYAALLTASMRRNGVVPPSWDAASANTLPSSCSTGSATGTYSTATVTTWPSTLTSGSASATTTIMATSTATSSSTTTSTTTACTTPSTVAVTFNVIATTTYGENVYIVGSISQLGNWDTGSAVALSASKNTSSNNLWYVDINLPGGTAFEYKYIRKETDGSIVWESDPNRSYTVPSSCGVSTATESDTWR

SEQ ID NO: 12534 - protein, 293 aa, Aspergillus nidulans
  unsure (1)..(293): unsure at all Xaa locations
MRAAQFYAAGDVRVEDVPVPQASDDRVLIEVEWCGICGSDLNEYMFGMTVVLXSAWXAMLTRTIGPFAIPSLQSGPHPLTNALLPVTMGHEFTGRIKYVPESISHLKKGQAVVVDPRYYCSSCTPCLHTATNSCEKIGFMGLSGGGGGLSEFVAVRPEAVHVLSEDGSAYMDLAAAALIXPLRVAWHALNLFLSISPCQAAHQNEVDLSTVPILVIGAGPVGIAISYVLQARGAKTIYVSEVSQARRETLRGMEIVTEVFDSGQVDVPKKVRLLTGDGVGVVFDCAGAQAGFD

SEQ ID NO: 12535 - protein, 248 aa, Aspergillus nidulans
LDPKEYKSLPLVQKKTLAPNVYKFVFQLPGRQDVIGLPIGQHVAIKANIEGKTVSRSYTPTSNNIDRGVLELVIKCYPDGLLTGKYLANLQVGDKVEFRGPKGAMKYTKGLCKKIGMIAGGTGITPMYQLIRAICEDPTDTTEISLIYANRSEEDILMRSELEEFARNFPKNLKIWYMLDTPPEKWSFGTGYITAEIMREHLPMADKDTKIMLCGPPGMLDACKKGLVALGYEAPGAVAKMDDQIFCF

SEQ ID NO: 12536 - protein, 704 aa, Aspergillus nidulans
  unsure (1)..(704): unsure at all Xaa locations
TQERAHYARAAELTQEPPKGKPYSVAIPGTEKDGRSPIYRSWWTQKELVKTLDPKVRIKLGYFIICXEAGWSXPFXVTTAHEIFESTANDTPKADCLGWRPYDPVKKTWGQYQWISYGTVQKRRTDFGAGLVELHHKHNCARPGQYGIGLWCQNRPEWQITGTXLFLQYTGXCXVSDLACMSQSLYSVSIYDVLASDATQYIINHAELSCVVASLPHIPTLIKLKPVLPNLKIIVSLDSLEAGEPAGHSKRALLESMAAGHDLTIYSMDQVEALGAASNRPLNPPKPSDIVTINYTSGTTGAPKGVVLTHENAVAATSGALVSVSQARGDTFPSYLPLAHIYERLTEHAALWSGARIGYFHGNILELVDDLKVLKPTGFVSVPRLYSRFGTAIRAATIEAPGFRGTLSKHIVAAKSANLKNPDPSKATVKHALYDRIWAKKVAAAVGLENAKQLISGSAPLDPSLHDFLRVAIGADFSQGYGLTETYAMACAQSPKDVTSGNCGRVAPCTEVCLLSLPDMEYSVDDKPFPRGELLVRGPNVFKEYLKNPEETSKAITEDGWFRTGDVAKIDDMGRIIIIDRRKNVLKLAQGEYISPERLEGIISSELGYLAQVYVHGDSMQTFLVAIFGVQAELFASFASKVLGRTIDPTDVAGIKAVLQDNKIKKAVLRDLERVAKKNKLAGYERVKNCALMVEPFSIENALL

SEQ ID NO: 12537 - protein, 464 aa, Aspergillus nidulans
  unsure (1)..(464): unsure at all Xaa locations
VMTALGEVATYLPIPGAFTSYATRLIDPSLGFAMGWIYWFSWAITFALELTATGLIIQFWNQDLNIAIFIGVFWVFITLFNMLPVSFFGELEFWFSSIKVLTVIGRDAANSPILLXLTICRFMIFGICINAGAGKQGYMGFDTWVHPGPFVAYDNISPDSTAKFVGFWAVLIQAAFSYQGTELVGIAAGETENPRKTVPSAIRKTFFRILFFFVLTIFFIGILVRSDDKQLLNSSTDANASPFVIVARNAGVAVLPDIINAVLLTVVLSAANSNVYSASRILIGLAQEGFAPRFFKKTSKAGVPYYSVAFASAFGLLGFMNVSNSGATVFNWFLNISSVAGLISWASILGCHLAFMRALKARNISRDLLPYKALWQPWFSWYGLFFNVLIIITQGFTAWIPEFSVTDFFVAYISLILFVVLYLGHKIVYRPSFIRPIEADIDTGRIALENEYWETTISDEKWYK

SEQ ID NO: 12538 - protein, 562 aa, Aspergillus nidulans
  unsure (1)..(562): unsure at all Xaa locations
MVGVGPKRPPSRKGMSPLPTQCSNXFLIARSYCRSMSDVPQNLLEHIKHFEEIFTVDTATLKKIVDHFVNELTKGKWFGTXIFENDTXIGTFRSSVEGGNIVSLRNRHSHRLSNGIAHNVTWVLGFPDGKETGTFLALDMGGTQPAVCEITLTEEKGGFDIIQSKYRMPEELKTGEAEELWQYIVDCVEQFIQFHHENENLSKLPLGFTFSYPATQDYIDHGVLQRWTKGFDIDGVEGKDVVPPLEKVFKERVWNNSDPCACACVCLPFLLXGLPIKVAALTTTQRDPFIASSYTDPAMKIGCIFGTGVNAAYMENAGSIPKLAHMNLPPDMPVAINCEYGAFDNEHIVLPLTKYDHIIDRDSPRPGQQAFEKMTAGLYLGEIFRLALVDILDTQPGLIFKDQDTSQLRIPYLLDSSFPAAIEEDPYENLIETAELVQNMLKIKATRSELELMRRLAELIGTRAARLSACGVAAICKKKNIESCHVGADGSVFTKYPHFKARGAQALREILDWAPSEKDKVTIHAAEDGSGVGAALIAALTLKRVKAGNTAGIRDAQAMLAM

SEQ ID NO: 12539 - protein, 276 aa, Aspergillus nidulans
PFINGGLAGMTATVVIQPIDMIKVRLQLAGEGVRTGPRPSALGVARNIIASGKVLDLYTGLSAGLLRQAVYTTARLGFFDTFMKALTKNADTANRKVTFAERAGAGLTAGGIAAMIGNPADLALVRMQSDGLKPPEARAHYRSVIDALFRISKAEGVTALWAGAFPTVVRAMALNLGQLAFFAESKAQLKTRTSLSAQNQTFAASAIAGFFASFLSLPFDFVKTRLQKQQKDPKTGQLPYKGMFDCARKVVRDEGWLRFYRGFGTYYVRIAPHALV

SEQ ID NO: 12540 - protein, 411 aa, Aspergillus nidulans
  unsure (1)..(411): unsure at all Xaa locations
ESPVYRATTTAPVNIAVIKVCLNPAIVQHIGLYQLSRYWGKRDATLNLPTNSSLSVTLSQRSLRTLTTASCSASYPAADELTLNGKPQDIQSSKRTLACLASLRAHRQELESADPSLPKLSTLPLRIVSENNFPTAAGLASSAAGFAALVRAVADLYKLPQSPTELSRIARQGSGSACRSLMGGYVAWRAGELADGSDSLAEEVAPQAHWPEMRALILVVSAQNKIVPSPRGMLTSVATSELFATRANAVVPARMTAIETAIQNRDFPAFAXITMRDSNGFHATCLDSWPPIFYMNDVSRAAVRLVHDINNAVGRTVCAYTFDAGPNAVIYYLEKDSNLVAGTFKSILGTELEGWSGPFYDAVKDVSSGVSLEQVDSRAVDVLKTGLSRVILTGVGEGPISVQDHLVGENG

SEQ ID NO: 12541 - protein, 298 aa, Aspergillus nidulans
  unsure (1)..(298): unsure at all Xaa locations
NGNAESTTSIIKNLNSANLDKSVEVVVSPPALYLLQAREVANKEIGVAAQNVFDKPNGAFTGEISVQQLREANIDWTILGHSERRVILKETDEVCPLKHFVVIRAXVLKDLFIARKTKAAIEGGLQVIFCIGETLEVXLFFCFGLSRLPTLTGHSPMLSFLPYXQCVPGREANKTIDVVTRQLNAAAKELSKEQWAKVVIAYEPVWXDTHLSAPRLTESKRANCVTGPLGTGKVATTEQAQEVHSAIRKWLKDAISAEAAENTRIIYGGSVSEKNCKDLAKEADIDGFLVGGASLKPA

SEQ ID NO: 12542 - protein, 384 aa, Aspergillus nidulans
  unsure (1)..(384): unsure at all Xaa locations
MHFLQNSLIAAAMGAALVAAAPAADLDARSSCTFTSASAAKSGASKCSTVTLKSIQVPAGETLDLTGLKSGATVRSSPSPSPPHXSRLSNGGAGIFEGETTFGYKEWKGPLISMSGDKITVKQASGAKINCDGARWWDTKGSNGGKTKPKFFSAHKLNNSKIQGLKIYNTPVQGFSIQSDHLTISDVTIDNSAGTSKGHNTDAFDIGSSTYITIDGATVYNQDDCIAINSGEHITFTNGYCSGGHGLSIGSVGGRSDNTVKSVTISNSKVVDSQNGVRIKTVYKATGSVTDVTFQDIELSGITKYGLIVEQDYENGSPTGTPTNGVEVEDITFKKITGSVDSSATRVNILCGSGSCKDWTWSGVDITGGKKSSKCKNVPSGASC

SEQ ID NO: 12543 - protein, 837 aa, Aspergillus nidulans
  unsure (1)..(837): unsure at all Xaa locations
HLDRFASASIPVQRLHVHVKRLVAAGHKVGVVRQLETAALKAAGDNRNAPFVRKLTNVYTKSTYIDDIESLEGSTAGASGASATGYILCITETNARGWGNDEKVHVGIVAVQPTTGDIVYDEFDDGFMRSEIETRLLHIAPCEMLIVGELSKATEKLVQHLSGSKMNVFGDKVRVERAPKAKTAAAESHSHVSSFYAEKMKSADAADDEVASNLLQKVLGLPDQVTICLSAMIKHMTEYGLEHVLQLTKYFQHFSSRSHMLLNGNTLTSLEIYQNQTDYSSKGSLFWTLDRTQTRFGQRMLRKWVGRPLLDRRQLEDRVNAVEELKDFRNVVMVERIKGLLGKIKHDLEKGLIRIYYERXVTLTLVXRGXQXKCSRPELLTILQTMQMIAQEFADIESPADTGFSSPAISQAIMSLPTILKDVVFFLNKINMHAARNDDKYEFFREEEETEEISEHKLGIGAVEHELEEHRPVAGEALGKKMVTYVSLAGIDYLVEVENNSPAIKRVPASWMKISGTKKVSRFHPPGVVKMIRQRDQPQKRSPAACDKAFLALQAEIATNYQALRDCVQSLATLDCLVSLATLASQPGYVKPEYTEETCIHVEQGRHPMVEQLLLDSYVPNDINLDSSKTRALLVTGPNMGGKSSYVRQVALIAIMGQIGSYVPAQAAKLGMLDAVFTRMGAFDNMLAGESTFMVELSETADILKQATPRSLVILDELGRGTSTHDGVAIAQAVLDYMVRSIRSLTLFITHYQHLSAMVHSFPDGELRNVHMRFSESGTGADEDITFLYEIGEGVAHRSYGLNVARLANLPAPLLEMAKQKSAELEEKIRRRRLAGF

SEQ ID NO: 12544 - protein, 225 aa, Aspergillus nidulans
  unsure (1)..(225): unsure at all Xaa locations
EGRLQQSTLDLLSGCDIQFRRENRLDIALVKNLPIALIFLPAADIPTFVGEGRVDLGITGRDQVAEHDAQLGLPEGEVSGVQEILDLGFGGCKLQVQVPEKGDVQKVEQLIGKNVVTSFTALSEQFFSRLEKEHGPAEKKTNIKYVGGSVEAACALGVADGIVDLVGMFLPPVTCXXLXSXGRQESGETMRCAGLKAIDTVVESTAVLVKNRNTQNPLVDLITSR

SEQ ID NO: 12545 - protein, 483 aa, Aspergillus nidulans
  unsure (1)..(483): unsure at all Xaa locations
WGSDGKDRALLAKLDTTLLPYFSLIWFLFGVTRASYSSAYISGMKEALNFQGKDYNYMRTAYLVTYAVCQIPGTSLLTLVRPKHVFVPANVTWSVLTMVTFRTTHAWQVHSVECYRRGVFSDCIVGLVLLARAVADPDSVGALFILGSWYKRSELGTRNAIFCVFGHLGSMAGGWIQAGLLKSLAGKGGLPAWKWIFIIVSVMTLPVALFGTPSLKISKEKKNKTXAYSDNAGWFFIPDLPVHRTAWYLNAEEKEHAAARLGSPSKQSWDLTVFKRVLWSWQFYLLAAYLHALVSLTIXGAPLXQILVYSLCVQSLSNNVMPLWMASRGYTTVQQNNYPTAIYATAIVGTVLYAVVSDKLRSRWEVSIAIGLTFVIGSAILFSDPPTAGYFFAFYLLGTTYAPQAVWYGWLADVTGHDVQLRAIATGFMNSFDFAFVTWWPLIFYPVTDAPDYRRGYFASLVTGALTLPFIGLIAYLERRDRK

SEQ ID NO: 12546 - protein, 336 aa, Aspergillus nidulans
  unsure (1)..(336): unsure at all Xaa locations
AKTRSQLNRRLPDSKKLPWPPFGKQWYAGCTTLIIGNSLKAGIRESLVLCVXTVVVWGADTLSLYSGFVAFDTFKSMLQDQDGKISGPRTVIAGFGAGFTESLLAVTPFESIKTQLSVLPHIPVVLSMRLAFNNHETGSSXYRTLSTSYRIDDRKSANPRMRGFFHGSGVIFRERGIHGFFQGFVPTTARQAANSATRFSSYTMLKQMAEGYVAPGEKLGTASTFALGGMAGLITVYVKYSSQHHLKRHTDNIIXIRTQPLDTVKTRFDQPALRFGRDASXQRNRMQSLEASKNYKNSFVCAARIFKDEGILTFWSGAVPRLARLIMSGGIVFTMF

SEQ ID NO: 12547 - protein, 1053 aa, Aspergillus nidulans
  unsure (1)..(1053): unsure at all Xaa locations
FAAWLESVGRWTQADEVYRLGIDREARPTERLIRKYGEFQRRYEQQPQDNGPSSPALPAVRPALAAKVDPFASSAAAPTDPQSQQQGSRTTNAPKTKSGKPKMAIFTDTEPAANQPALGAQTKGWDSLESRHDRRKENQIEAKPWAGETLKAGRKAPPKEKLAVFRDEVSFVIYSTPFVSIPYIYDHRTNWWHEPGLVYCYVFSSKSDLPTKEEMQSNPVPEHRIREAVNPRTGRRERVFVDLDAVYPDYKNPSIEVSFEELRAMKRGWMDRDWRKKGPLKQISGNAVQTEPNPFNDKALRDQFQQKLSLRNTDDHALNQPIVSEKTHDAKAAKGRKLKVREVKGETQTSRNYGLPVPKCLIRLTFEIVKMKFDSPTGGKIRRKSTAEPTMTIHTRAATDEIYSIFNQPLKAETENVAESSDFDDDDYTSAGESTVGRISAASSDFGDDTFHKSFDEGDGDDFENTSADSVVNGEWTRFSAAELGAEATSFHSEAADPTQSTIHHAESDDTEDQDAGPEFEQPQRPRFIPEMPEDYVPPVGPYRDPVVVAQSRLPFMTPIVERTEHSFPSMTAARSNLYSAKTPSNVLNPTTTPRMPRMGNLLSSPLPTETPFHGQTMHGLEDIIESPTANRSGSSSLRVPSPTKDSNPQGTIIKDTLCNPIDRSIRDTILQELHTTLAAYPGYHAHPDTQSHYAPEIERFMKSSSKRSRSGGEAAFDVPIIDPPGGERSYIIRRELGAGAYAPVYLAESIDNLDSDSEMESVGSNSGRSTVSNSLTRQKTPRYSFEAIKLEVGPPNAWEFYMIQTAHHRLSQLPTLSRAADSIVRAHEMHIFKNESILVEDYRPQGTLLDLVNLVRNEGIYGPATGEGGLDESLAMFFTIELFRTIQALHTCGILHGDIKADNCLIRFDDKPDPTQQILDENTDPREFYYSPSGAFGWKNKGLALIDFGRGIDMRAFDPSVQFRCDWKTGEHECPEIREMRPWTHQIDLLRSAGTVHVMLFGKYIESVPTDASKKTYRFREPVKRYWEKIFWPDFLIFLXILYGTGGLMEQK

SEQ ID NO: 12548 - protein, 513 aa, Aspergillus nidulans
  unsure (1)..(513): unsure at all Xaa locations
PIIKKVLIANRGEIACRIIQTCHKLNIATVAVYSMSMFSLFAXRHVVANRSRDTSSRHIRDADEAINIGSIDQCPRNPFLDGELLIRTALSVNADAIHPGYGYLSENAEFARSIRDAGMIFIGPSDTAMSTLGNKRAAKEYLSKHAPDVPLIPGYVGSSQDAPELSRIAAQIGFPVMLKASAGGGGKGMRIIREAGQLQAELERAQSEALRSFGSADCILEMYVESSKHVEIQLLGDSYGEVVSFFERDCSVQRRHQKVIEETPCTFLTEKTRQEMSATAVRIAKLLGYENAGTVEFVVDAVTGKFYFLEVNARLQVEHPITEEVTGVDLVSLQLYVAAGGSLRALPALQGLTQQGHAIECRLCAEDPRKNFFPEHGKIHLWLPASGVLGPGRDVRYEAAVQSGSSVSIYFDSMIAKIVVWAPTRALAIEKMVKVLAHTICAGVQTNQLLMQRCLLHKAFHNPAYTTSFLSLHLDELLHEPGGLIAEIRKSLPIVPAVALRHLAALSASQKRP

SEQ ID NO: 12549 - protein, 374 aa, Aspergillus nidulans
  unsure (1)..(374): unsure at all Xaa locations
DDSLLEKYGLKANDAILAEEKHMGLYEELLQHRDAKLIAGGAAQNTARGAQVIRLRLXYLHMTIADSIAHSYILPDNSTLYIGCVGKDKYADILQDACKKAGVHTEYRVDDAQPTGKCGVIITGHNRSMCTHLAAANEYKVDHLKQPHIWSLVEKAQYYYVGGYHLTVCVPAIQALGEEAAAKNKVXNTGSVSYGLRLRXSSLTHXVFMLSLSAPFIPQFFKDQLDSVLPYTDYTFCNETEAVAYAESHEWGTTDIVEIAKKLAQLPKKNTNRSRIAVVTQGTLPTITATVTTSGEVEVKEFPVHEISKDAINDTNGAGXVFKLATLNTSDDSRSSDAFAGGFVAGVVQGKSLEESVDLGQWLAKLSIQELGPS

SEQ ID NO: 12550 - protein, 725 aa, Aspergillus nidulans
  unsure (1)..(725): unsure at all Xaa locations
KVLCVAEKPAIAKAVAQHLSGGRMETVSEXPNLLNVNXKWNRKMSTGNRFVKNYVFDFNFGNQWGNSSVTMTSVLGHLTSLEFERQYSGWASCPPAALFEAPVKIAVDDVGXADVCPSAVFAKSXLQDKKAIANNIMKQATHSQYLVIWTDCDREGEHIGTEVRDQAKAGNGRIVVKRAKFNNTEKMXVDAPPLSCVLRXPIXAHVLNAARSLIELDERQANAVAARIELDLRIGAAFTRLLTLQLQNLHATLTQKVISYGMPRRPFXNALPSDRLLSNKDPASFPTLGFVVDRYLRVKRFKPETFWGIKVMHTRDGIKVSFLWNRVHLFDRAAVTIMLERCLMATKAEVTKVNQKPTSKWRPLPLTTVDLQMMGTKYLRMDSAKVMKVNCSITXNANMVTNGTXIAENLYTKGFISYPRTETDQFDKGIDLKKLIEKQLPDERWGEYARWCVAHSLSSINYXTALLVSSAGNFRTPRAGRHNDQAHPPIHPVCWVNPTTLTEDERKVYEFVTRRFLACCSDDAKGQSTDVEIRYGDEMFHAHGLLVLERNYLDVYVYDKWESTQQLPNYQVGELFEPTEANMFDGKTSPPNYLTEPELIGLMDANGIGTDATMAEHIERIKSREYIGEMTRGSGRNAVKLLIPTRLGIALILGYEDVFAGLADSPSLSKPFLRKQMELEMRDVCAGTRLRTHVVQQNLDMYRELFIHTQRRMNMLKAAFRKYIV

SEQ ID NO: 12551 - protein, 556 aa, Aspergillus nidulans
  unsure (1)..(556): unsure at all Xaa locations
MASAFRSSLKLRASARLPAVRTITTTPRLRAAEKPYFPNEPTAPKLATAIPGPKNKAASEQLNEVFDVRSLNMLADYTKSVGNXYVNLPSIYPAQCLPGLTPNQIADLDGNMLLDVYVVNHILSLLVDEWHFXPDCSYAQIASIPVGYNNPHLLKVAASPEMATSLINRPALGNFPSADWAHILKTGILKVAPKGLDQVFTAMAGSDANETAYKAAFMYYRQQQRGGPEKEFTEEEIQSSMLNQTPGSPQLSIMSFKAGFHGRLFGSLSTTRSKPIHKLDIPAFDWPQAPFPSLKYPLEEHAKENAEEEQRCLQEAERLIKEWHNPVAAIIVEPIQSEGGDNHASPAFFRGLREITKRNNVLFIVDEVQTGVGATGKFWAHDHWNLETPPDMVTFSKKAQTAGYYFGNPALRPNKPYRQFNTWMGDPSRALIFRGIIEEIERLFLVENTAATGDYLYSGLERLAKQYPEHLQNLRGKGQGTFIAWDTPKRDEFLVKGKGVGINIGGSGQNAVRLRPMLIFQKHHGKFPVIATNVNMANFSQLDILLESIEKIIKQL

SEQ ID NO: 12552 - protein, 638 aa, Aspergillus nidulans
  unsure (1)..(638): unsure at all Xaa locations
PPGPSRSKKSSFSSFVNSMLGSPRGIKISAPENPVHVTHVGYDNQTGQFTGLPKEWQRLLQESGITQKEQEEHPQTMVDIMRFYEKNARGDDEVWHKFDHAYPQQPTAASPISQPAGSTTYGTQRTSPPTSPRFPQNHEGSFENPRAPPPIPRAAPIAAHAMSPPLGGLVPNRAPPKPPTAAANLVPSRPAPQPPTSSPYSNISTRPSPETQSPQFSTPPIPETEPLPSESQRSRSNSRTNGAQGPWPSVSPSHYQQQQEQAMAVAQQALANKQLERSRSQRQQQQSPRPDQMPIAQPALPQHAPSPEDVALTQASQTARAAPAARPRQRPRQSNAMDVRARLVAICTPGDPTKLYYNLNKIGQGASGGVFTAYEQHTNNCVAIKQMNLDLQPKKDLIINEILVMKDSKHKNIVNFLDSYLHGLDLWVVMEYMEGGSLTDVVTFNIMSEPQIAAVCREVRFFERYLSSSTDFVSXTLNGLQHLHSKGVIHRDIKSDNILLSLDGNIKLSKWDIATLRSDXILMIRSDFGFCAQINDSQNKRNTMVGTPYWMAPEVVTRKEYGRKVDIWSLGIMAIEMIEGEPPYLTESPLRALYLIATNGTPKIKDEHNLSPVFKDFLHFALRVDPEKRASAHDLLKV

SEQ ID NO: 12553 - protein, 178 aa, Aspergillus nidulans
  unsure (1)..(178): unsure at all Xaa locations
ELGAFAKLEPEFTARGVKMIGLVRGHRCAPHTRSLTNSSXSANGLNSHKAWIKDIDEVTGSKLTFPIISDPERKIAHQYDMVDYQDTTNVDSKGMWDLGICXTXASLXPLSRRYGLTIRSVFIIDPAKKIRLIMTYPASTGRNTAEVLRVVDALQTTEKHGVTTPINWLPGDDVVIPP

SEQ ID NO: 12554 - protein, 562 aa, Aspergillus nidulans
  unsure (1)..(562): unsure at all Xaa locations
FVGSIDQGTTSTRFLIFNREGDPVASHQVEFKQIYPNPGXGLLFLMLYDSANGVGRWHEHDPLELVSSVETCIEEAVKQFEINGYDQQSIKAVGITNQRETTVVWDHETGEPLYNAIVWTDTRSQAVVDELKKKPGASQLQQICGLPLSTYSSSSKLLWMLTNVPKVKEAYEKGTLAFGTVDAWLVYRLNGGSAANVFVSDCTNASRTMFMNLETLGYDDFLLDFFGIKGRVHLPKIVPSSDVTAYGALSNGRLAGVPIMGCLGDQSSALVGQKGFSPGMAKNTYGTGCFLLYNVGDKPVISKHGLLATIAYNFDGRPVYALEGSIAVGGSGIKFLQNNLEFFRESKEVNDLALTVEDNGGCVFVTAFSGLYAPYWIDDAKGTICKLELLKFTLICXYXYKIVGITQYTQKGHIARATLEATCFQTKAILNAMEKDSGHRLFELAVDGGMSNSDLAMQVQNGXLSTPAXIQRLHTDISFFPMQKIQADLISIPVYRPKMRETTALGAAIAAGLAVGLWRNFAELRDINRAGGTVFRPQTSQDISREQFSLWEKAVSMCRGWV

SEQ ID NO: 12555 - protein, 179 aa, Aspergillus nidulans
  unsure (1)..(179): unsure at all Xaa locations
RPLLESERERLDEFIDSIHYSARCVHYLKLPSASKMRRYSDDQFEYRHVQLPKNMLKKIPADYFDSSKGTLKLLWEEEWRALGITQVRIIIPRQRIVXPYYRSLGWEHYEVHEPEPHILLFKYVPTVGLASLRAHSLHRRPLNYQPSIPQXTAYSELPTTRSQRLHGRRQSRHRGRAIS

SEQ ID NO: 12556 - protein, 306 aa, Aspergillus nidulans
  unsure (1)..(306): unsure at all Xaa locations
STFSPEGRLFQVEYSLEAIKLGSTAIGVCYSFLYSSSGMDTEVSXTAEHFISFFDNDRNESADCFHRXQTSEGVILGVEKRVTSTLLEASSVEKIVEIDQHIGCAMSGLAADARSLVEHARVETQNHAFHYAEPLRVESCTQAICDLALRFGETGDDEESVMSRPFGVALLIAGIDEDGPQLYVSLPSIRALLACLSPRLALHTSYTTKIIHXLLSLPDITAEPSGTFYRYDAKAIGSGSEGAQAELQNEYHRSLTLAEAETLVLKTLKQVMEEKLDAKNVQLASVTKEKGFRIYNDEEMGRAVAQ

SEQ ID NO: 12557 - protein, 382 aa, Aspergillus nidulans
  unsure (1)..(382): unsure at all Xaa locations
ITMARVYADVNKHMPRSYWDYDSVNISWGVLENYEVVRKIGLFPFSIVEIXGFCTNRCSCRRGKYSEVFEGINIVNYQKCVIKVLKPVKKKKIKREIKILQNLAGGPNVVALLDVVRDNQSTTPSLVFEYVNNTDFRTLYPRFSDYDVRFYIYELVKALDFCHSKGIMHRDVKPHNVMIDHEKRKVXCVPVLNEXALIFFXLRLIDWGLAEFYHKGTEYNVRVASRYFKGPELLVDFQEYDYSLDMWSLGAMFASMIFRKEPFFHGNSNSDQLVKIAKVLGTEELFEYLDKYEIELDPQYDEILSRFPRKPWQSFVNAENQRFISDEAIDFLDKLLRYDHAVSLLNASPQRISRXPAFRNRLTAQEAMAHPYFAQIRAEEAA

SEQ ID NO: 12558 - protein, 446 aa, Aspergillus nidulans
  unsure (1)..(446): unsure at all Xaa locations
FLDIDLKYYDLVCLECLSPIFSALILLXGLEYRDQTDDKVTTESAEAIKKYGVGVKCATITPDEARVEEFKLKKSKHYMLTARKSXLTKQPXVWLSPNGTIRNILYVTFTFXNPLLLQCADTIKWGTVFREPIVIPRIPRLVPGWTKPIIIGRHAFGDQYRATDRVIPGPGKLELVYTPEGGQPEAIKVFDFPGGGVTQTQYNTDESIRGFAHASFKLALTKGLPLYMSTKNTILKKYDGRFKDIFQEIFESDYKKEFDAKGIWYEHRLIDDMVAQMIKSEGGFIMALKSECIXNSXCCRRLTPLDYDGDVQSDIVAQGFGSLGLMTSTLITPDGQAFESEAAHGTVTRHYREHQKGRETSTNPIASIFAWTRGLIQRGKLDETPDVVKFAEELERACIDVVNEEGIMTKDLALSCGRKERDAWVTTREYMAAVERRLRANLKARL

SEQ ID NO: 12559 - protein, 509 aa, Aspergillus nidulans
  unsure (1)..(509): unsure at all Xaa locations
KNFLTEETLALLVKLAKQAGVEELRDQMFAGEPINFTENRAVYHAALRNVSNQPMQVNGKSVVEDVNSVLEHMKEFSEQVRSGEWKGYTGKKINTIINIGIGGSDLXVLSPESAAMIFXRAHQGPVMVTEALKPYGHPDLKLHFVSNIDGTHIAEALKDSDPETTLFLIASKTFTTAETTTNANTAKSWFLEHAKDGAHIAKHFVALSTNAEEVAKFGIDTKNMFGFESWVGGRYSVWSAIGLSVALYIGYDNFHQFLAGAHAMDKHFRETPLEQNIPVLGRLLSVWYSDFFGAQTHLVAPFDQYLHRFPAYLQQLSMESNGKAITRTGEYVKYTTGPVLFGEPATNAQHSFFQLLHQGTKLIPADFIMAAESHNPVEGGKHQRMLASNFLAQSEALMVGKTPEQVKAEGAADNLVPHKTFLGNRPTTSILAQKITPAALGALITYYEHLTFTEGAIWNINSFDQWGVELGKVLAKKIQKELETEGEGSGHDSSTSGLLLAFKKKAKLA

SEQ ID NO: 12560 - protein, 1080 aa, Aspergillus nidulans
  unsure (1)..(1080): unsure at all Xaa locations
GQEGDNDFSGNKYVWLRDPEKAFVKGLVLEEQDGARLLVQTDDGQVXATGAKVIRILTICKQREVDVDQVDRVNPAKFDKADDMAELTHLNEASVVHNLHTRYLADLIYVRLYLSSACCQSLIDNTLLTYSGLFLVTVNPYCPLPIYSNEYINMYKGQSREETRPHIFAMADEAFRNLVEEGENQSILVTXVFATHPCKCKFXRPHRGESGAGKTDNTKKVIQYLAAVATSDNMYSRSGSKQMNTLSQQILRANPILEAFGNSQTVRNNNSSRFGKFIRIEFSRSGQISGASIDWYLLEKSRVVKPNLQERNYHIFYQLLRGAEPKLKQKLLLSNLQIEDFAYTREGNDTIAGVSDEKEWDSLLEAFHIMNFSEEDQMCILRTVAAVLHLGNITIVKESLRADQAALSRDALDSVHKACQLLGIETEPFVKGLLHPKVKAGREWVEKVQTPEQVRLALDALAKGIYERGFGDLVNRINSRLERNTVTGEDSYFIGVLDIAGFEIFQNNSFEQLCINYTNEKLQQFFNHHMFVLEQEEYAREQIEWQFIDFGKDLQPTIDLIEVTNPIGIFSCLDEDCVMPKATDKSFTEKLHSLWDTKSTKYRASRLRQGFILTHYAAEVEYSTDGWLEKNKDPLNDNITRLLASSQDNHIAALFSDCGNADEVDHPRSRVKKGLFRTVAQRHKEQLSSLMNQLHSTHPHFVRCIIPNHKKRPKMLNAPLVLDQLRCNGVLEGIRIARTGFPNRLSFNEFRQRYEVLCRDMPKSYMDGQSAARIMLQKLALDKAWFRVGRTKVFFRAGVLAELEEKRDELIRTIMTRFQSVARGFVQRRISNKRLYRAEATHIIQHNFRAYLEMKANPWWRLFSRMKPLLGETRTAQEVKRRDEKIKQLETKMKQDQSERQKVEEERRRAEIEIQRIQQTLESERALALDKEEIFKRLQDREVELSEKLAGAIADQENLEDQLDELILAKKKTDEELDLRKTQLEQAGEIIQRLEAERKEMQQKLEDLEQKLLEAQSSASETENHMRELGQEVKMLQSHLSLKERKLQDLEAKLLKTDQDLDVKLAKTSKELDRSKKEVK

SEQ ID NO: 12561 - protein, 371 aa, Aspergillus nidulans
  unsure (1)..(371): unsure at all Xaa locations
HPSFIQVAKPYIFEQTIQQCLAAMGVNPLREESLRLQGVTWIDNVRRALNLYVDHSINCESCLLMRXPIRTFNTAVVYYHKFRLIHHDTDYNNMVRFLTFSFCXPSLTVKDAAAAALFMACKIEDTLKKSREILCAAYNLKLPQSEHISSDNQVWCLFQQCLATECXHRVXXILDEPARGIIGLERLMLESSGFDFRTRHPQKTLIKLARQYRLTPQSEVSNVAYRISQDLYRTFAPLKQTTSTMAFSCLELAGRLLEQRIKEVELGQTTRDGEQAGRRLWVRRSHKEAIRGLMDLETLLDLLELYTHNRSATTVGPHFPADRFLTVRIPLNKEAEEQNLPRYTNSIDEDKTHKGLAQGTSNQQLKDGKRS

SEQ ID NO: 12562 - protein, 294 aa, Aspergillus nidulans
  unsure (1)..(294): unsure at all Xaa locations
MHGLTPAPVTPFTPTGEIDYDAIQRLGSWLSSMNGVKGLVVLGHAGEGTFLTAEEQVAVIKAFVKSVDDKIPIIAGITGEGTEVAALEAHAXKLLGRNGPSVSISGWLRFGYQDGAPQDRYRRVYEVSNLPLILFQYPDNTKATYSLQTMLDIAAQPGVFAMKNGVRNMRRWDTEIPVIRRERPDLQILSCHDEYLLHTAFDVDGFLVGYGNIAPEPLIELIEAGKAKDYRRARAIHDRLLPVTKSVYHRGSHMEGTVALKHALVARGILSHATVRSPLRPLEAGAEQEIHAAI

SEQ ID NO: 12563 - protein, 426 aa, Aspergillus nidulans
  unsure (1)..(426): unsure at all Xaa locations
FATLAVHAGAPHDPTTGAVIAPVSLRFXDFPFCLDQRXLXQISLSTTFAQESVGKPVGLYEYTRSSNPNRSVQDFKLKIQLNTDFSQRNFEEAVASLEHAKYALAFSSGSATTATILHSLAPGSHVVSVSDVYGGTHRYFTKVAAAHGVNVSFSSCLELDVEKLIRPNETKLVWIETPSNPTLALVDIRKVAAVAHRHGVLVVVDNTFMSPYVQNPLDHGADVVIHSVTKYINGHSVSHLVSGPFTRVLTIRXDVLMGVAAFNSDELKERFTFLQNAIGAVPSPFDCWLAHRGLKTLHLRAREATANATAVALALESSPHVISVNYPGLNSHPNREIAVKQHRKGMGGGMLSFRIKGGHKAAHLFCEYTKIFTLAESLGGVESLCEVPSSMTHAGIPKEEREAAGVYDDLVRMSCGIEDVEDLTAD

SEQ ID NO: 12564 - protein, 400 aa, Aspergillus nidulans
  unsure (1)..(400): unsure at all Xaa locations
GXRWIQLRSXSKQXNSNLNTSTDGYCYASAATNVQTGEGVAIKKVTNVFSKKILAKRALREIKLLQHFRGHRNVMSYQRLLHTGQMRLTWVQITCLYDMDIPRPDNFNETYLYRRLEHWSPIGRSLVTDTLIRPELMECDLAAIIRSGQPLTDAHYQSFIYQILCGLKYIHSANVLHRDLKPGNLLVNADCELKICDFGLARGFSIDPEENAGYMTEYVATRWYRAPEIMLSFQSYTKAXYVPSRCFELXPSXRDAVDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVR

SEQ ID NO: 12565 - protein, 376 aa, Aspergillus nidulans
  unsure (1)..(376): unsure at all Xaa locations
LFSLVGAALCAPREHFKRTARTSAPAGCLTVGGSGTYSTIGAAFAALGSSSSEACIYISAGTYKEQLTFQYAGPLTLYGETTDTSSYKKNTVTITHTISSPEAGSLVASATVNAAMDNFTMYNINVVNGYGKGAQAVAXGFFHLHFIFISNFQFHTILLILFLFXRMYHTAADAYFCRLAASGERQGYYGCQFLGYQDTLYARVGVQYYSNCYIEGYRPLNSFSTLREQHXTSTGAVDYIFGDASAWFGECDIVSNGAGYITAMSRETASDPAWYCFDHCNIYGKSGLDLTGDVYLGRPWRVLARVIYQNSELSDIINAAGWTTMAEGATPLYYEIGNTGDGADTSKRLYLSEISAAVTKATVLGSDWTDWLDWSY

SEQ ID NO: 12566 - protein, 259 aa, Aspergillus nidulans
  unsure (1)..(259): unsure at all Xaa locations
EATTWQSRMTLFIAHGNDSQRGHIVAAAKFGFALVNRNTGELSYIARPWDEPDLLRRXVELCSVNRTSSXPIXQNRFNDGAVDSKGRLWAGAMNDPKVQSLINEGVLFRLDPDLKLSRMVEQLTIPNGIGWNSANDTMYLTDSPTGKIFAFDFDESTGEISNRRVHFDTGEPKEPDGFAIDSEGCIWSAIYGGGKVIRIDTQGKVIGEISLPTRNITCPAFVGTELFITTAKDDKNDDKFPESIRYGGHLYKVDVGVRG

SEQ ID NO: 12567 - protein, 363 aa, Aspergillus nidulans
GTFSTVYKAEDLLYDHYRNDWDVFQDTPRDESTNSPSKRRRVEDENGNTIPIRRTKPRYVALKKIYVTSSPLRIQNELELLHDLRGCRSVCPLITAFRHHDQVVAVLPFFPHTDFRLQYRTFMVADMRHYFRSLFTALHSVHKHNILHRDIKPTNFLYNPDLREGVLVDFGLAEREGSEYTGTCLCTSTSHIRRARYTQSYHYTHCASSGLAIGYPKSDSRPSRRANRAGTRGFRAPEVLFKCTSQTTKIDMWSAGVILLTLLGRRFPFFNSADDVDALIEMASIFGTRRMKNAAAMHGQIFETNIPTIGEKGYSWEKLVKWSSCVEELTESEKQATRLLAGLMELDPSKRLNAKEAMQHEFF

SEQ ID NO: 12568 - protein, 358 aa, Aspergillus nidulans
AGILVYSVIVNFMCGHVRNAGAFFTFVLLIYTGYINMSVIFRTIGCLSPAFDHAMNFVSVLITLFILTSGYLVQWPNAQVWLRWFYYINPFGLGFASLMVNEFKSLNMTCTSESLIPNGDGYTDMNHQVCTLAGGEAGSPIIPGQSYLSTTFNYNREDLWRNFGIMVALIIAFLGMNLYFGEVVRFNAGGKTVTFYQKENAGRKKLNKALDEKRAARQSNDLGGPGADILLTSKPVLTWEDVCYDVPVPSGTRRLLHNIYGYVQPGKLTALMGASGAGKTTLLDVLAARKNIGVISGDILVDGAKHGTSFQRGTSYAEQMDVHEPMQTVREALRFSADLRQSYDVPQSEKYAYVKSFL

SEQ ID NO: 12569 - protein, 516 aa, Aspergillus nidulans
  unsure (1)..(516): unsure at all Xaa locations
MPISKIHARSVYDSRGNPTVEVDVVTETGLHRAIVPSGASTGVXPIEHASIDEKQTFLTSIAGQHEAHELRDGDKSKWLGKGTFATTPTSLIRDGDLXQWFSNRVLTAVKNVNETIGPAVIKENLDVKEQSKIDEFLNKLDGTPNKSNLGANAILGVSLAIAKAGAAEKGVPLYAHISDLAGTKKPYVLPVPFQNVLNGGSHAGGRLAFQEFMIVPEXVSCRPFAFVQVYXHMESTASSFSEGLRQGAEVYHKLKALAKKKYGQSAGNVGDEGGVAPDIQTAEEALDLITEAIEQAGYTGKIHIAMDVASSEFYKPEEKKYDLDFKNPDSDPSKWLTYEQLADLYKSLAAKYPIVSIEDPFAEDDWEAWSYFYKTSDFQIVGYVLQSAFSXXLIXLVNSDDLTVTNPLRIKKAIELKSCNALLLKVNQIGTLTESIQAAKDSYADGWGVMVSHRSGETEDVTIADISVGLRSGQIKTGAPARSERLAKLNQILRIEEELGEDAVYACQNFRSLVTL

SEQ ID NO: 12570 - protein, 236 aa, Aspergillus nidulans
  unsure (1)..(236): unsure at all Xaa locations
GIGLAITKYLLSAPQSHNVVVIARSVEPLQALKNEYKDQVAILNGDISDFSLATRAVELALKSFGRIDGLVLNHGILGQVGKIATANIEEWKKGYDVNFFSLVSFVQAALPKLRESKGKIVFTSSGAAVSAYRGWGLYGSTKAAMNHLALSLGEEEPDVTSIFIRPGMVDTEMQRELREDHAPPLEPQVHSKFTTVHNEGKLLKPEQPGHVMAKLVLDAPKELSGKFLSXVSAQIA

SEQ ID NO: 12571 - protein, 332 aa, Aspergillus nidulans
  unsure (1)..(332): unsure at all Xaa locations
SKVPQPGPAKLKRNAGPDEWLEAAKDCKYLSESHMKQLCEIVKEYMMEGAFCASXLKLFSDAEICASAXESNIQPVSTPVTVCGDIHGQFYDLLELFRVSGGMPDASLAEPPKTSSAVITSDDIEPPTTITDPELRKKLGKPGTAGDDDDDDDDNNENAGQKEKSSSSGTSEIAVNRNFVFLGDYVDRGYFSLETLTLLLCLKAKFVIQTVFDMGVADYXRYPDRVTLVRGNHESRQITQVYGFYEECLQKYGNASVWKACCQVFDFMTLGAIIDGRVLCVHGGLSPEIRTLDQVRVVARAQEIPHEGAFCDLVWSDPDDVETWAVSPRGAG

SEQ ID NO: 12572 - protein, 513 aa, Aspergillus nidulans
  unsure (1)..(513): unsure at all Xaa locations
QRRLGNRQIQLIAIGGSIGTATFVSIGGGLAKGGSGSLLISWFIHCCFLAMVNNCLTEMSVYQPVEGGFIRLAGKWVDDAWGFMAGWNFFLYEALLIPFEITAINVVLTYWRDDFPCGVFVXHVLXSMGTFARSLRXSLTKDXPARLLNILAVRAYGEAEFWLSGGKVILILMLFAFTFVTMVGGNPQHDVYGFRNWNKPGAFAEYLSHGNLGRFEGFLACLWSAGFACVGPEYISMVAAEAKHPRRYIRAAFQTVYFRFIVFFIGSALCCGIVVSYADPTLRAIHFGDGEGSGTAAASPYVIAMKNMSIEGLPHVVNALLITSIFSAGNTYTYTATRILHSLALEGRAPRILRKCTKQGVPIYCFLVVMIFPFLSFLQMGDSSSTVLTWLTNIITAAGLINYVIITLTYIFFYRATVAQGFDRSTLPYTGWFQPYCGYLGFAWMFTVVCCFGYESFTPWSVETFFTNYTMVLLAPVLFLGWKLVKRTRFVTPLETDLIWEAPEIDLYEEELS

SEQ ID NO: 12573 - protein, 615 aa, Aspergillus nidulans
  unsure (1)..(615): unsure at all Xaa locations
KHFFSDPTHLVHTALNSLTLTNPSLAFDRENKIIFRRPDVVRKGKVAIISGGGSGHEPAFAGFVGQGLLDASAAGTIFASPNAEQIRIAAMERVNNEQGVLIIPMNYTGDVLNFGMAAEKSRAAGIKTEFFAINDDAGVGKTKGGKVGRRGIGGGVLILKIVGALAEAGXVVSLLGTDEILTSCSGSLEEVYKTAQLANENLASVGSSLEHVHVPGREPSDDHIPEGEVEIGMGIHNEPGSTRTKTTLVDLVATMLLQILDHNDPDRSYITHSPGDKFVLLVNNLGGLSTLELSGITDEVYRQLGKSYQIKPERVIQGTFLTSLNGLGFSISLLKLADTGLGPGKSFLELLDAPAEAVGWSAPIKPATWEYRNAPELKSREPSQPSSLPATSSVRPVPPFIDTCXQYTVDIAKVRKVLGAALKRMIDAEPQITRYDTIVGDGDCGVGLKRGAQAVLDLLNDASANLNDDIVHTVNRIVTVVENTMDGTSGAIYAIFLNALVHGLREQDKGTETPADTDVWGTALKYSISALGKYTPAQVGDRTMIDALVPFAQTLADKRDVHAAAKAAEEGTEATKHMKASLGRAVYVGGEQEWVGKVPDPGAYGLSEFFTGLAG

SEQ ID NO: 12574 - protein, 338 aa, Aspergillus nidulans
  unsure (1)..(338): unsure at all Xaa locations
DVVRMIRRVVTTRSSSSSAGNSANSWSLGRMAVVASLAAGIGYGIGNSDQLLEPKDAGTPRYGTAKDFEKVQTRTQYGYCEMLLTIAFVVXAIAELQVKLGEDAISTDEDDLQRHGFSEWSSVNAQRLPVAIAYPSSTEDVSEIAKICNKYKMPMVPYSGGSSLEANFSAAYGGLTIDFAYMNKILDLHEADMDVVVQPSIQWMDLNEKIKDTGLFFPVDPGPSAMIGGMIGTNCSGTNAVRYGTIKDWVINLTAVLADGTAMKTRRRTRKTPVGYNPTGLVGGVKGTFGLAPKLPLRLPLIPTENGLAVVSFLTMRDDASTGTTXKGKGLPARGMEI

SEQ ID NO: 12575 - protein, 502 aa, Aspergillus nidulans
  unsure (1)..(502): unsure at all Xaa locations
LSPSTGKVFFEQPRRHGRTVRQIAQACEDAFRTYRKLSLDQRKAIVVKALEIIDANKETLAHELTTQMGRPISYTAGEVDTMRKRANYLIDQAEDALKTIPGQEENGFKRFVKKAPVGPVLLATAWNVSCPRLSEGLEANRSVPYLITINALVPALLAGNTVILRPSPQTPLVGDRLSEYFEKAGLPKNVLQVVHLGSWDVLDEVVKIPQIKLVSFVGSTQGGLRLRQATAGRILPLNLELGGNDPAYVRADADLAYTAAQVVDGAVFNSGQSCCSIERIYVHADVHDAFVAEVRKELATYVLSPXIKNIINECRYKLGDPLDKATTTGPVISHQAVKNIQAHIDDALSRGAVDSTPENPTFAKIPSEGSFIAPRVLTNVSHDMRVMREETFGPVVPIMKVQSDDEAVALMNDSDYGLTASVWTKDIKAGEDLIERIEAGTVFINRCDYPSPVRGKTHYASNMILTANQDLAWIGWKSSGLGCSLGPQAFDAFYKLKSFHIR

SEQ ID NO: 12576 - protein, 910 aa, Aspergillus nidulans
  unsure (1)..(910): unsure at all Xaa locations
DDREQDIDDLIDELESQDGLHDNPSRKSMDSGSRIPGMEAQFDTDITTGLTSVEAAQRRKKYGPNQLKEEKENMLKKFLSFFVGPVQFVMEGQXQSSFCPTSIIADADWSXGAAILAIGLRDWVDFGVICALLLLNATVGFIQEYQAGSIVEELKKSLALKAIVVRDGRVTDIDATEVVPGDVLKIDEVLPILWLIEDGEGXLLAGHIVPADGRVKTNHLLQIDQSSVTGESLAVNKCKGEVCYASSVVKRGHAYLVVTATGDYTFMGKTAALVKSASSNSGHFTEVLNRIGATLLVLVVLTLIVVWVSSFYRSNETVTILEFTLAITMIGVPVGLPAVVTTTMAVGAAYLAKRQAIVQRLSAIESLAGVEVLCSDKTGTLTKNKLTLSDPYTVAGVDPNDLMLTACLAASRKLKGMDAIDKAFIKALPNYPRAKEALSHYKIQQFHPFDPVSKKVTAVVLSPEGQEIICVKGAPLWVLKTVSEEQQIPESVEKGYSDKMDEFAQRGFRSLGVARKPAGGEWEILGIVPCSDPPRDDTAATINEAKTLGLSIKMLTGDAVPIARETSRELGLGTNVYNSDKLGLGGGGDLTGSELYNYVEAADGFAEVWPQHKYNVVDILQQRGYLVAMTGDGVNDAPSLKKADTGIAVEGASDAARSAADIVFLAPGLSAIIDALKTSRQIFHRMHAYVIYRIALSLHLEIFLGLWIAIMNESLNLQLVVFIAIFADIATLAIAYDNAPYSKTPVKWNLPKLWGLSVILGIVLAVGTWIALTTMMNAGEHAGIVQNYGKRDEVLFLEISLTENWLIFITRANGPFWSSLPSWQLAAAIFVVDLVASFFCYFGWFVGGQTSIVAIVRIWVFSLGVFCVMGGVYFLLQRSQTFDDIMHFNFLQKRDSVSQRVLDDLGKLLQ

SEQ ID NO: 12577 - protein, 461 aa, Aspergillus nidulans
RFPGAVNSKFTTEMAFINPMDKPGIPTYRVMDSDGVLIDKSRSELSVSNEEALAWYRNMLTGGFWVYIPISLFSALMGMRYTVSIMDVIMFEAQRQGRLSFYMVRDLFLALEGQFLLMRYILERSSAGEEGISVGSAAALTPDDVVFAQYRETGVFQQRGFALKNFMSQLFANANDNGRGRNMPVHYGCEYPKTVLSIPPPFDEVHTDKLTQHTISSTLATQIPQASGAAYALKLQALQNPDTPPRIVACYFGEGAASEGDFHAGLNIAATRSCPVVFICRNNGYAISTPTLEQYRGDGIASRGVGYGIDTIRVDGNDIFAVYEAMKAARTLALSQGGKPVLIEAMSYRVSHHSTSDDSFAYRARVEVEDWKRRDNPIIRLRKWLENEGIWNEDMERQARESIRKEVLREFGEAERAKKPAIRFAFEDVYDEVTEEAREQMKELRRILEEYPEEYDLRSFE

SEQ ID NO: 12578 - protein, 363 aa, Aspergillus nidulans
  unsure (1)..(363): unsure at all Xaa locations
NLSFVLEGIHRVKFEDRPIPKLKSPHDVIVNVKYTGICGSDVCTXPQTTGTIGLTHQVHYWDHGAIGQFVVKEPMVLGHESSGIVTQIGSAVTSLKVGDHVAMEPGIPCRRCEPCKAGKYNLCEKMAFAATPPYDGTLAKYYTLPEDFCYKLPESISLPEGALMEPLGVAVHIVRQANVTPGQTVVVFGAGPVGLLCCAVAKAFGAIRIIAVDIQKPRLDFAKKFAATATFEPSKAPATENATRMIAENDLGRGADVAIDASGVEPSVHTGIHVLRPGGTYVQGGMGRSEMNFPIMAACTKELNIKGSFRYGSGDYKLAVQLVASGQINVKELITGIVKFEDAEQAFKDVKTGKGIKTLIAGP

SEQ ID NO: 12579 - protein, 425 aa, Aspergillus nidulans
LREALRRREDKLCRRKLTILPSSSVDFSSNDFLSLSTSPAYRARFLDILQQAPPLHPFASGGSRLLDGNSAYAEELENFIAAFHNAPSGLLFNSGYDANVGVFSSIPQPGDLIVYDELIHASAHEGMRLSRAGKRIKFPHSSPDGLRAVLQAEITADPRLLQGRRNVFIAFESVYSMDGDVAPIREFVEIVDQLLPYGNGYFLVDEAHATGVFGPRGSGVVQELGLEDRMFVRVHTFGKALASHGGSLARCLWVSILTVLLAIVLCCADTRDYLINYARSLIYTTALGFPFLASIRAAYELSLREKLSRYGPSLEEATFHYRPMGKLTNIQLQHKLGQLIAHFRTGLDNLNHKDSSTFEVEHFTNSPIFSLRSSVPRVLASVCQEQGYTVRAIMPPTVPAGKERVRVCLHAGNTVEEVDGLLETI

SEQ ID NO: 12580 - protein, 1006 aa, Aspergillus nidulans
  unsure (1)..(1006): unsure at all Xaa locations
LLVLGRPGSGCTSFLRVLSNDRESFDEVTGETWYGSMDHTAAKKYRQQIMFNTEDDVHFPTLTVNRTMKFALRNKVPRQGEEGPGEKEFVLRERDSILNSLGILHTKKTLVGNEFVRGVSGGERKRVSLAEVMAGQVYQPTVTRMEVHTDFVRCTESVQFWDNPTRGLDSKTAAEFAGMIRREAYENGKTIVCTTYQAGNDIYDKFDKVLVLAEGLVTYYGPRSQARSYFEDLGFVFPKGANVADFLTSVTVLTERIVAPGMEEKVPNTPQEFEARYRASAIYQEAVDVIIPPEKLASEEEDLATAVAREKGKGHIPRPPSVYTTGLWAQIIACMIRSFPSHSRSPCXQVRQFQIMAGDKFSLIIKLASSIIQALVCGSLFYNLQMDSSSIFLRPGALFFPCLYYLLESMSETTSSFMGRPIFSRHKRFGFYRPTAFCIANAITDIPITILQVSCFSLILYFMSALQMEAGKFFTFWIIIIANTLCCMQMFRAVGALCKRFGLASQLTGLISTIGFVYGGKIPEXYAASVXLGLTCNSGYLIPFSKMHPWFRWIFYLNPCSYAFEAIMANEFTGLELQCVEPNYIPYGPGYSDTSSSNRGCSAQEAKATXSQEAAYIREQYSYLPGFIWRSFGVLVGLWVFFIFLTAVGFEKLNSQGGSSVLLYKRGSNPSCQNERPATAANREMALAQSGKQSIFTWNKLDYHVPFHGQKKQLLDQVFGFVKPGNLVALMGCSGAGKTTCVXRIHHYLLGYXPFTRLLDVLAQRKDIGEVRGSILIDGRPQGISFQRLTGYCEQMDVHEGTSTVREALIFSAFLRQPSSVPEEEKLAYVDHIIDLLELYDIRDALIGSKLFMDXKAGKTLTCTAPGAGLSIEQRKRVTLGVELVAKPTLLFLDEPTSGLDGQSAYNSXYAXYHSLVRVLTTEVIRFLRKLVDGGQAVLCTIHQPSAVLFDAFDSLLLLAKGGRLAYFGESRIPSPTYRPKALTRLAGKDSEKVLEYFAGIXPPCP

SEQ ID NO: 12581 - protein, 347 aa, Aspergillus nidulans
  unsure (1)..(347): unsure at all Xaa locations
ETPPYEFEELIGKGAYGRVYKGHQLPSREVVAIKVLDIDSLDYKSVRDFKDESIKDFIHETKVMKQVKDAGAKNINEIIEAVSIHSQLWLVCEYCPGGSCXDFGRLLQTWTCELLLNVQMRATGDRLEERFAIPVARELAAGLRAIHDAGIIHRDIKGVNAMLHDLVXTLANSDTSCNVLIHEEGRLQICDFGVAGVLQSQMDKRSTWIGTPHWMPPEMFTAKQDHQYSSEVRTLILVIYCHXQPQVDVWAYGCTLFELATGNPPNANLRERMQIGRQLNRKTPQLADGGEYPEGLRDLVAYALNSDPVTRPSMADILLHPYIANSEEEYPTSSLSELVRIYYQWSQ

SEQ ID NO: 12582 - protein, 302 aa, Aspergillus nidulans
VKAKKLGEGTYAVVYLGHVRSDPTSFVAIKKIKVNTEYRDGLSMDAIREVKYLQELSHPNVIALHDVFSSKDQNLNLVLEYLPRGDLEMLIKDSDIHYGAADVKAWMGMLIRGVWFCHENFVLHRDIKPNNLLIASDGEVKLADFGLARSFADPYMNMTHQVITRWYRPPELLYGARQYSGAVDIWSVGMVFAELLLRVPFVAGNSDLDQISKICEAFGTPTEESWPGVSKLPNYIPADNNIPLQGREFFLRQFPTAGPVGADLLMSMCTLDPRRRTTAHQALQHRWWTTEPRPTNKQDLPQ

SEQ ID NO: 12583 - protein, 329 aa, Aspergillus nidulans
FDFIVCGGGTAGLAIAARLSEISNVNVGIVEAGKYRIGDPLIETPATFMQMFEDPEYDWCLFTAPQEANNGKVHHIPRGKVLGGSSAINYLMYVRGSLQDYDDWAALVGDEGWSAANMKAYMRKHQARNTFANPSYEISLTLPFLDPRTGQSRVQGAASPIAPEHHGTTGPIRTSFNESNLPIETDFVKACAETANLPNMPIDAWSGEPYRFYHTLGAVARTGPNRWKRSYSWIEYYEANRLRPNLKLFCEARVNKDILNGTRATGVSITFRGQEYTVYARCEVIVFGGTIQSPQILELSGIGDPEGLAASGVQSMLENPADGANVQDH

SEQ ID NO: 12584 - protein, 374 aa, Aspergillus nidulans
  unsure (1)..(374): unsure at all Xaa locations
PHQSEPEEYWDDDDEENEEDDYITARSYRSRSENTTGGATTLLFPRYNQQVKRELALAKQIVEATRTVEDIEDDYCDTSMVAEYSEEIFEYIREQEVCTDIRNYQTGLSSQYLCRSRMLPNAHYMDNQAEIQWSMRSVLMDWLVQVHHRFSLLPETLFLCVNYIDRFLSCKIVSLGKLQLVGATAIFIAAKYEEINCPSVQEIVYMVDGGYTVDEILKAERFMLSMLQFELGFSGPMSFLRIISKADHYYLETWPPAKYFLEVTIMDERFVGSPASFLAAGAHCLARLMLKKGTWVCFLXSVYVYVTDDSLVSAHVHYAGYTYSQLYPLVSLIVECCEMPRKHHSAIYDKYNDRRFKLASAYVEAEMRKNFRLP

SEQ ID NO: 12585 - protein, 489 aa, Aspergillus nidulans
  unsure (1)..(489): unsure at all Xaa locations
TKSGCLSNVADNVFAAIKKDFPKLVWTVKEGDENLTWFFDKADGSLSRDGEVLFWYGVESSDEVKLLVQEFTQHGRQMFGDINLESRLQRAAHAAANIGKPLGAAAGQKRTFSTASNALRSARFGRPSVPVQTVRTYATTNPNPPLGEKNNSNTKPSKVALIGARGYTGQALINLINAHPHLDLRHVSSRELAGKKLQGYDKREIIYENLSPEDVKRMSSNGDVDCWVMALPNGVCKPFVDAVDQGAKDGNVIIDLSADYRFDENXAYGLPELVSRSKIAQATRIANPGCYATGTQVAIAPIVPHLGGQPTVFGVSGYSGAGTKPSPKNDVQNLTNNIIPYSLTDHIHEREISSQLGTPIAFMPHVAVWFQGIHLTINIPLKETMSSRDIRNIYQDRYAGEKLVKIVGEPPVVKNIAGRHGVEVGGFAVHSKENRVVVCATIDNLLKGAATQCLRKSPHISPSALGPTNIRRTENMNLALGYSEYEGIP

SEQ ID NO: 12586 - protein, 419 aa, Aspergillus nidulans
  unsure (1)..(419): unsure at all Xaa locations
DMSGEQMQAKITAARREAEGLKDKIRRRKDDLADTTCTKIPFVSLHSVVENGHLYRVCHPTVSGELLTRANXTVRDVAQNQTDALPRIGMKPRRTLKGHLAKIYAMHWSTDRRHLVSASQDGKLIIWDAYTTNKVHAIPLRSSWVMTCAYAPSGNYVACGGLDNICSIYNLSSREGPTRVARELSGHSGYLSCCRFINDRRIITSSGDMTCMLWDIESGSKVTEFADHLGDVMSISINPTNQNIFVSGACDAFAKLWDIRTGKAVQTFAGHESDINAIQFFPDGNAFGTGSDDTTCRLFDIRADRSLNTYQVRPGCHTHCRTVLLTNATSDQILCGITSVGFSVSGRLLFAGYDDFECKVCSVLDACDSGDGDXPMNRSWDVLRGDKVGSLSGHENRVSCLGVSNDGISLCTGSWDSLV

SEQ ID NO: 12587 - protein, 310 aa, Aspergillus nidulans
  unsure (1)..(310): unsure at all Xaa locations
EGFPLRSWSIEVYLLNEHGEQVPANVFDKVTYSLHPSFGNRATQGQSLSLXASVVFIPCFYPDSHYRESSDDKRNILDYYSXGXPGTIVFKNPPFRIQEEGWGEFDMQIGLTAADNKEHFIAHDLNFAQSRYESKHVIVRLDCFQTRLLCHICLHLLXTFKNPKPALLAALRESGPVPGDENGVKSKRSAGGEEGSKKKKRTDKSVSQXKYRDXNVDVXHSYSQVDMDKLADGLQRLGEDDLLQVVQMVHDNKAPDSYTKNDVERKSSIPVRSSPKNQPLTTSNRREFHVDLYTLPDPLIKMLWEFTQEK

SEQ ID NO: 12588 - protein, 190 aa, Aspergillus nidulans
  unsure (1)..(190): unsure at all Xaa locations
EVCPVCKSSRYLNPDMRFLINPECYHKMCESCVDRIFSGGPANCPVAGCHKTLRKQRFRKQTFEDINVEREVDIRRRVMTVXVVLLSASPLSANHAXLNRREEEFDSKLDWDNFLEQREEIIFNLVNRIDVAKTEADLQSYASENMKSIRANQALEAKEVSSFQERQNQEQELARLRRQAAKEEYENERK

SEQ ID NO: 12589 - protein, 160 aa, Aspergillus nidulans
  unsure (1)..(160): unsure at all Xaa locations
IPTIGFNTKRVQKGHVTLKWFVNLHSSRASLXPPQWDLGGQPRFRPMWERYCRGVNAIVXDRYRXLIATLLTSDSYIVDAADRAALPVATEELHELMNKPTLDGIPLLVLGNKSDLPNKLSVDDLIEQMNLKSITRREVSCYGISAKEETNLDAVLHWLI

SEQ ID NO: 12590 - protein, 405 aa, Aspergillus nidulans
  unsure (1)..(405): unsure at all Xaa locations
FKDYFNQPSRAEIGTVVAILEVGAFISSLLVGKIGDLIGRRRTILYGSMVFFVGGAFQTFATGLPMMMLGRIVAGLGVGALSTIVPVYQSEISVQLPSSPXSRRLLWTMLIFDHQPPHNRGKLACIEFTGNIFGYAASVWVDYFCSFIRSDFSWRLPLLLQCIMGFLLGLGSLIICESPRXGLYXFSKTRNSXNWLXRSPXLXWLLDNDHDEEGMVVIANLYGKGDLHNPEAQREYREIKMNVLITRQEGERSYVDMFKRYNRRVLIAMSAQALAQLNGINVISYYAPLVFESAGWAGRDAILMTGINGLTYLASTVPPWYLVDGXERRPILLSGALAIVLSLWAISYFIFIHIEATPSLTVIFVMICNAAFGASCGPIPWLYPPDILPLGFRTKGPSLSAATQW

SEQ ID NO: 12591 - protein, 1105 aa, Aspergillus nidulans
  unsure (1)..(1105): unsure at all Xaa locations
EIVIDKTAFFNRLSSFYAAWKADKRSTNSVFGGAGSIIILMGKTDEANSYQKNNAIHVCCLRRRLLIISTDTFSFWLLGYEFPATLFVFTPEVMYVVTTAKKGITXSEQGIAQESSLPNFMTAKHLEPLKGGKIPVEILVTTKDQEEKTRLFEKCVDIIKSAGVCFLSCPGIKMTMRGSLTSDANKLSANRNKVGILPRDTTTGPFVEDWKRVYGKISGDVEEVDISPALSAACFSVKDTDELVRSIHLQRRXKWSKVLQVSIRNASRACSGLMSDYFVDEMSRLLDEEKQMTHKALSMRIDAKIDDAKFFNKLAKLPSEFDPQQIDWAYGPVIQSGGKYDLKLTAVSDDNNLEPGIIIAGFGIRYKTYSSIIGRTYLVDPTKSQEANYSLLLSVHEAVLKEARDGVVAKELYNKAIGIVRARKPELESHFVKNVGAGIGIELRDSNMILNGKNTRVLKSGMTFSITVGLVDVEEPSVKDKKKNVYSMMITDTVRVGEQGPHVFTKDAGIDMDSVSFYFGDEEEPQKPAKEKKETKSSAIASRNVTRTKLRAERPTQVNEGAEARRREHQKELAAKKTKEGLDRFAGTTGDDNGVTQKKFKRFESYKRDNQLPAKVKDLTVYVDHKASTVIVPVMGRPVPFHINTIKNASKSDEGEYAYLRINFLSPGQGVGRKDDQPFEDLSAHFLRNLTLRSKDNDRFAQVAQDITELRKNALRREQEKKEMEDVVEQDKLVEIRSLSPFYDICFXNXSRVRSSPVKLPDVYLRPPLDGKRVPGEVEIHQNGLRYVSPFRNEHVDVLFSNVKHLFFQPCAHELIVLIHVHLKTPIMIGKRKTRDIQFYREATEMQFDETGNRRRKHRYGDEEEFEAEQEERRRRAALDREFKAFAEKIADAGKDEGVDVDIPFREIGFTGVPNRSNVLIQPTTDALVQLTEPPFLVISLNEIEIAHLERVQVSXHRYSSHSGGDXNAVQFGLKNFDLVFVFKDFHRAPVHINTIPVENLEGVKDWLDSVDIAYTEGPLNLNWTTIMKTVVSDPYGFFADGGWSFLAAESDSEDGSDEEEESAFELSESELAADESSEEDRDYDDDASADDDFSADEDESDRTG

SEQ ID NO: 12592 - protein, 487 aa, Aspergillus nidulans
  unsure (1)..(487): unsure at all Xaa locations
GTANNTNHLNGHSSNGSKKMATRKTAIYRHAVAVHSQVQHSCLSRDSTKATSFIGFRNLMVVVLGEDIVVLTTLILCXLSIVAMNLRLVIENFLKVSFLHMTQWLGSFNKPXYGVLICIRCHDYRKQDVVIGAILFALVPCQLLCSYFIELAASRHAQRVIGRAKKQDKDRILNESKRTWFAIALLHSIISFFGLAATSYVIFYYVNHPGIGTVCEVQVIIVSLKSYSYALTNRDLRRAMLGSPSADSDIPELYRSCPYPRNITLGNLAYFLWAPTLVYQPVYPRTPRIRWSFVGKRLFEFVCLSVVMWLLSAQYAAPLLRNATQKIATLDIASILERGLKLSTISLVIWLAGFYALFQSLLNGLAEIMRFGDREFYTDWWNSPSFGVYWRSWNRPVYIFMKRHVYMPLVTRGWNPTLAGTVVFAVSAVLHEILVGVPTHNLIGMFPRTQSXGSCXRCXVVASIAMMFQLPLILLTAPFERFKSPLG

SEQ ID NO: 12593 - protein, 390 aa, Aspergillus nidulans
LLASANFTLSLLPARLASRIEALRNLPFIVVANPHVSKIYGNYVHSLSTLLPWQKRQVTTLEEENQFAEVLADLVHTHSNTIPILARGFLECRKYIDPAEVTRFLDTHLRARIGTRLIAEQHLALHFASRPAGDGSAEGREQPRKDAPPSNYIGVIDTALQPARIVRSCEEFVGEICELKYGVRPRLEIHGQPDATFAHVPVHVEYILTELLKNAFRAVIESGNEQEPIEVTIAAAPDVPGNHLQAHEPVTNGKPADALDTGAQSDSDVGFHVDTVVGTADANESIKFSTPSSQSITLRIRDRGGGISPDVLPQIWSYSFTTFSDLDMGEAGGIDALNTISSNSGQLSSIAGLGYGLPLSRAYAEYFGGSIAVQTLWGWGTDVYLTLNGV

SEQ ID NO: 12594 - protein, 635 aa, Aspergillus nidulans
LQDLTLRIPAGKQTALVGASGSGKSTVAGLITRFYDAEEGQVTIGGHDVRELNVRFLRSAISLVQQEPCLLDRSILENIALGLVNSSAHVHLMDVLKSSALEDIATAIREKGLSLNHAIDLQPSNKDQIREIVSLVETAAGLADASNFINKLDHGYATMVGSSGNLISGGQKQRISIARALVKSPQILILDEATASLDSATELRVQRALEAAAAGRTLVTIAHRLSTIKKADNIIVMRQGKLIEQGSHAELLAADGAYAELVRLQNLNVNASQESASSSARPSLDSTALEKERNAEVTSVQDDESSTPSPKEKPADEEPVTTERSVGSTSKAIASLFRPYSLALLVAIIGAVVIGGTYCGSAVIFGNVVGKLSSCETAESIRHAGEFWGLMFFVLALIEFFANLISWSLFGWIAEQLIYKVRVLSLRSILEQKLEWHEARTPSGLLSLIVKDSNALNGLTGSVICTILSILVNLFAAIIMTHIIAWRIALVCLSVVPLLLGAGFMRVSTLARFEERHNDAFARSLGITVEAVTSIKTVHALAIESEVLSTYRRSLQGPMREITGQSAFTNLWLAVGYGLSNFVYALAYWWGAKQIIAGHYTQTQFFIVQLALLVSSQLWGQMFALAPDVSRAVQA

SEQ ID NO: 12595 - protein, 504 aa, Aspergillus nidulans
  unsure (1)..(504): unsure at all Xaa locations
FDDAGLHPIMRQNICLCGYEFPTPIQAYAIPAVLTSHDLIAIAQTGSPXDIINSSSYXHAQGSGKTAAFLIPVLSQLMGKAKKLAAPRPNLAAGFDPITDVVRAEPLVLIVAPTRELATQIFDEARRLCYRSMLRPCVVYGGAPVADQRNELQKGCDILIGTLGRLLDFMDKPYTLSLRRVKYDTQHHVKTSINLPSRYTIIDEADELLLSDWEEYFKKIMSGGVVPVFPGVGLMLTSTDINEDADHRYMMFSATFNKECRELARKFLADDHVRVRIGRPGCTHVNVDQNVRTQDAHKPCFNHXEIRISDYLYEPQLKKKCLYDLLLAMQPSRTLVFVNSKATADQIDDYLYNLGLPSTSFHADRTQRDVRMALXAGNWLRSXYTCAHVLLGVRSASAKCPIMVATGVSTRGLDIKNVMHVINYDLFNALHGGITDYIHRIGKLIYQCKSRHTSSSKPXHLRGRTARIGNEGLATSFYSDKDSALAPDLVKILIEANKPVPDFL

SEQ ID NO: 12596 - protein, 526 aa, Aspergillus nidulans
YTDADTRRSYTYNDVKQSAITLCQGLKSLFDWRKGDVALFTPNSIDTPIVMYGALWAGGVVSPSNPAYTVEELAFQLRNSGAKAVVTQLPVLSVARAAAKEVGIPDDRIILIGDQRDPEARFKHFTSIRNISGATRYRRTKINPEKDLSFLVYSSGTTGVPKGVMLSHRNIVANSLQLAAGEAGNLTWNGGADGKGDRLLAFLPFFHIYGLTCLVHQTIYKGYELFVMAKFDLEKWCQHVQNYRITFSYVVPPVVLLLGKHPIVEKYDLSSLRMMNSGAAPLTQELVEAVYNRLHIGIKQGYGLSETSPTTHTQPWGEWRESVGSVGKLLPNMEAKYMTMPEDGSEPTEVPTGEVGELYLRGPNVFQGYHNNPAATADSISPDGWFRTGDVGYQDSKGNFYITDRVKELIKYKGFQVAPAELEGILVDNPAVDDVAVVGVESAEHGTEVPVAFVVRSAKSKSSGVSAAEEAKNIAKWLDGKVAHHKRLRGGVRFVDEIPKSAAGKILRRLLKKQAQEEAASPKAKL

SEQ ID NO: 12597 - protein, 375 aa, Aspergillus nidulans
PLTVSGRWILDSTGARVTFAGVNWPGAGEAMIPEGLQYASVASTISKIKSIGMNVIRLTFPIELVDDIYANDGDTTVLASLIKALGVTNGTDVFNQIVTNNPLITNTTTRMQVYDLVAAECAAQDVYVHLDNHISKAMWCCSTTDGNAWFGDTYFDVDNWKRGLQYMASHAASWETFTSIGLRNELRQPASANPSYPYNWETWYSQMTEAADLVNAANPDALIFLSGLNYDTTLAPIPTGSDLGEGTRFYLEDFSYADKLVLELHNYDTGASSCANLSGALWNGGFKALDTNSSDIVNIMPVVLTEFGFAQDETTWQSVYASCIREWIPQQQAGWMVWTISGSYYIRSGGQDYDDTWGILDHTWSGWRNEEAIEQ

SEQ ID NO: 12598 - protein, 416 aa, Aspergillus nidulans
VTLIHLLEILGGDSLGRYAANPKLRVQKFENVNKSLDYIKGRGIQMTNIGAEDIVDGNQKIILGLIWTLILRFTISDINEEGMTAKAGLLLWCQRKTACYEGVEVRDFSTSWNDGLAFCALLDIHRPDLIDYDSLDKNDHRGNMKLAFDIAANEVGIPDLLDVDDVCDVAKPDERSLMTYIAYWFHAFSQLERVENAGRRVEKFVNNMHGAWEMQNSYEKRMRELLRLIRAQREEWKNASFEGTYKDAKEQASQFAMYKRNQKRQWVAEKSDLAALLGNIKTKLSTYRLRAYDPPPELSPEACDQEWECLTRDEHERSQLINETIRDIKNALRRSFADKANDFALTLKTLSLAISGLDGDVEDQLAHVKRLNDNLPPLDAFLETIAELDEQCQEANVEENDYTTYTLDELAYELSL

SEQ ID NO: 12599 - protein, 626 aa, Aspergillus nidulans
  unsure (1)..(626): unsure at all Xaa locations
MSSSDDDTPLVKMNGRSSGKSRLVLVKSDALASFPGFPXYFTRFFTSSIQSXLIYLPDKGGQSDVKVNGAADTNGHVDPGVSIRFGPVQKDEDVEMNDANGASASKRKARSSANQAQSYAEPESSEEDEPLVRPPTTQITTAFLPSLFASTADSPGRAKRRRTLVKHEDPETDDDVPLALNGRKLPKAWEGAIGEESDSDVPIERKLAAEKKKIXVKGEKDADPSAQATKSAAFGKKQANGVKKEPAFAKQTLKQVKAEPKSAQSTPAKKNAKATALKKEESEEAEEPEEEEYRWWEDPTKGDGTIKWTTLEHNGVVFPPPYEPLPKHVKMKYDGIPVDLHPEAEEVAGFFGSMLNSTQHTENPTFQKNFFADFKEILKKTGGAKDQKGNKVDIKEFSKCDFQPIFQYYDAQRQEKKALPPAEKKRLKAEKDAQEAPYMYCMWDGRKQKVGNFRVEPPSLFRGRGEHPKTGRVKARVQPEQITINIGKEARVPPPPEGHKWKEVKHDQEGTWLAMWQENINGNYKYVMLAANSDVKGQSDYKKFEKARELKKHIARIRKDYQKNLKHELMVERQKATAVYLIDQFALSAGNEKGEDEAETVGCCSLKYENVTLKPPNKVIFDFLGK

SEQ ID NO: 12600 - protein, 643 aa, Aspergillus nidulans
  unsure (1)..(643): unsure at all Xaa locations
GVHFTGISLRTLMENLKPRLTKGADGSQLSTRETFQDLFGILFPATGGIFAXVSVSSLLDIRLIWVVGASMSGDLKNPSRSIPKGTLYGLALTFILYTLVIFAMAASLTRDSLYNNANIVQIVSFQTTLFITIXHFXANLSGAIVLSGEFATSFFSALMGLIGSAKLLQAIAKDSLLPGLNLFSKGTRKKDEPVRAIIVTFIAAQLTMLFDINQIASFVTMAYLMTFLVMNLACFLLKIGSAPNFRPSFHYFNWQTAATGTLVCGASMFFVDGVYATACFAVLITLFLLIHYTSPPKPWGDVSQSLIYHQVRKYLLRLKQEHVKFWRPQILLFVNDLEHEFKTCAFCNSLKKGSLFVPGHVIVTDDFSFAVPEARRQQTTWTKLVESLKVKAFVNIAVSPSVEWGVRNIVLNSGLGGMRPNIVIIDQFREGRSLGESIYHHNHHSHLLSPDASRSESSKKPADCRTYVRVLEDLLFQLRINVAVAKGFEELKLPGQRGSESKKYIDLWPIQMSAEINANSETKRNILTTNFDTYTLILQLGCILNTVPSWKKAYKLRVAVFVEYEIDVEDERKRVETLLEKLRIEAEILVFWLACGDLKTYRIIVNGDPLPECQDVHETVHKVLKNENWWEDVQRGRRSSDES

SEQ ID NO: 12601 - protein, 543 aa, Aspergillus nidulans
  unsure (1)..(543): unsure at all Xaa locations
FFTATPGKYLSWTSAYILVVSRVIGSGIFATPGSIVKSSGSIGLSLLLWGAGTVLAACGMVISMEYGCMLPRSGGDKVYLEYTYPKPRYLASTLVAVQAVLLGFTASNCIIFAKYTVFAFGGAPTELTHKLFATGLLTLITIVHGRFRQTGIWIQNVLGWLKIFLISSISLTGIWVILLRPSGIESGAGAASAAMDQGLMNWDTLWEGSNWSWNLLSTSLFKVLYSYAGLNNVNNVLGEVRDPIRTLKTVCPAALLTSAALYLLANLSYFLVVPLNEIKQSGELVAALLFDRLFGPRVGGTLFPFAIAVSAAGNVMVVTFALVRLISLXFSFFHLQLQSXRKGEQARVNQEIARQGFLPWGDLLSSSKPFGTPLWGLIVHYIPSILVITLPPQGDVYNFILDVEGYPGTIFGLAITVGMLILRYREPYLTRPFKAWLPAVWLRIVVCLALLVSPFIPPPGHKGDVEFFYATYAVVGTGVYVHSSFAFSFFLVGSEVMLLIMQACLGVIYWYVWTVLLPRWGGYKLEEEEKVLDDGTAVTRLVK

SEQ ID NO: 12602 - protein, 542 aa, Aspergillus nidulans
  unsure (1)..(542): unsure at all Xaa locations
YKKAVFWALFLSTSLVMEGYDLVIVXGLGDQSLTDTDWHQITSFYGQTQFKERFGVYDPASDQKLIPAAWQSGISNSALVGQLAGLVVNSICQDRFGCRRTMMVFMVWMAVAIFVPVFAPSLPVLAFGEAFCGIPWGVFQVNIREGHELFLSDFAYRTLSTTYASEVVPTVLRPYVTAYVCMCWGAGILLSSGVVRAVAGLQGELGWRLPFMLQWVWPLPLFIGAYFAPESPWNSVRRDKIDEARTNLMRLYQDMPEREHQVEQTLAYIKYTTEMEKAETANASFLECFKGTNLRRTEIVRFLTTVVSLAQLTGLRICVVWAAQILCGNAILGYSVVFLQAAGFSELQAFNINISLSACYIVGGIICWFLFPHVGRATIYMSGLTFMFFCLVTIGGLAWGPGKDAQLAIGILLVISTLCNMIAIGPTCYPIVAETPSGRLRYKTITIGRFVYNLTSIFTNSVTPRMLSSTCKLPRSSLCAILDLGTAWNWGAKAAFFYAGTNLLCNIWCWFRLPETKDRTFGEIDLLFTHRVPARKFKSTHV

SEQ ID NO: 12603 - protein, 308 aa, Aspergillus nidulans
VRNIVVIGGTSHPQLTQTICDILGIPPADVLLSKFSVGETRVEIKESVRGKDVYILQSGGGKVNDHLLELLITISACKTASARRVTAVLPLFPYSRQSDIPYNKSGAPLVKSSLEGKGASNGYTFESTPTTPHPGKLEVGNPINGVSIDNLQKSLAKAQLEESSGSPVKKRLPNGLSRSDTMESLKSDSSKSTLPNGLLDDSQDKINKFEPRPGYKQWVAQAGTLVADLLTCAGADHVITMDLHDPQYQGFFDIPVDNLYGRPLLKNYIMRNIANYKEAVVVSPDAGGAKRATAIADSMGMEFALIHK

SEQ ID NO: 12604 - protein, 161 aa, Aspergillus nidulans
  unsure (1)..(161): unsure at all Xaa locations
LQSELMQLMVSPSPGISAFPDADGNLLSWTATITGPSETPYEGLTFKLSFSFPNNYPYSPPTVLFKTPIYHPNVDFSGRICLDILRDKWSAVYNVQNVLLSLQSLLGEPNSKATSXIYFLLLYXRSISASPLNAQAAELWDTNQEEYKRHVLARHCDIEDI

SEQ ID NO: 12605 - protein, 249 aa, Aspergillus nidulans
  unsure (1)..(249): unsure at all Xaa locations
ACLFDMDGLLIDSEDLYTDITNQVLHSFGKPSLPWSIKAQLQGRPSQKYAVTFSPTYNTLSAPLPQKLKKQGLIXLNSQAARIFSDWAQLPISHEEYVSRISALQAELFPTTKPLPGVETLLKNLVSTQKGPNPVHIALATSSHTRNYHLKTSHLQDLFSLFPESQRVLGDDPRIGKGRGKPLPDIYLLALETINAGLREKGEKEITPEECLVFEDAVPGVEAGRRAGMRVVWVPHPGLLEAYKGREEE

SEQ ID NO: 12606 - protein, 345 aa, Aspergillus nidulans
  unsure (1)..(345): unsure at all Xaa locations
DHVRIVEVGPRDGLQNEKKSISLETKLELISKLAKTGVTTIEAGSFVPAKWVPQVCLQMPPARNRXSQRSSKFDADICKXXMASTAEICEHLLQTPPQSLNAIAYNYLVPNVKGLEGLIKVMDATGASASHTGNQNNSATTTEISLFAAATEAFSKANTNCTIQESLDRIRPIVALAKTKDIRVRGYVSVALGCPYEGPDVPPSKVADITATLLEMGADEVSVADTTGMGTAPRTMELLQALKAAGIANTDLALHFHDTYGQALVNTIVGLEHGVRIFDSSVGGLGGCPYSKGATGNVSTEDLVHTIHGLGMHTGIDLEEMSRIGQWISDELGRPNESRAGKATI

SEQ ID NO: 12607 - protein, 556 aa, Aspergillus nidulans
  unsure (1)..(556): unsure at all Xaa locations
GSSALFDSFAYLASEKSGWSHTLVGWTGEVEPLNEGSNPLQALNSNANTNLPAALDNTSRSLSKGSAPVVPDISLLQSNSSVAETSTVGPDDRKRLEDQLSSSRHGKVVPVWLSDESDVPEDTIILGDQSRWRRYAEKELYALLHYKQNGPTDGRFERDSWTDYVRMNQLFAERILQEYKEGDIVWIHDYHLFLLPSILRQHVPNIYIGFYLHSPFPSSEYMRCLAKRKEILTGVLGANMIGFQTFSYSRHFSSCCTRVLGFESDSAGVDAYGAHVAVDVFPIGIDAEAIQKIAFENADTEKAVEGLRQLYAGKKIIVGRDRLDSARGVAQKLQAFETFLERFPEWRDKVVLIQVTSPTSVEEEKEEQKIASRISNLVSTINGRFGSLSFSPVKYYPQYLSPHEYFALLRVADVGLITTVRDGMNTTSLEYILCQQENHSPLILSEFSGTAGALSSAIHINPWDTIGVSEAINKALTESVADKKEQHLKLYKHVTTNTVSAWSNQFISRLLANPLLFRSVYGDPALDRTKLLKQYRKSERGLHVXLDGTLPDVKDP

SEQ ID NO: 12608 - protein, 843 aa, Aspergillus nidulans
  unsure (1)..(843): unsure at all Xaa locations
LCFDDPTRGLDALFGLDYARFSWLMTDTCGYATLMTAYHPVAAINDIALVAGVSHRQRDLLYLGPVHAGTASLHDPTDQCVRMLAAYDLITSSTVQKRRKFREGWEQRAPKGPIELEQAFRKSAAFMNVQKEVRSYDSQGFGGRSRAESHSDTDYESLEDVKEALQTDKSRFVSSKSPYTISLFRQVVLCAKRQIWQIRGHMSPLYIKLISSVIYGLLVGSMFYDQPQTTDGMYSRGGVIFYSSILLAWLQMSELEEAMQGRDILSRQKKFAFVRPSAVCLARVVADIFIAALLTFLYLVVVYFLSGLKSDVSICQAIVHPVANSIIAGAFFIDFLFIYMCTISLTAQFRLFAAASSNFEVALRYTGFLVLLCIVFGGYVLSVDKMMADVPWVGWIAVSILPNVYIIKLMHTXYITPALYTYEAMMAAEVSNTNFTCSPASVVPAGPVYTDIAYQTCAYAGSQIGSTIVNGDDYLAVKYGFYFSHVWRNFGILCLFTVASVAATCLLSEIMEWEPDSAGPVQYKKSRKQLRKIANISDEEERPVQVNQTSPSASDTDGPSVGALTATKSTFTWDNLELFVRVGKENRKLLDGVSGYCKPGTLTALVGASGAGKSTCEXPGLCFCSSQDCVLTFLVLTALTQRQSSGDLTGTMYVDGRPIDSSFKSRIGYCEQMDIHDESSTIREAFEFSALLRQDSTVPDQEKLAYARTVLETLDLVELQNAIIGSLDIEKKKRVTIGVELCARPELLLFLDEPTSGLDSQAASSICALLRRLADQGLAILCTIHQANQEQFEMFDRVLALSPGGKTYYFGEVGEAGHSIFDYFAKYGQKPENITNAADYIIE

SEQ ID NO: 12609 - protein, 300 aa, Aspergillus nidulans
RFKPDKEGDIIQYTGLSQSAIREMALCSELDHANVVQLAEIILEDKCIFMVFEYTEHDLLQIIHHHTQPQRHPIPAAMVRSILFQLLNGLLYLHTNWVLHRDLKPANILVTSSGAIRIGDLGLARLFYKPLNSLFSGDKVVVTIWYRAPELLMGSRHYTPAVDLWAVGCIFAELLSLRPIFKGEEAKMDSKKTVPFQRNQMMKIIDIMGLPHRDNWPGIVHMPEYSQLQSLAMSRAPNHISRTSNLGSWYQNCLKNGGYSVNSSVGTPGDDGFDLLSRLLDYDPTSRITAKEALEHPYFK

SEQ ID NO: 12610 - protein, 359 aa, Aspergillus nidulans
RIWLAAVGGGAVEGSIRWWARDHRAHHRYTDTDKDPYSVRKGLLYSHLGWMVMKQNPKRIGRTDISDLNEDPVVVWQHRNYLKVVFTMGLAVAMLVAGLGWGDWLGGFVYAGILRIFFVQQATFCVNSLAHWLGDQPFDDRNSPRDHVITALVTLGEGYHNFHHEFPSDYRNAIEWHQYDPTKWSIWAWKALGLAYDLKKFRANEIEKGRVQQLQKKLDRKRATLDWGTPLDQLPVMEWDDYVEQAKNGRGLVAIAGVVHDVTDFIKDHPGGKAMISSGIGKDATAMFNGGVYYHSNAAHNLLSTMRVGVIRGGCEVEIWKRAQKENVEYVRDGSGQRVIRAGEQPTKIPEPIPTADAA

SEQ ID NO: 12611 - protein, 287 aa, Aspergillus nidulans
  unsure (1)..(287): unsure at all Xaa locations
MAEIRRKLVIVGDGACGKTCLLMXVFLQVIXSILSASFTYSILPVQVFSKGTFPEVSFHIQFVPPSAVELCLXPGCSLLRKLTAILSGLVPTVFENYVADVEVDGKHVELALWDTAGQEDYDRLRPLSYPDSHVILISFAVDSPDSLDNVQEKVSFFYLINKIILADTMLTLEQVDSEVLHFCQGLPIILVGCKKDLRHDPKTIEELNKTSQKPVTPEQVRSRGKMXLFGTQLTYSVGXGSRKKIGAYKYLECSARTNEGVREVFEAATRAALLTKTHKSKKKCSIL

SEQ ID NO: 12612 - protein, 235 aa, Aspergillus nidulans
IDLEAQKKYYAYLSKTGLTGLVILGTNSEAFLLTREERAQLISAAREAVGPDFPLMAGVGAHSTKQVLELAADAASAGANYLLVLPPAYFGKATTMNVVKRFFADIARRSPLPVVIYNFPGVCNGVDIDSETITDIVHESAKSSPNGVSNVVGVKLTCASVGKITRLAATFPASEFAVYGGQADFLIGGLSVGSAGCIAAFANVFPRTASKVYELYVSGKVTEKMNLHQKAALAE

SEQ ID NO: 12613 - protein, 383 aa, Aspergillus nidulans
  unsure (1)..(383): unsure at all Xaa locations
IMAETDSFLHLSRPLGPVLAGSAPTTAPLNVVIQPQVQLLCLRKIKNYVANLLFQALFSILDHSLRRNADQERVIGTLLGTRSEDGTEVEIRSTFAVGHTETTDQVEVDMEYQKQMLALHLKANPREVLVGWYATSSELNTFSALIQNFYSGQGDGTWPHPAVHLTVSTEPGKDIETRAYISAPVGVTAERAADSAAFIPVPHEIRYGEQVRAGLEAIAAARDSEERSTSLFTDIEALERAIEEVLGMIDRVSRYVESVIDEEAPASTALGQFLLNALALAPKVEPADIERDLYXATLSYDIVSVYXPYSSNNHIQDVLVVSYLANTIRTQMELSNRLATAQLTLGGESGNAEQGGAQRNQRGKGGRGGQQRNQERGAEEGRA

SEQ ID NO: 12614 - protein, 94 aa, Aspergillus nidulans
  unsure (1)..(94): unsure at all Xaa locations
TLAEVARHSSPNDLWIVIEGKRXEPFSAEGLNXRNGIVYDVAEYREDHPGGDEILRQFAGKDATTEFQDAGHSNDAYVKLKTLLVGSLQSKTLP

SEQ ID NO: 12615 - protein, 501 aa, Aspergillus nidulans
  unsure (1)..(501): unsure at all Xaa locations
SNVVGVHYRVGKKIGEGSFGVIFEGTNLLINQQVAIKFVSHVPKIGWKLKKANDTREPRKSDAPQLRDEYRTYKILVGCRECSPICNETITDWSSRIPNVYYFGQEGLHNILVIDLLGPSLEDLFDHCNRRFSVKTVVMVAKQMVSFPCXLEKREMRSXLSXLSRVQTIHEKNLIYRDIKPDNFLIGRPNSKAANVIHVVDFGMAKQYRDPKTKQHIPYRERKSLSGTARYMSINTHLGREQSRRDDLEALGHVFMYFLRGGLPWQGLKAATNKQKYEKIGEKKQTTAIKELCEGFPGLSSSNPPRLCXPRLEEFTKYLSYVRNLGFEDTPDYDYLRDLLTQALKNAGEVEDGEYDWMKLNNGRGWEYKSYSSQQALQNSAMHTSARDLHGQQIRNSQRPGVTADRLNAAQPPPPSPAKPGAGKTREPQNVRGGIPPKRQSGGFDTTPAASTVAQFQNSNANISGHRIGSPATPAKNQPAPGGQQASNEPQPTLMQKVMKA

SEQ ID NO: 12616 - protein, 336 aa, Aspergillus nidulans
  unsure (1)..(336): unsure at all Xaa locations
ERQAGDSRLNGDPSEAPPKKRRRLSNEQQPGSSGEQAAKQGKPTTLLQFPALEWGPCRHVDNFERLNHIEEGSYGWVSRAKELTTGEVVALKKLKLDNSPDGFPVTGLREIQTLLEARHQNVVYLREVVMGNKMDRVSLITNPYDSXPGLFMPHTRVFSPLPSTPLIACSSTMKSIRYIMLTIKPGGGFSPFSGIFRVYLVMDFLEHDLKTLLDDMREPFLPSETKTLLLQFISGLDFLHSQWIMHRDLKTSNLLLNNRGELKIADFGMARYYGDPPPKLTQLVVTLWYRSPELLLGAESYGPEVDMWSVGCIFGELLTKEPLLQGKNEVDQVSKV

SEQ ID NO: 12617 - protein, 523 aa, Aspergillus nidulans
  unsure (1)..(523): unsure at all Xaa locations
LDQKAKAMFTCVXLLPRALKAAFAAGLPKDRIYLIDVLPGSGKIPPEFKTLSQIVEEGKSLPKLEKLKWGAGEGARRTAYLCYSSGTSGLPVSNHPPDKGHFLSADRALKGVMIAHRNVIANVLQMTALEKSWRDTRKNADGSYYSDVLLGLLPQSHIYGLVVICHAGTFRGDQVIVLPKFELRSCLAAVQRFKISVLFVVSLILSGSEPIXRAARFPPIIITMLRSPEICAEYDLNSAVALVTGRAPLGQETALDFQKRYPKVAIRQAYGRSSASXVXPIDYXFRFTGLTETSTVVTATHFDDIVPGSSGWLIPGVEARIVTPEGEDITKYDTPGELWVRAPSVVLGYLNNEKATKETFGDGWMHTGDEAVIRKSPKGNEHVFIVDRIKELIKVKVRSNVQESMTPRXLTCVLGSPSAPAELEAHLLTHPAVADCAVIAIPDDAAGEVPKAIVSKSPEAGPDDEATVKSIVKYVQDHKARHKWLKGGVRFIDTVPKSPSGKILRRLLRDQEAAMRRQAGSKL

SEQ ID NO: 12618 - protein, 255 aa, Aspergillus nidulans
KVFIIGRREGVLQETAASAVNGSIIPVTADVTSKESLQAAYDTFASQTDHIDLLVANSGIAGPITNTEIQPDCYPTLSEFRDQFWSIPMEEFTNVSHVNVTGAFYTILAFLPLLEAQNKKRPAPIPGTVSSPKPQVIITGSIAGFTRLALPGFPYNLSKAAVTHMVKMLATTFSQYDMRVNGITPGLYRTDMSLPFYKSQGVRGNGTEDGSFPRSMVPVTRSGSEEDMAGIILWMAGAAGGYLNGNIVVSDGGSV

SEQ ID NO: 12619 - protein, 423 aa, Aspergillus nidulans
  unsure (1)..(423): unsure at all Xaa locations
SRQCSKHNQTSGIRASSSTRQYHVAAIESPARRRRDSTFMKRSDFIQSXGRXPNSKCLIARKMADRCLIXNFHATKVLAAIPDPYKVLGVDKGASAGDIKKAYYGMAKKYHPDTNKDPGAKEKFAEAQSAYELLSDKKKRETYDRFGSAAFDQNGGFDPSAGAGGNPFAGGGGFHGFGGGFGGGFPGGFAADINIEDLFGAFAGGARRSGRGRRGPFQEILVGEDIEVQTNISFMEAAKGTSQDIVITPLKECGTCKGDGLKEGAKRTQCRQCNGTGTRVHLMQGGFQVAATCDACGGAGLIVPRGSHCGTCKGDGVVRERKTVRVDIPGGVEDGMRLRISGEGDAPPTGTAAAPGTRTQRGDLYVSIRVSPDERFSRSGSDILDRASIPLNTALLGGEVLVPTLDGQVKVTVATGPGTGDRI

SEQ ID NO: 12620 - protein, 642 aa, Aspergillus nidulans
  unsure (1)..(642): unsure at all Xaa locations
NLAFPRGLMIGTDSHTPNAGGFAIAAIGVGGADAVDVMAGLPWELKAPKVIGVRLTGEMSGWTAPKGKYHYLHLTQGLRGIVHXYSLDIILKVAGLLTVKGGTGAIIEYHGPGVNSLSATGMATICNMGAEIGATTFLFPFKDGMYDYLKATKRQQIGDFARSYAKDLREDEGAEYDQLIEINLSELEPHINGPFTPDLATPISQFKEAVKANGWPEELKVGLIGSCTNSSYEDMSRAASIAQDALDHGLKAKSIFTVTPGSEQIRATIERDGQLKTLEEFGGVILANACGPCIGQWDRKDVKKGTPNSIVSSYNRNFTGRNDANPATHAFVTSPDLVVALSIAGTLNFNPLTDTLKDKDGKEFKLKAPTGDGLPSRGYDPGRDTYQAPPTDRSSVDVAVSPSSDRLQLLAGFQPWDGKDATGIPILIKCQGKTTTDHISMAGPWLKYRGHLDNISNNMLIGAVNAENGEANKIKNVFTGEYGAVPATARDYKARGVKWVVIGDWNYGEGSSREHAALEPRHLGGLAIITRSFARIVSLMRLIQTKXYLDXQIFSSTKTNLKKQGMLPLTFSDPADYDRIPPDATVDLLCTELAVDKPMTLRVHPKDGASFDVKLSHTFNESQIEWFKDGSALNTMARKSGN

SEQ ID NO: 12621 - protein, 552 aa, Aspergillus nidulans
  unsure (1)..(552): unsure at all Xaa locations
LIAYAISGGIVFLTMLSLGEMAAFIPVAGSFCTFARVSQPYVLRLLTNFVSSXTLNLNLGLGXHATSRFVDDAFGFALTWNYWFNDAVSTASDLVALQIVLQYWTESDNFPGWAFSLIFWAVLIGLNLFAVKVYGEVCVVHPPRIFPPLILFPSGXYWMSVLKVITIIVSGRCPLIXQNRQVLIAEIGLHVLGIVVNCGGNESGRYIGGENWHIPDAPFVGGIGGFASVFVTAAFACESFRSFFXRIAAKSRLLDGGTESIAITAGETKDPARTIPKVVLNVFWRILIFXSVLFHALXSSSAALLMDNSILSSLIIGLNIPHNYPSLNDGTVKTSPFTLVFEMTGTKAAGSVMNAVILTSVLSAGNHALFAGVRLLYTLSVAGHAPGFFGKLNRNHVPWIAVLATGAVSGLCFGSSKIGAGQLWTWLQKYAPIPSHSCYTRYTDKPLPQHRGVSNQLSWISIGITSIRFRAALKQQNKTHLLPFRNFTYPVGPWVCVILNIVIVLVQGWSCFSPTFDGVSFVSFYLELPIMLGMFIVWKVWKRTTFVNSREV

SEQ ID NO: 12622 - protein, 336 aa, Aspergillus nidulans
  unsure (1)..(336): unsure at all Xaa locations
VETIPTVDISAWLDPSSAEEDRQNVVNAMRHACTTYGFLSLVGHGVSLEEQKQAMDCAKLFFTLSEEEKMDVWIGKSKGRSFRGYEPPGIQVHQEGLPSRYQGGKFFCSREVMCXCXDIGKCFIIGHEVPEDHPDSGTFSTGPNLWPKSLPEDQFRIPIMKYQARMVQLVKVLLKILARGLPSEWNCPPDALDALAENEPSIPMRLLHYAPQASQRRETVWWXVLFYPXTPHRQRENQSXLSAVGDHTDFGCITILLQEMGTEGLEVWYPPTETWIPVPPQENAYVINIGDMIQKFTGGYYRSARHRVITFTEKHRYSVPFFLNGQLKLKCTALDG

SEQ ID NO: 12623 - protein, 514 aa, Aspergillus nidulans
  unsure (1)..(514): unsure at all Xaa locations
SPLDRSMLVSPILEPRKPRLHXQVIALGSNVGSGLCIGTGKAFANGGPANMILPYSTVCIAIWAHLQTFAEMTIVSPTSGSYIDYADRWVDPALAFGAVXLSGWVYSSNPIPQRANSWISGWTAVFASEATFFAFLVDYWTKDVIPEAALRMSFPAPICVGNLTPVXYPSSSXYVXRYSFCQTPTSPGFIILGPWXKLFFSFSSVXSLWPLVGGAGLTGSVKDGSTWTDLPAIQNGFEVCTRIXTPFQWTGNLVIAVXGFASAALLAVWAVGDHIYIGVLGGGARSPRYSWHMRANAVPWRVTVFYMVLITFVSVIVPLSEARLLGGSGSQPLHFVIAIDNAGIKVAPDLVNACMIIRIVVIALECIFLTSRMLRTMALQKLIPSFIAEVDKRADPAGALMITGVVGVVLTYISLSGRXSSSQQXNGQCXSRAGKGTELLNXFIAITSASFFINFAIVALTSFRFRAAVKAQKGDLLYRELQLEIPSLATDSDIVLVLSALLLVSLLYISIKPV

SEQ ID NO: 12624 - protein, 422 aa, Aspergillus nidulans
  unsure (1)..(422): unsure at all Xaa locations
YSQIGQFCXWWGFSSVVAESRLADGNLFSMPITLDASKAVIEQAGLKPGSRVTLRDFRDDRNLAILTIDDIYRPDKXVVFMTLGNCLVIGTPRSLGLPDGGTSGRCGFAKDVAFIXTRIAQFLTSLLIPGEKEAKLVFGGDPEHPAIKYLNTKVEEYYIGGKLEAVNKLNHYDYVGLRCTFENTTGACINQERXIXRDFRHPAELRIHFDKLGWTRVVAFQTRFVLVTXLETGMSWLTDLINPMHRAHRELTVRAGRARQANVLIHPVVGLTKPGDIDHFTRVRAYQALLPRYPNGMAALALLPLAMRMGGPREAVWHAIIRKNHGATHFIVGRDHAGPGKNSKGQEFYGPYDAQHAVEKYRAELGIEVVEFQQVTYLPDTDEYMPKDEVPAGTKTLDISGTELRNRLRTGAHIPEWFSYPE

SEQ ID NO: 12625 - protein, 318 aa, Aspergillus nidulans
  unsure (1)..(318): unsure at all Xaa locations
VPGYXLLFALXAIHTNVPGGKLNRGLSVPDTGVALLQKELSEEQYKDLATLGWLTELLQAFFLVSDDLMDGSITRRGQPCWYRHQGVGLIAINDAFLLESGIYVILKKQFRSHPAYVDFIELFHETTWQTELGQLCDLITAPEDKVDLNNFSMEKYMFIVTYKTAYYSFYLPVALALHCLQLATPENLRQAHDILIPLGQYFQVQDDYLDAYGDPXVIGKIGTDIQDNKCSWLVNQALQRCSAEQRKVLDAAYGRKDAEQEAKVKAIFRELDLESVYKEYEEKIVGELKTKIAAVNESEGLKKEVFEAFLGKIYKRSK

SEQ ID NO: 12626 - protein, 456 aa, Aspergillus nidulans
  unsure (1)..(456): unsure at all Xaa locations
QNLHSQSKEKINEFVRGHFYGHNDFDFDDTLYVFTSGRYEFRNKGVDMFIEGLARLNHRLKSSGSKTTVVAFIIMPAQTSSLTVESLKGQAVVKSLRDTIHMIEQGIGKRMYERCLAWKEGDNMPDEKDLITSQDRVLLRRRLFAMKRHTLPPIVTHNMINDSEDPILNQIRRVQLFNQSSDRVKIVFHPEFLNSSNPVLPLDYDDFVRGTHLGVFPSYYEPWGYTPAECTVMGVPSITTNLSGFGCYMEELIENSSDYGIYIVDRRMKGVDDSVNQLTDFMYNFTLKSRRQRINQRNRTERLSDLLDWKRMGLEYVKARQLALRRGISRSPGYSLFAYXLRAAYPSSFDNQEDYFDVIGGTEQKISRPLSVPGSPRDRSGMMTPGDFASLQEVKEGLSTEDYVAWRLPXVLHIYLGSSSXFSIRTSEEDDAEDHFYPLTLRTKKSDRPSSPLDRI

SEQ ID NO: 12627 - protein, 339 aa, Aspergillus nidulans
  unsure (1)..(339): unsure at all Xaa locations
FTVNTGAQIPAIGCRTFQDEEQQEGAVLEALKAGVRLIARVYALLHFLLIFCSYMPRYNTNPHFSYDTESFIGTAIKRSSIPRDEIFLTTKLXCNSFHPDDVDSALYETLRDLQTEXVDLYLLHHPCTFARGKDRFPKGEDGLMRMGETTYVDTWKALQEIMKRTRKARAIGVSNFSRDELRILSMLKWXASSWSHSARHTMEVRANVVRWAQTPAVHQMELHPFLSQKFFAVWHKSLEIHAQQFSPIGNMNSFYRDVYWSNRRANLGRLLDEPVLSEIGAMYSKNPAHVVLAWSVNHGRSVIPKSTIPWQIRQNVESDFVLEEDMERIDELNADLRFN

SEQ ID NO: 12628 - protein, 282 aa, Aspergillus nidulans
  unsure (1)..(282): unsure at all Xaa locations
RLREVTKRVNRSPLGTGALAGNPFHIDREAMAKELGFEGLLYNSMNAVGDRDFAMETMQWGSSFMLKISRWAEDLIIYSSLEFGFVRLSDAYSTGSSLMPQKKNAGAFSPCSALXFSNHCIDSLELLRGKAGRAFGHMAGLMCTIKGLPTTYNKDLQESVEPLLDHIKTVGDSIQIATGVLSTLTTIPEKMAAALAPEMLATEFADYLVRKGVPFREGHHISGRVVQLAEKHGVPMDQLSLEQLKSVDDRFGDDIQECLDYERAVELKDAIGGCSKRAVLEQ

SEQ ID NO: 12629 - protein, 450 aa, Aspergillus nidulans
DPGTDLPWASCPTNSAEDVVFSVQIAHDAFVKFKKVNPRQRAQWLLKWDSLIREARSDLAKILTHETGKPIAESYGEIDYATGFTWWFAGEAERIQGSIAVPAAPNRRVFTVKQPIGVAAALVPWNFPIAMVLRKAGAALAAGCTMIVKPSPETPLTALVLAHLAEKAGFPAGVFNVLTTDLENTPPLSEALCKHPLVKKVTFTGSTRVGKLIASHCAHGLKKVTLELGGNCPFLVFDDADLDQALDQLMALKWRHAGQACITANRIYVQAGIYDKFAQLLKERTAKLVIGHGAKEGTTLGPLTTPRSIDKAISQVEDARRLGADVILGGSRVQGTQGYFFEPTILKNMTKDMLVSREESFAPIAALYRFETEEEAVKLANDTSMGLASYAFSKNIDRMWRLLENLEAGMIGMNTGNSSAAESPFGGIKESGYGKESGKEVAVNEYLITK

SEQ ID NO: 12630 - protein, 993 aa, Aspergillus nidulans
  unsure (1)..(993): unsure at all Xaa locations
ELRFDNQTVVVTGAGGGLGKAYALFFASRGANVVVNDLGGSHQGEGSQARXAHHMQLLLFSMSPVLTRVLWXAADVVVDEIRAAGGKAVANYDSVENGDAIIDTAIKNFGRVDVLINNAGILRDVSFKNMKDQDWDLINKVHTYGAYKVGTGSSAFDGXEADFTVRRAAWPHFRKQKYGRIINTASAAGLFGNFGQANYAGMSHTDANANKLTNQLAKLGQVGFTETLAKEGAKYNIIANVIAPIGMLACXHSRALLTPTAASRMTATVMPPEVLELLKPEWVVPVVAVLVHSSNTTESGSIFEIGGGHVAKLRWERSKGALLKTDASLTPCAIARKWNEVNDFSKPDYPTGPADFMGLLEDGLKLPPAPSGPEPEFKGKVALVTGGGNGYVIXSLGYAQANFISLGRAYCLLFGRLGAKVVVNDLVDPEPVVQEIKKAGGEAVGNKASCEDGAAVVKTAIDTYGRIDILVNNAGILRDKAFTNMNDDLWNPVVNIHLRGTYKVTQAAWPHMLKQKYGRIVNTASTSGIYGNFGQANYAAAVCSLKSSILHXLIYVVETWILGFSRALAIEGAKYNIKVNTIAPNAGTNMTRTIMPEEMVQAFKPDYVAPLVVLLCSDMTPEPYSTKGLFECGSGWFGSTRWQRSGGHGFPVDVKLTPEAVAKELAKIVNFDDGRADHPEDIQAANEKVMSNFSNRSGGESGGSGNEILSAIEAAKKASTDGTSFDYTDRDVILYNLSLGAKRTDLPLVYENNEHFQALPTFAVIPWFNTATPWDMNDIVKNFSPMMLLHGEQYMEIRKFPIPTEAKTKTYPKLIDVIDKGAAALVVAGYTTKDVATGEDLFYNESTVFIRGSGGFGGSPKPTAPRPKAAVAAYKPPKRKADVVVEEKTSEDQAALYRLNGDRNPLHIDPEFSKVGGFKIPILHGLCSLGVSGKHVFQKFGPIKNLKVRFAGVVLPGQTLRTEMWKEGNTVLFQTTVVETGKPAISGAGAELL

SEQ ID NO: 12631 - protein, 281 aa, Aspergillus nidulans
  unsure (1)..(281): unsure at all Xaa locations
KFEGWLGLDAGSVDGKMQWKEFEPKPWEETDVDIKISHCGICGSDLHTLRSGWGMFSPLLPSFCLSEISRLTIVIIXGPTNYPCCVGHEIVGTAVRVGSQVKHIKVGDRVGVGAQTXSCVGRKGECNECATSNEPYCTKHFAGTYNGVFMNGGKSYGGYALYNRSPAHFAIKIPDAIPSAHAAPMMCGGVTVYSPLKHYGCGPGKTVGIIGIGGLGHFGVLFAKALGADRVVAISRKSDKRADALKLGADEYVATAEDTEWMANNKRSLDLIVCTVSSSEM

SEQ ID NO: 12632 - protein, 533 aa, Aspergillus nidulans
IRIFDRGDWYSAHGKEAEFIARTVYKTTSVLRNLGRSETGGLPSVTMSITVFRNFLREALFRLNKRIEIWGSAGTGKGHWKKVKQASPGNLQDVEEELGAMGMEGSNGAPIIMAVKLSAKAGEARNVGVCFADASVRELGVSEFLDNDVYSNFEALVIQLGVKECLVVQDVNRKDVEVAKIRAICDNCGIAISERPASDFGVKDIEQDLTRLLRDERSAGTLPETELKLAMGGAAALIRYLGVMSDATNFGQYQLYQHDLAQYMKLDAAALRALNLMPGPRDGSKSMSLFGLLNHCKTPVGSRLLAQWLKQPLMDLAEIEKRQRLVEAFVVSTELRQMMQEEHLRSIPDLYRLAKRFQRKQANLEDVVRVYQVAIRLPGFVNSLENVMDEEYQTPLETEYTAKLRNHSASLAKLEEMVETTVDLDALENHEFIIKPEFDDSLRIIRKKLDQLRHDMYLEHKAVARDLDQEMDKKLFLENHRVYGWCFRLTRNEAGCIRNKKAYQECSTQKNGVYFTTSTMQSLRRDHDQLSSN

SEQ ID NO: 12633 - protein, 491 aa, Aspergillus nidulans
  unsure (1)..(491): unsure at all Xaa locations
MSNTDFLGRAIDTVKKAIESDNEGEYEKAYQQYYSALELFMLALKWEKNPKSKEMIRAKTGEYMDRAEKLKNHLASQDSRKKPSAVGANGKVSQGSGKGGYVLLINTSRGVCSVALMLLFLCWQKRGDDNEDADSKKLRSALAGAILSEKPNVKWEDVAGLEGAKEALKEAVILPIKFPHLFTGRRQPWKGILLYGPPGTGKSYLAKAVATEANSTFFSVSSSDLVSKWMGESERYAAESSTTVLPLTETSXAVKQLFNMARENKPAIIFIDEVDALCGARGENDSEASRRIKTELLVQMDGVGNDSKGVLILGATNIPWQLDAAIRRRFQRRVHISLPDINARMKMFMLAVGSTPCHMTQADYRSLAEQSEGYSGSDISIAVQDALMQPIRKIQTATHYKKVTALGSNPISSELIQVPGTAXRSRKANPCSPGDNGAMEMRWENIEADQLLEPSLVLKDFIKAIRNSRPTVSQEDLKRNAEWTQEFGSEG

SEQ ID NO: 12634 - protein, 659 aa, Aspergillus nidulans
  unsure (1)..(659): unsure at all Xaa locations
TDSRPKAVDRDSTATSCNSTLDENQIENDREVTNLARVLSERSKHSHHQLPFNFGKDPSLDPQNAQFNARAWAKAFYNVRYSSTDAPPPRVAGVAFKNLNVAGYGSPVDYQMSVGNALLKLPTLAWQWLGGKKQRTEILQDVDGLLLPGEQLCVLXAPGSGCSTLLKTIAQETHGFEVDPSSYVNYQGITPKQMSKKFRGEAIYTAEVDAHFPQLVVGDTLYFAALARTPRHVPGGMSREEYAVHLRDVIMSTFGISHTINTKVGNDFVRGVSGGERKRVTIAEAALSYAPLQCWDNSTRGLDSANAVEFCKTLRTQGDVFGITSCVAIYQAPQAAYEVCWKSFSCQLYXPFPSSSDKVTVLYEGRQIYFGPAKEAKDYFIRLGFVCPEAQTTPDFLTFMSSPVERVIRPGFENLVPRTADDFAQRWKESPERQALLRDIDRYNTEHPFNATDLDLFSSSRDAEKSKNQRPKSPYTLSYWGQIRICLWRDFQRLKNDPSVTLAMLILNFFEALIISSVFYNLPGNTSSFFSRGALLFMMVLLSAFSSVLEIITLYEKRTIVEKHSRYALYHPSAEAISSMIMDMPYKIVNSLLNSLVLYFMGNLRREAGAFFFLYLISFAMMMGMSMFFRFFASLTKSIEQALAPSSIILLALVLYTGF

SEQ ID NO: 12635 - protein, 762 aa, Aspergillus nidulans
  unsure (1)..(762): unsure at all Xaa locations
AGYLVTLGQELANENSASHIRTAAGLALKNAFTFRDRERLNEVQQKWRQQITPDIKAQVKELALKTLASKDGRAGQSAAQFIVSIAAIELPQNEWPDLMQILVQNVASGSDQMKQASLVTIGFICESQEMELRESLAAHSNAILTAVVQGARREEQNMDIRFAAIKALSDSVDFVRSNMENEGERNYIMQVVCEATQAEDLRVQAGAFGCLNRIMGAYYDKMSFYMEKALFGLSIMGMKSEEEDVAKLAIEFWCTVCEEEIAIEDDNAAVCLTQHCLDDQLLIMFSRAQAEGLTDVRPMYGFARIACREVVPVLLQAMCKQDEDAGDDEYNISRAAYQALQLYAQCVQADVIQPVLAFVEENIRSEDWRRRDAAVAAFGAIMDGPDPKVLEPLVKQALHVLVSMMEDSSIQVRDSAAYALGRVCDFCSETLDPDVHLQPLISCLFNGLASSPKIASSCCWALMNVADRFAGDVGAQTNPISKYFEESVKSLLALTERYVPRIFISXVKPNSRLDQTADNQLRTAGYEVLNSFVTNAANDSLPTVAHLSDVVLQRLERTIPMQQQVVSVEDRIMLEEMQTGITSVVLVSTRKFPSLIVYXLDXAIVQRLEAEIKPQADRIMQILLQVLSTVPPKSSVPDVVFATVGAIANALEEEFVKYMESFSPFLNGALGNQEEPGLCAMAIGLVSDISRALNEKVLPYCDTFMNHLMNNLSVRNLSYIQCTNPNMISRAPPNQLKPAIXETFGDIEQAIGEHFDKYLTVV

SEQ ID NO: 12636 - protein, 404 aa, Aspergillus nidulans
SPRTESALSSSLPESSLHRYGNMDPALNVPQGSLNNSAGESSPTPRSSFRVGVTEDRNKKCRRTMEDTHAYLYNFLGNPVPSAQNDDSDQSSHPSDASPKTGELTPIVETDNGYFAIFDGHAGTFAAQWCGKKLHLILEDVMRKNINAPVPELLDQTFTSVDQQLEKLPVKNSGCTAVVALLRWEDRIPTPSSVTGSSAIGPAAVAATKAGADSKADDTPTQEAAATPVPAIPPKLREKAIRQRVLYTANVGDARVILCRNGKALRLSYDHKGSDENEGRRIANAGGLILNNRVNGVLAVTRALGDAYIKDLVTGHPYTTETVIQPDLDEFIILACDGVSQHAFLARISIELIVLCSLWDVCSDQEAVDLIRNVSDAQEASKILVDHALARFSTDNLSCMVIRL

SEQ ID NO: 12637 - protein, 218 aa, Aspergillus nidulans
  unsure (1)..(218): unsure at all Xaa locations
AKVPRNFRLLEELEKGEKGLGQVSKRHRIIXCKSQADVVLRFXTEACSYGLADGEDMMMSNWNGTVLGPPHVCRIPIYVPCLEVXCTKLAPHDYRAVHENRIYSLNIHCGPEYPDQPPTLQFISRVNLPCVDAHSGKVRNPQSRSNSTRRSXRLLGXPSKLPCLAQWKRDYTMETVLIELRRXASRXSXTLAAVSXTSRYMALPQHKKLPQPPEGSTF

SEQ ID NO: 12638 - protein, 208 aa, Aspergillus nidulans
  unsure (1)..(208): unsure at all Xaa locations
GAVAVVTVDFLVYPFDTLKTRVQSPHYAEIYKDAATNTIKKGVLFRGLYQGVVSVVLSTIPACTGAPIPKIQTSRDINSWXHLAAGAFFTTYETVRSTLNRTKQASAIPFLQSVPAPAINAISSSTGEMVSCLLLTPAEVIKQNAQVINNSPSANISEKLKQGGTSVTLQVLRRFKQQPWKLWSGYSALVGRNLPFTGINFPIFEAIK

SEQ ID NO: 12639 - protein, 418 aa, Aspergillus nidulans
  unsure (1)..(418): unsure at all Xaa locations
IPYPPSTARDVAIEVQKVKENRDRFRIESRTGGVGPAVSVCMFTFHNTYDGLVNLDPSLRVDRXLGXINCLDFSDDNLLVAAGMQESYIRVWSLDGKKIPSDDSADEPPTNSRRLIGHSGPVYAVAFAPSATPSENAVAPTNARWLLSSSADRTIRLWSLDLWQCMVVYKGHDQPVWDLQWGPFGHYFVSGGHDKTARLWVTDHIRQQRIFVGHEQDVDCVCFHPNSAYVFTGSLDRTVPMWAVTTGNAVRMFTGHTGNITALACSRDGKTLASADDHGSILLWDLGPGRLLKRMRGHGKGGIWSLSWSVESNVLVSGGADGTVRVWDVMGPAHDPSQGRVAGEGGAGTKIDGASSAAANSTQTPGTVGPGMGSGKKKGKDVVVTPDQISAFPTKKSPVYKVKFTNMNLIIAGGAYLP

SEQ ID NO: 12640 - protein, 112 aa, Aspergillus nidulans
  unsure (1)..(112): unsure at all Xaa locations
YTLEQVKAHCTPDDIWIILHNKGTYCSHSRGFILXPCTVYEVTKYLEDHPGGSAVLIEVAGADATEAFEEIGHSDEARRQLEPYYIGDLPDQVMPALDRXLLPPSPDGVQEQ

SEQ ID NO: 12641 - protein, 442 aa, Aspergillus nidulans
  unsure (1)..(442): unsure at all Xaa locations
LNLPDPFATIPRVSLLYPFSSPIHPLQSLSGLASAPAPASASASASTTHSAPGSTRSQGARTEGIHVSLYAKREDHSSPLACAGNKYRKLEYIVPDILSSSPRYGAGIAADVPTPIHGKGKVTTLVTEGAIQSNHTVQVASVASRIGLESVVLLHKGTGGGLASAKDKAAFLRTGNVQIVKLLGAEVRMFEKPVAPKTQDDIVEEVLNNLRAEGKVPYWIPSGASLHPLXGLGYARCAFEIAAQEKDILGSPNDRGSGGYGIKQPRFDYIFVACGSGSTVGGLIAGFKLLEKMENSQPHEQTRGERKRRVIGILTSPTMRKRYHEERILRFARGAGKLIGLNPQTDITMDDVVLDDRFAGERYGVLDAKTNDMLSLMAEKEEVILDPVYTAKVARGMMHWVAEGEIEKDLLASPATYRGQDGEQVNVLFIHTGGQSALGAYA

SEQ ID NO: 12642 - protein, 467 aa, Aspergillus nidulans
ALLPFILFFLSFPAPASAVGSAVLGIDVGTEYLKAALVKPGIPLEIVLTKDSKRKESAAVAFKPTRQSDASFPERFYGGDALALSARYPDDVYVNLKILLGVPFNDGKNELIETYRARFPALRLEDAPFERGTIGLRSNRLGEAERKDAFLVEELLAMQLKQIKANADNLAGKGSDVRDAVITYPAFYTADEKRSLQLAAELAGLKVDALISDGLAVGLNYAMSRTFPSVSDGEKPEYHVVFDMGAGSTTATVLRFQSRKVKDIGKFNKTIQEVQVLGAGSDRTLGGDSLNDLIVGDMLSQLLDDKKLKGRVSLADLRSHGKTMARLWKDAEKVRQVLSANTETGASFEGLFDEDVNFKYRVTRSKFESLAEQHIARVGKPLEEALAAAGLQLNDIDSVILHGGSIRTPFVQKELERFCGGSEKIRTNVNADEAAVFGATFKGAGLSPSFRVKEIRAIESSGYPVVL

SEQ ID NO: 12643 - protein, 468 aa, Aspergillus nidulans
  unsure (1)..(468): unsure at all Xaa locations
VRFSDVHGCVXAKDELQELVEFLLNPERFSSLGGKLPKGVLLVGPPGTGKTLLARAVAGEAGVPFFYMSGSEFDEVYVGVGAKRVRELFNQARSKSPAIIFIDELDAIGAKRNERDAAYVKQTLNQLLTELDGFSQSTGVIILAATNYPELLDKALTRPGRFDRKVVVDLPDVRGRMDILKHHMKNVQISTDVDVAVIARGTSGFSGADLENLVNQAAIFASRNKQSKVTPKDFDYAKDKIIMGAEARSRIIQDKDKLLTAYHEAGHALVAYFSPSSMPLYKITIMPRGMSLGSTHFLPEMDMVSKNYVQYLSDIDVSMGGKVAEELIYGEDKVTSGISAVCSQRLNLXAQGSRXWMXDLASATRTAFTLVTRFGYSKKLGNVDLYANYDSLSSETKQEIEAEVRRLVEEARQRATNILTERRHELELLTKALIKYETLTKEEMEKVLRGESLDRLVVPADAPMKLPE

SEQ ID NO: 12644 - protein, 184 aa, Aspergillus nidulans
VGLSARLAQILGGCINMMFMFGSIVPSFFLDRMGRRNTMIAGCAGLSLCMMMISALLSQAKTSNGHSYSSAAVTFFFLYMLVFGMSVNCVPWVYVPEILPLAARTRGTAIGISSNWLWNFTVVMITPVIINRLHWKAYLIFMVTNALFVPAFYFFYPETSNLRLEDVDYIFSRSGDPVKNAQQI

SEQ ID NO: 12645 - protein, 286 aa, Aspergillus nidulans
  unsure (1)..(286): unsure at all Xaa locations
IXLRSFGPKGSWAIVTGASDGLGKEFALQIARAGYNIVLVSRTASKLTALTDEITSKYPSVQTKMLAMDFARNLDEDYEKLKALIQDLDVAILINNVGKSHSIPVPFALTPEDELADIITINCMGTLRVTQLVVPGMTQRKRGLILTMGSFGGLVPSPLLATYSGSKAFLQQWSTALGSELQPYGITVELVQAYLITSAMSKIRKTSALNPNPRAFVKATLSKIGNMAVPQATHTESPYWSHGLVAYLATCVINPMSKWLANQNKAMHESIRKRALRKAERENAKK

SEQ ID NO: 12646 - protein, 390 aa, Aspergillus nidulans
  unsure (1)..(390): unsure at all Xaa locations
QMARTQKNRNTXYHLGRILADFFTRRHHXWNDYRQLKAKLAKLKRELLTPSGGGGGGSGGKEQTSLIPNLVALTLYEAGFDVARTGVASVYVSSVVRRRSEIVINYGIVVSIGFPSVGKSTLMSRLTGQHSEGMLNEDRSRVTDTDAFLQQRRRYEFTTLTTVPGQVLYNGAKIQILDLPGIIQGAKDGKGRGRQVIRVAKTCHLIFIVLDVNKPLVDKKVIENELEGFGIRINKQPPNIMFKKKDKGGISITSTVPLTHIDNDVSRXETGFNCCDGYXHFRFRTXQEIKAVMSEYKISSADISIRCDATIDDLIDVLEAKSRAYIPVVYALNKIDAVTIEELDLLYSIPNAVPISSEHGWNIDELLDMMWEKLNLRRIYTKPKGKAPNY

SEQ ID NO: 12647 - protein, 713 aa, Aspergillus nidulans
KVRSLIRSQGFKSYAVRTVISGWYVADFRCHLQIAEFATVYKWMLTSIPRDESFNSITGLNGSGKSNILDAICFVLGITNMSTVRAQNLQDLIYKRGQAGVTKASVTIVFDNRDTAKSPIGFEEYATISVTRQIVLGGTSKYLINGHRAQQQTVQNLFQSVQLNINNPNFLIMQGRITKVLNMKAGEILSMIEEAAGTRMFEDRREKAAKTMAKKDLKLQEIEGLLKEEIEPKLEKLRAEKRAFLDFQQTQNDLERLTRLVVAHDYLRSGDRLRASGEECEKKKRKIQALEDNTAKLKSEIAHMEEDVKRVKAVRDKELRKGGKFQALEDEVKAHSHELVRLTTVFDLKKASIAEEKEKSKELQKSVKDLETSLKEKKKIYDKLQAEYDAAKAELDAQTAEVEQKEELLQTLQTGVASKEGQESGYQGQLQDARNRASNAATEQEQAKLKIAHLEKRIKEEEPRAKKAKEQNSGLLKELEGLKSQAKKLEYELSKLGFEPGREEQLYQEQSGLQKEIRELRQRADGLQRKVANIEFNYSDPYPNFDRSKVKGLVAQLFTVDKEKLQAATALEICAGGRLYNVVVDSSDTGTQLLQKGKLRKRVTIIPLNKISAFRASVEKIGAAQNLAPGKVDLALSLIEYDEEITAAMNYVFGNTLIANDAETAKRVTFDPSVRIKSVTLDGDVYDPSGTLSGGSAPNSSGVLVTLQKLNEI

SEQ ID NO: 12648 - protein, 674 aa, Aspergillus nidulans
  unsure (1)..(674): unsure at all Xaa locations
FTTPELYGPANPPEDDTVKTPGSVDSGNANTTSLTDMFRIERMLTVKVTEAKMFGNKGVDETPRSRKQSRSHFNAAAASATNDYYTEVLLDGEIRARTAVKYRTSNPFWREEFTFNDLPPVLSQVSIMVKTLNPAQRDWSLVAHGTYALSQDTNPTRLLDDVEVSSQDAMCGRVDIRLDDLEPGTETEKWWPILDDRDQCVGEMLMKARMEETVVLMSQEYAPMSEILHSFGNGLTVNMAEIMSSELNQLSEALINIYQVSGSTVEWISALVEDEIDGIHKESTANRLRYTSRLHSNDTREHGQDREVLVRDLGRTATLEANLLFRGNSLLTKALDFHMRRLGKEYLEETIGERLYEIDETDPECEVDPSRIHRADDLERNWKNLVSLTTSVWKSIASSASRCPAELRLIFRHIRACADDRYGDFLRSVTYSSVSGFLFLRFFCPAILNPKLFGLLKGKSTLISLRLXHLTDARLDHPRPRAQRTLTLIAKALQGLANMTTFGSKEPWMEPMNKFLNSNRNEFKTFVDSICAIPADRPTPIVTPSYATPIQILGRLPPPSREGFPSLPFLIDHARSFANLIRIWLEVAPGRLSQLEELDPAVMKFHEIAIRLQQRTKECLSRAELAERPSGNLEVKWEELVDSLERSVTLYEESSSKPATPAAAPSSAPISETV

SEQ ID NO: 12649 - protein, 188 aa, Aspergillus nidulans
  unsure (1)..(188): unsure at all Xaa locations
SMTQNRLFREYKTLSTNPPDGITAGPVSEDDMFHWEALIQGPEGTPYEGGVFAAELKCPKDYPLSPPTMKFVGGGRWHANGELXPLCFFSFERKGRFIGXMFRWAVYPDGTVCICILHPPGDDPNHYEHASERWSPIQRVEKILIPVMSMLAEPNDESPANVEAAKMWRERRAAYERKVREEVRKGLG

SEQ ID NO: 12650 - protein, 467 aa, Aspergillus nidulans
  unsure (1)..(467): unsure at all Xaa locations
TMNSLLRAARDAENSQSKQYLSFVEAVRLEHVDVVESQINSAELRTQLTSAINAECERVLKVLEAAQTLGEISARCVDKVISTGEKLSCRLMAAFLQDRGVDSEYVDLSEIVDFHISGQGLDQEFYDNLAAALGRKVHACENKVPVITGYFGTIPGGLLDQIGRGYTDLCAALVAVGVQAGELQVWKEVDGIFTADPRKVPTARLLPAITPAEAAELTFYGSEVIHPFTMEQVIRAKIPIRIKNVMNPKGDGTVIFPDSTYELERTTPGHDPRLFRTRSPSLLQRPKRPTAVTIKHNILVINVHSNKRSLSHGFFAGIFSVLDRWKLSIDLISTSEVHVSMALHSERPLLNGVGRDEYQIIDEDLKGALSDLQRYGTVDIIPGMAILSLVGKQMKNMVGVAGRMFSTLGENNVNIEMISQGNSYYSWSWIMRNXLSSSXGASEINISCVIEERDADRALNIIHTSLF

SEQ ID NO: 12651 - protein, 300 aa, Aspergillus nidulans
NFITQFEIMLKLPQPTLATAAVYLHRFFMQYAIADKPERPGIHRYPIAATSLFLATKVKKNVRRMKKLVIAVCRVAQKKPDLVVDEQSKEFWKWRDTILHHEDILLEALCFDLQLEQPYRILYDFICFFRVNDNKHIRNSSWAFLNDSMYTVLCLQFPARVIAAAAFYAAASHCDIGFEDDEFGRSWWEQIDVDIAQVRRACTRMAELYESNSQHRHSQYYPPVPLAWKEGAEKTRIPRPGGSLDAPPDPSSRKRSREPEDSSKSSQQPSQDTASLKKEEASQNGARSPKRPRVGSDADQ

SEQ ID NO: 12652 - protein, 406 aa, Aspergillus nidulans
VTSLVILALNVFAVEWYGESEFWFAGLKILAIIGLIILGVVLFFGGGPNHDRLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIQNAGIGGLNHVVNAAILISAWSSGNAWCYAGSRTLYSLAGEGQAPKIFTRTNRTGVPYVAVLATWTIGLLSFLNLSSSGQTVFYWFTNITTVGGFINWVLIGIAYLVCFPPSLHLNTPDQKQRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 12653 - protein, 386 aa, Aspergillus nidulans
  unsure (1)..(386): unsure at all Xaa locations
NSDSPASPTVHMPPAVTSSRSSAFVTRIELFAAGVPDWYVAPICGASAGVASGIVTCPLDVIKTKLQAQGGFVRRGKMVEAKTIYRGMLGTGKVIWREDGIRGLYQGLGPMLLGYLPTWAVYLAVYDRSREYYYETTGGCYLFFFGXPRTFTEFIIGSWWLSRGYASVTAGACSTIVTNPIWVIKTRLMSQSLRSTTEGFRAPWQYSGTWDAARKMYKNEGILSFYSGLTPALLGLAHVAIQFPLYEYLKMAFTGYSIGEHPDTGSSHWVGISCATFLSKICASTVTYPHEVLRTRLQTQQRTPPSPSPEEIAFRGGLGGMDRGRGAGASSSDGMPNRPRYSGIIRTCQTILHEEGWRAFYSGIGTNLFRAVPAAMTTMLTYEYLR

SEQ ID NO: 12654 - protein, 298 aa, Aspergillus nidulans
RGGYYGNPLQAASARGHEKIVQILLDHGADVNAQGGKYRNALLAASVEGHGKIVHILLNQGADINAQNGYYGSAFQAALVQGHEKIVQVLLQQVANVNTQDGIYANALRAASARGYEKIVQILLDKRADVNAQGGEYGNALLAASVEGHEKIVQFLLEQGADANTQVEWYGNALQVASSKGHEMVVQILLDYGADINAQSGRYGNALQAASAEGYERTVHILLDYGANVNAQGGLYGNALQAASSQGHEELVQILLHQGADINAQGGRYSSALQAASAEGFEMVVQILLDQGADVNAQ

SEQ ID NO: 12655 - protein, 369 aa, Aspergillus nidulans
  unsure (1)..(369): unsure at all Xaa locations
VAGESGLGKTTFINTLFSTTIKNYADHKRRHQKQVDRTVEIEITKAELEEKFFKGYIERPWSNXATANKNCAVXVRLTVIDTPGFGDYVNNRDSWQPIIEFLDDQHESYMLQEQQPRRTDKIDMRVHACLYFIRPTGHTLKPLDIEVMKRLSSRVNLIPVIAKADTLSPADLSRFKQRVRRLAPYXQIRRCKANRISWLTDSSVIEAQGIKIYTPPIEEDDETAAAHARSLMAAMPFAVIGSEKDVKTNDGRVVKGRQYAWGVAEVEDEEHCDFKKLRSILIRTHMLDLIHTTEEQHYEAYRAQQMETRKFGEASARKLDNPKFKEEEENLRKRFTDQVKLEESRFRQWEQKLICGADRLTRIWEATHA

SEQ ID NO: 12656 - protein, 644 aa, Aspergillus nidulans
  unsure (1)..(644): unsure at all Xaa locations
PGXASTMSYSYLPTSTHAYGPARREITSSGILQSIHDALPHGFRKGCRRSSTRRRISWKSTRVGLSXKRSHXEXYEPLFTVTNGLIIIWIWTLWWGERTVFRDSVDACAWDAWEKWVSLSRALFIEVMEQCXCFLFSRANARPHHVAFIADPQLVDPHTYPDRPWPLSTLTIKFTDQYMRRSFSSIQHTLDPDSVLFLGDLFDGGREWSTSRSSSPEERWRQYNDDFWKKEFHRFVKIFLGPWSSQETQSTNSRGRRLIASLPGNHDQGFGSGVQLPVRDRFQNFFGKGNRVDVIGNHTFVSVDTVSLSAMDQPDPRTGSTGGGNGDGDRPNQEIWQEPEDFLNAMKVHRGRAEADELRFMGEPRKGRLFKHEVSEVSKPSIYREDDPEIIGFPAILLSHVPLYRKPATPCGPLRERYPPSADGLEEDEQNALKISGGYQYQNVLTKTISNDIVSKIGPNLVQVYSGDDHDYCEISHREFSGSPKEITVKSISWAMGVRKPGFVLTSLWNPIDPTTGTSIESSSPGSTIQNHLCLLPDQLSIFIYYGVILAFTLTVLLVRAVILALRRTESTTPEPILPLTENPVIRTRSRAVSHTSSSSIPNTAFIKPGGLASRATNNYNPRYSPPHSYNDPSAYPSSDYIGE

SEQ ID NO: 12657 - protein, 551 aa, Aspergillus nidulans
TIVTGTGRRSSIRQTDLQTSVRVSSPEPMASPIDKFPAFQDEQFGTAEPTTLYPNTTVRYAPSDRWDYKPVRDSKRRPRKSISETISAIRTRNGSVSANAQDLAQALRSTCVVQAHSTAFQPRRLLQSLTRPQMLCLFWYTTSALTNTSSKSILNALPRPITLTMVQFAFVSLWCLLLSYLSTKLPWLKTSIPALKNNIRPPSRDVIMTALPLAIFQLAGHILSSMATSQIPVSLVHTIKGLSPLFTVLAYRFLFRIRYAKATYLSLVPLTLGVMLACSTGFSTNFFGILCALVAALVFVSQNIFSKKLFNEAERAESDIQSAGRRKLDKLNLLYYCSGLAFILTLPIWLVTEGYPLFSDLMQDGAISLTNKAGSLDHGALFLEFVFNGVSHFAQNILAFVLLSMVSPVSYSVASLIKRVFVIVVAIVWFGNSTTPVRALELPSPFLGLYLYDRNSHDDVADQKANADHFHFKNPILPLNTRGASKLRGSNGYAIPQGRPVDQHVLDRSFPISSNSKKDDGVGHARPRASSNTKAWLPPGTKQETTWQSSD

SEQ ID NO: 12658 - protein, 258 aa, Aspergillus nidulans
  unsure (1)..(258): unsure at all Xaa locations
VLIVGATSGIGRAIATRPIEKGIPVVISGRREENLQEFVRQHGSDKVKSKVFDVTKLDKVRRSMQCTRTSXQLKIPVFASEVLIENPDIECDFVNSGVQRPFDFSKPDTVDLPMFDQELVTNYASAVYLSKAFIPHLQARENQTSLIYTTSQMALVPMMRCPNYGASKAALHHFILALRTQLRDGLVVEIYPPPVQTELHDTKHQRSQERTSNWMPLDDFTDEVWARLQNREEQIAVGSAQEIFDAFEIKRQGLYKEM

SEQ ID NO: 12659 - protein, 290 aa, Aspergillus nidulans
  unsure (1)..(290): unsure at all Xaa locations
LVTPKELSDALKKNPSTKISTSPRVIPLCAAWFMPNDPEGRTGIDVFRKHRVPQARFFDLDAIKDTESPYPHMLPTAETFAQAMSELGIRRDDEVVVYDTEELGIFSAPRVGWTLRVFGHPRVHILNNYRLWVRDGYPTETGEPRQPERTNYPVPSYDSKLVIPFRELKEIAKEHRKEGAKEVEILDARSQGRWAGTDPEPRPGLSSGHIPGSMSLPFQELLDPETKTYLPPDQLRKIFESRDIDETKSIISSCGTGVTATIVETALGLAEYGDPSIRRVYDGSWTXVIF

SEQ ID NO: 12660 - protein, 121 aa, Aspergillus nidulans
LACAVHTGNVELVDLLLAHGARLKGSNAIVRAAIDEDLEMVKYLLLRGADIDEVGIKGPPGAEAYGDMGSPLHQAAVEGYMEMALFLIEAGADIYLKDPLGRTAEDLALEKGHMEILDALR

SEQ ID NO: 12661 - protein, 249 aa, Aspergillus nidulans
TNSPLGIGRATAHQFARNGAKAIYICDFTSTHLPTHAREIKSLYPSVDVHTRTFDAADEAALKAVIDEAIQNYGRLDIFFANAGISGSNVPFTEVTGEQFAETLRINTVGVFLAAKHASLAMRKTSPEKKYPGGSIIATASVAGLRSNAGATDYSASKAAVVSIAQTVAFQLAGTGIRINAICPGVVETGMTAAMYEAARARGTERKIGQLNPLQRGAVADEIARVALFLGSDESSYVNGQAWAVCGGL

SEQ ID NO: 12662 - protein, 696 aa, Aspergillus nidulans
RAWPLHVLSYSRSALNMLFSMRQPYIVIPSYVAQVVAYPIERAWAKVMPHKTIRMFGMSVNLNPGPYSKKEHAIAVIMANATFGGGAAYATDVLLAQRAFYKQRFDWAFEIFMCISTQMLGFGMAGFFHRFLVTPAAMIWPSTLINSALFTALHDRSRPDPSKVSGWTIGRYRMFLYCLIGSFLWYWFPGYIAPFLSVFAWVTWIKPNNVVINQLFGGWTGLSLIPMTFDWTQISGFNFSPLIAPWHGIANTKLGMFIFFWVVTTALHYTGTHWAKYLPISDSNSYDNTGQVYNVTRILTPQMTLDKAKYEAYSPLFLSTTFSLAYGLSFATIIAVLIHAILFHGKDIWVRFRQIGHEDEDVHARLMARFKPVPLWWYGAITLIMIGMALGVTLGYPTNLSWWAFFIALIMGAVWFVPCGIIQASTNIQIGLNVITEFVIGYMQPGRPMAMMLFKTYGYISMYQGLYFCQDMKLGHYMKIPPRVTFAAQMISCLWSSIVQICVMNWALGAISSVCTLDQPNRYTCPNGRVFFNASIIWGTIGPARMFSPGQLYASLQWFWLAGAALPVAIYIAAKLLRNTKYARYVRLLNAPIIFGGSSFIPPATPLNYLSWGIIGFIFNKWIRDRWRGWWMQYNYVLSAGLDVALALCTILIFLTLNLTNTEFPSWWGTNIAANTMDAAGTAVQVTEVKFGPESW

SEQ ID NO: 12663 - protein, 307 aa, Aspergillus nidulans
  unsure (1)..(307): unsure at all Xaa locations
IVLAPWEYIRSLPGKKTLGRLIDCLQCWLTLPEDSTNIIGEVSRMLFDAVLMVGLPFQXSTSNXQRRLDDIQDGSRLRRGRPAAHAVFGQPQTLNSATYLYVKGSRLVKKLKTPMSAQTYLXVCIPLGLTVTANTRRELETLSFGQGLELHWRFNTILPSTKEYLVMVDNKTGGFFRLVLRLLEVESESEPNPELMHLFTLLGRYYQIRDDYLNLASEEVTYRSPXFVTLADSXVLVTAKKGFCEDLSEGKFSFPLIHLLQNIANPEPIRGILFRRDNATDLSVEMKQFVNEEMKKAGSLTHTEAVL

SEQ ID NO: 12664 - protein, 668 aa, Aspergillus nidulans
  unsure (1)..(668): unsure at all Xaa locations
TGPRALQPSQFGMICLAYTLEGEACGLVKNLALMTHITTNDEEGPIKNLIFMLGAEDIQTVGGKEIYAPGSYTISINGTPMALTRRPKYFLNAFRRLRRMGRISEFVSIYINHHQRAVHVATDDGRICRPLIIVEDGKSRVKKHHLRKLRDGTMQFDDFLAQGLVEYVDVNEENDSLIAIYEKDITDTTTHMEIEPFTILGAVAGLIPYPHHNQSPRNTYQCAMGKQAIGAIASNQFLRIDSILYLMVYPQRPMVKSRTIELTKYDQLPAGQNATVAVMSYSGYDIEDALVLNKGSVDRGFGRCQVFRKYVTNMKSYSTGTKDIVSPTTYENKAPIRKHALLENKSLAAVGEQVNAGEVYINKSTPDQSMSSGMPGSDAGRPISYNXTPMTYKLPDPAYIDKVMISATENENQIIKVLTRQTRRPEVGDKFSSRHGQKGVTGIIVDQADMPFTDQGINPDIIMNPHGFPSRMTVGKMLELVAGKAGVLSGQHGYGTCFSGTPVEQMTQTLIDKSFSYGGKDYLTSGITGEALPFYVFTGPIYYQKLKHMVQDKMHSRARGPRATLTRQPTEGRSRDGGLRLGEMERDCLIAYGTSQLLLERLMISSDRHEVDVCEQCGFMGYLNWCQRCKSSRSVVKMVIPYAAKLLIQELMSMNVTARLKLEDEFPE

SEQ ID NO: 12665 - protein, 520 aa, Aspergillus nidulans
  unsure (1)..(520): unsure at all Xaa locations
MQRALSSRTSVLSAASKRAAFTKPAGLNLQQQRFAHKVSWIPIAIQKRPXELSASLPQLSGXLQQNCXQLGRELKFGVEARAQLLKGVDTLAKAVTSTLGPKGRNVLIESPYGSPKITKGTFALXSSFLPLSLYTTLSKVVITFTNLLRGVTVAKAVQLQDXLENLGAHVLQDVSYKTNELVDDGTATDTAVDRAIFSETANNVAAGCNPMDLRRGIQAAVEAAVDYLQQNKRDITTGEEIAQVATISANGDTHVGKLISSAMERVGKEGVITVKEGKTLEDELEVTEGMRFDRGYTSPYFITDAKAQKVEFEKPLILLSEKKISAVQDIIPALEASTTLRRPLVIIAEDIEGEALAVCILNKLRGQLQVAAVKAPGFGDNRKSILGDLGVLTNGTVFTDELDIKLEKLTPDMLGSTGSITITKEDTIILNGEGSKDAIAQRCEQIRGVMADPTTSEYEKEKLQERLAKLSGGVAVIKVGGASEVEVGEKKDRVVDALNATRAAVEEGILPGGGPALRKA

SEQ ID NO: 12666 - protein, 499 aa, Aspergillus nidulans
WYRDWTLLKLNTLLLCALLTQIASGYDSSMLNGMQSLPQWVSYFGQPTGTRLGAMTFGPTGGTLISVLISSQLCERFGRRYPICGGSIVIIIGGILQAAAVNYGMFVLSRFVVGFGLGIVATAAPPLLTEVAYPTHRGKLVSFYLVTWPLGSLIAAWVTYGTFKMEGSDWSWRIPSALQCFFSLVQAVLALLAPESPRWLIYQGRREEALAILTEYHGHGDADSRLVRFEMAEITATLEMEKVQRLSRWTEWLSTRGNRHRLFLACYIPAMLQWSGNALTSYYLAKVLVTIDITDPKTQLIINACLSVWGFLTAAVFATLVDRAGRRRLFLSGMGSMGIAYIIWTICSALNEKHNFEDKGYAGGVLAMIFVFSAAYHMCSPVAPTYIMEVVPFSLRSKAAMMYQLTGNLAGLYNSFANPVAMDAISWRYYIVWCVVIGVNFTLIFLFFPETKGKGLEEVAEIFDGPDALAGKNAMREMGLDVNADKAVAVGERKHVEEA

SEQ ID NO: 12667 - protein, 161 aa, Aspergillus nidulans
NRARDNCIGLMYDGLCLHSAEPPKAVLSKAAAVEAAAYDAYGPETKEPYRTKIRSLFQNLKNKSNPTLRVRVLSNEVTPERFVKMTHEELRSDEQREKDRKIQKENMDKAMVAQAERSISTSLQCGKCGQRKVTYTEAQTRSADEPMTLFCTCMHCGKSWR

SEQ ID NO: 12668 - protein, 402 aa, Aspergillus nidulans
  unsure (1)..(402): unsure at all Xaa locations
MAATESALTIHNDISMELPELAPNQGLEAFKDIVFGSVSYRKSPTMYGLCXRHLXAAGMIGKVIEYPFDTVKVRLQSQPDHLPLRYNGPLDCFRQSFQAEGLRGLYRGISAPMAGTAVENSCLFFSYRVVQELLQASYYSSTEPLPLTALVFSGAASGSITSLALTPIELIKCKMQVPSEPSSARVGPLKIIVSVFRQDGVLGFWRGQLGTLIRETGGGAAWFGGYEGVSALFRSYHYSPSTTFSSEVESGSLPLYQQMLAGAAAGVSYNFLFYPADTIKSRLQTEDINNTSSKRQTFGGAARASGISKDFAAYIEAVVSLVRGLRQARHSFLQYLKAYGVTLDERIRYVIRFHFDSRRFFGPFLLIDDTYDLSRLRFSCLIIRLFNQSGLGPRSKVRWRKQ

SEQ ID NO: 12669 - protein, 148 aa, Aspergillus nidulans
PLYVRFIHMLLAAQGVTASQERVQLQLLDFAYRYTSGVLQDAVHLTTEGYAGTGADTTTSSGNKGPPEVNSVTLPALRLSIASRLHYQFQTGLPKEFLMDVAAERNRVALPGATRGFDAGAGKPAASNSVLMAGMRLPPERICLTASD

SEQ ID NO: 12670 - protein, 386 aa, Aspergillus nidulans
KSGGWKLKNVALRPLREKELLVEMVASGICQTDLHFAGMETGYGVHYPRVMGHEGTGLPRWSLAVLLTYLQAPDTVRAVGPDTTVARVGDPVILSFSACKDCEPCKGGHPAHCSNFNAINFEAVAEDYVFRDASSPEPASGGDIYGRFFGQSSFASLSIVQQDSIVNVAGVVKSRQDLALLSPLGCGIQTGSGAIINAAGARPADRVAIMGLGGVGLSAVMGAKIAGCTQIIGIDRHGSRLELAKELGATHVVQVAEGMPLDEVTAAVKAITGGLGSNITLDTTGVPALIAEGVKMTAFKGKILQVGTAPETATLSIPIHEFMVSGKQFIGVVEGDVVPQEYLPKLLNWVNEGKLPLDRIVKFYQAEAFETAIRDMQSGVTVKPVI

SEQ ID NO: 12671 - protein, 318 aa, Aspergillus nidulans
  unsure (1)..(318): unsure at all Xaa locations
IEGPFGIHLWPIFDKAFQAVMGYPASEFQFVEGKTPMSTFRETAIMLIVYYVTIFGGREVMRNRPAFKLNTLFMIHNFVLTAVSAILLALFVEQLVPTIWNHGIFYSICDHRGGWTQPLIVLYYVSVSVAWEXSATNKSSLNYLNKYLEFLDTVFLFLKKKPLTFLHTYHHGATALLCYTQLIGLTAVQWVPITINLLVHVVMYWYYFQSARGIRIWWKKYITRLQIIQFVIDLGESLLRLRGPIWTRGXPQLXSSVYFASYTYFASTYFPWAPNAGNCAGEEFAAFAGMGILTSYLVLFISFYIVTYNKAAKTGRPR

SEQ ID NO: 12672 - protein, 497 aa, Aspergillus nidulans
  unsure (1)..(497): unsure at all Xaa locations
IYYLAAVVCAGGLLFGYDSGVIGLVSLFSALPCLMRSVNKPVRRRPHVPFLRRLLLPQRQHQPKXTDISALAVATQQAGALLGCLVIWPVTNSVGRRKALALCSLTFCIGVLFEILTLHSLALFYTGRIIAGLGVGGSTTVAPIYLAEMSPPHLRGRLGSGYQFTFTIGIFASYWIDYAFRLLVDDANSAQWRVPLALQLVPGVLMGAGVLSLPESVRWLLGRGETHTHEAWNSLVWVRGSDQGGRVGDEFADMKRAVHRDTEESADFHPRELLLRPNRHRIFLAVSLFIAQQATGATAMAYFGPQFFSILVNPNPQPSEAASASSNSLTLLLTGIFGALKVLSCLSFILFIADRFGRRPLLIFGALGMAFCMIATSVLVHSMPIQDQKSLIHHISKVLTTILLIYLFIVIYNTSWGPLPWPLVAELFPTRTRSSGVALAVASQWASNLVWSFATPFILRDVGANTFLLFGGVCVGAAGFVRLCVPETRGLSLEEVQ

SEQ ID NO: 12673 - protein, 355 aa, Aspergillus nidulans
  unsure (1)..(355): unsure at all Xaa locations
SIADELLLVDTRAAWRDGQVRDLSDAAYASRSKTRVYSATYREASQCDIVVITAGSKYLYGRCLAFPSILASGDGDWTCMGTGQTSMDYLYRNTSIVRSIINEMKPFRSDTVLLIVANPVDLMTSLAKELSNLPSAQVLGSGTFLDSIRLRGLLADETGVSTTLIPLAVPVGEHLFHFSFFFSFFCPTCTTAILTARXELVASSVVKNVNTLNMPLIVXLAPNSLDLYVLGTHGDSAVAAWSCAAVGGVPLKDALGLEKRVEESLVEECKHRSQSIVRAKGATTFGIGSIVCSIRKVVLLGRHNVRPVSHYQPQHGCCFSLPAVLVRKGIVQTFPVPLSAADEEGIAQSVGALKS

SEQ ID NO: 12674 - protein, 799 aa, Aspergillus nidulans
  unsure (1)..(799): unsure at all Xaa locations
PTXRFNMSSPAKKRKRDTQPTRSIASFFQGQTAKQTEKSEQLASLADTEQHLSDEALARKLQAEWNNEQDFASPATVPHSEPTAASPSPEKDREQKKAKVGVLSLQSSTGTEDTISLSVPFDQSPLVFDSSRYAGELKAHWSAEGGNASYALLTRAFVLANSTTSRIKIVDTLVNFLRVLIEGDPSSVLPAVWLATNSISPPYHELELGLGGSSISKAFKKIYGLNSQGLKSLYDRLGDAGDVAFEAKKRQSFTLIKPKPLSIKGVYQSLIKIAMSKGSGSQELKQRIVEKLLQDTRGAEESRYIVRTLVQNLRIGAVKTTMLIALARAFLVSKPDNATFTVHSQHELARLKKEELAEIYSSAEELVKASYARHPNYNDLVPCLLEIGVTEELLLRCGLQLHIPLMPMLGSITRDLSEMLTKLQGRDFTCEFKYDGQRAQVHCDEAGKVSIFSRHLEEMTEKYPDLVSLVPQIRGEGVSSFILEGEVVAVDQNGELQPFQILTNRAKKNVDIGEIKINVCLFAFDLMYLNGAPLLERSLRERRELLRSLFMEIPNRFTWVKSLDATSADSEAVLDFFKSATENKCEGIMVKVLDNTLATNGSDSTNSSITATPKAEAKETKKGGRRKALLSSYEPDKRLESWLKVKKDYSASSETLDLIPVAGWHGNGRKAKWWSPILLAVRNPETGGLQAVTKCMSGFSDKFYQANKEKYEEGSPNVISRPSYVEYNGEPDVWFEPQEVWEMAFADITLSPTYPAAIGLVSDERGLSLRFPRFLKVREDKSIDEASTSDYLALLYRKQ

SEQ ID NO: 12675 - protein, 466 aa, Aspergillus nidulans
  unsure (1)..(466): unsure at all Xaa locations
QLQRRLSNRHIQLIAIGGSIGTGLFINIGMGLARGGPASLLIGIIIHCCFMALVNNCIAEMTVLFPVSGGFIRMADKWVDSALGFMAGWNFFLYEAILIPFEITAPSIVLQYWRDDIPSAAVTAVTIAMYGXVTLIRSEAAGXPQIXCSXSAPVGLYGETEFWLSSGKVVLVFILFGFTFFTMVGVNPQRDAYGFRYWVSPGPLAEWHTGGDLGRFEGLLNVTWVGTFIVVGPEYLSMAAAETRHPRVYVKSAYKAVYFRFGLIFNGSALAAGIVFPTMDPVLQSLARGEQSSSSAAASPYVVAMKHLGISVLPDIVNALIFTSILSAGNTYTFCAMRSLYGMALEGRAPGFLRKCTKGGIPIYCLGVTTLLSCLAFLQESRSSHVVLQWFVNLVTAGCIISFIVICITYLRFFRACKVQGVDRKNFPYYAYLQPYGAWLGLFWTVFVVLGYGYSSFTPWNVGTFF

SEQ ID NO: 12676 - protein, 344 aa, Aspergillus nidulans
SDLNRLNPIHVAGTKGKGSTSSFISSILYQFTPSQSSSPVFNKVGLYTSPHLRFARERIRINNEPLSEELFAQYFFEVWDRLDDAARAAGEDPNNLQTKPQYFRYLTLMAFHTYLSEGVDAAVIECGIGGEYDCTNVIEQPAATAITSLGIDHVALLGNTIEEIAWHKGGIIKANTKAFSAPQPPSAEKVLRERAANKHTELEFVSSHPDLKKNGDIKLGLAGDFQYGNAALAVATAGEVLKKVGKLDISAGFREQSLPAEFRKGLEQAQLEGRCQTRKEENVIWYIDGGHTQESIKLAGQWFASQIKADSSSEASAAKKLRVLIFNQQTRDSNALAQSLHETL

SEQ ID NO: 12677 - protein, 452 aa, Aspergillus nidulans
  unsure (1)..(452): unsure at all Xaa locations
KHLRIYTGILDQDNPAEDAPLVYASDILTKPRLWNIYRMGNGRKSFLLSDGDILRLSERVYLIYRSLDNAQHTYFDPFQVHEMEGEYLPMLLTSTHVLQAFSHEYVITRRKLGSGAYGQVHMAYNKSTGQQFACKIVNLLAVKHQLAKVGEARHELAFGKNISAKMKDSYVRFQLQETLEKYHREAKILETLQHVSLASMYLSXLTYEAEYHWLGEGVYXXQYHVSLMSRNQYSCSDMSRYMFQDLLTAGDLFSYIQYKGGRLPDIEAAVIVRQIVIALDYLHDRNIVHRDLKPDNILMTALADGCRVVLTDFGCATFVDPMTNRMLSTVGTFEFSAPSVLFDPWGYHALILYSEVVRQNREGYTKAADLWSLGCLAAVLLTGEPVFDNMRNGHDENCRLKAIEELKVKMHRLNVGDRAQDFVFRLLQQDVRKRMDVKQALQHMWFTNPSHK

SEQ ID NO: 12678 - protein, 494 aa, Aspergillus nidulans
  unsure (1)..(494): unsure at all Xaa locations
LARGFDAQVNGAVLSIPSFRRDFGEHFEGDFVVPAPWLSAFNSISSVGQFFGGFLCSAVADRVGRRLALAVGVMISCGGIFGELFSTARVAFLISKLILGVGLGFYLTIGPLYSSEVSSTIRKCVTNASHXQTKVSPVVLRGITTAGVNLGIVIGQLLSNAAIKGFGERGDRWAYRGPFAIQFFFVGMSISNVXCLIEQAHQTXPQVFLGLGLPFSVESPWYLVRHNRIDDARNALQRLYGAGTNVDTKLVAIRMTVAQDLAARESKWSYAIRGPNLLRTTISCGVFVCQHLVGIIFVLGFSAYFFQLAGLPTERSFDLGVGVTACGVVGTIISWLIVNRLGRRLIFNSGMAILSTINLLIGILDVVPTSGASWTQAALTVVWAFFYQVSIGAVAFVLLGETSSPSLRAKTTAMATATQAVFGIVMNIVIPYMVNPDEGNMQGKVGFVFGGLGVVATVLCYLYIPDLKDRTFEEIDLMFETRVAPRNMGRYVIE

SEQ ID NO: 12679 - protein, 494 aa, Aspergillus nidulans
  unsure (1)..(494): unsure at all Xaa locations
PXNDNRRNXSNRPSILDDQWLFRXTDRVAITILSRAQTTEDMLLSQIHTGTMKRSCKIIFLSLYFLSSNVAVSXSLLLSSDVFGDQSEIDVSVYDRNDSEAFLGHVRLCVNLKEDNSRLDGWFPLKGRAAGDSRVSGEIHMEMRFEKTEKKQVGPNDFQILKLIGKGTFGQVYQVKKKDTRRIYAMKVLSKKVIIQKKEVAHTVGERNILVRTAMAASPFIVGLKFSFQTPTDLYLVTDYMSGGELFWHLQKEGRFQEPRAKFYIAELIMALQHLHDHDIVYRDLKPENILLDANGHIALCDFGLSKANLTQNDTTNTFCGTTEYLAPEVLLDEQGYTKMVDFWSLGVLVFEMCCGWSPFYAEDTQQMYKNIAFGKVRFPRDALSTEGRNFVKGLLNRNPKHRLGAQNDAKELMAHPFFHDIDWEALGRKEVIPPFKPKLKSDTDTSNFDPEFTNALENSNSLNDRAAALANGFMAASTPLSPGMQANFQGFTF

SEQ ID NO: 12680 - protein, 471 aa, Aspergillus nidulans
  unsure (1)..(471): unsure at all Xaa locations
YLESLPGTVFFKLYQQPSTALAIFRRMLPDLGMYIMWSAIHFDLGXSHTYDGAKCFVMALLYLKDPLPAADLETWVRSESLRXVSSQSGVCVLXKANRLSFLRERDSALSILARLHILTNATKKGSVRAYMVTDPFAASLRQALTGAKETQSFGCLHHIPDDQTVPIHDLDEYARRQWEGVLGYMVGTSGLGIQRDVNLSKGVKQLLQAGHLVEIRDRRVEITQDGFAFVLQDVGTQVWHILILYVESAEAIGMDSVEVLSFIFLLSSLELGKSYEKKHLTSNHVRTLTDLADFGIVYQDSPEASHFYPTRLATTLTSDSSALSNPISGALSDPDGGDSNQPGSGFIIIETNYRLYAYTSSPLQISLIALFTTLKYRFPNLVTGKVTRQSIRRAIEMGITADQIISYLATHAHPQMRKHNVARSTSNQAGMPPSVLPPTVVDQIRLWQLERDRVKATSGFLFKDFVSLAEY

SEQ ID NO: 12681 - protein, 265 aa, Aspergillus nidulans
  unsure (1)..(265): unsure at all Xaa locations
MKTXYSRRLWAVVYXSPCRRYRTMEAAANRLQKEAKGYLDSLRGTAIVKRVDVRSVCXLFAQAMTASQMRIAETIDAFYGDAGAKDGVSRSYKQAVEDLDAETIKALDGPYRYILVFLRRVFRRXLTCPRTTVLDPISRFCAYFPDVNECIKKRNNKLLDYDAMRAKVKRLVEKPDKDATKLPRTERELEMAKQAYEQLNEQLFTELPQLIDLRVPYLDPSFEALVKIQLRFCAEAYSRMAQVQQYLDAETRDQYARGDLDNRVE

SEQ ID NO: 12682 - protein, 281 aa, Aspergillus nidulans
  unsure (1)..(281): unsure at all Xaa locations
EIRGRLALITGASEGEPTPSHHLSDXGXHALRIGAACARQLAEKGVHLALTYASNLSAITSLTEQIKTTFPDLRISIHQVDVASAEQIQDMFLQIDKEHGQRPDILVSNAGYGKRVPQVWDITLEEFDYTINVNLRASFILVKAMIEHMRNQRWGRIIFMSXIAASGGGITGCRCALFLLPSILNQRLRSVRADYAASKGGMTGMMKNLSTRLAEFNISVNDVAPAMIGDTGMIPNAQAIPEVAAGIPIGRLGVPEEVANVVTMLATTGYMTGQSLLLAGG

SEQ ID NO: 12683 - protein, 465 aa, Aspergillus nidulans
  unsure (1)..(465): unsure at all Xaa locations
PVFSLEEYEFSAQTGFLPETPPLRCLPDHYYAPCETVAQDLAASIENGTIRQAVESLPLLNTTKLRTKPEWRRAYVVLSYLTHAYVWGGKSPRRLVFCPLGIXYGFSLLVSRXVLPSAISVPYLEVSRYLELPSVATYAALNLWNWSTSSPNDDLTCADNLSVTLSYTGTKDEEWFFMVSVALEARGARVIEMMLNTIQAVTVGDDQRIVAYLNQITEGFNELARILERMYEKNRPAVFFHLLRPYLAGSKNMASAGLPNGLFFDQGNGKGEWLQYSGGSNAQSSLIQTFDIFLGVEHTAMGRSHXDXASKGKIGKDSIHPGMPSHLSRAVVYEQSDINDLLQEMRNYMPGPHRRFLEMLTRNANLRPYAMSCKLGSPVRDAYNTAVMALGSFRDKHVQIVTRYIILASKLPPPANTPVRINLASTTQTQMKDSTEKVSTGFSGTGGTDLIPFLRQTRDDTKATA

SEQ ID NO: 12684 - protein, 576 aa, Aspergillus nidulans
  unsure (1)..(576): unsure at all Xaa locations
PEPQTQRTSANQSTPDVSSTLSLGTPHPPLPSTGRSRSMERAQTMPTESPAASSSPTAPIVRPADIYKRMREEQQDRRPSPAAPSTDERASGGVTVLESSENTVPPAAQAPEPITKQNKPVSRKRVPPRQHRTTPRPSHCQKXSAYPRSVLVSSVNPNATLRTTRNREINHISYITIRLSASAPPSTKLGMGVKLQVPLLTAXLAQIAIARWAXVPSFPVAGNTDDKTPTIHEEPNENTETPTEGNMVFKPGHRRDLSIPSPGNSPSRRPVVAGPDATASSELAQISSGSPVESPLATQPQQHVFNPDIPQPSREATRGDLPAPLNVQTNIVSNPAVSTDIPVIIPAMSTENSPEDTRMIGXERRLFVPXAERTHPPTTRRMARHPIPVERIIYSRENYEAHRAAPQTATSPGSEPSGPTFDTILATSQALSTGNLTPPPSHVSQPKLKKRFSWEESSEDEDPVPVTQAQPARPPPMPGQFPFSQDSVLPESVVAPTKQQSEIADASEERVGPPTPEKPKLTLVPPVAMDAPSIPLSDHGHEPALSQTTETLARAEEGDSSSHMPPTLERPTHTPP

SEQ ID NO: 12685 - protein, 110 aa, Aspergillus nidulans
QVSFLRSGHGCNVDWTDHMDSTPLLLAAERGHLDIVSFLLEKGAQTNHTDLEGRTALFWASKGGHMGIVRVLVAQGADLNRADEYGRTPMLAAVQHGRTEVVQFLLDAGA

SEQ ID NO: 12686 - protein, 310 aa, Aspergillus nidulans
  unsure (1)..(310): unsure at all Xaa locations
SIGYXEWGTGAVRPEQGILNVRKEMGTFANLRPCNFAAPSLVESSPLRPEICRGVDFNIIRELTGGIYFGERKKTTAAFALDTEPYSRAEIERITRLGAHLALQHNPPLPVWSLDKANVLATSRLWRKTVTEIMAKEFPQLKLEHQLIDSAAMIMVKDPRKLNGIVITSNLFGDIISDEASVIPGSLGLLPSASLSSIPDGKGKVNGIYEPIHGMYSYVIAPLEDXYAELILLGSAPDISGKGIVNPVAAILSVGLMMQYSFALFEEARAVATAVSNVIEAGVRTGDIGGKASTKEVGDAVAAELEKLLK

SEQ ID NO: 12687 - protein, 370 aa, Aspergillus nidulans
  unsure (1)..(370): unsure at all Xaa locations
SVLKVVDPNTAENVDLRNIRIVKKVGGTIEDSEMVDGLVLNQGVIKSSGGPTRIEKARIGLIQFQLSPPKPDVRLCLKNFXSDTDGLQMENQIVVNDYRQMDKILKEERQYLLNMVKKIQKTKCNVLLIQKSILRDAVHDLYLHLLSRLRFSASRHXRDQSSSCAEFGCMPVANVDSFTEDKLGTADLVEEVQSSGARYVKITGIKAPATTANQTVSIVARGANNLILDEAERSLHDALCVIRCLVKKRALIAGGGAPESEVANTLAKRARELTGTESICWRHLAEAMEVIPTTLAENAGLNSIKVVTDLRHRHAQGQQNAGVSIRSGGVKDDITEENILQPLLVSTSAIELAAETVKMIMRIDDIALSR

SEQ ID NO: 12688 - protein, 512 aa, Aspergillus nidulans
HEADDDSIENIATSWFVWLVSLTASIAGSLFGYDTGIISAVLVYLGSDLDGRPASENEKQLITSLCSGGSFVGAIIAGLTADKVCMHAYCLLPGLVGTNLHLIFGRKPAIYVGCVLFTVGAVLQGAAYSIAQMSVGRLIVGFGVGSASMVVPLYIAELSPTKVRGRLIGLNNMSITGGQVISYGIGAAFAHVPHGWRYMVGLGGVPSIILACLLPFCPESPRQLVYHGKTQEAETVIRKIYKGASDAQVAAKVRLIVRACDESRELNKDSTRWAKIKLLHSNPAYFRALVCACGFAVIAQMSGFNTLMYYSATLFDLVGFSDPVAVGIVVAGTNFVMTWVNMMLVDPLGRRRVVLLTAWGMSAGLIAVAIAFKFIPVDTSTLELETDTVSPPAIVVLIFIIWFVFFYGASMGNTAWMNTDFFPMEVRAIGTMFQTCCTWGSNIIVSSTFLSMMQGITPSGAFGFYAAICGFGYILIYFFYPEVSGLSIEEIREVFQHGFGVAYSRKLRKTRK

SEQ ID NO: 12689 - protein, 336 aa, Aspergillus nidulans
  unsure (1)..(336): unsure at all Xaa locations
ETIAGFTAGTATTLCLHPLDLIKTRLQGTFSPATLPLRVQHVXYQAVHSRPNLIVSSRQFLSESSAKSSTKEGGLIAFYRGLTPNLIGNSSSWALYFLFYDNVKEILGSWRSRSNSNGLAAAPGAAGSIRLFYRSGSAGVSTTAVRKSESSKTNGYVYGIGIITSILTNPIWVIKTRMLATGSMSPGAYTSFTAGAMQILRSEGVPGFYRGLVPSLFGVSHGALQFMAYEKLKFHRANAHSGGLQRKELSNMDFFIISSVSKIFAGSITYPYQVLRSRLQTYDAYLAYRGLQDAIVKIWATEGLGGFYKGLGPNLFRVLPSTWVTFLMYENTRAYL

SEQ ID NO: 12690 - protein, 267 aa, Aspergillus nidulans
  unsure (1)..(267): unsure at all Xaa locations
VIILGDSGVGKTSLMNQYVSYLLFPSRARFSAHTDSPTRVNKKFSGSYKATIGADFLTKEVLVDDRLVTMQARIHGTACSIHKLTKWSRSWDTAGQERFQSLGVAFYRGADCCVLVYDVNNSKSFEALDXWRDEFLIQASPRDPESFPFVSRIGPWLRSANRAFXVVIGNKIDMEESKRMISSKRAMTFCQSKGNIPYFETSAKEAVNVEQAFEGISFQXCYTGTLLISAIVIARSALAQEEAEEYGGDYTDPINIHDTTERDGCAC

SEQ ID NO: 12691 - protein, 575 aa, Aspergillus nidulans
  unsure (1)..(575): unsure at all Xaa locations
PDGFTDDPDHXGNRNRESIPRDTFSYSLIRARARTQRRLELDQYLRPFLSAQKSGSCQETLGHSRRDYLRQYRVLKSRPQDKTSRAGTASLAGFEPLKILGRGSFGVVRLVREKRTDEQTQSGRVPLAPKTNHRQAMTGVKKDVFAMKVIRKSVMIRNCQEAHLRAERDFLVASAKSRWVVPLIASFQDQKHLYLVMDYMVGGDFLGLLIRHNILRESIARWYVAEMILCIEEAHRLRCIHRDVKPDNFLISESGHLKISDFGLAFDGHWAHDQWYFTYQRHSLLKRLGIQIDGDAEDQKLSHDANIQSLGTTREDGSMEDDWIHPPTNGLLHWRDKNQTRTMARSVVGTSQYMAPEVIRGHPYDGRCDWWSLGVILYEVLTFSLPFCLSLVXHPHSACMGFTPFASEDRHQTKLKIHVSGLQYSLFIMSGFCXYSMKKRHLQTLYFPVHRPTDKLVSADAIDVINSLLQEKEFRLSSPKYKQNDAISSKPAKCSFYKPDSSNPSYQGHYVYPDDATDIKSHRFFRGINWEQIHRTSPPFIPMVRGWEDTRYFDDGEHPSDREDDSSDSELDGVQ

SEQ ID NO: 12692 - protein, 498 aa, Aspergillus nidulans
TYRYNESPVYTTSNGCPVRYTYDSAINQADNPRVMDPQASQRVGPNGPLLLPDFNLIDLLAHFDRERIPERVVHAKGAGAYGEFEVTDDISDIIVIDMLKGVGKKTKTFVRFSTVGGEKGSPDSARDPRGFACKFYTEEGNWDWVFNNTPVFFLRDPSKFPMFIHTQKRNPQTNLKDATMFWDYLSTHQEAVHQVMHLFSDRGTPYSYRHMNGYSGHTYKWIKPDGTFNYVQLHLKTDQGNKTFTDAEATRLAAENPDWHTQDLFNAIARGEYPSWTCYVQTLSPEQAEKFRWNIFDLTKVWPQSEVPLRRFGRFTLNKNPENYFAEVEQAAFSPSHLVPGVEPSADPVLQARLFSYPDTHRHRLGTSNYQSIPVNCPLRAFTPFHRDGAMSVNGNHGANPNYPSTFRPLQYKPVKASQEHEKWAGSVVTEQLPVTDEDFVQANGLWKVLGRQPGQQENFVGNVAGHLCNAHPRVRQATYGMFRRVNADLGKRIEKAT

SEQ ID NO: 12693 - protein, 740 aa, Aspergillus nidulans
  unsure (1)..(740): unsure at all Xaa locations
TEAPTICQTPECVNAASDILRNLDPNYANIDPCTDFDQYVCGGWRNQHDMRSDQGSIFAGTYMEEASQTRLRHLLESTGPSDPADSKIFEKLKAGYNACFDEDAVRNRGNEPLVKLLNDFEKIYSLDSAMGGTEAGLTDSVLYLYKSGVPALVLPSFRXAFPSVXVYNIRTNTLVQPDDRDPDNVVIFLTPPRKIGLPAREYYNDTQTVSDYTAVVETVLGEFVGSKKGKQFSKDVVAFESALADVTPTTQVQEDVTQYYNPRSIEETESLLPQILISDIISDLAPSDYETNRIIVGSPSYMKSLSKILADTSRETIQFFFKWKIIQAYSEHVESAEIEPLREFNNVIAGKDPQAKMDRWRKCITTVDEDLGWILSRFYILDAFPEESKRLGDQIVSDIKERFVFTLDQTNWMSSEVRKLGIQKVGNIVQKIGYPTKSPNVMDPADVEKYYQSLSISNDTYFENGLAVSRFVVEKEWSELGKPTNRDQWGMTAPTVNAYYNPPGNEIVFPAGIMQPPVFYGKGAPLYLSYGAFGAVSGHELSHGKLRPSIQXNMXELTHISKPFDSTGRHYDETGNYTDWWDEKTVKAFEDRAQCFIDQYSNFTVHGKDSELHVNGRLTLGENIADAGGLTAAYHAWKKRDEAHADPILPGLSSFSKEQVFFISYANWWCSKTTPEKAQEAIYNDPHAPKPARIIVSRIRTLGTAVVMGLTLGLIGYHANSLEFKEAFNCPNKQPTCKLW

SEQ ID NO: 12694 - protein, 285 aa, Aspergillus nidulans
  unsure (1)..(285): unsure at all Xaa locations
MGCMSSKQLEAGDDKEAIQRNARIEKSLKNDKKVMDRTIKILLLGTYKVEXPLQTCLWLSQGAGESGKSTIIKQMRIIHSGGFPEDERRQTRAVIYSNIVVAFKVLLDIMRTENIDFEQEGTRVSDSTCLVIICMLKLICTTQFSLXQNFVDNLEPDVGVEEAFSDLRVRDAMNEMWKDGGVQKAVSKGHEFALHDNLNXXAGRXAVPSIPTLLMIMXLLHSLDRLFESGWLPDNQDMLQARLRTTGITETLFELGQMNFRMMDVGGQRSERKKWIHCFEGVQCL

SEQ ID NO: 12695 - protein, 532 aa, Aspergillus nidulans
  unsure (1)..(532): unsure at all Xaa locations
VSLTAPNGHKYEQPIGLFINNEFVASKSGEKFATVNPQVCISGDARXXLYSNIRASDEEEITQVYAAGEEDIDIAVKAARKALKDPSWKLLTATDRGNLMLKLADLIDQNKETLAVIETWDNGWXNLSILSQPILXLSXAKPYQVSLNDDLSEVVNTIRYCAGWADKIHGQTISTTPAKFAYTLRQPIGVVGQIIPWNFPLAMAAWKLGPALACGNTVVLKPAEQTPLSILYLAKFIKEAGFPPGVVNIVNGLGRVAGSALVTHPGVDKVAFTGSTMTGKEIMKMAAGTMKNVTLETGGKSPLLVFDDADLEQAAKWAHIGIMYNQGQVCTATSRILVHEKVHDEFIRLFREAVATTSKVGDPFSDDTFQGPQVTKAQYERVLSYIESGKQEGATLVDGGVPYKNVKDGKGFFIAPTIFTNVKDNMRIYREEVFGPFVAIARFSTEEEAIDRANDTTYGLGAAVFTKDIERAHRVASEIEAGMVWINSSNDSDFRVPFGGVKQSGIGRELGEAGLEAYTQIKAVHVNMGTKL

SEQ ID NO: 12696 - protein, 1030 aa, Aspergillus nidulans
  unsure (1)..(1030): unsure at all Xaa locations
AVNNLSIDVNKGQIMVLLGANGSGKSTTLDAIAGLTKLSSGDININYGTEEPGFGLCPQKNVLWDNLTVKEHVKIFNRLKSTGKVDTEEQIMHLLRDCDLQKKAKARSKTLSGGQKRKVQLAMMFTGGSPICCVDEVSSGLDPISRRKIWHILLAETGSRAIILAAQYLDDSFLLADHIAILSKGVLKAKGSSVELKNQLGSGYRIHVFNVPGSERAVQKRFSSIHKEVHFDETVYTVQNSAEAAQFVSELEQEGMMEYRVSGPTIEDVFLKVASELDFEPSRGRVREGERAADHSSEADDENIERRSLHLMTGCRIGIILQAWYLFRKRLTILRRNPLPYLAAFMIPVIAAGLVTLFLKGLRRRMLGRGFLPNTXIYHRRSMGXLAPCDWPIRQSAARTSRELRGLNERSIDAVQSSSNASQFYIVDDYPDFSDYIKANYSKVTPGGVYLGDSSWQPTIAWKGDNGNFPLAALYAERARSVCNRDVHXHRFRLFRYSFNAGLLQYLAACCILWACMSVYPAFFALYPTCXAAEECRALQFSNGVRALSLWLAYIPFNLCQVVASSVLAVIIFRAVTNIWYHIEYLFAVFFLYGLCGTLCAYLVSLFTKSQLAAFAFAAGFQCVMFLIYLIAYMCVLTYASTDKIDSYIDITHYTIAIVSPSGNLLRALFASLNVFSILCRGSEGREIASYPGEIGLYGGPILYLILQSIFLVVLLVWIEGGTPLLSWLRPKSRQRDVEEKELMDSDIAEEITRVSSSKDNLRLLHVSKAFKKFIAVEDVTFGVGAGEVFALLGPNGAGKTTTISLIRGDIQPTRNEGEIFVENISVLKQRAVARSRLGVCPQFDAMDQMTVLEHLVFYARIRGVPDINHNVNEVINAVGLKQLRHRMAAKLSGGNKRKLSLGIALMGNPSVLLLDEPSSGMDAASKRVMWKTLTAVAPGRSIVLTTHSMEEADALAHRAGIMARRMLALGTTDALRLKYGNMYHVHIVHTQAPHTSDEDMEKIRGWVTDNFPGAVIEQKTYHGQLRFSV

SEQ ID NO: 12697 - protein, 464 aa, Aspergillus nidulans
  unsure (1)..(464): unsure at all Xaa locations
QVGWKGTTALMMKAQLGLGVLSIPQVFDTVGLIPGILIVLAISGMTGWSNWMVGVFKRRHPEVYGIDDVGRMLFGRIGFEVLGAAYTLREXYSPYALLLANVPSLIFVSGSGMLSVSIALNALSSHAICTAIFVAICAVVGFGLSSIQTLAKMSWLAMGRYRLYHCCGXVLYYLCSSLSXPVPVSTVTIAVGVQGHPPAIDGVVPEADYKLFNSPSFAEAMAAVSTVCLSYAGTPAFFNIAAEMKDPRLYTRALAISHSIITVIYIVCGTVVYYYCGSHVASPALGSAGALIKKICYGIALPGLVVSMVLLLHVKSSPSSNESTLRXLSQLPAKQIFVRMLRGSKHLTSHTLIHWVAWLGSTFAVALIAYIIASGIPVFSSLVSFVGALFGTPMCFQPFGCMWLYDNWGSGTSGKPLSWWFKVCWSSFMVLAGCLLTIAGTYGSIVGIIDSYNASGGSSAWSCA

SEQ ID NO: 12698 - protein, 282 aa, Aspergillus nidulans
  unsure (1)..(282): unsure at all Xaa locations
FMLEGKVFAVTGGARGLGLTMAEALVEAGGEGSFPVIXIPMRMLRMLTSAVYCLDRLPEPDDEFYAAQKRANPDFGGALHYRRMDVTDDANTEAILDDIASKKDRLDGLIAAAGVNHVKDAFDLTPEMVDKLIHINYTGVFRSAVAAARAMTARKCPGSILLVASMSGLIANKGMASAIYNSSKAAVVQLSRSLAMEWSESRKDGTGGIRVNALCPGHIETSMAQMVMEKDPETRVIWESENMMKRLARPEEFRGITLLLMSDASSFMTGSTVVVDGGHTAW

SEQ ID NO: 12699 - protein, 534 aa, Aspergillus nidulans
  unsure (1)..(534): unsure at all Xaa locations
QDGLNGRQIAEPRGRTLGGSSAINLGMVIYPSKKGVDSWEELGNPGWNWASLSEYLRKSETFTSPSPSIRDELSLGYIDETLQGGNGPVHISFGDGPYPAFSAAWPKVFENLNHRLTGDPISGVSKGAFCNPATINPKDKSRSHAGVAYYNKEVAKRPNLRVLADATVARIVLKIEADGSLVATGVQFTPKDGVQRTVAAAVEVVLSAGAVQSPQLLELSGIGGAKLLEKHGIEVLVDNANVGENLQEHGFVPFSWEIADGRQSGERLRDPAVAQMAMEAWQQHSGAGPLGLCPLASAYMTLPSLQDGELKALLKQYLDDDQYPSASRLXGSVPHPAPDVGGXDGAQGQYTLAPFQITPEKGPSPKGIFGMSEPECFVSIVSVLNRPFSRGHVHLASSDPYAPPVFDPKFFSHPLDLEIHARHTQWLETLASTEPMASLIKKHGRRLHSSKRVDDLDTARELTRDRIVAHYHVTGTTAMAPRENGGVVDERLRVYGTKNLRVVDAGIMPLIPRGNIQAIVFALAEKAADLIKED

SEQ ID NO: 12700 - protein, 597 aa, Aspergillus nidulans
  unsure (1)..(597): unsure at all Xaa locations
MADAVIAGQRVEAPVTWKAYLMCVYAAFGGIFCGYDSGYINGVMGMDYFIQEFTGKVRKIPCFCRAKNHTFSSMXVKSETPAAQFVISSSNKSLITSILSAGTFFGAIIAGDLADWYGRRITIINGCGVFMAGVAFQIASTTVPMLVVGRLIARVGGGFVSANIILNMSEISPXKFPGAIGSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQVSRDPTSLSSISHQIVGALTQCRWTGVNFVFYFGTTFFQNVCTLIPPVRXWWLILIQLGTIDDPFLISMITTIVNVFSTPISFYTMEKLGRRPLLLWGALGMVVCQFIVAIAGTVDGDNSKTVSAQISFICIYICKWYTHYESCVWLIIIAVFFASTWGPGAWVVIGEIFPLPIRSRGVALSTASNWLWNCVRYSSLPGSWDLALTLLXIIAVITPYMVDIDKGNLKSRVFFIWGSLCACAFVYVYFLIPETKGLTLEQADKMMDETPPCTSAQWK

SEQ ID NO: 12701 - protein, 448 aa, Aspergillus nidulans
  unsure (1)..(448): unsure at all Xaa locations
FDLSKCARKNILKLQPYRCAREYVRPLTLPPQSAPKLINRTSDYKDDGTNVLLDANENAYGPGLALNSGGALQESAANGHSTGSSKPEIDLLGLNRYPDPYVNYALQALNSHLSDHNGLKXHQHPLKQLFCNIRNTHTHTDKTITPENLFVGVGSDEAIDALLRAFCVPGKDKILTCPPTYGMYSVSADVNDVEIVKVPLDTDNGFALQPEKINAALSADPTIKLVYICSPGNPTATLVSKSDIQKVLEHPTWNGVVVLDEAYIDFAPEGSSLAEWVAEWPNLVVMQTLSKAFGLAGIRLGVAFTSPEIATLLNSLKAPYNISSPTSALAMAALGNPKNLEVMRSYRSKIIAQRDRILKELPSIPGIGRSRGGTESNFLLVEILDKPADQGGKPSNPVALATYEAMAEKRGVVVRFRGKELGCEGCLRITVGTEDEVTRFLEEIRHVL

SEQ ID NO: 12702 - protein, 200 aa, Aspergillus nidulans
  unsure (1)..(200): unsure at all Xaa locations
TLLENYVHGFAPSLLAPGLYLHSQDIFVDNVHMELSLWDTAGQEEFDRLRALSYEDTHVIMLCFSVRSLPSLRPSGXYMENRSDSPDSFENVASKWIEEISENVPGVKLVLTALKCDLRKDEYMNDNPNVITYEQGLAKAKEIGAVKYLGKASMLFWSERPELVXCFHRVSAVQNRGIREAFYEAAKVALEVKAQNTGSS

SEQ ID NO: 12703 - protein, 400 aa, Aspergillus nidulans
  unsure (1)..(400): unsure at all Xaa locations
PKLTEDRXITLTGLFFVLINLFTVLYYNPSLDQDCPPWVYASCAIGLFLYQTFDAVDGIQAYVSSSVVWRMELIRLIERRTKQSGPLGELFDHSKWSSXYSCKSCHXDLFCRCDACNTALGVLIFAGVMNLGQTWATVLTLFGCMVVPEPRSSAKPNFIPIATMTFYVQTWDMYYTQVLTLGIVSGPVEGVLTLCVVFGFTAYMGGGSFWHQPMFETIGVPKLEFIPKQLYDLPFTQWYLIYGAVMLFFATGSSIAHVIQVRKERGKDSIGPLFGILPLALTWVVVPAYLYLNPTILENYLVPFALYVGLVNAYAVGRIICAHLVHQDFPYFNILLGPLALAVVDSAGALFGVWSSTLIGTIGQPAFVFLCLGLGLGVYGSFVVSPASTLSIYKSLIVLA

SEQ ID NO: 12704 - protein, 591 aa, Aspergillus nidulans
  unsure (1)..(591): unsure at all Xaa locations
GKCSAFTGPGRTDRDSTNPSHNQRFWLPPQSSDTKSHXICRRTPSQKWMARHRCRRKSTSENPLGVPXRKPSFSENEWKITTAEQGNGGLRNAVRAAAETGQLEDKVWVGTLGMPTDALTESTKATISEKLEGEYDCLMVDVSDSDFDGHYTHFCKTILWPVFHYQIPDNPKSKAYEDHSWVYYVKLNQVFAERIARNWRRGDTIWVQDYHLLLVPAMLRKLLPDAQIGFFLHVAFPSSEVFRCLAPRKELLEGLLGANLGGLQTEDYCGHFLQTCSRILSVEATNDGLQLEDRFVNVRKFPIGIDPLSWDKRRKAADVEQWIKTISDRYAGKRLIVARDKIDQVRGIRQKLLSYELFLNTHPEWREKVVLIQVATSTTEQPELEAMISDIVMRINSTHSTLAHQPLVFLKQDLAFPQYLALISVADAMMITSLREGMNLTSHEFVYCQDGKYGAQRYGSLILSEFTGSASVFGNHALLVNPWDYHQCADAIHTALSRSEEKRQQVWTQLHEAVLQNSTSNWVKSFSETLSRVWHEQSSREIMAVPRLPMNKLEDRYRQAKRRLIILDYEGTLASWGSPKSIILTTPQRAI

SEQ ID NO: 12705 - protein, 108 aa, Aspergillus nidulans
KLRHVLQKASDIEKHDDHGDTPLGVAARLGHGPIVQCLLEARAQVNARSAGGKTALMLASYAGFEGVVQLLLHHNADCQEYSNEGLTCLHYATFRHASAGLIRLLTQH

SEQ ID NO: 12706 - protein, 299 aa, Aspergillus nidulans
  unsure (1)..(299): unsure at all Xaa locations
PATAREMGAQFSQFFPPHPTFTSENLSEQQGKVFLITGGTSGIGLELAKILYCHGGKVYITARSEEKAEKAIQEIQASAPNHHGELDFIILELDDLRSIKASVEAFKAQESKLDILWNNAGVSQPPLGSVSKQGHELQLAVNCFGPFLFTQMLLPLLDAAVASSVSPGSVRVIWTSSQVAELSSPDEGIIMSELTSPPKDNVRNYVNSKTGNWLLSAEFARRYGSRGIVSVAXNPGAANTNLLKDARLMKILSYPLLHRAGLAAHTELYAGFSPAISLQNNGCYVIPFGRIHDQVADAL

SEQ ID NO: 12707 - protein, 412 aa, Aspergillus nidulans
  unsure (1)..(412): unsure at all Xaa locations
PELDYLKSLQNEQNINKIKWRRRLXAFYFLLSTNHKTIKLWKVFDKSLKVVAENNLSTELTPAGVGGGGAPRAPPVSFKDSSALKLPQMTHHDTVVAAVPRRTYANAHAYHINSISVNSDGETFISSDDLRVNLWNLNIQDQSFNIVDIKPANMEELTEVITAAEFHPTSCNWFMYASSKGTIKLADMRQRALCDTHHKRMCFSSLSSSRDTFESSSNLPYVVFEQEEDASSRSFFSEIISPISDVRFSHDGRYIVSREYLTVKIWDVNMERQPVKTIPIHEHLRPRLCDTYENDSIFDKFEVVFSGDAENVMTGSYNNNFMIYPTDPAKETEIVLQADKSAFKAKKVGVPTPMNKGANGKKSNSRTSSPAGPGSRMKKETDADQIDFNKKILHMSWHPFEDSIAIAATSNV

SEQ ID NO: 12708 - protein, 281 aa, Aspergillus nidulans
  unsure (1)..(281): unsure at all Xaa locations
DTPNLLDNSETVHISSLALLKMLRHGRAGVPMEVMGLMLGEFVDEYTVRVTDVFAMPQSGTGVSVEAVDPVFQTKMMDMLRQTGRXAITIRFDSIVLRMHDSRPEPVVGWYHSHPGFGCWLSSVDINTQQSFEQLTPRAVAVVVDPIQSVKGKVVIDAFRLIQPQTVVMGQEPRQTTSNLGHLNKPSIQALIHGLNRHYYSIGINYRKTGLEENMLMNLHKQVWTEALQMNDFHDECQHNVDRMKQLVNLAEGYEKRVKEETELTKDQLKTRYVGKVDPKK

SEQ ID NO: 12709 - protein, 739 aa, Aspergillus nidulans
  unsure (1)..(739): unsure at all Xaa locations
MASGTSGPAGPPLDPIDLNVSGDRSKRVAYFYDSDVGNYAYVSGHPMKPHRIRMTHSLVMNYSLYKKMEIYVSFRPFVPRIGTYXCSTFARAKPASKFEMTQFHTDEYIDFLSKVTPDNMDAFAKEQSKYNVGDDCPVFDGLFEFCGISAGGSMEGAARLNRNKCDIAVNWAGGLHHAKKSEASGFCYVNGMSKLFCGFNSTLIKRCRIVLGILELLRFKQRVLYVDIDVHHGDGVEEAFYTTDRVMTVSFHKYGEYFPGTGELRDIGVGQGKYYAVNFPLRDGIDDVSYKSIFEPVIKSVMEWYRPEAVVLQCGGDSLSGDRLGCFNLSMRGHANCVKYVKSFNLPTLIVGGGGYTMRNVARTWAFETGILVGDNLGSELPYNDYYEVSTHPGVSVNMLTQDSTLAPDYELDVRPSNMDNANTREYLDKIRTQVVENLKRTAFAPSVQMTDVPREPLVDGMDDEAEAALDDLDEDENKDKRFTKRRFDQYVEKPGELSDSEDEDENAANGVTRKPAHLKRRNQANYRLDLADSGVESGMATPQDASSVADEEMDTGTDVKITEAPGPEPDSEAQGTSSAAEPPSRAGNGSVDEPSEMIVDSKEPPRSVPVSRPVSPKPTDEDTAMEDADMPVPEVNQENTPEASQATQNKPAEGTPASESAVAKLTSQTKASFESNEGRKQLEPETVKEAGLAAVTTETKDKTPEAPRAGALPAVTAEQETTKQGEPSAEAQPEAAKE

SEQ ID NO: 12710 - protein, 929 aa, Aspergillus nidulans
  unsure (1)..(929): unsure at all Xaa locations
PEDWLETDLNGLPSSQIEPRRKRGGWNELTTEKTNFFVQFIGYFRGPILYGEXPGLPVFHVNISNXNCSHLVMELAVLLAAGLRDWIDLGVIIGILMLNAVVGWYQEKQAADVVASLKGDIAMKAVVKRDGQEQEILARELVTGDIVSCPIRPFHVLLPHCXLPSPNXVVIEEGTIVPADVRLICDYDKPETYETYKEYLATANDDTLKENYDDDDDHGIDARLGVSLFAVYQSAITGESLAVDKYMADTCYYTTGCKRGKAYAIVTATAKHSFVGKTAALVQGAQDQGHFKAVMDNIGTSLLVLVMFWILAAWIGGFYRHLKIATPEHSDNTLLHWTLILLIIGVPVGLPVVTTTTLAVGAAYLAEQKAIVQKLTAIESLAGVDILCSDKTGTLTANQLSIREPYVNEGVDVNWMMAVAAIASNHNVKNLDPIDKVTILTLRRYPKAREILARNWVTEKYTPFDPVSKRITTICTCDGVRYTCAKGAPKAILAMSECSPEEAQKFREKASEFARRGFRSLGVAVQKEGEPWQLLGMYPMFDPPREDTAHTIAEAQHLGLSVKMLTGDALAIAKETCKMLALSTKVYDSERLIHGGLAGSAQHDLVEKADGFAEVFPEHKYQVVEMLQQRGHLTAMTGDGVNDAPSLKKADCGIAVEGSTEAAQAAFIIVFLAPGLSTIVDAIKLARQIFQRMKAYIQYRIALCIHLELYLVTSMIIINETIKADLIVFIALFADLATIAVAYDNAHFEARPVEWQLPKIWVISVVLGVLLAAGTWIMRASLFLENGGIIQNFGSPQPMLFLEVSLTENWLIFVTRVVRPWPSWQLVGAIFVVDVLATLFCVFGWLAGDYVETSPPSQATFSTNNDTDIVTVVVIWAYSIGVTIIIAVVYYLLTIIPALDNLGRKNRSVVDTKVENLLNHLSKLAIEHE

SEQ ID NO: 12711 - protein, 349 aa, Aspergillus nidulans
  unsure (1)..(349): unsure at all Xaa locations
LPLLLNVLLASAAGIPSSRYRNCQRSRKACPEGTLVVSASDPKADFSTVQAAVESLPHDNSSQTILILAGTYTEQVNVTRPGPVTLLGQTDHVTDASKNQVTINWAQANHDSTGQSVDNVFGSVLTVAPTLNASYTGSGPTGFPVPEDTPFGSVDFRAYNIDFTNTWADYSDGPAHALSFSRANGGFYYCGFYSYQDTVVCLTSCEIIXQSXVYVGKLGNAYFHRSIIAGQTDFIYGFGTAWIQSSDILLRNCGGGITAWKGTNTTFENKYGVYIVDSSVQAANASIAPEIVGACPLGRPWNELHRSIFVRSYEDASIDPEGYIDWVVDGVSRLSNKTFMAEYRTFGPG

SEQ ID NO: 12712 - protein, 292 aa, Aspergillus nidulans
  unsure (1)..(292): unsure at all Xaa locations
ATKLIKILXGKVVLVTGGAKGIGRMISEGYVTNGATVYISSRDAKACEQAVKELNALGKGKAHAIPADFYKEEDVKKLAEELAKRESSTCPTLAEKEELMGLLELHVLVNNSGSNWGAPYDEYPSSAWTRVLTLNLHRVFDLTKLVTPLLEKAAAPNDPARIINIGSIDGLRVPALETFAYSASKAGLHHMSRVLANHLGKRNITYVLXTAARLFCWTYGKLLTXHRSNTLACGPFQSKMMAATLKNFREQIESGIPLKRIGTPEDVAGACLFLSSRAGAYVNGSTIAVDGG

SEQ ID NO: 12713 - protein, 353 aa, Aspergillus nidulans
  unsure (1)..(353): unsure at all Xaa locations
TLYFCNLTVGTPGQSLRLILDTGSSDLWCNAANSTLCSSPKDPCRISGSFDPSSSSSYSYISSDFNITYADGTGAAGDYATDTVSIGGATIKDFQFGSATHPVQQVCXENVLLYQXLXYXXLSEGVLGIGYPSNEVQVARYGDDAYPNLPRFLMQNGFVQSSAYSLWLNDLEANTGSILFGGVDTEKYRGDLQTLPIQTVNGEYSELIIALTGVSLDTEARKHTVSSNALPAAVLLDSGSSLSYLPDSIAEKIYDDLRISYEPSTGAGYAPCSLARQNINVTFTFSSPEIAVGIDELIIDAGDLRFSNGERACIFGLVPAGDNTAVLGDTFLRSAYVVYDLTNNEISIAKTNF

SEQ ID NO: 12714 - protein, 328 aa, Aspergillus nidulans
FGPSPIQYLPNITAALGGKVNIYPKREDVNSGLAFGGNKTRKLEYLASDALAQKADTLVSIGGFQSNHTRQVAAVARKLGLEVALVQEKWVDWDDKNGVYDKAGNIQLSRLMGADTRLDMSGFGIEHKLTLKNLEEEIRARGGKPYYIPAGASDHPLGGLGFARWAFEVEMQEKELGVFFDTVIVCAVTGSTMAGMIAGFKLAQKVNGSRKRKIIGIDASATVEQTFEQILRIAKFTGVKIGLDEEDITAEDVILDDRYHAGVYGIPDEATIEAIKFGARTEAFITDPVYEGKSLNGMMDMVRKGEIQEGANVLYAHLGGQLALNAYT

SEQ ID NO: 12715 - protein, 607 aa, Aspergillus nidulans
  unsure (1)..(607): unsure at all Xaa locations
SRSENGARDSLELASLASSSPESALDLSRSSSPSGISSSRKLSLEDEDPLSNSNPHMTHLSSRPRPDRSYSISSAFDFGRNLFPLSQTADGYAPLGAPTQIDGDGGGIDGSLERNKTLTYINGLSLVVGLVIGSGIFSSPSQVNANVGSPGGALIAWLVAGLLAWTGAASYAELGGAIPLNGGAQAYLSKIFGELAGFLFTWCAVLVLKPGSAAIISIIFGEYVVRAILGAEVEQISPWINKGVAFGGLLVVICLNCLSTRLAARIGDLFMIFKFVALIGVAIIGIIVAATGLSAKGQANQEWKISWFEGTNMDISGWAMALYAGLWAFDGWDNVGIANTTFRSAHXHSATNYVTGEFKNPNRDLPRVIHTAMPLVIVSYLLANVSYFFVLPHSTIEATNTIAVQFGDKVFGSIGALIFALIVSASCFGALNATVFTSGRLVYAAGKEGYLPTLFGNLWTQGSSSSMNRLQRQSWMSKLVRRVFGNGTWIGYTPINAMALNGILTLLYVIVGEFGTLVTFYGVAGYTFYFLTVLGLIVLRVREPQLERPYKTWISTPIIFCCVSLFLLSRAVISEPLQTLIVVAFIVAGVPVYIWRIYKRDGKKAFQ

SEQ ID NO: 12716 - protein, 748 aa, Aspergillus nidulans
  unsure (1)..(748): unsure at all Xaa locations
SAALFSALNSSKAVPQTLTEKIVQKYSVGLPQGKFVKSGDYVTIQPHRCMSMFNIQELAPNECWPELWLIRXILAHDNSWPCALKFMSIGASRLHNPDQIVMTLDHDVQNKSDKNLKKYRQIEEFATQHGVEFYPAGRGIGHQIMIEEGFAWPGTLAVASDSHSNMYGGVGCLGTPIVRTDAASVWATGKTWWQIPPVAKVTFKGVLPPGVTGKDVIVALCGLFNKDDVLNHAIEFTGSEETMRSLSVDTRLTIANMTTEWGALSGLFPIDSVLKGWLRGKATTAAMGLADGPFKTRAAERFTHPLLEQLFENPLTADKGAKYAKELFLDLSSLSPYVSGPNSVKVATPLKELEAQNIKVDKAYLVSCTNSRASDIAAAAKVFKEAAEKNGGKIPKIADGVKFYIAAASIPEQLAAEGNGDWQTLLEAGATQLPAGCGPCIGMGQGLLEPGEVGISASNRNFKGRMGSTEAKAYLGSPEVVAASALSGKLSGPGWYQTPEGWTEVIRGEGDGIREEDRMLTNEEALEKIIGQLDDLVADGEKRFASETPAVEESEQGLTEIYPGFPERVSGELVFCDADNVNTDGIYPGKYTYQDDVPPETMARVCMENYDPEFSTTAKEGDILVSGFNFGCGSSREQAATAILAKKIPLVVSGSFGNIFSRNSINNALMGLEVPRLVNRLRETFGSGDKVLTRRTGWTLTWDVRKSQIEVQEGPGGPKWTHKVGELPPNVQEIIAKGGLEKWVKNAI

SEQ ID NO: 12717 - protein, 309 aa, Aspergillus nidulans
  unsure (1)..(309): unsure at all Xaa locations
ISGNITETRWKFGXELIRRIRREDAEGDLVLNQYEQAIAMDVVAPEDIPVSFKDIGGLEDIIEELKESVIYPLTMPHLFSSTSSLLTAPSGVLLYGPPGCGKTMLAKALAHESGASFINLHISTLTEKWYGDSNKLVNAVFSLARKLQPSIVFIDEIDAVLGTRRSGEHEASGMVKAEFMTHWDGLTSANSLGEPQRVVVLGATNRMQDIDEAILRRMPKKFPVELPPAAQRLGILSLVLKDTKIDRQNFDLHYLVKAMAGMSGSDIKEACRDAAMVPVREFIRQKTAQGLKITSVDPSEVRGLRTEDF

SEQ ID NO: 12718 - protein, 689 aa, Aspergillus nidulans
  unsure (1)..(689): unsure at all Xaa locations
LRSKNRRPRPQISAPKPISGPLPQNHQPAASGSGTASSGSGSRDYASSNHATSDLVKRRYSTRFNQVPDFDGAPPVPSVPQVPSAYAGLGPPQPSRKQSAESSGPSRSXSNCPTGSKFTSXSMXVTLNQSSXHYPQPQYXLFVLXYLDVTNLLANASEDDIREYQQALRKVKNRTSTDLQQNVYQNRTQFIRISQEADKLKGEMKTLRSLMAELTTALGQTAIGDSPNPMSPTLDERASKRSNRSSVANLESMWNVQLQTLWKTVEGSQKFLPMVPGRHIVLKTGNWAELDSATWKPRRPVHLVLLNDHLLVAAKKRKRVDQSNPNHRGPVPTKLIAEECWPLQDIIXLTWAPTXLDLLAKRPKIVVSRMLSAFASARSPLHIVMTNEIATAKSELLATFRKTVEDLRRTLRSETEAAGKNGESLGFMSAINSRNSLLCSPKLDLSENTDNPRDRPEVRIDVDGKQQNLRWVDSQVDELDIDIALQRFEEAVSNIDRLRKLARGLKGNAVAQDVINTKVDERAAKLAGILSRSLVDTHGFPVATKTNVVWLTRLGFEDQARESYLKARSDVISKRIRXANTLSANQPPRDHXPRPNSACIFEGDLPLYIFQISFVYFTLIKNTISTYQQCFPSVMTSACIKWAKHHLDAFNALLTRQLSSVQRGATVWQNCINIVHEQAGILAEVGVDF

SEQ ID NO: 12719 - protein, 372 aa, Aspergillus nidulans
  unsure (1)..(372): unsure at all Xaa locations
ERHLLLKLDIAMLSIGCLGFFMKYLDHGNLSNAYVSGMQEALSMFGNEYTYAQTMYTIAFAIMQIPSTLIIQRVRRSIWLAAMEICWGAFTFAQAGLKSVSELYAFRFLVGPSESSFFSSLLYLLGSWYTKTELAKRVALFHSDGALGAAFGGYLQAAVYENLDAVMGIEGWIWLYIVCGCMTVPVGIATLFILPDTPYNTRVCFXTKRRRDLAKERVTRAGKAPPVRVTLGTIKRILGSWKWYAFVLGICGQYSFLLPWAQGVLLMIGLGIRAAAKWYLAFWPASLALKEFAFLIIGVQLMTAVLXGIQPLSVNCLXHAQLFLGQEVCADNNEQRAVVIRSMNGFHYAVAAWLPIVIFPXTIAPSLRECLV

SEQ ID NO: 12720 - protein, 499 aa, Aspergillus nidulans
TLKDPTLFIESSYIDGKWVTSSSSRTFNVYDPATEEFIGTCPESNIDDINSAIRAAATAFPKWRALSGRQRGRILRRWFDLIVENKEDIGKIITAENGKAKGDAEGEALFSAGFFEWFSEEAARIYGDVVPHSNPSSRVQVLKEPVGVCGLITPWNFPMAMGARKVAAALAAGCTVVLKSDGLTPYSSNVLALLAERAGVPGGVFNVVTALENTPALGVALCESDNVKKISFTGSTRVGKLLMKQSSHTLKKLSLELGGNAPFIVFDDADLETAVTSAVACKFKVTGQTCVCANRFYVQEGIYEAFSKRFVEEVKKCQVGHGLDPGVTHGPLTNGIAKTQEHIQDALNKGATVLLGGSRLPSLGKNFHELTILGDVDDSMKVASEETFGPLAALSKFKAEDEVVRRANGVEVGLASYLITSDLGKAHRVSEKLEFGMVAINTGVISDSAAPVCPSSRSHSMKLTPSRFGGVKHSGMGREGSKYGIDDYLNIKTIVTGGI

SEQ ID NO: 12721 - protein, 594 aa, Aspergillus nidulans
  unsure (1)..(594): unsure at all Xaa locations
PNILYIMADQMAAPLLAFHDKDSPIKTPNLNKLAEEGVVFDSAYCNSPLCAPSRFVMVTGQLPSKIGAYDNAADLPADIPTYAHYLRREGYHTALAGKMHFCGPDQLHGYEQRLTSDIYPGDYGWSVNWDEPVSYAPKWIRESWKNXLDXDVRLDYYHNMSSVMDAGPVVRTNQLDFDEEVIYKSKQYLYDHVRQRTDQPFCLTVSMTHPHDPYAMTKEFWDLYEDVEIPLPKHAAIPHDQQDPHSQRILKCIDLWGKELPEERIKRTRRAYYAACTYVDTNVGKLLKVLDETGLRDDTIIVFTGDHGDMLGERGLWYKMAWFENSARVPFIVNAPNRFAPARISQNVSTMDILPTFAELVGAPLVKELPLDGVSLVPYLTGEDGVKTDTVLGEYMGEGTQSPVVMIRRGRWKFVYSLIDPPMLFDVQNDPLEKVNLVAGLPDPSMAAAADAKAAAATAFNKAAPATLPTPAESPRATPLAHRNAAQDYPFPSPTPPRTPSPGKPSNVTVPETTDPSKLLAYFTEEVHSLWDLESIRQDVLRSQRRRRLVYSALIKGTPHFWDWEYRVDPSTQYVRNQGKGVLDDVEFISRWPR

SEQ ID NO: 12722 - protein, 342 aa, Aspergillus nidulans
RIPLGVVVLITPYNHPLLIAMKKIAAALAGNVVIVKPSELAPLSVLKLGALFKEAGLPDGVLQIVSGYGRETGKYLCEHPKISKIDLTGGIAHYRAIAPVAAMNMIPITAELGGKAPVCIFPSTDVETAVKAALFAGFIASGQTCVTGSRILVHKDIYDSFRSLLEKRVRALRVGDPTDEKTQIGSVISAAAIERCEAFVSRATAEGGTILCGGTRLTPTPEKKGYFFAPTVIETASTSDLANNEVFGPVLALIKCSDEDEIVRIANGTSYALGASVWSNDFTQAHSVADKIEAGIVWINGHHLNDPSSPWGGFKESGVGKENGVEAYESYTKVKSTVMNYG

SEQ ID NO: 12723 - protein, 626 aa, Aspergillus nidulans
  unsure (1)..(626): unsure at all Xaa locations
VXDHEYDAVVVGAGGAGLRAAFGLAEAGFNTACVSKLFPTRSHTVAAQGGINAALGKXVLVLICPVACAYMWTSMHPDDWRWHMYDTVKGSDWLGDQDAIHYMTREAPASVRELEGYGCPFSRTEEGLIYQRAFGGQSKEFGKGGQAYRCCAVADRTGHALLHTLYGQSLRHNTNYFIEYFAMDLLMENGECRGIIAYNQEDGTLHRFKAHHTVLATGGYGRAYFSCTSAHTCTGDGMAMVARAGLPNQDLEFVQFHPTGIYGAGCLITEGARGEGGYLLNSEGERFMERYAPTAKDLASRDVVSRSMTMEIREGRGVGPEKDHIYLQLSHLPASLLHERLPGISETASIFAGVDVTKQPIPVLPTVHYNMGGIPTKFTGEVLTQDENGNDKVVPGLYACGEAACVSVHGANRLGANSLLDLVVFGRAVSHRVKEIASPGKPHAELASDAGAESIKDLDTVRTAEGPKSTFEIRNAMQKTMQTDVSVFRTQESLDEGVEKITKVDQLFDQVGTKDRSMIWNSDLVETLELRNLLTCAXVPQFTDTTWKPTNDISTQTAVAAANRKESRGAHAREDYPDRDDENWMKHTLTWQKKPHGKVEIGYRSVVHNTLDENECKPVPPFKRVY

SEQ ID NO: 12724 - protein, 554 aa, Aspergillus nidulans
  unsure (1)..(554): unsure at all Xaa locations
YFIKYLDQININNAFVSGMYVRCSQSPPLLYTTXRRTRPDRTXEEDLGMYQNQLNYMQAAWTVGYVIGEIPSNIMLTKVRPRYWLPAMEVGLTYALRHEEDRXSLSPLSSSWTVLTMCLSRCNKASQFYVLRFFIGMQNLDTSQQCSSPRMLILRACRPRRSTFYPGMQYIIGSWYRKDELAKRSCIFHTSSGIASMFSGYLMAGVYNLGGRGGFKGWQWYFASQDFIALIMGXHALTKDTGYLSIDGVISLPVALLGFVILPDVPEISNPWYLTKQVCLPLFKXDKAGLNRIKEVQLCQKRMELEGRKNRGPYTKAKLKKILTSWHIYFLTGLYMYDDQHCQEQRTYFXRAQNVXQRQGGQPVFQQYLKASTNPVYSVGQINSYPTTTYAVQVFTTLVYACTPNSSIQPSGSXSSAPAGTSDSILRGARWPPILVGAVSNITCYTSLAVWDIPDGWKWTCYIMSGAGYGLSGLCMAWAHEICSGDNEERALVVGSMNEMAYVFQAWLPQVVWQQIDAPQYRKGFITGTVMSVLLIIFTLSIRSLQTRENRKTR

SEQ ID NO: 12725 - protein, 442 aa, Aspergillus nidulans
  unsure (1)..(442): unsure at all Xaa locations
HRRYNPLRGAYVLVSPHRTKRPWQXVMTSLLSHSNACHLNSADCEMNHVYCSLTWRQGAQETPSKTTLPDYDATCYLCPGNKRAQGDHNPKYEKTFIFVNDYSAVKEEQAPYHPEAEPVRHSETIPCIFMTSINCHSETESFFLRADPVTGKCYVLTFSAAHNLTLADLSPVEIVPVINAWTDVYIAHLSPSSPLAAAASKLTISSGSPAASLAKPNEQYRYMQIFENKGAAMGCSNPHPHGQIWTTSSLPEELAAELEQMKKYRREHNGGHMLADYAALESKKQERVVFENDAFLVVCPWWAIWPFETMIISKTHKRALVDLDDNEKAQLAEAIAEVTRRYDNLFETHFPYSMGIHQAPLEGSEEEIEASYLHLHFYPPLLRSATVRKFLVGXVLRNHSQFCERVLTGHSYELMAEPQRDITPEQAAARLRGCGGELYRKK

SEQ ID NO: 12726 - protein, 263 aa, Aspergillus nidulans
  unsure (1)..(263): unsure at all Xaa locations
LTXDFLPSQTTFVKRHLTGEFEKKYIATLGVEVHPIKFTTVCPAVDPASALPPSLLSPRLTQVSNLGTIQFDVWDTAGQEKFGGLRDGYYINGQCGIIMFDVTSRITYKNVPNWHRTCSHALLAERHSQIHRXLVRVCENIPIVLCGNKVDVKERKVKAKTITFHRKKNLQYYDISAKSNYNFEKPFLWLARKLVGNASLVSRFLGTRCITTHTDRNFCRNSVAAPALAPPEVQVDATLMQQYSDEMAAAANQPLPDEDDADL

SEQ ID NO: 12727 - protein, 572 aa, Aspergillus nidulans
MYDFDPNATTDWYESVDLVKFIAADNEFTELPDAAFPDVDSEQLDPDSEERGNQFGGLEVLDVHGNLLERLPIGFRRLQRLHTLNLSNNKLTMEDIDVIFEMASLRDLKLAKNQLQGPFSQKIGQLDKLEVLDIHENTITALPETVEGLKRLRVLNVGQNQLTELPFEILCTLPLREIIAPKNKLQGVLIPATVDKLDSLQELDVVGNALTSLGEKLTLPALKTLAISMNRIKNLPNVSSWQALLKLSAEDNSISEFPLGFTELKNVRNVDLTGNNISRLDEKIGLMDNLFTFRIANNPLRERKFLNMTVEDIKRDLRSRCEPEPQETDDEEGSVATQFTLAPETPAQNSGWLLKPGGVLDRSYTDMQEFDVEQLEAINPSDVRYLYLQHNSLRSFPVPALSVLAANLTDLDLSHNPLDISSLTATPVMLASLQTLNLSATGITTLEPLMTGLKAPSLTFLDVSSNNLSGSLPYIRRAYSKLTTFLIAENQLDSLDFEAVQGLQVLDVGNNSISSLPPRIGLLRAAGNSANWGGGSALRRFEVAGNSFRVPRWQIVAKGTDSILEWLKDRMP

SEQ ID NO: 12728 - protein, 203 aa, Aspergillus nidulans
  unsure (1)..(203): unsure at all Xaa locations
FWGQGAETSSSQDNAGKTTLLYRLKVCFRSLCVXYTXLQLRRXHSNTXIGEVVTTIPTIGFNVESVTYRNLNFNVWVRTSSHCSGXXAPLILFVQDLGGQTSIRPYWRCYYANTAAVVFVIDSTDVERLGTAADELAAMLNEEELREAALLVFANKQDQPGAKGAGEISEALKLGELRDRNWSIVACSAIDGKGLNEGMDWLV

SEQ ID NO: 12729 - protein, 668 aa, Aspergillus nidulans
  unsure (1)..(668): unsure at all Xaa locations
KAKDRDRAMAMEKANDSGIAEPEAEMDGDTNMEEAEEAATEAIGSKVVVIHVGSQNLRIGLSSDALPKTVPMVIARKSTTNEAEDQEEPRPKRLKLDDGSEMEPEKKFGPEVCLDVXSGDITFGLNRLXFSSQYTTMMADLKTHMRQNKRRTLPNSKEMVINYNRRTVPETISEHNDPMRVEWTEIPDPAPEYIVGQPALRIPDESKPRYKLYWPIKHGWCNEEDYDNKRLLFLDISIILEDAIKTQLGLTSKKDWPQYSCVFVIPDLFDKSYVTQILEMLMREFSFARVCFIQESLAATFGAGFTSACVVDIGAQKTSICCVEEGMCVENSRVNLKYGGADVTELFIKMMLYDHFPYEEINLWRRYDFLLAEELKKNVCTMNEASVSVQVFDFHLRVAGQDTRKYTFKAYDEVHLAPMGIFQPSLFDNSRELNGRRKLIARSVDIYDGQPNDPTSAAQSEILTALAPASSANQVNGESQTSIRDVQATPSRSQQLNALSRVQEAEATPRSSVAGSPGPESTPQAGGAATPAPAGQGQNTSQPRAPTIEERDDILPVYPLDKAILTSIMHAARSDERKMRDFLGGIMVVGGGSLVSNFHLFVEERLQLLQPSFAKEIMIGTPPRDLDPQVVVWKGASVFGKLSGTNDSWISQLEYDRLGHRLLAYKCM

SEQ ID NO: 12730 - protein, 514 aa, Aspergillus nidulans
  unsure (1)..(514): unsure at all Xaa locations
GQGRFHPISKLGSQISPSGLGWIIVDSLDTLMIINLTSQLSDARKWLNRGLTYGQDQDVNTFETTIRMLGGLLSAHYLSTVLHDVSSQRDYIYLSKAVDLADRLLGAYESRSGIPYASVNIGTRQGLPSHADGGASSTAEATSVQLEMKYLAHLTGKEVFWRKAEQVMKVVDDQQRPDGLLPIFIHPDTGRFRHQEIRLGSRGDSYYGIPCVAINVYXRQKAHLNPEYLIKQYLQTSGQEPXYREMWEXALTGIQKPLVTSTKHSKLQFIAELPQGIGGQLSPKMDHLVCFLPGTIALGATEGLTEKEARKLPSWTPQKEQQMQLARELMKTCWAMYAVTATGLSPEIAWFRADEADLRSTFGSSIRPPSKNDEASWKRDLIIKPQDTHNLQRPETVESLFLMYRITNDPLYRKWGWKIFKAFRMHTAVGDNGGYTSLQDVTKVPAPQRDNMESFWLVKTPHSQSGKSFDVCSXALNILILXAETLKYLYLLFSPKDFLPLSDVVFNTEAHVLP

SEQ ID NO: 12731 - protein, 421 aa, Aspergillus nidulans
  unsure (1)..(421): unsure at all Xaa locations
LNAPAGTFLPNTKVQVGSHRVVVEKYLSEGGFAHVYVVRLSQPVDGSDKAVLKRVAVPDKIALANMRTEVETMKKLKGHRHIVKYIDSHASQLKAGGYEVFLLMEYCAGGGLIDFMNTRLQNRLTEPEIIKIFSDVAEGVACMHYLKPPLLHRDLKVENVLISRHGNSVIYKVCDFGSAAPPRPAATSAAEGRLIEDDVQRHTTLQYRSPEMIDVYRKQPIDEKSDIWALGVLLYKLCYYTTPFEEVGQMAILNASYKFPSYPPFSSRLKMLICEXPSRLHDLHCVLMPYSSMLQESAQKRPNIYQVLREVCQMQGREVPIKDVRLSKISVYFRLLTMSDLCPSLDFGSTPIPGAPAIPNRSTAVGAAFSPPIQETQISIPEIAPMRRGRPTRPDASQHNSARPSPSPFRGASTDPFAALD

SEQ ID NO: 12732 - protein, 396 aa, Aspergillus nidulans
  unsure (1)..(396): unsure at all Xaa locations
PINNAAVRVSHLTLAIQDRPVTPPGPNEVLVQVISTGICGSDTHNWNNPNVSRELILGHESAGLRGLIVEIDSEVKDRHVGQRMAVEPGFACATYGDSHISTTLFCPILKEESVLTIKKMRSAFAGNPNTCANLKYCGLDPTDGTLQQYFTCKAHMAIPIPEEISWEEAGAIQPLAIAVQLARRAALSASKTVAILYASPPTSYXQXSSCXSGWXRGCGPLGLLVIAIAKAYGVCKIVVFDIEQSRLDFALSYGEDIGVLSPKISENVEPLKFVFEFTSSVVREHNLGHGVDISVEASGADSSAQMALTILKPRGTCIQAGLGKRLTKAPLFPTDSERVDAXGTVRFTPGCYQEAIELVQSXRAHLKPLITKTFPLTRAQEAFRAQFERRGIKIVI

SEQ ID NO: 12733 - protein, 422 aa, Aspergillus nidulans
  unsure (1)..(422): unsure at all Xaa locations
LQLXAAIAWAAGEPLSIEDVEVAPPKAHEVRIQVLHTGVCHTGQXSNXCSALDFTDNDDAYTLSGKDPEGAFPVILGHEGAGIVESVGEGVTSVKPGDHVIALXVGFEIKPRKRLANKRSTPECRECKFCKSGKTNLCGKIRATQGKGVMPDGTSRFKARGKDLLHFMGTSTFSQYTVVADISVVAVTDKIPTDRSCLLGCGITTGYGAAVVTAKVEEGSNIAVFGAGCVGLSVMQGAVKNKAGKIIAVDVNDAKEEWSRKFGATDFVNPTKLNGQTIQEKLIEMTDGGCDYTFDCTGNVGVMRAALEACHKGWGESIVIGVAAAGQEISTRRKAANLIETSLSLLLTPHATAFQLVTGRVWRGCAFGGIKGRTQLPGLVDDYLDGKLKVDEFITHREPLANINTAFEQMKAGDCIRXDVDL

SEQ ID NO: 12734 - protein, 183 aa, Aspergillus nidulans
VWAVLASGSDDETVRLWDPATGSLQQTLEGHSGWVLSVAFSPDGRLLASGSFDKTVRLWDPATGSLQQTLRGHSNWVRSVAFSPDGRLLASGSFDKTVRLWDPATGSLQQTLRGHSDTVRSVAFSPDGRLLASGSFDKTVRLWDPATGTLQQTLIIKGTVTELQFSQDGSYISTNLGSLNIQS

SEQ ID NO: 12735 - protein, 722 aa, Aspergillus nidulans
  unsure (1)..(722): unsure at all Xaa locations
ECPYSRQNANIDAAGQNNRDWWRTDLKLNIFRQHNSVSNPLDKGFDYTAAFNSLDYFGLKRDLEALMTDSQDWWPADFGHYGGLFIRMAWHSAGTYRVFDGRGGGGQGQQRFAPLNSWPDNVSLDKARRLLWPIKQKYGSKISWADLLILAGNVALESMGFKTFGFAGGRSDTWEADQSVFWGGEKEWLGNDVRYLNGELDNPLAASHMGLIYVNPEGPNKNPDPVLAAKDIRITFGRMAMNDEETVALIAGGHTFGKTHGAGPATHLGKEPHGAGIELQGLGWESGFESGTGRHAITSGLEVIWTKTPTKWSNQFFEYLFKYDWELTKSPAGAHQYVAKGVEPFIPDPFDPSIKHPPRMLTTDLSLRYDPEYEKISRRFLENPDQFADAFARAWFKLTHRDVGPRVLYQGPEVPSEVLIWQDPVPPLDHPVIDNDDIATLKKAILNSGISHTDLFSTAWASASTFRGSDKRGGANGARIRLSPQKNWKVNSQPWLSESLAALEKIQKQFNDAQSTDKRVSLADLIVLAGAASLEKAARDAGHNVSVSFTPGRTDATQEQTDVDSFNNLEPIADGFRNYGRGTPRVLTEDFLIDKAQLLNLSPPELTVLIGGLRVLNNNYDRSNLGVFTKRPGQLTNDFFVNLLDMGVQWKPADDTNEIFIGSDRKTGQARWKASRADLVFGSHAELRAISEVYGSSDGEAKFVKDFVAAXEKVSNLDDFDL

SEQ ID NO: 12736 - protein, 760 aa, Aspergillus nidulans
  unsure (1)..(760): unsure at all Xaa locations
MATSITAGLQKAQQAVQDTATKNKKIVDISHDTVNVHTDQEQRTDFGVAITDPDHWLRVTNETHSGPSLLEDHIARERIHRFDHERIPERVVHARGTGAYGNFTLKESIEDLTYAGVLTDTSRNTPVFGRFSTVQGSRGSADTVRDVSRFAVKFYTDEGNWDIVGNNIPVFFIQDAIKFPDFGTCPQMTATEXCXLPAVHAVKPEPHNEVPQAQTAHNNFWDFVYLHPEATHMFMWAMSDRAIPRSYRMMQGFGVNTFSLVNKEGKRHFVKFHWIPHLGVHSLVWDEALKLAGQDPDFHRKDLMEAIDNKAYPKWDFAIQAIPEEDQDKFEFDIFDATKVWPEEQVPLRVVGELELNRNIDEFFPETEQVAFCTSHIVPGIDFSDDPLLQGRNFSYQDTQISRLGVNWEEIPINRPVCPFLNHNRDGAKRHRITKGTVNYWPNRFEANPPASDKGFKSHPAPITGRKRRDLTPKFKEYHNQAQLFYNSLSEVEKVHVKKAFSFELDHCDDPIVYERLAGQRLAEIDLPLAQAVAEMVGAPIPTKALRDNHGKTSVRLSQFDFTPKAPGIISRRIAIIIGDGYDKIAFNGMKAAILAAQALPLRHWHQTLRHLRQGEDKNSSKGVIPDHMYDGMRSTMFDATFIPGGSHIETLQKNGQIRYWIAETFGHLKALGAMGEAAQLVKEVLGNVMGVQIAGADSAEPVEWYGVVTARGPESAESLSEGFKVLKDAGDFTSKFFYQISQHRNWQRELDGLASTVAF

SEQ ID NO: 12737 - protein, 350 aa, Aspergillus nidulans
RANILKEVQIMRQIDHPNIVKLIQFSESRQYYYIVLELCPGGELFHQIVRLTYFSEDLSRHVIVQVAKAIEYLHETSGVVHRYGYSSSLSGAQLILPVDIKPENLLFYPTEYVPSKHPKPRQPGDEDKVDEGEFIPGKGAGGIGVIKIADFGLSKVIWDTQTMTPCGTVGYTAPEIVKDERYSKSVDMWALGCVLYTLLCGFPPFYDESIQVLTEKVARGQYTFLSPWWDDISKSAKDLISHLLTVDPDERYTIKQFLAHPWIRQSGEETQAASDAPPLTTPAPEARNQALDAIAAELAPYPPASAQLSAGERPMDFRSPGAINLREVFDVGYAVHRQEEEGKRRKAGRG

SEQ ID NO: 12738 - protein, 448 aa, Aspergillus nidulans
  unsure (1)..(448): unsure at all Xaa locations
FRKVGWFNATVIFIKILFATGVLSLPSALYALGAVGGSISIVAWGAFNTYCFVILGNFRLKHPHCHSIADMAEVALGIVGKEVTGLLFIIGYVLVTGSGIVGVSTALNALSHHAACTVWWSFLATAVIIATASIRKLEHVGWLSYVGFLSIYIAVFIVVVGVRSGTDQRCHGKVPYVCIRCHQPNPVAGGMVASSTIFVSSAGTSAFLPVISEMRNPKEYKKPLYYCMSLVTASYLAFGLVVYRWCGMWVASPSLGVCIIPLLSLRLVVGXXYIERGQTIKMVSYGVALVGLIVSGTLYLHVSVRRKLTFSILSNAYHIHQVGAKYVFVRILGKTSHLQSNSIIHWGTWLACTTLLGALAFILAESIPIFNYLIALVGSVCFAPLAMSLPGLLWLYDHGHYRKESLMQKVVYLLHIGLVLLGVFFLVGATYGVVKQIIDAYATGQIGK

SEQ ID NO: 12739 - protein, 469 aa, Aspergillus nidulans
  unsure (1)..(469): unsure at all Xaa locations
MTWVLRTVWILWLRPTWLVLGGQRIVFLITXLVAVFLHSTGSVSVDAFLNMIAFYCKEGPDSKALRRIQTASLEYLWMGPRGMQVMSIHAGHTWETAFVLQAMPNGLSKVPEIQAAIERAYKYLVEQQHVVDYPEDSQCHFFSRLGGWPFSTRYQGNVCSDCTGDSLKSILMIERDSRFTRLTTEHQLQLAVDNLIMVQNASGGYSSFEPTRGSELLEYMNGTELFGKMMVEYDFTECTSSCITALALYHQRNPNYRTKAVCTAIDRGIKYILKQQRADGSWLSSWGIACTYGAFFALEALAIGGLNYQNSPAARRGCDFIVKQQLADGGWGETIDVRLLLXIAREGGSRLTVSSPSXRNHILHQEASHTVQTAWVCLALMQAQYPGQEPIRRGVQLLISRQRENGEWRQERAWEVEXLLGILLMMCRSGSSFKLTXHSSELLYHSYIYSFPIRALAMYKAKYGDDAVI

SEQ ID NO: 12740 - protein, 555 aa, Aspergillus nidulans
MENYLRVWRQQAKVRGQYDAAVFIGDKVLALTSELFSRLHPGNRLTSMHRQDEDALWLAEVHFSNNNYTRALAILSRQDLISRSTACRYLAAHCYIKQGQYEQALTVLGDQNPTHLIRSNKSRRKIQHLNGHSRITLRNAKSRYEDRDREDAGNIRYEAGMCYLRGLCFAKQNAFDRARDCYKDAVRIDVQCFEAFDQLMKNSLMSPAEELEFLESLDFDSITGADAPISQEAADFTRMLYTTRLSKYSSPAVLTDATETLSTHYKLAENPDILLSRAEALYTQCRFAEALELTSSILSTSRSSLSAQTTAGQNHLGHSPTVYPLHLACLYETGATNALFLLSHTLADHSPEESYTYLAIGVYYLSVAKIAEARRFFSKASLLDPHSAPAWIGFAHTFAAEGEHDQAIAAYSTAARLFQGSHLPQLFLGMQHLALNNMSLAQEYLCAAYAMSTGTATGTVPSIPSLPSSEMSPLGGDPLVLNELGVVLYHQNHLEGAVDLFRQALGLATSLRCEPGAWVATRSNLGHALRRLGRYSAALDEFDECLRIGSSGASL

SEQ ID NO: 12741 - protein, 666 aa, Aspergillus nidulans
  unsure (1)..(666): unsure at all Xaa locations
AFRLPSTAARRWNSTEEKVKGQVIGIDLGTTNSAVAVMEGKTPKIIENAEGEWRQAYIPFHQYXAMANNKKVPAQQPSVVAFAQDGERLVGIAAKRQAVVNPENTLFATKRLIGRKFTDAEVQRDIKEVPYKIVQHTNGDAWVEARGEKYSPAQIGGFVLGKMKETAENYLSKPVKNAVVTVPAYFNDSQRQATKDAGQIAGLNVLRVVNEPTAAALAYGLEKEADRVVAVYDLGGGTFDISVLEIQKGVFEVKSTNGDTHLGGEDFDISLVRHIVQQFKKESGLDLSNDRMAIQRIREAAEKAKIELSSSLQTEINLPFITADASGAKHINLKMTRAQLESLVEPLISRTVDPVRKALKDANLQSSEVQDIILVGGMTRMPKVTESVKSLFGREPAKSVNPDEAVAIGAAIQGAVLAGEVTDVLLLDVTPLSLGIETLGGVFTRLINRNTTIPTKKSQTFSTAADFQTAVEIKVFQGERELVIFNKLLGNFQLVGIPPAHRGVPQIEVTFDIDADSIVHVHAKDKSTNKDQSITIASGSGLSDAEIQSMVEDAEKYGAQDKERKAAIEAANRADSVLNDTEKALKEFEDRLDKAEAEQIREKINTLREFVAKNQSGEVAATAEELKQKTDELQTASLTLFDKMHKAQSEQQQQPNQGETGQGENK

SEQ ID NO: 12742 - protein, 483 aa, Aspergillus nidulans
  unsure (1)..(483): unsure at all Xaa locations
PHLLSPTNLLLCACLMVGFCCQTMNGYDGSLFSGLLANTIFLDHFNGRDAGIWAGLVSAMYQIGGVSALPFVGPAIDTWGRRFGMFLGSFMIVLGAVVSGTTIANASVGQFMGGRFLLGFGVSIAAAAGPIYVVETTHPAWRGMVTGYCNTFWFIGSILASGAVRGSITLDNNQSWLIPLWLQLVFSGIIICTCWMIPESPRWLYVHGKQEKAVEVLTKWHGLGNRDSLWVKLQISEYDAHLNMDGSVSVQRLDLAXSGRLTQARLIGQEILDYRSLFNRRSSIYRLCCNCFFAIFAQWAGNGVLTYYLVPALRGAGFTSDVTQANINLGYACFQFFWALVGAAFVDSLGRRPMMLLGMAGCCVVWIAILSASSQVNNSDGTLNSAASNATLGFIFIFGAAFSFFITPLQALYPVEVLSYEMRAKGMAFSSLAVNAAGLLNQFAWPVSLDNIGWKTYIVFVVWDAIQTVIMYFFFPETKDRTV

SEQ ID NO: 12743 - protein, 266 aa, Aspergillus nidulans
  unsure (1)..(266): unsure at all Xaa locations
LKDKVAIVTGGAQGMGKATASVFLRAGAKVVIADIKAEQGEQVASELSSLGEVRFVKTDISKSEDVQNLVAQTVGFFGRLDVAINNAAMTPDKTVLIETDEEYWRRLVDVNLTGTALCCKYEMQQMRKQGSKGSIVNITSINAFMPQPNMPAYTSTKHALLGLTKHAATEGGPLGIRVNAVAPGAIFVRLRLFIVNLFSVNXRASKSEMSAKALEIMGTTHDEFAPKVSSLNRFGQPHXVAQASLWLASDSSSYVNGITLPVDGGF

SEQ ID NO: 12744 - protein, 276 aa, Aspergillus nidulans
FSVKGKVALVTGGGSGIGLMATQALAKNGAKVYITGRTSEKLNRVAELYSKNIDGQIIPLTADVTDKSSIEKLVEEISSNEKALDILINNAGVSSATQDTDKQTPEDLRKALFEDASSSMEEWDKTYRTNVVQCFYTTTAFLPLLQKATDAQRGWSSTVINISSISGIVKASQHHFAYNASKAATIHLTKMLAHEVASSGLKIRINNIAPGVFPSEMTASESDEKQKSALPKEKYEGKVPAGRPGKHQDMAATVLFAATNQYLNGQTIVVDAGYVL

SEQ ID NO: 12745 - protein, 729 aa, Aspergillus nidulans
  unsure (1)..(729): unsure at all Xaa locations
SKPKDTKSSKKKESASQASQQNSANLGFHHGHQSGFSQPVTPTSSTTSVNDIRGKAPEDASQAGGFPPGEYPIARSVGVPFQPVTDGGSATPTKQGQPMAPSVVISPSGPVRAXREEITRFFALDLSSSSVLTRIILLQHAPPPGAAETMPGDLAPPRKSHVFDRLQTTPKDMSEGIRTPKRQHSSRFDISDQRQRELEKLPGFHEVPPNRRQELFMQKIDQCNIIFDFNDPTADMKSKEIKRLALHELLDYIANNRSVITEPMYPRVVEMFAKNLFRPIPPPITPQGEAFDPEEDEPVLEVAWPHIQVVYEFFLRFIESQDFNTNIAKAYIDHHFVLQVRHLVFLQPNTTDRLXLLELFDSEDPRERDFLKTTLHRIYGKFLNLRSYIRRSINNVFFQFSYETERFNGIAELLEILGSIINGFALPLKEEHKLFLTRVLLPLHKVKSLSMYHPQLAYCIVQFLEKDSTLTEDVRFPRSLPCYIXLXLRSGCAGLLRYWPKTNSTKEVMFLNEVEDIFEVMDPAEFAKVQEPLFQQLAKSVASPHFQVRLMRRSEDASRTDMSYARLPSRALYFWNNEYFCNLVSDNVEVILPIMFPPLFENSKGHWNRYIFHLSFLSSRXPLLQNHPQMVYNAMKMFMEINPQLFDECSHEYNERQNSAEMREKARQNRWEKVAERAMQRQNGVNLPRNSTTAEIPLQLDDVDALTQESQRRLQSLKLDEAGSKDRRP

SEQ ID NO: 12746 - protein, 216 aa, Aspergillus nidulans
QGVGKTSLVQRYVKNSFNASATTSTVGASFVTKRVLDSASDTLVRLQIWDTAGQERFRSISRLYYRGANACLLCYDITDESSFNEMTGWLHELKRNLTSDDEPIVIHVVGTKSDIVADDPGRRRVPFERTIAYIAEQLYPSRASTPPPTAAPSAASGFARTSSATLGMGMGVDSKRSSGFWGQDIGWDCCHEISAKDGEGVEEVFRVIARKLVEQR

SEQ ID NO: 12747 - protein, 371 aa, Aspergillus nidulans
  unsure (1)..(371): unsure at all Xaa locations
IIDNGAYNMKAGYAPDSQPLDDEEIALSACAAIPNAIVKTRANRTYVGAQIGTNVTDWNEMLFRRPVEKGYTVNWEAQKEIWENSFFDERTVRSKELHIADPEDVTIIFTEAPNALPALQKNADEIIMEEWGFGGYLRCVGKSKYLILYYXVGMAKPFALNTGPSLNAWNEIQSLFEDSVLSQPRAVASPAECLLVVDSGYSHTVITPVYRGRPLQRGIRRLDLGGKHLTNYLKELVSMRQYNMVDETYIMNEVKESVCFVSNDFIRDLERTWKGNRKRGQPDPTDGVVVDYVLPDPNGGKRGFIGLMTLCXDPRKESLVLAGASAEQLNEDVLVLGNERFTVPEILFTPSDIGKKTAGIPDIILQSLSVC

SEQ ID NO: 12748 - protein, 418 aa, Aspergillus nidulans
  unsure (1)..(418): unsure at all Xaa locations
KREHQDQTGDSRPSKKSKGTKDTKKNTEVSPPYFQSPALDNVPQTEIDKFLSDHSIKITDASADKPSLRPIISFSFLPPSNKDLYAPLDGFASPTAIQSATWPLLFAGRDVIGIAETGSGKTLAFGLPCLKKVLDLKTKQKSCRPLAVVISPTRELAMQIYDQLVKFAEKVDIQVACIFGGVKKDEQREALKSAAVVVATPGRLKDLQNDGSLDLGRVKYLVLDEADRMLDKGFEQDIKDIISPMPVSKRQTVMFTATWPPIVRNLASTFMTSPVTVTIGGDPSADPRANSRIKQVVEVVKPHEKEQRLVQILNRHQRGTPDKVLAFCLYKKEAMRVERLLRTKGFKVAGIRSSLSQQERFRSLEAFKSGAATVLVATDVAARGLDIPHVKLVVNVTFPLTVEDYVHRIGRXGQSGSS

SEQ ID NO: 12749 - protein, 599 aa, Aspergillus nidulans
  unsure (1)..(599): unsure at all Xaa locations
PIVQCVQVKPLPPQANNQERYRVVFSDISSYVQTMLAIRMWYRAXTIRCKVSNELSCIXKQNHFVTDGLLRKGCFVRLKQFQANSVKEKSSILRSRFGVYADYYRILIVLDLEVLKELGEAEKLGEPKPLESKAEEEEKPQPTTISSNGFYGAKAQNAPSQISSRAQHTRPMQGSAPATIYPIEAISPYAHKWTIKARCTSKSPIKTFHGRSGDGTLFSVNLLDDSGEIRATGFNEQCSALYDLFQEGEVYYISSPCRVQIAKKQFTNLNNDYELTFERDTLVEKSVLKLLSIFIFSHYLXAEEQNDVPQVRFNFTTIGDLQSVEKDTTIDVIGVLKDVGETTQIVSKTTKKPYDKRELTLVDNTGFSVRLTIWGTTAMNFAASPESVVAFKGVKVSDFGGKSLSLLSSGSVTVDPDIEEAHRLKGWYDAQGRNENFASHASSVGTMSATKRDQLKTIAQVREEQLGMSEEPSYFTLRATVVYIKQDNLCYPACLSEGCNKKVTEVDPGQWRCERCDKTHPRAEYRYIMLVNVSDHTGQLYLNCFDDVGRLLLGMSANQLMELPQNDGKALGNVIQNATCRTWTFGCRAKIDHYGDQQR

SEQ ID NO: 12750 - protein, 523 aa, Aspergillus nidulans
  unsure (1)..(523): unsure at all Xaa locations
SCQANSIAELRSPPASQAVYREDCTQCFDSVVXEHPFLVHVFVLTTGVIQDDESGLNVCLSCFNGGCAGQGIMHVLHFERFGHPLALNIRRTRKKIQVLSHHLAHDCGLTCXLGTARGPPHKISKLAINAETDEDRYDTSTRVVCYSCGRDDVGEPSGKLQSVIEGVMHATTFSKREEIKAWEQEFIPCEHTTGLIQQESKRIKSQGRNIHEVFXVSLTNMSRSQQCSMCDLRQNLWLCLECGNLGCGRSQFGGTGGNSHGLAHFNATSHAVAVKLGSITADGSADIYCYKCNEERIDPDLATHLYHWGIDLAGREKTEKSLMEMQVEQNLKWDFLMTTEDGQDLTPVFGAGLTGLSNLGNSCYLSSVVQCLFDLPEFQRRYYHPNEDPPLAETPAADFETQLRKLADGTLSGRYSRPDDKTVASPKPQEIRHQKGLAPSMFKHLIGRDHPEFSTMRQQDAFEFLLHVFKHVTLSKHPVGMDNPIDSFKFSIEQRLQCLKCRGVRYRLDEQDNISIPVPARRV

SEQ ID NO: 12751 - protein, 487 aa, Aspergillus nidulans
  unsure (1)..(487): unsure at all Xaa locations
RLPTKLISLTIIASSNGFDGSLVNGLQSLDSWMGFMGQPSGTWLGLINAVYSLGALVSTIFAAWCSNRYGRKQCVWIGIAFILAGSILGAAAPNDTVYIVSRAVIGVSSGMVSNAPPLLLNEIAYPAHRSISSCLFMIGYYFGAVISSWVTFATRTYASSWSWRLPTLLQMLCPLVAIPGFLLTPESPRWLIGQNRVEEARKVLADLHASGDLTAPLVIKEIHEIQEAISTERESAASSSYSDMITTPGNRHRLLITVTIGIFSQWSGNAVVSYYLAMVLDTVGVSATKDQLLISGCLQIWNLIFGTIGAVLVERDGRRPLFLTSAGVMLVSYIIITGLSGSFASTGSAPMGTAVIPFIFIYFAGYDIALXAQSFSFLSSFTRPVILICRNRTPLLVAYPCEIWPFALRSRGLSVAWFSAIGALIFNTFVNPIALSAIGWRYYFVFVAILICYGLTSWFVYPETKGYNLESISHIFDGNHQPGHDSE

SEQ ID NO: 12752 - protein, 496 aa, Aspergillus nidulans
  unsure (1)..(496): unsure at all Xaa locations
EFIRSDILGTTFETTSRYFPTIGXDDPQATNHXQCRYANLQPVGLGTAGVVWYSLGNYRNGSQITTDRLLSSAYDLISEQVVAIKKMMKPFHSTSVAKRTYREVKLLRHLRHDNVRILRGRPLWSRPLXLGQLALTYILQLINMSDIFISPLEDVYGLPEAPVSVDGSNXHDVTSRYLVTELLGTDLHRLLNGKPLESKFAQYFTYQILVRRNIAIASRTNLISFPGLTDXRNPAPSCLVLVLLQRGLKYIHSAGVIHRDLKPGNLLINENCDLKICDFGLARVQEPQMTGYVSTRYYRAPEIMLTWQRYGSKVDLWSVGCILAEMLLGRPLFPGTDHINQFWLITDLLGNPPDEVIDRITTNNVRNPAPDLQPSNHLEPANGNRRIDRRVVKSMAKRNPRPLKEILPAAEDAGKCAFASCPPIRTSSDQRNLALNLLDNLLVFDLDRRISAEQGLMHPWMAPYHDPTDEPVATEQFDWSFNDADLPLDTWKIMMY

SEQ ID NO: 12753 - protein, 207 aa, Aspergillus nidulans
KTVLITGCSDNGIGSGLALTFQAQDYYVFATARNPAKMSKLADLPNVTLLPLDVCKNEEITAAVEAVKSHTGGTGKLDYLINNAGQGHFMPILDQDLKNARDLYESNVWGPLAVTQAFAPLLINANGTVTFITSVSGHINCPYIGVYAASKQSLEIIAETLRLELQPFDVRVLSVVTGAVQSMGQVGRFDEYKLPEDSMYKPIEAFI

SEQ ID NO: 12754 - protein, 425 aa, Aspergillus nidulans
  unsure (1)..(425): unsure at all Xaa locations
FHPVHLMDTFKDSRYRVIRKLGYGSFSTVWLARDTKKSHGQHICHGIGNSXGSRLGRYVALKVGQAEDQSSSAPIEETRIYQLLAKTKFPSHPGRDHYLPLLDQFRYTGPNGTHQALVYEPMSASVTEVKEALFPNGPFPFQMAKAILWQTLLGLDFLLANGVVHGDVQPRNLLFTLEDLKDVPEDQLVQDKDKSITLCVDTELKGGCEGAGVPCSSALVDAVPQYFKAIYRQSVXSRRLYVPTSLQKRXELTLQPSSLPTRPQHRRPPLHLRGPETLFQRCISANQDMWSFGCLIFEFITGFALFDLSDHPVTGITDDMHFIDMYNILGFPKDEALRNQHWPNWRRFFRSNGEPIDHFIRRRDRDFDITGRPTSHTLEELLEEAVGEGLSPEEINITKQLLRGLLEFEVEKRFTTKDVLRHQWF

SEQ ID NO: 12755 - protein, 338 aa, Aspergillus nidulans
IDHKTGNLVAVKIIRNKKRFHQQALIEVNLLQKLKEWDPHRRHNVVNFTQSFYFRGHLCISTELLGINLYEFIKAHDFRGFGIKLIRRFTRQILNTLTLLQAKKVIHCDLKPENILLVHPLSSEIRVIDFGSSCFENEKVYTYIQSRFYRSPEVILGMSYGMPIDMWSLGCILAELYTGYPIFPGENEQEQLACIMEVFGPPEKHLIEKSTRRKLFFDSLGKPRITVSSKGRRRRPSSKELRQVLKCDDEAFLDFISRCLRWDPQRRLTPSEALRHEFMTGHRMAPRPRPFGSQSPGKRANTLSTPTTGRPLPEPPGTSLKNGAVVRSRDPSNPSPIK

SEQ ID NO: 12756 - protein, 388 aa, Aspergillus nidulans
  unsure (1)..(388): unsure at all Xaa locations
KTKPSYTTPSRRGGQWTVLILIICTIFSITEFRTWLKGHETHHFTVEKGVSHDLQLNFDAVIHMPCDALHINIQDAAGDRVLASEMLKKEPTSWKLWMDKRNYHSSEYQTLSDSRGDEERVAAMEEDVHAGHVLNELRRNGKRKFAKGPKLRRGDVVDSCRIYGSLEENKVQGDFHITARGHGYRDGREHLDHSGAYISLPFSGPRFETWVXXCXLMACKAFNFSHIITELSFGPHYPSLHNPLDKTIATTEFHYYKYQYFLSIVPTIYSRNQNLRLDALPSSSSARSNKNLIFTNQYAATSQSDAIPESPYVIPGIFFKYNIEPIMLLISEERTGFLNLLIRIVNTVSGVLVTGGWVYQIMTWLGELRRRRRGGEKSEGYLHGKLEE

SEQ ID NO: 12757 - protein, 517 aa, Aspergillus nidulans
  unsure (1)..(517): unsure at all Xaa locations
QETDHGAETDLRRTLSTRHLTMIALGSSIGMGLWLGSGTSLRNGGPAALFIGYILAGTMIWSVAHAIGEMAVLYPLPSAFVQWSSIFISKELGFAVGWAYWFSAFITIANELQVRSRVLXSDEKLTAKGCVTVVSFWTDAVPTAAWISIFWLVIIFINAWAVRFFGEVEVVSSTIKFSWIFVVIISLIGWQPSILTFFAHCQLNPTPVVSAGGAPNHEAVGFRYWNAEPFTNGFKGFLSVMPTCIFAMSGSENSALVAAETQNPRRSVPRAVGTIWLRLSLFYLLGAVVVTITVSPEDPNLFGASGANASPFVIAYTNAGIPVLAHMMNAVIFISVVSTGSISGFGGSRLLMGLSHLGLAPKGKQHFHRKDQPNTEEQIFGRADRKGRPVAGLVVTLLLGGGFSYLNVSQSGADVFSWLSNLTSLFTLFGWGSICASHLRMRYAWKNQGRSEADLPWKTWTYPYASWWGLSWCILLIIAEFYLSVWPLHTNPNVTDFFANYVSIIVVLVVYLGARLW

SEQ ID NO: 12758 - protein, 400 aa, Aspergillus nidulans
  unsure (1)..(400): unsure at all Xaa locations
KPKVQPCRYKTGKTLGAGSYSVVKECVHIDTGQYYAAKVINKRLMVGREHMVRSLGNCCRLRSSVVAGEAEIQASAKVIXVRNEIAILKQVSTGHQNILTLVDYFETMNNCRAPVEGXDGLXRRXLLAFSAVYLVTDLALGGELFDRICRKGSYYESDAADLVRAILSAVAYLHDHGIVHRDLKPENLLFRTPEDNADLLIADFGLSRIMDEEQLHVLTTTCGTPGYMAPEIFDKSGHGKPVXVLPFRPALAKHRQLTRMMAQRHWAIGVITYFMLCGYTPFDRETNLEEVQAIATANFSFTPVEYWRGVSQEARDFIKRCLTVNPKKRMTAHQALQHPWINPPYDTTDDLGSGEDLLPNIKKNFNARRTLHKAIDTVRAINKLRENGGLMMDGIMSVDP

SEQ ID NO: 12759 - protein, 433 aa, Aspergillus nidulans
SASTLSRRARSSLKCTSNALWDVLNDIWHPQSNPHGYVTLGVADNTLMQQQLLFRANSSFEMSGQHLALNDTITGSPRLKAAIADILSRYLHPSKLLRPSHILATNGVASAIEHCSWALCDPGDGILVGRPYFRGFSRDICLRPAARLVQVSFEGVDPLGISAVSIYEEALINSSKQGCAIRAIMICNPHNPLGRCYSQSFLIEIMKLCQRFGVHLISDEIYALSVWREGQDGAVSMNKFTSVLSIDHDGLIDPSLVHVLWGVSKDFGANGMRLGAVISQGNSDMLESIRGVAQYSSVSGLADCFTTNILEDERFVNQFIAENNKALAATYEYVVAFMDRHGIPYARGSNAGFFVWCDLLTPYLKLQPASSFDGSEKAKAIKNRELLDKLSRFKVHLGVGDDFGSEQKGWSRITFSQSQNQLDKGLARIINAL

SEQ ID NO: 12760 - protein, 595 aa, Aspergillus nidulans
  unsure (1)..(595): unsure at all Xaa locations
PLQALTNHLPATYRICNPNFHYESSRNPRRVLTKPSKGVKNDGYDNEDSDYILYSTTSWEAKRQGISXYHCATTPITQSSVXQLSRNRYLILDVLGQGTFGQVVKCQNLKTQEVVAVKVIKNKTAYFNQSMMEVSVLDLVSLHEKLFVYCAYFRHNSSTADTTKNDDHHLLRLKDTFIHRQHLCLVFELLSVNLYELIKQNQFRGLSTTLVRVFAQQLLNALSLLNKAHLIHCDLKPENILLKKSVHNSVGAFGXTNGVSYSLESPIIKVIDFGSACDERQTVYTYIQSRFYRSPEVLLGLPYVTEIAHCYWRSLANFSRYSSAIDMWSLGCIVVELFLGLPLFPGSSEYNQVCRIVEMLGLPPTWMLEMGKQSGEFFEKTQDEFGRKSYRLKSLEQYSREHNTKEQPSKKYFQASTLEEIIRSYPMPRKNMKQAEIERGKNPVLFLIXQLTPLQKSTTALHSLTSSVVCCRSIRSSAGRRNSKAPPVHYTAKVHRAVCPPNELEVFVSXQDPPTRYSAAAASGTAEXAKGGTCSIRRSERVHNANEPVPSFGTCAAPPPMYTGMYGGHQQPAPPYPTQPPAYGHQMNLMPGQMP

SEQ ID NO: 12761 - protein, 775 aa, Aspergillus nidulans
  unsure (1)..(775): unsure at all Xaa locations
VNYARQIRNLEIAKRGSSRPLTLTEKLLYSHLITSEKNTWDVERIERGKTILELRPDRVACHDATASMALLQFISAGLPRVAVPTTVHSDHLIISKKGAEEDMHRALGEHAEVYDFLSSASRKYGIGFWKPGSGIIHTVIFENYATXAYPSSXVPINLITHYFHDQPGGLIIGTDSHTPNAGGLGMLGIGVGGADAVDAMSGMPWELVAPKVVGVRLTGQLQGWSSTKDIICRLAGLLTVSGGKGRVIEFFGPGTQTLGATAMATICNMSAEIGSTSCIFPYTDAMGRYLETTQRAHVIEMAQRARSALLNADEGADKYYDQVIELDLSTLEPHVNGPFTPDLAHPISKLKTAVAAEDWPVDLSHAMVGSCTNSSYEDLDKTRQIVAQARAAGITKLPTPFLVTPGSEQIRATAEADGILDELRDAGAVVLSSSCGPCVGSWDRKDVDVKGKEKNSVISSFNRNFVGRHDSNPATHSFVTSPELVAAFAYAGRLDFNPLTDPVTVPGGPSKELYFSPPCYPRAPHFFRNRVQDSIQNPSLDDTDLPVQIRPDSDRLQLLQPFPPCQPGCAHGMELLIKVKGECTTDHISPAGPWYKYRGHLENICNNMLTTATNAFVGQGDPRLLGHTRHPITSKVEGAPQVARDLKQRGVRWCIVGDHNYGEGSSREHAALEPRYLGGVAVIARSFARIHETNLKKQGMLPLTFADPATYERIAEADRITLIGVEEGELCPGSSVTMRVEPRRGEVWEAELKHSYHSGQIPWLRAGSALNYIKA

SEQ ID NO: 12762 - protein, 416 aa, Aspergillus nidulans
  unsure (1)..(416): unsure at all Xaa locations
ISLNLRGFFSGFEVXLYNKSCIAIAGLGELGGNVSSITDSTAHFRNAFEGTSNATVYGATNSLINVMFSYQGYENAFNLVNEVKNPVKTLKWSTPASLITVGILYMLANIAYVAAASKQEIVESEINVASLFFQKVFGGGGASRALNFLICVSAFGNLLVVLIGQSRMLRECGRYIHLKDCSQTNHLRGFYRQGVLPFTRFWTSTRPFGTPLGPYWLKWALTAIMILAPPAGDAFISVRILIATKSHYKINIHPVVDLGIYPQSMFNFFLAVGLLFTRRHRKRLNIPRTEWHAWDIVVYFAILANLYLLVAPWYPPAGGANGGDVSFWYGTYVVVGISLXGLLPPFFSSFPSGYATNIIASIGLCGVYYWVYMKVLPHFGGYQFRQTIITGPAGETSHKMVKVPNDELARWDEEHD

SEQ ID NO: 12763 - protein, 571 aa, Aspergillus nidulans
  unsure (1)..(571): unsure at all Xaa locations
VARRLSSVYRKLALESDQQFLPTPVSKLPSGLETGRYLAIDVGGSNLRVAFIELLGDTADPDMARTSASERPLKKAQTQRVKRTLEKAWPIQEHLKMDKAEDLFAWIGDCIAEVVAESLSSDATKNAVPEELEMGITFSFPMMXVASHSFPLLNVSEDNSYTANKLQQESLAEATLMPMGKGFAITSDLNLRNILLSGYERHTRRPDDEDQPSTKRRKLYALPKLKISAITNDAVATLASLAYAVKSLPNSRVAMGLIVGTGCNATIPMKLSALHEDKVKHVRRSDPETSGIIVNTEWTIYGVLPPLKELNIITKWDAELDASSARPGFQPFEYMTGGRYIGELIRLIFTDYLINVAGVSTAALPATLTQGYALTTSYISDKVARARSDEELTDELAHSLPPPSDTWQWDATSAGVLRTVARTVQRRSAGLVAAAVVGLLACAGEIELRLDSPQGSPQDSHAASPERDSITTLSAQLKSEGSASNGFRGPIVPIISPTPADWQSGPEELVVACTGGIIQHYPNFKEMCQQTIDRLIMRTGPQKSGKSVFLREASDGGVIGAGVLAGMVGNR

SEQ ID NO: 12764 - protein, 456 aa, Aspergillus nidulans
  unsure (1)..(456): unsure at all Xaa locations
MGSCFSSESAGDVEQKKRSQAIDRKLEEDSRRLRRECKILLLGTLQVPSFSRQSACDRSQGLLKSXPALLDRSGESGKSTIVKQMKIIHQNGYTVEELALYRLTVYKNLLECAKALIGAYHQFNLEPTSQKVRDNIEFLANYNIDPDPNIPLDPAVGDAITYIWNDPCTSTALERQNEFYLMDSAPXXGFLELVLVXACXTSFSFFEEAKRITSPDYIPNVNDVLRARTKTTGIYETRFTMGQLSIQXGIPLPGVIDHYXXFATACLNVGGQRSERKKWIHCFXNVTSIIFCVALSEYDQVLLEEGNQVGCALNSVLAHAKLLAERMMESLVLFDSVVNSRWFMRTSIILFLNKVDLFRQKLPRSPLSNYFPDYSGGNDVNRAAKYLLWRFNQVNRAHLNLYPQXVLREXPFPNSWIIXXSGKAXHQATDTTNIRLVFAAVKETILQNALKDSGIL

SEQ ID NO: 12765 - protein, 679 aa, Aspergillus nidulans
  unsure (1)..(679): unsure at all Xaa locations
KHELVRHVETTLARSLYNCDELYVPCLFFSRDLNSDQTXAAYSGTALAFRDRLIIEWNKTQQRQTLNDQKRVYCXYRTADFMDSTLTKXIDLSLEFLMGRTLDNAMLNVGMKDVARGRSRVFYCGNSIAKPCTEGLSDLGFRIEDVVSQEHDAALGNGGLGRLAACLLDSLATLNYPAWGYGLRYRYGIFKQEIVDGYQVEIPDYWLDFNPWEFPRHEITVDIQFYGWVRTYEDENGKTVHSWQDGETVQAVAYDVPIPGYGTRTTNNLRLWSSKAASGEFDFQKFNAGDYESAVADQQRAETISAVLYPNDNLDRGKELRLKQQYFWCAASLHDIVRRFKKTGRPWSEFSDQVAIQLNDTHPTLAIVELHRILIDIEGLDWDVSWEIVTNTFGYTNHTVYQKLSEKWSVPLLQNLLPRHMQLIFEINLYFLQFVEKKFPDDREILSRVSIIEESHPKMVRMAHVAVIGSHKVNGVAELHSDLIQSTIFRDFVAIYGPDKFTNVTNGVTPRRWLHQANPRLSDLIASKLGGYDFLTDLTLLDQLEDYADDKDFQREWVEIKTSNKLRLAKHIKETTGYSVNPNSLFDVQVKRIHEYKRQQLNIFGVINRYLKIKSMSGEEKKKVQPRVSIFGGKAAPGYWMAKTIIHLINEVSVVVNNDPDVGDLLKVIFIEDYNVSKA

SEQ ID NO: 12766 - protein, 510 aa, Aspergillus nidulans
MTMSRSSRSSVLALALATGSLVAAGPCDIYSSGGTPCIAAHSTTRALYSSYNGPLYQVQRASDGTTTTITPLSAGGVADASAQDAFCENTTCLITIIYDQSGNGNDLTQAPPGGFNGPDVGGYDNLAGAIGAPVTLNGKKAYGVFVSPGTGYRNNEAIGTATGDEPEGMYAVLDGTHYNDGCCFDYGNAETSSLDTGNGHMEAIYYGTNTAWGYGAGNGPWIMADLENGLFSGQSSDYNAGDPSISYRFVTAILKGGPNLWALRGGNAASGSLSTYYNGIRPTDASGYNPMSKEGAIILGIGGDNSVSAQGTFYEGAMTDGYPDDATENSVQADIVAAKYATTSLISGPALTVGDTVSLKVTTSGYDTRYIAHTGSTINTQVVSSSSSSTLKQQASWTVRTGLASTAAANGCVSFESVDTPGSYIRHSNFALLLNANDGTKLFSEDATFCPQDSFNDDGTNSIRSWNYPTRYWRHYENVLYVASNGGVNTFDAATAFTDDVSWVVADGFA

SEQ ID NO: 12767 - protein, 489 aa, Aspergillus nidulans
MTSNGTNGSATAYHASSTQEAIQAENDFAAHNYHPLPVVFARAQGTSVWDPEGRHYLDFLSAYSAVNQGHCHPKLVAALVDQASRLTLSSRAFYNDVFPKFAEMVTKYFGFDMVLPMNTGAEAVETGIKIARKWGYKVKGIPENEAIILSAENNFHGRTVSARQLWAAVFGDMRLTLPMAAISLSSDPESRENYGPYVPNIGCTIPGTEKPITYNDKAALREAFEKAGSNLAAFLVEPIQGEAGIIVPDDDYLQLARSLCDQHNVLLICDEIQTGIARTGKLLCHEWSGIKPDMVLLGKAISGGMYPVSCVLGRKDVMLTVEPGTHGSTYGGNPLACAVAIRALEVVQEENMVERAEKLGQAFRSGLEAIQNPIIQTVRGKGLLNAIVIDEFKTNGHTAWDLCMLMKEKGLLVGINPPFIRPTLTRPRPKPTHQNIIRLAPPLVITEEEIAKALEIIKAAVAELPNLKGAAEDKVVPPPEKKVKITLEN

SEQ ID NO: 12768 - protein, 274 aa, Aspergillus nidulans
  unsure (1)..(274): unsure at all Xaa locations
MLSILRKARLKDKEMRILMLYNPLXPEILGKVANQQXGLDNAGKTTIVKRIMKEDVTTVSPTLGFIIKTIDFEGYFLAVYRFCSXSLTVSRYRLNICKEPDSVATQPLTLAQGTVGGQKTLRSYWKNYFEKTDTLVWVVDATDRLRIGDCRDELAGLLLEEVSXCPPGKLLSTGVLDELTTTEQRLMGASLLVFLNKTDVEGCMTQDEVRKVGCFFFPIDLFKDPGSFXLSVQNLALDSIKTHKWTILPCSAMTGANLHEGLNWIVQDAKDRLF

SEQ ID NO: 12769 - protein, 283 aa, Aspergillus nidulans
  unsure (1)..(283): unsure at all Xaa locations
DIPDLAGKVVLVTGGLVSPIDPVHVRIWCXXGAGNTGLGKETIRQIIKHNPEQVFLAARSEEKAQNAIRELESTAPNIKITWLPLDLASTKSIHDAAETFRAHASRLDILILNAGVMSLPPGETDLGHEIQLGTNHTGHFLLTKLLLPVLLETAQKPDSDVRVISLSSIGHNLAPDFETILHQDELKKCNTNARYGASKAANIIFAAELARRYPSLTAVSVHPGIIVTELYAATSASNPIAALAVKLLGLIATKVEQGAWNQLWAAVGAKKGELVNGAYYTPV

SEQ ID NO: 12770 - protein, 482 aa, Aspergillus nidulans
TSLVDYKKPEELQDILQLDLPEQGTGQTGLVSVLRKVLRYSVNTWHQGFLDKLYASTNAPGVASELILAALNTNVHVYQVSPALSVIEKHTGKRLRALFGLNGPRAGGISVQGGSASNTTSIVIARNNLYPNTKTDGNGDYKFVLFTSAHGHYSIEKAAQMLGLGSSAAWSVPIDKEGRMIPSELEKLVQKALSENRTPFYVNATAGTTVLGSFDPFDDIAAICKKYNLWLHIDGSWGGSFAFSRRQRHKLAGAEKANSIAINPHKMLGVPVTCSFLLASDLRQFHRANTLPAGYLFHNNDDEDAVPVENGIGGFSELNSDSPEIWDLADLTLQCGRRADSLKLFLSWTYYGTAGYERQIDNACDTAAYLATIIQDHPDFILVSQNPTPCLQVCFYYGPNGKLLHPRGDSIVSDENQRAKANSKVTEQITHAIVGRGFMVDYAPPSGDEKAVGDGKFFRCVINVQTTRETVEGLVRAIEEVG

SEQ ID NO: 12771 - protein, 541 aa, Aspergillus nidulans
  unsure (1)..(541): unsure at all Xaa locations
LTGSRQSIXVFEGTSGIDVKKVHCLGSFLYCFGVEGNIADLDYSARPKSEFTNHSLKLGVSEDMLGRVFDGSGRAIDKGPKVLAEDYLDINGQPINPYSRVSQPMPNHXRRLSLIECWIGVPEEMISTGISAIDTMNSIARGQKIPIFSASGLPHNEIAAQICRQAGLVKRPTKDVHDGHEDNFSIVFAAMGVNMETSRFFTRDFEENGSMERVTLFLNLANDPTXALLFIQSEYPMADWVYYRIERIITPRLALTTAEYYAYQLEKHVLVIMTDLSAYCDALREVSAAREEVPGRRGYPGYMYTDLSTIYKRAGRVQGRNGSITQIPILTMPNDGKLGHRTRTYNHXXLGTDITHPIPDLTGYITEGQIFIDRQLYNKGIYPPINVLPSLSRLMKSAIGKGRTRDDHSDVSNQLYAKYAIGRDAGSVPLSYFILTLTQQLIKLIPLKPAAMKAVVGEEALSSEDKLSLEFLEKFERTFINQSAYESRSIFESLDIAWNLLRIYPPHLLNRIPKRVLDEFYARSGRKIPNKDTRDNSVPEQ

SEQ ID NO: 12772 - protein, 331 aa, Aspergillus nidulans
  unsure (1)..(331): unsure at all Xaa locations
MLHHFGSEEQKRTLIPARLCGEFRTTFGLTEPDHGSDATFMSTVAQRKRNSDGVEGWEINGAKKWQTGAHHCTHMIIFARTSGESGSARGITAFLVPAHTKGIEVTSYEWTFNMPTDHATVTLNGVFVPHSAILGKLDNGLAIAQTFVHENRIRQAASSCGAAKYCLDRAIERANSRTIWGEGRKLSEHQGIQFPVVELMTQVEMLRLLILRTSVRMDDIVSECEKTGGKDVPWVRIEKELSGEVAMCNYWANRLACQAADRAIQVRTLLLSLYWLXINALTKLLRVXIHGGDGYSRHYPFEHIYRHFRRYRITEGSEEIQIRKVAAYLFG

SEQ ID NO: 12773 - protein, 446 aa, Aspergillus nidulans
  unsure (1)..(446): unsure at all Xaa locations
NMXSQQSGLPKFLQSYPITMVKIALLGAAGQIGTPLSLLCKAVRSQTVFLPIARHARXRQLSQSDLFAEISLYDIVHVPGIATDLMHIDTRARVTGHLPDDSGLKKALTGADIVVVTAGIARKPGMTRDGRFMQQSTSVXPVIDARNRSIQGRFLPPFLFFLLPLHSPFCLLIFLREEERIVRLISNQRQTNASIIRDIFAEIAATCPNAVSCVVTNPVNSTLPVAAETLKKAGVFEPTRLFGITTLDVVRASTFAAHALDSNSDPKAFKVPVIGGHSGATILPLYSQAEPPVNLDKETLAAVIHREYTLLSTPSLLFFKSPMLTXPLNQVCQFGGDEIVKSKQGAGSATTCMAYAGFRFVKAIVAAMNGESVTEEAYVYLPGIAGGQEIAQELGVDYFALKVTLGRTGANQVLPIGEISENESTLLKVAINDLKANIVTGVSFMA

SEQ ID NO: 12774 - protein, 545 aa, Aspergillus nidulans
  unsure (1)..(545): unsure at all Xaa locations
DLFVDLVAPNGTHYSQPTGLFINNAFVASSGQTITSLDPSVGSPAIISLNDDXRKGRTDKPIATVHAASAEDVDRAVIAARAALVHPSWKKLPGTERGQLMARLADLMEKNKELFATIDAWDNGRASQFYAFSSFPSFSVSQVLSLTEKSGKPYHIALSEDLVEAIGTIRYYSGWADKTFGQTISTTPAKFAYTIRQPVGVVGQIIPWNYPLSMACWKLGPALACGNTVVLKPAEQTPLSVLVLGSLIKEAGFPPGVVNIVNGYGRDAERALAGHPLIDKIAFTGSTVTAREIMKLDGETVXNITIDTGGKSPLRELPGADLEHAVKWSHFGIMSNQGQMCTATSRIYVHQDIFQLFLSKFKAAVETTSKIGDQWDESTFQGPQITRAQYDRILSYIETAKKGGMAVVTGGSAHAPSSEKNKDGYFIQPTVFTGTDDSHAIVREEVFGPVVVILPFASEEEAIRRANDTTYGLGAAVFTCDLERAHRVAAEIEAGMVWVNSSQDCDPRVPFGGVKQSGIGRELGEAGLEAYTQVKACACNMGNKL

SEQ ID NO: 12775 - protein, 353 aa, Aspergillus nidulans
  unsure (1)..(353): unsure at all Xaa locations
TAAKFIETEASSSTATSTSTTVSVPSSTTSQPAASSSSASTATGLDAPFPDGELDCSTFPSDYGAVPLDYLGLDGWSGIQYVTLVGEIISDIITAVTGDSCTSGAMCSYACPPGYQKSQWPSTQGSTGQSVGGLQCKFGKLYLTNPDLSDKLCIKGVGGVKAKNTLSDHVAVCRTDYPGEXYPSANASCAYGXPXTGTESETIPISLNSGETKEVTCPDGATYYKWEGKTTSAQYYVNPAGTSQEEGCQWGDGSKPIGNWAPINLGVGENNGKWLSIFQNSPTTTEKLDFNIKIQGDNLSGSCKYEDGSFISDTGSNDSGCTVSFHDLIRPLKLRLNYLQVQVMSGDATFVFY

SEQ ID NO: 12776 - protein, 266 aa, Aspergillus nidulans
  unsure (1)..(266): unsure at all Xaa locations
PPAVAVEEKTEKANGDIVTVFHDPENFNVKHPLMHEWTLWFTKPPSGKVERASLRPRKVFRLRWLILGRQWNDLLKEVVTFNSVEEFWGIYVCRFCLIFQTRVSLMALFAXNNITPTSELGLKADYHLFKKGVRPEWEDPQNKHGGKWSFSFKDKRSVPIDDLWLHAQLAAIGETLENDGDNEVMGVVVNVRKGFYRVGLWTRTVGKTLPGDKSGRTPAQGKEVLESIGRRFKEVLRLGPNDSVEFSGHTDSAHSGSTRAKAKYTV

SEQ ID NO: 12777 - protein, 778 aa, Aspergillus nidulans
  unsure (1)..(778): unsure at all Xaa locations
DGRKERVQFDKITARVSRLCYGLDPEHVDAAAITQKVISGVYQGVTTVELDNLVWPPTTHCTVLCXYHSSKAAETAAYMTVTHPDYAILAARIAVSNLHKQTKKQFSLVISDLYHYVNPKNKKPAPMISKETYEIVMKHAEELNSAIVYDRDFNYNFFGFKTLERSYLLRLDGKIAERPQHLLMRVAVGIHGNDIERAIETYNLMSQKYFTHASPTLFNAGTPQPQLASCFLVDMKEDSIDGIYDTLKTCAMISKTAGGIGLNVHRIRATGSYIAGTNGSSNGIVPMLRVFNNTARYVDQGGNKRPGAFAIYLEPWHADVFEFLDLRKNHGKEEVRARDLFYALWTPDLFMKRVEANGDWTLFCPNEAPGLADVYGDEFDALYEQYEKEGRGRRTIKAQKLWYAILEAQTETGNPFMLYKDACNKKSNQKNLGTIRSSNLCTEIIEYTAPDEVAVCNLASLALPTFVDASRGEYDFGKLHEVVQVLVRNLNKIIDINYYPVPEAKKSNFRHRPIALGVNGLADAFLALRLPFDSAEAKQLNIQIFETIYHAALTASSNLAKEDGPYESYEGSPVSQGILQYDMWERTPTDLWDWDALKAKIAQTGVRNSLLVAPMPTASTSQILGFNECFEPYTSNIYSRRVLAGEFQVVNPWLLKDLVDLGLWSDNMKNRIIAEGGSVQNIPNIPDDIKALYKTVWEISQRRILEMAADRGAYIDQSQSLNIHLKEPTMGKITSMHFAGWKMGLKTGMYYLRTMAASAPIQFTVDQEQLMVADTNVA

SEQ ID NO: 12778 - protein, 228 aa, Aspergillus nidulans
YTDNGGSVLGITGKDFAVLAGDTRSTSGYNINSRYVPKVFKIGGEDETGKGAHILLSVVGFAADGLALKERLDAVVKMYKYQHGKPMSVRACAQRLSTILYQKRFFPYYVQAILAGLDEEGKGALYGYDPVGSYEREQCRSAGAASSLIMPFLDNQVNLKNQYIPGSGEGHALEARKPEPMSRETVEQLVRDAFTSAVERHIEVGDGLQMLVITADGIEEVYHPLKKD

SEQ ID NO: 12779 - protein, 473 aa, Aspergillus nidulans
  unsure (1)..(473): unsure at all Xaa locations
DTPVFAVKFINKDYAARHGKISPRQLLMEATVHKHIGDHNNIISFFQTGEDGAWRWIAMELADGGDLFDKIEADEGVSEDIGHVYFTQLISAVGYMHSKGVGHRDIKPENILLTADGNLKIADFGLATLFEYKGGTKLSTTFCGSPPYIAPEVITCSSRNQTKGPGYRPDVADIWSCGIVLFVLLAGNTPWDSPTEDSYEFHEYVMTNARTSDELWQKLPTATLSLLRGMLNIDAQARFSLEDVRRHPWFTRQNKHLAPDGRLRDPIKVAPSMFESLHIDXSQSASRPLKGGSFGPDRMDVDIGDDLGAEHRISSTQPEVPRGDMLIDWDTPHLTDVFSSSQPTNNPRPPSSSLTPEILEDEPSFSQFSQRPSVPMSRTQNAQRFHDIVPSRSLTRFFSTWELKLLVPLICEALHRLGVPVPAVPAVSPGDNSAMIRVITRDGRMCPLHGKVLVECVSEGLFEIEFMKGKGDP

SEQ ID NO: 12780 - protein, 253 aa, Aspergillus nidulans
SSKPVLAVIGVGPGIGEAVSHHFASKGFVVALIARTESKLEKVQKTINDDVGTTASKYYVADARSESSLQSAFAAIKADLGPVDVLIYNAGSRRFTPRNILETSSEEFENFTRINLFGAFFATKCVLPDMLAKSSGTIIFTGATGSIRGNAGVSSFSPGKFGLRSLSQIIAREFQSSGIHAAHLIVDGPVESDIVGGFVRRRWEREGEQGRKKVEEKDLYLMQPKELAEIYWFLYSQPRSTWTQELDVRSMKE

SEQ ID NO: 12781 - protein, 201 aa, Aspergillus nidulans
  unsure (1)..(201): unsure at all Xaa locations
DQFDDYRESTIGAAFLTQTISLDESTTVKFEIWDTAGQERYKSLAPMYYRNANCAVVVYDITQAVCLRTXSPIAQDTCXYSGIHNSHSLDKAKSWVKELQRQANENIVIALAGNKLDLVTENPDKRAIPTADAEAYAREAGLLFFETSAKTSSNVRELFTAIAKKLPLDQAGPRNMRTAPRPGVDLRPEAPGTQSGGACNC

SEQ ID NO: 12782 - protein, 804 aa, Aspergillus nidulans
  unsure (1)..(804): unsure at all Xaa locations
MTIPEEVDIIICGGGSSGCVPAGRLANLDHNLSVLLIEAGESNLNNPWXECSSLEAPCEDELITDKPRVYRPGIYPVNMKLDSKTASFYYSRPSEHLDGRQAVVPCANILGGGSSINFMVLPAHIALNDSAPANVSMYTRASASDYDDFQAKGWTTEELLPLMKKHETYQRACNNPEIHGFEGPIKVSFGNYTYPIAQDFLRAAESQGIPVTDDLQDLKTGYVISLQVPYHTDSMIATGAEHWLKWINRDTGTSVLIPIYPLSYXHQLGRRSDAAHAYVHSTRAKYSNLHLQCNTKVDKVIIEDGRAVGVVTVPTKPLDGKEPPRRIFRARKQIIVSGGTLSSPLILQRSGIGDSEKLRRAGVKPIVHLPGVGRNFQDHYLTFSTYRAKPDVETFDDFLRGDPKVQKRVFQEWNIKGTGPLSTNGIEAGVKIRPTQKELEEFKKWPTPDFVDGWETYFKNKPDKPVMHYSVISGYAALLAVPFSYFLHCXQRTLKQLVRDHMLMPPGKFFTMFHFLEYPFSRGSTHITSPDPYAAPDFDAGFMNDKRDMAAMVWGYIKSRETARRMSSYAGEVTSMHPHFAYDSKARAEDMDLATTKAYAGPNHLSAGIQHGTLLSPFFYFPLSESVGMLTNASPAGSWSHPLTPGKQPSPTTLSSNRFEARSELEYSKEDIAHIEKWGTQSSTIPSIPHTNIDVPVVPVQRHVETTWHSLGTCSMAPREGNNIAPHGGVVDERLNVHGVKGLKVCDLSICPDNVGCNTFSTALLIGEKCAVLTAEDLGYSGDALKMEVPEYHAPGEFLNLARL

SEQ ID NO: 12783 - protein, 321 aa, Aspergillus nidulans
  unsure (1)..(321): unsure at all Xaa locations
MTTNSTGNGGAVGQENINTDIVTLSRFFTEEQTKVPEATGDFTXVSLESWIWKTAANMLETRLLCHALQFSFKSIAYYIRRASLINLTGLAGSSNTTGDDQKKLDVIGNDLFVSAMRTSGKCRILVSEEEEEAIIFDEHPNARYAVVCDPIDGSSNLDDDVSVGTIFGIFRLPDDILGPGKKVTAKDVLLPGTEMVAAGFTMYGASAQLVITMKNGGVNGFTLENSLGEFILTHPNMKLPPSRAIYSVNEGNSMYWDDWCNAYFDSLKRPGEGKKPYSARYIGSMVADAYRTLLYGGVFAYPADSKSPKGKLRILYECAPM

SEQ ID NO: 12784 - protein, 475 aa, Aspergillus nidulans
  unsure (1)..(475): unsure at all Xaa locations
PVDPQDDVPIAEGRVWVDGCFDFSHHGRESIIPDSCMIRPNHIPVGHAGAMLQARRLGDELLVGVHSDEAILENKGPTVMSLEERLLLPHPIRSGSXYXSRIAAVEACRWATKCIPHAPYVTSLPWVSHYGCKYVVHGDDITSDSNGNDCYRFVKAAGRFKVVKRTPGISTTDLVGRMLLCTKGHFVKSVKGMLSGKEGSGNEEERAQYALYLQERLKDYATDETGLQPGSQVWVWEGSNAAKLEASLDESGSFDKLVSGKPPRPGQRIVYVDGGFDLFSSGHIEFLRQVLAIEESDGRQRGWYDQEQREQRVKTHGEDFGTAYVVAGVHDDDVINHWKGLIIPIMNIFERGLCVLQCQVSSILSITGWSDNFXYVHAVIFSAPFSPSQPYLETMPLGVPDVVYHGPTTFIPLTYDPYAAPKRMGIFRETTDHAFQHVNAGEIVERILKSREAYEARQRAKLQKAVIEDQAKSRE

SEQ ID NO: 12785 - protein, 742 aa, Aspergillus nidulans
  unsure (1)..(742): unsure at all Xaa locations
NYQDQQGETALHVAARFDHEKCARILLKGNDVQKADTELAESTYSWTPLFIACVDGSLSVVEALIEAGADLERLDSSGWTAKEHAALRGHLDVARCLAKVTPEPELSEEPALTVPTASGSTTSGPLSSQPQSSLMEKKSNGGSAAGSSPSRNPEPVKSFGHRYLTDEAMILVSLGTMDTRKHVHAVNLDRIPMEHRHATQLDTALSIVVSANGAHGEPEIIDLTVQENISTEPIVFHAADPTKVRLLFDLDPTYSGSKDQIVGRGVALLSSVRPSVGSHRTNLQGDSTVPIVAANTLEVIGSITFNFLVITPFKHPNMSINREQTYWRSMSSTMVIGHRGLGKNFATRNSLQLGENTIQSFIAAANLGASYVEFDIQLTKDHVPVIYHDFLVSETGIDAPVHTLTLEQFLQLGERGTTRTPGSPGQIAIGGTERSKTPPLPPRHRSMSVGGTESDISELNERIKHTRDFKKKGFKGNSRGNHIQAPFATLEELFKKLPQNVGFNMELSKSIHFQVYLWFGRXSKAEEYPMLYESEEEEMDTYAVELNSFVDTVLEKVYTLGQGRNMIFSSFNPDICLLLSFKQPSIPVLFLTDSGSSPIGDIRASSLQEAIRFASRWNLLGVVTQAECLVLCPRLIRVVKESGLVCVSYGTSNNDPHKVKVSFXAHRGFWTSLTSFXLQAAEGIDAVIVDSVLAIRKGLTEHEGKNSFTPGPTPHASPLSQPTINAALKDAHRIPVLNNNTE

SEQ ID NO: 12786 - protein, 747 aa, Aspergillus nidulans
  unsure (1)..(747): unsure at all Xaa locations
NYTRTIYTRDAYGTPQGQNLYGVDPIYFDHRQDGTHGVFLLNSNGMDIFINNESGRSLEYNIIGGVFDFYFIARQSPQDVARQYAEIVQPPLMVPYWGLGFHQCRYGYQDVYEVAAVTANYSVHDIPLETIWTDIDYMDRRRIFTLDPERFPPELVKDLVDTLHARDQHYIVMVDPAVYYSEPNPALDAGLKYDAFMKELNGTHYQGVVWAGPSYFPDWFHPNAQEYWTEQFLNFFDGVNGPDIDALWIDMNEPANFYNRPYPGNNTTPEEFAEANDNPPEPPAVRDGPDAPIPGFPDSLQPNFASGQTNEKRAVVTVERRARSQSHRQLGAGRWRSAVRHWPRDPKAGWQHGRKSGSGCGPHECRGLPNRELIRPPYMIQNGAGPTLADNTADTDIVQSGGYVQYDTHSLYGAMMSTHSHNAMRARRPDDRALVITRSTFAGSGKDVSHWLGGKEFLQSKFAARGNSCXLALLFSADNISDWLSYRLSISQILQFASLYQIPVVGPDVCGFGGNVTETLCARYDRPNSTASYVPANIVSTRWATLGSFYTFFRNHAEIFANPQEFYRWPIVAEAARNGIAIRYQLVSLRSPLDPNIINIESANLVDYIYTAIYKQTQTGTPSLKPLFFNYPFDQNTYGIDLQFFYGPGILVSPVTEENSTSVSYYLPDDIFYEWGTGKPVRGHGEYVSAEVGVTHITVHYKGGLVYPQRIESANTTTALRQKGFNIVIAPGLDGSAHGELYLDDGL

SEQ ID NO: 12787 - protein, 955 aa, Aspergillus nidulans
  unsure (1)..(955): unsure at all Xaa locations
KSVRIDELDPFSVEAQDQMALRAPGLADDTEGPLSSKTAETSLPRFTALTVTIEFIVENIRDGIQFVGVENGDKRYPHAYTTNSLDHGTGCPLFPCVDDPSSRCTWEIAIRCPCTLGDVFERKPLDQSVSGTGTRLRSNHDRLAPDDEALDLSVVCSGELTDDIVDSKDSSKKTVSFASYSPLSARQIGFAVGPFEYVNLADFRESDQDEQLGQNAIPLHAFCLPGRGDEVRNTCFPMAKAIDFFSMTYGSYPFSSYKMCFVDDAPEDTLPTACFSICSSRLLFPEEIIDPMYDSTRAITHALAAQWIGVNIVPKEPADTWVTVGVAWYITDTFMRKLCGNNEYRFRLKLMSDRVCDLDYERPSVYDMGNILSIDPSEAKFIALKAPLVLFILDRRLTKASGKATMSRIISRLFLNARMGELPNGAVTSSVFQKTCERLGHAKLDTFFNQWIYGAGCPRFQATQRFNKKKLVVEMMIKQVQSDQPTARDLERDAFMRDVKEEIRNVYAGTIQPVFTGSMTIRIHDADGTPYEHIVEIKEGVTKFDIPYYTKYKRLKRNKRQKERAAAVIGADGNAEVQEDILLYCLGDVLQSEEEMQQWRLADWSKEDEERMGQESYEWIRMDADFEWICKLSLVMPGYMYLSQLQQDRDVVAQLEVSRHIPLSFSLLTLHXSLQYMAAQREHPLISTIFLRTLMDRRYFYGIRVAAARALVKHAKEEINWLGLFHLEKAFQELFCLPGSPMTRSNNFSDRAAYVLQLVIPEAISKVRDVSGKTPMRVKRFLYDKLKFNDNSNNEVSKSTLYVFMHILTLMKYSDNLNVATLMKSICHAMLERVESRTDDLNNFDMDAVLEALAEEQLEKDAIAEIDRYRRMDEWSSSFQSLYSRAALYCRMQLMQAKIAEVDVMQFLPYTRVGTYDLLRLDALECPRPAGHLQKPERKRWFIFTMSNDPSRWVR

SEQ ID NO: 12788 - protein, 326 aa, Aspergillus nidulans
  unsure (1)..(326): unsure at all Xaa locations
APALDKPSDDQFWTPEEPTKPNLQFLKQHFYREVALTEDQALWIIQAGTQILKSEPNLLEMDAPITVCGDVHGQYYDLMKLFEVGGDPAETRYLFLGDYVDRGYFSIEVSSLPLITRPVXPFQCVLYLWALKIWYPNTLWLLRGNHECRHLTDYFTFKLECKHKYSERIYEACIESFCALPLAAVMNKQFLCIHGGLSPELHTLEDIKSVCYAMLNTSTGSGXPAXIDRFREPPTHGLMCDILWADPLEDFGQEKTGDYFIHNSVRGCSYFFSYPAACAFLEKNNLLSVIRAHEAQDGYTACYVRRVKPGYRGIEFLILSLNFLEL

SEQ ID NO: 12789 - protein, 343 aa, Aspergillus nidulans
  unsure (1)..(343): unsure at all Xaa locations
LADQVAIITGAGQGIGAEAARLFANEGAKVVIADIDGGTHPSYSIPSQTNKENGQANDYVEKANAVANAINSASPNRAIAVVGDILNDKYITTLVEKAAEFGNGKIHIIVNNAGFTWDGVIHKVSTPLVLVACFTKRRTVADACLNGMVXITDKQWDTMIAVHNTAPFKLIRAAAKYFRVKDGEPRVIINISSTSGIHGNAXVPPPPPPSRPLKLVXLTLIMRSGQANYALAKAGVVGLTRTIAKEWGPQFGVRSNTIAFGFVQTRLTAAKEKGAFITTPDGTKVALGIPGQQLGAKEGAKDGKPAYPDIPLGRPASPEEAARSELAVASPLFSYVNGETIRV

SEQ ID NO: 12790 - protein, 992 aa, Aspergillus nidulans
KCLAPQRFCRARGNIFSHIVNHLVRARHKEVQLHPESSLGDTVLECYNCGTKNVFLLGFITAKSDTVVVLLCRQPCAAMPSSKDMNWDTSRWQPLIEDRSFLTWLVAAPSDQEQLRARHLSPQMIAKLEEMWKENSQATIADLEKATAVDDEPAPVLLRYDDAFQYQNIFGPLVKIEADYDRKLKESQSQDGLIVRWDLGLNNKHLASFILPKLELGDVKLAVGDEMRLKYTGELRPKWEGVGYVIKIPNNQSDEVTIELRAKGDHKSVPTECTHNFTADYVWKSTSFDRMQLAMKTFAVDEMSVSGYIFHRLLGHEVAAAPMKTQMPKKFSVPGLPELNGSQINAVKSVLQRPLSLIQGPPGTGKTVTSATIIYHLAKLNGGQVLVCAPSNVAVDQLCERIHRTGLKTVRVTAKSREDVESPVGFLSLHEQVRLNDSNIELIKLNQLKSELGELSSQDEKRLKQLTRAAEREILNNADVICCTCVGAGDPRLAKLKFRTVLIDESTQSAEPECMIPLVLGCKQVVLVGDHQQLGPVIMNKKAAKAGLNQSLFERLVILGCSPIRLNVQYRMHPCLSEFPSNMFYEGSLQNGITSFDRLRREVDFPWPILDSPMMFWSNLGNEEISASGTSYLNRTEAANVEKIVTRFFKAGVQPKDIGIITPYEGQRSYIVSSMQATGTFKKEHYKEIEVASVDAFQGREKDFIILSCVRSNDHQGIGFLSDPRRLNVALTRAKYGLVILGNPKVLSKHPLWNCLLQHFKERHTLVEGPLSNLQESLIQFSRPKQAYRGPQRFQMAYNHVSNVTSGFMNGRNGHRNEFHDTGSVVGYIPDDVSSVHSSALGGVGIPSGYPPMFQQFADSWPSLPGARRANGNRGKGAPSIAGDSVAATESDITGSIIDGKGPEQGGVSLAGLSINDMTKQPSLSQSDRLKRYVESGARDPYKPGAPDSGSIFGGSSASIRVTRGIPGHIHDDDDARSVSTAFASQVGGNYD

SEQ ID NO: 12791 - protein, 560 aa, Aspergillus nidulans
PSKTEIAPLRAAKYPFGNIVDALRHAAAHTDEGIIVYHPNSISTSSPPQTVSYKDLLHQAEANATRLLQQKLCSPKSIVLVHFESALDSIVWYWSVLLAGGIPALTGHGMFSQNPADRERHLRHLSETLNSPVCLTRPALLAPFEEQTADDRIKARTVDEILAAPEIADVADAPLPALTPSSTDMLALMLTSGSSGNAKAVPLTHQQLLAAFRGKSTAASLRFPRSPFLSWVHMDHVANLVHCHIFAIVSGISQIQVPAPDLLINPAQLLNLISRHRVSRTFMPNFLCAKLRRQLESGSPEYILDPGLNLETLYIDTGGEANVTEVCIALQSLLSRYGAPDNVFKPSFGMTETVAGCIFNSHCPSYDHAQRHEFACLGKPMPGVRMRVTRLDTPSEEAAPGERGSLEVTGEVVFKGYYNNPAATAEAFTSDGWFRTGDLAFIDSNGNLHLDGRTKEMININGVKYLPYELDAALEQAQIPGATPSYFCTFSSRDATMDTEVVVVLYLPSYVESDDEARFSTQSSIIRVVAMHTRSRPRVVPLRPQDMPKSTLGKLSRAKL

SEQ ID NO: 12792 - protein, 476 aa, Aspergillus nidulans
  unsure (1)..(476): unsure at all Xaa locations
EEDFWTRNGLNFKSFQRRPAHVVELNRSMKTRHMHMIAIGGSIGMLYAXGPKAALTVAGAGFFVGSGGALSTGGPASLLLDFSIIGIMIFNVVGLSLEYSSCWCADRSVYALGELAVMYPISGGFYTYSTRFIDPSWGFAMGWNYVFQWAIIVPLELTVAGLTIDYWQVDVSVAVWITVFLIAIIIVNIFGALGYAEEEFLSSCLKLGAIIVFMIIALVLVCGGGPSDGMYNEYWGARLWYDPGAFRNGFKGFCSVFVTAAFSFSGTELVGLAAAESKDPTKSCRGAIKQVFWRSPCMSPLLQAPAMTRHIXQYSSSFYIVGLFFVGLLVRSDNERLLGSGLIDTRRRPLVILAYDAGLKGYDHFMNVIILISVLSIGVSGVYGSSRTLTALAEQGTLPSFFAYVDRSGRPLWSVLITILFGVLGYVNVSSSGEEVFAWLQALSGLAALFTWGSICLAHIRFRRAWAYNGRSLDEI

SEQ ID NO: 12793 - protein, 478 aa, Aspergillus nidulans
  unsure (1)..(478): unsure at all Xaa locations
EHLMTVRPALRAYPXAVIWSLTIPMSIIMKGYDTALIGSFYAHPEFKVSFGKEYAHGHEVPGGWQSALGAGGNADCIIGAFLNGYLVNRYGIKKVFIGGLLFMCGFIFVSFLGKSVRAQVAGQVLCGKLHVLPNFKNDYANHGTVSIPWGIFATIGPAYSSEPFPMALRPYLTAYTNMCLAIGQFILMGVMQTLVNRPDEWSYRIPYAVPWIWPALLCVIAISMPESPWWQVRHMXRQKRQSRNXWQRARNTMRARLSPNLWRTEIACVIFAGQALSGSQFAYSRTYLFEQAGMSANYSYKLALGGAAIAFIGTVLSWFLMKGFGRRSMYLGGVAMMCVYLFNIGILDLVREMAGVKWAQSSLCIIWLFTYFLSVGPLGWSIAPEVSSTRLRSKTIVLAQNTYYIAIVVANVIEPYFINPTAWNWLGKTDFFWFGTGLATLIWGFFRLTETKGRTFEELDIMFAAKVLTRRFKAYHVD

SEQ ID NO: 12794 - protein, 153 aa, Aspergillus nidulans
  unsure (1)..(153): unsure at all Xaa locations
RXLTREYQNIQKNPPPFIIAHPSESNILEXVKPTGEEKRTNGLXYXWHYILTGPPGTPYENGQYWGTLMFPPEYPFAPPAIRMHTPSGRFQPSSRLCLSISDFHPKSFNPAWEVSTILIGLLSFMTSEEMTTGSVSATEAERRVLAARSRWWN

SEQ ID NO: 12795 - protein, 690 aa, Aspergillus nidulans
  unsure (1)..(690): unsure at all Xaa locations
PQNNQTTPXEKNGPRPQNSLTKETTTKSFNISIGGEWDQDEREQNLESLFETFVSRISQQGQESSGLKDALEVYKSRGGDHEVGREXCSHGLITVGELEEAKSEQTEQNIRLKVELDVSKSRLAEAEDALKNAQRDHEIAIDELMSRQRAECESVRYESQKSLDALKAQHESELKELRRQFERELEDEKCARVRELNQLHSKTALDAQLSQIELDKTIKELAATREDLQSLRTELDRERKNTNNLRQNLDTAASNSVTLESTISALKARIEFLESGREEQSEAFERLNQQMMDAMAETNAAKEKLRREETLRRKLHNQVQELKGNIRVFCRVRPTLENEGASDAAQFTYPDEGEDSKEINIIGPEEKSSFGTVTRKNHNFSFDHVFGPSAQNSDVFDEISQLVQSALDGYNVCIFCYGQTGSGKTHTMSSLDGMIPRAVHQIYETATSLEEKGWRYTMEGNFVEVYNENLNDLLGKAEELDKKKLEIRHDMQRGKTTITDATTVQLESPEMVESLLKRAAANRSVAATKANERSSRSHSIFILKLIGENYITGERSEGTLNLVDLAGSERLSHSGATGDRLKETQNINRSLSCLGDVIAALGQGKKDGHIPYRNSKVRSFVQTTVVHSNITIVDYLLQFSLGGNSKTLMFVMVSPLQAHLSETLTSLKFATKVHNTHIGTAKKQTRVRDV

SEQ ID NO: 12796 - protein, 254 aa, Aspergillus nidulans
  unsure (1)..(254): unsure at all Xaa locations
SSSVEPSXCFNSPGGSVLLTQFWDYDPSAGPADSWTLHGLWCAYXIHPLISLQPRXXWCFATGPDNCDGTYEELYDSSREYSNITDIIKEFGRSDLLSYMNEYWMDYSGDDESFWEHEWNKHGTYFASLSIXKKKKKNFVLICNRNLINTIEPTCYTDYTPQEEVVDYLQKAVDLFKTLDTYKALAAANITPSSSATYTLDEIHSALSDIHDGFAPYVGCDGDNLNEAWYFYYVRGNLITGDFDPAEKRXLPXC

SEQ ID NO: 12797 - protein, 452 aa, Aspergillus nidulans
  unsure (1)..(452): unsure at all Xaa locations
RPLREAQDXSYYRLKRPLTYAEKVLYNHLDDEFDGNIVRGQTQLRSKPVRIACQDATAQMALIQFVSAGLDTAAVPTTVHCDHLIVSREGEESDLSRALETHREVYDFMKSACQKYKMGVWRPGVGIIHPENYAYPAGMMVETDSHTPNAGGMGMITIGVGGADAVDVMAGLPLETAPRILGVRLHGELSRWASPKDISTELAGIISVKGSTGSIIEYFGLGAQTISATGMATVCNMGAESGATTSIFPYTASMAEYLRANRRPDMAAAVETIAYELRSDEGAEYDQIIDIDLSSLEPHIDGPFTPDLSTPISKFGSAVIDNEWPSTLTAGLIGSCTNSSFHDLSRAASLAQXALDAGMKPTTQLLLSPGSLQTLNTLEEAGIMQVFEKAGAIMLPNACGPCCGSWDRTDIQKVSLHVESQSVFWHXQAQGTKNSIITSYSRNFSGLHYWQP

SEQ ID NO: 12798 - protein, 627 aa, Aspergillus nidulans
YSNVSVYEMEVNGVAVMKRRSDGWLNATQILKVAGVVKARRTKTLEKEIAAGEHEKVQGGYGKYQGTWVNYQRGVELCREYHVEELLRPLLEYDMNPNGTAASGQDSLDTPTKEQAMAAQRKRLYSGMENRSMSQPQQGTFFQNISRTAATAVNAMSKARFESPAARGGDSRRLSVIRKPSQQMGSQDAQPPFGSQQSFYSAASDSGFASNIPTNGRYAPQDAMSFEQEEPMEPPRKRIRSSQAFSLPIDGTSMSMSEPTPTEPNDSFYQDMEPLHHIDEGRHGLDPLPPATTPERFQKMKLIMTLFLDKTTKDFSTHPALIQLSGEDLEVPLDEYRNNALHWAAMLARMPLVYALVKKGVNIARLNGAGETALQKAVGTRNNLDYRSFPRLLQVLAPTIDMVDRSGRTILHHIAVMAATGHGGHVSAKHYLEALLEFIVRHGGTSLNQQSNGTASQPGMPLSNEVITLGRFISEIVNLRDDQGDTALNLAGRARSVLVPQLLKVGADPHIPNHSGLRPADYGVGVDMVDGSSQPAGGRSNTFLAQLAKTRKEILEGMRNVIPLKPPTDFVPATTAQVTAIVQETLGTFDKELAASLTSKQEKFDHWHAKIPESAKARQIEQKQLDE

SEQ ID NO: 12799 - protein, 959 aa, Aspergillus nidulans
  unsure (1)..(959): unsure at all Xaa locations
DKLKRFCTFSASIYDCAWLSMINRRENEQILWLFPQCFDYVLSQQLKDGAWPSPASTVDGILNTSAALLCLLDRRRLTQDSRLSSRINAAASSLQRLLEAWDLDGTDQVGFEVIVPGLLRQISHFGITFKFSCQCRLEALRAAKLEKLRPDMLYSGYQATILHSAEALIETIDMDRITQHCTEDTGILGSPAATSAYLKHASGWDGRAESYLRKLLASADREQGGIPSGFPTAIYELSWVRLLASSLYDQXSPNXLFGQALSTVFLAVGPTTPCDIVLLSPVKEYLHETLAKNGVAGFAPGILAGADDTARVLLTLELLGTEVLTIYPLMKHCRKGIFCTTYEHERNPSFSANCNVLLALDESSHALQHIDTIEEVAAYLIECWKAGSIKDRWNSSPRYSNMLLVLALTRLFLRYDKGDFHGPLQVSLSRDIIICLSQILSRTLIEQHPDGSWDSSLEVTAYSVLTISRMMLLPYVDKLKIDHIAPALRRGCGYLIDHQHDPVQPRREDYVWIEKVSYVSSFLRKVYTVAAIHASRKQSPCSERLVSLFQPLPTTHELKVLLLATPLCKESPVPFMDLALLEAHYWSQLLREKSSMIFKSPISSDGQKLFHLIPLIFTSCNQRAGLVLSTNTLWNMIHFSLLVYQVDALMESTAIRMSDAELDEVLLRLDRSCSLARTAFQLPQRVSNGSSAQTAGVQPDDLKTIPLNKSRVENLMHLLLPFINHVLGHPQVLQAPVEIQRELADELYRFLLAHVEHIRANLTRTRINTLSASSGHQLRQLTYYRWVHSIGSADTSCPLAAVFFLCLISKHGSFCFQHPKAQYLSRTVAHHLSVICRQYNDYGSAVRDHEEGNLNSLDFSRFSTRGTGKWCSIXAQDVKQCLPFRLRYAAVPTSCMHVAECKRXPYGSRXVXAELYGASPAATGRCRMYTXRAQAIXGVVDVTDLFGHVYILKDLTGKV

SEQ ID NO: 12800 - protein, 595 aa, Aspergillus nidulans
RGQSLDPPSKIDELLPLYVELLTKLKEAGVEDVQIDEPVLVFDLPLKSKNAFKPAYEKLGSLGAQAPRLVLATYFGDIVHNIDVLPALHNIYGIHIDLVRNPEQLDSVIGALGPKQVLSAGVVDGRNIWKTNFKAAIEKVELAIQKLGKDRVIVSTSSSLLHVPHTLASEKNLDPEVQDWFSFAVEKTSEVVVIAKAVTEGPAAVREQLEANAKSVQARASSKRTNDPKVKERQAAVTPEQHNRKSPFPVRIAEQTKSIKLPLFPTTTIGSFPQTKEIRIQRNKFTKGEITAEEYEKFIEKEIAEVVKIQEELGLDVLVHGEPERNDMVQYFGERLTGYVFTTHAWVQSYGSRCVRPPIIVGDISRPAPMTVKESKYAVSISSKPMKGMLTGPITCLRWSFPRDDVHQSVQAQQLALALRDEVVDLEAAGVKVIQVDEPALREGLPLRAGKEREDYLQWAVAAFRLSTSGVSDGTQIHSHFCYSEFQDFFHAIAALDADVLSIENSKSDAKLLKVFIDEAYPRHIGPGVYDIHSPRVPSEQEIKDRVEEMLAYLRPEQLWINPDCGLKTRQWPETKAALSNLVQAAKYFREKYAK

SEQ ID NO: 12801 - protein, 1078 aa, Aspergillus nidulans
EREVALYNRINARKAELAALPANIAAWNSGQSDVATGDDSLKLKALIEYRMLNLLPKQRLLRKQIQHEMFHYDNLGMTANRATHRRMKKQSLRERRITEKLEKQQRDARESREKRKQDVHLQAIVNHGAELRETASQQRQRAGKLGRMMLQHHQHMEREEQRRVERTAKQRLQALKANDEETYLKLLGQAKDSRISHLLNQTDGFLKQLAASVRQQQRNQAERYGEDTISMMMMTKTSHPASDEEGEGRRKIDYYAVAHRIKEEITEQPSILVGGTLKEYQMKGLQWMISLYNNNLNGILADEMGLGKTIQTISLITHIIERKRNNGPFLVIVPLSTLTNWNLEFEKWAPSVSRIVYKGPPNARKQQQQNIRWGNFQVLLTTYEYIIKDRPILSKIKWTHMIVDEGHRMKNTQSKLSSTLSQYYTSRYRLILTGTPLQNNLPELWALLNFVLPNIFKSVKSFDEWFNTPFANTGGQDRMDLTEEEQLLVIRRLHKVLRPFLLRRLKKDVEKDLPDKQERVIKCRFSALQAKLNKQLATHNKMVVSDGKGGKVGMRGLSNMLMQLRKLCNHPFVFEQVEDQVNPGRGTNDLIWRTAGKFELLDRILPKFKATGHRVLMFFQMTQIMNIMEDFLRLRGMKYLRLDGSTKSDDRSDLLKLFNAPDSEYFCFLLSTRAGGLGLNLQTADTVIIFDSDWNPHQDLQAQDRAHRIGQKNEVRILRLITSNSVEEKILERAQFKLDIHRKVIQAGKFDNKSTNEERDALLRTLLETAEATDQAGDQDEMDDDDLNNIMARSDEELAVFQRMDRERQKTCPYGPGHKLPRLMGESELPEIYVTEENPVAEEAAEIELSGHGARERKITRYDDGLTEEQWLMAVDADDDTIEDAIARKEARVEKRRSNKEKRGRKAQGDESSPEPSRETSETPQPKKRGRRGPAPKRKAEELAEETPQPKRKRGRQAKPVETLSPDDRAALQQILNNVYQALMDMEQELPADSSDSEDGPVTRSIIEPFMKPPPKSQYPDYYMIIQNPIAMDMIKKKINREEYQSLRDFRNDIGLLCQNARTYNEDGSILFQDANDI

SEQ ID NO: 12802 - protein, 764 aa, Aspergillus nidulans
  unsure (1)..(764): unsure at all Xaa locations
SVLSVLLVSVAQAAAAPWRPREPRAAGSKRLTFNETVISAALSPSSISVQWIATENDGGLCVPGGGWKHQDXEHCHQPIADNRSAEKIPADAYSYWISPDLSAVLWATNYTKQYRHSFFADYYIQDVETLETVPLVEDMVGDIQYAEWSPSGDSIAFVRGNNLWTWSDGTVTAITKDGGPDMFHGVPDWIYEEEILGDRFALWFSPDSELLAFLTFNETGVPTFTVQYFMDNQEIAPPYPRELDIRYPKVSETNPTVKLNILQLSDNTVSTIPIDVFDPSELIVGEVAWVTDTHTELAVKAFNRVQDESKVVIVETASGETKIAHERDGTDGWLDNLLSISYVGPLALGSGDASSAYYVDLSDHSGWTHLYLFSTSGGDPIPLTEGEWEVTSIVSIDQERELFYYLSTQHHSTERHLYSVSYRTFEITPLVDDTVEAYWSVSFSAKAGYYILTYAGPSVPYQELYSVNQTAPLRTLTSNAALIEKLEEYALPNISYFELEIPSGEKLNVMQRLPVGFSPDKKYPVLFTPYGGPGAQEVSKRWQSLDFNAYIASDPELEYVTWTVDNRGTGYRGREFRSLVAKQLGKLEAEDQVYAAKQAAKLDWVDSEHIAIWGWSYGGYLTGKVLETDSGAFSLGLLTAPVSDWRLYDSMYTERYMKTLSTNAEGYNTTAIRHTDGFKNVEGGFLIQHGTGDDNVHFQNAAALGDTLIGNGVTPEKMQVQWFTDSDHSIRYNGGNVFLYRQLAQRLYKEKNRAKKEQHQWSKR

SEQ ID NO: 12803 - protein, 652 aa, Aspergillus nidulans
  unsure (1)..(652): unsure at all Xaa locations
PFLVGKPLSLAITATAGSGFLLXVXPFVKASPLTAQFGYDQGVMSGLLTGDAFVRVFPEIDTTVGGHGNSSLQGTVYVLLHMVCXIEGHDXPXRQGCNLXDCSYGIQASAHTDSRQGCFFGAIMSLLVGERLGRRWCIMAGSVILSIGAVLQATSYGIPQMIVGRIVAGVGNGLNTSTIRRFIQRXREHWALRCXRRQPCWHSELSKASSRGKGVRSFAGCLLMDDADSRSLQSSWSINIFGVMTAYWVGAXGHLLSSARLLAAHLIYXLIPDYGMSYVNNESQFRFPLALQILFAIVTFLGVLVLPESPRWVSSHRPSMHQQRXRASSSPHDRHADARQVLWSVQPNARFINQDDPVINMEMAEITQTMAEERQAAAEGSFKRLLTDGPQRFRHRTLLAMGGQMMQQLSGVNLITYYNTVIFEQSVGMTHNLALLLAGFNGVAYFLSAFVPVWTIDRYLSNPASSCSAYPVTLKADQYRLGRRKLMLFAAAGQCACMAILAGTVYDGGFSAGIVATVMLFLFNFFFGVGMLAVPWLRMLLFYSSRSLIKTDCFSIVPAEYAPLAIRTRTAALATATNCTIRLIARSRSFSRLILIGIFTFLVVEITPVSISSIGYRTYIYFAVFNFCFLPIIYFLYPETRNLTLEQIDRLF

SEQ ID NO: 12804 - protein, 789 aa, Aspergillus nidulans
  unsure (1)..(789): unsure at all Xaa locations
KSVPXNSCCSRWGFCGTTEEFCEETDDEESSCQSNCGQPERDTCDSRWETRRIAYYETWADTRECDAFRPEDIPVKALTHLNIAFAGIEDSEITIDSSEMISRIVKLKRRNRSLKVFIAVGGWAFSDPGYSHXPPXKSTEKLMVAGPTRTAWSDMASTSDNRQKFINSLMDLFETHGLDGVDLDWEYPVAGKYXGXVYSLKGLSNEIFRXRGGKDEDYENYVSLVREMNEAFQKRNPSWDISMAIPASYWYLQHFDVSAMEKEVSWFNLMRXVLPFLYHPKNADFTLQLDMRGKWDQFNEWTGPYVFGHTNVTEIEIGVDLLRRNNINLYKVSLGMGFYGRTFTLSDPGCSEPGCEFSDAGLRGECSGESGILTFKGTLAFKXSRLSANLLIXKSWPAKSGXTKRXSSTDEDSGVKYMVYDENQWITYDDEESFEKKREMLDNECFGGVMIWAIDQDTNDFQALTGLLGDWVTDELLEGGELSDEEKEDLVDEMGGLTGDGCYVTSGCVGGEPTIEGNPECRKGDVVVALVHSPTESYQELYGALSHTADTCGLGQYKRVCCPADSPAVNCQTVGAPEGDSTKCTGGEAELTCGNGRYELITDRYVDAVGQKKCSSGAISVCCDAAPELQKCHWSPCTVFHTCSDGYAQPIATRGDFCEEGEAQNFCCELDGKATPGNRKXVGKLKSTAALKNCDWVPEVESYEQDGDITLINMPTMSECSKRGCPSTQFTAAKAKLPNRRAGTWAPCDYYFPGIRHRLCCDPKPDRDLPFDLGKIFPNPIEEDVIYRY

SEQ ID NO: 12805 - protein, 370 aa, Aspergillus nidulans
  unsure (1)..(370): unsure at all Xaa locations
FAVGVGRRLQIWHTPETPTVGGDGEIDFAPFVLHRDLAGHFDEVQHIEWSSDSRFLLTASKDLTARVWSLDPEDGFEPTTLSGHRQGVRAAFFSADQESVSDPINNVALLFXYNLIYTVSRDCALFRWEYVSKKDPDTMEDVAEPRWRIVKKDFFQQPHATVKCAAFHAASNLLVVGFSNGLFGLYELPEFNTIHLLRXVAYALRTGIDAKRISSISQSNIDVVSINKTGEWLAFGSSKFGQLLVWEWQSESYILKQQGHLDSMNALAYSPDGQRIVTAADDGKIKVWDVKSGFCLVTFTEHTSGVTACQFSKKGNVLFTSSLDGSVRAWDLIRYRNFRRFTAPSRLSFSSLAVDPAEEVICAGSQIRSD

SEQ ID NO: 12806 - protein, 508 aa, Aspergillus nidulans
  unsure (1)..(508): unsure at all Xaa locations
KTVAWCFALASGIILYGYDLAIVGSVSSMPEFQCVRSNVYSIANDPPILTSSRKDFGRRLDGKLIIPALWLALWNIANPIGGVLGSIAGGYIQDRVGRRGSLTIASVVSAIGVAVAYISDLPSEINGRRSIIFVAKLVQGFAVNQVMCTTQTYMSEVLPPILRGPILGLFPTFILMGQLIGSIIIYAMAARRGPEGYKLCFVSEWPFSVLPFVVSFLMPESPTYLIRENRLDEARRCQEQLSYSTEEADMVFQQCRFSIELEKKAKGSVPGYSDCFKGTNRRRTMVVLFACLLPQLFGISLLARGSYFMQVVGMNAHTSLIFLQVGVGLGLVANVGSMITVAKFGRRPLTLFGLIACTILWMGMGIAGCFPGTATVWYVASPXIKSGPSENADSTGXSSKPIRYTQMTILFVVTLTGLTIWPASYAFGAEASSLQLRAKTQGLGWLVNCLSNGILGIVLPYIFNDDEGALGAKTGFVYMGFCILSLAAAWRIVPEMKDKTAMEIDQVF

SEQ ID NO: 12807 - protein, 259 aa, Aspergillus nidulans
  unsure (1)..(259): unsure at all Xaa locations
QVAIVTGAGSGFGYGSAKKFAEEGAEVIAADISEKNGQAVAAELGSKFIYTDVTRRDDWQALLQATLDEYKTLDIVVNNAGATYSNKPTLEVTDADFDLCVNVNAKGSIYLSTSGIVPYFVEHNRPGCFIQVSSTAGLRPRPGLTWYNASTAAGSNATKALGCXVWAPEIRFLCVCPVVGSSGMXVTSFPQFLRSFLYQVXHPSXDTSLPGKPDTEENRAAFVSTIPLGRPSTPADVANTCSFLASDEAGFITGVELEV

SEQ ID NO: 12808 - protein, 243 aa, Aspergillus nidulans
SPQGRIFQVEYAQEAVKQGSVVVGLVNKTHAVLVGLKVRNPINSSNHPHGRNEPLLTSECVFRRNAEELSSYQKKIIEVDSHMGVAIAGLASDARVLSNYMKQQCLGSRMTYGRPMPVNRIVSQIADRAQTNTQQYGKRPYGVGLLVAGVDEAGPHLFEFQPSGMTQEMLACAIGARSQMARTYLERNLDKLQESSRDELITHGLRALKETLSQDKELTVDNTSVGVVGLADTGKVESFKLYE

SEQ ID NO: 12809 - protein, 611 aa, Aspergillus nidulans
  unsure (1)..(611): unsure at all Xaa locations
FRFVHLVIIFLPVILTAPTIWLGRRIKNNDGARTGTLWWYSFLVRAMERAGPAFIKVNTFDYIIQNLLTSXLGQWAASRTDIFPPEMCEIMSSLHSNAPGHSLHETKRIIEKAFSGMPFEDIFEEFNEEPLGVGAIAQVYKAKLKPNLANLADNQLTCEPQNLRGKLRKNVDALVKSTPRRVPSSYVAVKVLHPRVERLIRRDLRIMSFFASLLNAVPTMHWLSFPDEVAQFGEMMKLQLDLRIEATNLKIFREKFRSRTTAWFPYPYLDYSTREVLIEEFAQGIPLSTFLEKGGGVYQHEIANEGLDAFLHMLLIDNFVHADLHPGNIMVRFYQPSELDLSLRKKGRADEAPTLKEVDVADAILARLLPHADDSQKWERALEELNAEGYRPQLLFIDTGLVTQLNDTNRANFLALFRAVAEFDGHRPGELMVERCRQPEEVIDPDIFALRMQNLVLGVKSRTFALGNIKIGDILSEVLSMVRRHHVRLEGDFVNVVISILLLEGIGRSMDPDLDLFKRLAPIFPALLLEIIELPPAQNPLFWXSAELTHFSSALPILRKLGSNATFLKTIRSGDTSMLRVWVGLEARGLLRASIESVENCVKYDLLSPNV

SEQ ID NO: 12810 - protein, 561 aa, Aspergillus nidulans
  unsure (1)..(561): unsure at all Xaa locations
RLIQEQERQLSLWATVKLHPRAVLACTFQSVILXGQSXIYPGSVAFAAGAMFGYDQISNGSTIAMPAFMMYYGDHNESGLYLPSIWTSLWTSMTSLLQAVGAICVGMISDRFGRKWPGVMAGILSIVGTVVLYYAKSRGALLAGKMVCGLALGAGMAIGTTYASEVSSAAVETLGFXKWCXXYQVAPLKLRVPIQTILVVFIVFMQGLAMGIVRIFVPNTDEQAFRNVFAIQWAVGGIFAVTCLFAPEYVCLNSQNAXYLLSXSPVYLINSGRVDAAEKVMKKLYSSKFSIDDRLAYLVKTISEEQEQQRISAGSYLDCLRGSNLKRTLTVMFLYSTANLGGAAFLSQSIYFLLTLGLPSVHIFDISIGGFALAIIVILLTGFIGKFLSWRRMLLMGCLINLAFLGVIGCLYYACGMGPSWAIAVLMYVHPSLQLYGYXQSDNRNILISIQTSLMQADGWPIAAEIYSNRLRVKSLSIGVLAQTLSTWVMTFTVPYMYNVDSGDLGARTAFPFAGITVLLVIGAYFLDPDTTGLSTEEIDRLYEDKVSPRRFSSFVTHDVP

SEQ ID NO: 12811 - protein, 269 aa, Aspergillus nidulans
  unsure (1)..(269): unsure at all Xaa locations
GRVNERPHFKLTEKTPVVAILDGDNGFGFVVATRGMAEAIKRAEIYGIGMVSVNHSNHFGMAATYVLQALQANMISLVFTSSAKQMPPFGGKETPLGIAPFAAGAPSNREVPYILDIAPSVVAKGKIRRAAGRGESIPLGWALDANGNPTTDANVASTGSMALIGGPKGXGSGIAILMDIMSSVLTVAGFGGQVGDRYKDAKPQDAGHCFIAIKPDVCFSVDDLKARMDTLVQRVHGVIPAPGFSEVLFPGEPEQRLCLQRRREGIPYA

SEQ ID NO: 12812 - protein, 363 aa, Aspergillus nidulans
MPPTIRVIGSLNADMVSVTPRFPDAGETITSSSYFTSAGGKGANQAVACGRLSRSQPQSSSFSTSINTGDVNVEMVGAVGGLDGHFSALLKPTLEKSGVDTSRVKVVEDAYTGVAVIIVDSSAGGENRILFSPGANYSGMQADPSVVGMALAEPAPDVIVMQGEIPTETTVAILREIARWKEQQRADGKRGIDAGPDVMFNPAPAPPGGLPEDVYKGVDHLIMNETEAELMTPDEDVLLRVPGIESAQDGKEKVARYFHSLGVRYVIVTLGAKGVWYSAADPDTLGDRVVNEVPAAKVSRVLDTTAAGDTFVGAYAVQAARGVREGAGKERLGRTLTLRRRSIGTKMSWMRRWVWPRGLRQEA

SEQ ID NO: 12813 - protein, 855 aa, Aspergillus nidulans
  unsure (1)..(855): unsure at all Xaa locations
YLFWRSCYNAGIGWLLHNQSHHKTLVRWAEKSQIFVNPATGKNPYPQLYHLIKRDXEIKISKDYSFEEAPLEYNTWLVFRRLVDLILMCDFASYCLFAIACSRHPANESVLMTVIRWTSGIALVLFNLWVKLDAHRVVKDYAWYWGDFFYLIDQELTFDGVFEMAPHPMYSVGYAGYYGISLMAASYKVLFISIIAHAAQFAFLVLVENPHIDKTYNPPPPRKRTITEHDAASQRSQSPDTPNAPSVSEENVPNATTFSSPPPAVHNLLGFHNLDLHRITDTSSILVQFLMFSLTVLTPSTPWYQFLFVANAAIWRLWYSVGIGYLLNRQSNCKSWTRHFVKYGETPHEAWNQWKGTYHLSMVMCYASFISAVWKMYTLPSNWGYGLAILRHVLGAGLISLQIWTSVSIYESLGEFGWFYGDFFFDESPKLTYNGIYRFLNNPERVLGLAGVWGAVLITASGTVAFLAFLSHILSLGFIQFVERPHMQKLYGRSLRQDAGLVKSLKRSLPPSLRQLHGSVDKIFDESYEFIEEIIDTARPKLAAVNTFVRDTTALFQKYPARVTISRIDADLAGYDLRDYSLTVEASQLPLDEGDLSKEGDNARTPLDRRGDLENLVFPYGTPVKVKWTAPLNHSKKDWIGLYKVTDNTSREVTRVSSQGRWVAVNEGFYDNLTCERGILISDVVVSTSQGDNGEKHDIATGEVVFSGDKLFWTQGVFEFRYHHNGKHNVMAISRPFEVRIPRFEEEDHFDMSQTAVETSLLPVIQNCFDRDPEIAPETPEEQYGSLVERDGKFAKRVVFAVHQMCVPSSSRILNDTNMLNPRFGVEFAPEVVRSDGNVRNLAWRICNAKRVLVS

SEQ ID NO: 12814 - protein, 265 aa, Aspergillus nidulans
PRTTVGWKGLINDPDIDESYQINKGLRVSRKLYADLTGMGMPIASEMLDTISPQYMADLISLGAIGARTTESQLHRELASGLSFPIGYKNGTDGNLTVAIDAIGAAAHPHRFLGVTKQGLAAITKTAGNPHGFVIMRGGNKGTNYDRESIQGAREALRGKKQREVLMVDCSHGNSKKNHRNQPLVAKEVADQLREGQDAIIGVMIESNINEGNQKVPPEGPSGLKKGVSITDACIDWETTVTVLEDLADAVRARRAVKSKANGTA

SEQ ID NO: 12815 - protein, 348 aa, Aspergillus nidulans
  unsure (1)..(348): unsure at all Xaa locations
VNLNQFRLLRVVGKGAFGKVRIVEKKDTGLTFALKYIRKEEGAYFSRRIFFILFIIADRLFSLAVVRSESVRNIIRERRMLEHLNHPFLCNLRYSFQDIEYMCVFTSGDIRTVADFTSYIVVDLMNGGDLRFHISRKCFTEEAVRFWLAELGCALRYIHSQGIIHRDVKPDNVLLDSEGHVHLADFVSSPHDVXIWTGSDSRQNVASDFRPGKPLTSKSGTLAYLAPEVYEGGGYFFEVDWWSLGVTFYECIYNKRPFEGRSQDTLSENIKKGPTEVLRYQRRRIHSGLRAMSALMEKDRSKRIGAVSFESFTSHQFFADIDFEALERKEVPPVFRPSSDKTNFDATY

SEQ ID NO: 12816 - protein, 384 aa, Aspergillus nidulans
DLRVGNKYRIGRKIGSGSFGDIYLGAFVSGWSDVRILLTCVKGTNIISGEEIAIKLESVKAKHPQLEYEARVYKSLAGGVGIPFVRWFGTECDYNAMVIDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGTLPWQGLKAATKKQKYDRIMEKKMTTPTEVLCRGFPNEFSIYLNYTRSLRFDDKPDYSYLRKIFRDLFVRESFQYDYVFDWTVYKYQKNAAMMSDAKKDKEAEEQARRQGATMPLTTSGAAKPGAISSQRRKIMERGALDNTPDPTVLWEGATGCEYL

SEQ ID NO: 12817 - protein, 297 aa, Aspergillus nidulans
  unsure (1)..(297): unsure at all Xaa locations
EDPGEPSETTPASSDIETHTKTRPGLHLNTKPDEELMKPPVLGKLQDPAGGYKTNPPPVGRPVRVYADGVFDLFHVGCVYSLAFXLGISRLHWYMLIRFRQHMRQLEQAKKAFPDVYLIVGVTGDKETHERKGLTVLSGAERAESVRHCKWVDEVFPNCPWIVTPEFMEEHKIDYVAHDDLPYGAAEGDDIYAPIKAQGKFLVTQRTEGVSTTGVITRFVCLRPPVISVLTFVEIVRDYDRYISRQFKRGASRQELNVSWLKKNELEIKRHVSELRDSIMTNWTNTGQELSRELRQL

SEQ ID NO: 12818 - protein, 385 aa, Aspergillus nidulans
KFEGWMGLDKNAADGNMVWQEFEPKEWEETDVDIKITHCGICGSDLHTLRSGWVSGLKFDYQGGISKGGYRRMQTGEQYIKESITNLFTQRPALYPCCVGHEIVGTAVRVGSKAVGGIKLGDRVGVGAQSDACVGRFGDCPECAMGWENYCSHKFVSTYNSVHFNGGKSYGGYALYNRCPSHFVVKIPDAVPSAEAAPMLCGGVTLYSPLKHNNCGPGKRVGIIGVGGLGHFGVLFAKALGADKVVAISRKNGKSEDALKMGADQYIATDDEPDWATKYARSLDLIVCTVSSTKVCTYQIDASSCAETLTLNKMPLAEYVGLLATNGSFVQVGLPEDGVLNAPVANLRRRLKMESSLVGSPNEIREMFALVAEKGIKPWIETVPM

SEQ ID NO: 12819 - protein, 275 aa, Aspergillus nidulans
SQTIGVEFSSRIVKLGTGPRRTRIKLQLWDTAGTERFRSVSRSYYRGAAGAILIYDVASYASFNSLPTFMMDARALTSPYLTVILAGNKTDLTQDDYHEDGMRRPITPSSTSSPQSSLPYDSTAGSFRSSNFGTATRMTATYASHGREVSMEEASQWAARSNIPAVVEVSALTGDGVEELFQRLARIILTKIELGEIDPDDPQSGIQYGDGSPYGHGTSDASSIKSQMTIEDNAVQLHRRNTRRRGGSNWRASMNEWEDVFRVSGSHNRKSSGCC

SEQ ID NO: 12820 - protein, 685 aa, Aspergillus nidulans
KPVPDDPNEVEIVNANFSLAYGGMLLLSHTNLRLLKGHRYGLCGRNGAGKSTLMRSIANDKLEGFPPPDQVRTCFVEHNQGEDADLTIFEYVKKDPKIAAEGDEHIRNVLLEFGFTDGPEGRQSQAVGSLSGGWKMKLALARAMLLKADVLLLDEPTNHLDVANVKWLQEYLKKHTEITSLIVSHDSGFLDEVCTDIYHYEQKKLVCYKGHLAEYVNLYVTLHHQLLTIDCAVFVKVKPEAKSYYTLSASNIQFKFPPPGILSGIKSNTRSILRMTDCSYTYPGASKPSLTGASLSLTLSSRVAIIGGNGAGKSTFIKMLTGETIPQTGKVEKHPNLRIGYIKQHALEHVEMHLEKTPSQYLQWRYANGDDREVFLKQTRILTEEDKAQLEKPVDLGDGAGPRRIEALIGRQKWKKSFQYEVYVPQSIPFSSPYLCILTHSGNGVGLLPKHNTMISRETLLELGFFKMVQEFDDHEASREGLGFRVLEPKTIAKHFENVGLDPEIANHNEISGLSGGQKVKVVLAGAMWNNPHLLVLDEPTNFLDRDSLGGLAVAIRDFKGGVVMISHNEEFVGALCPEQIHIADGKIVARTNTAISLDRFEDSASSTPQPGSTAASSVANSAAASAVNSGAEDQGELKFKARKKKKMTRAQLKEREARRRLRHIEWLNSPKGTPKPPDTDDEAE

SEQ ID NO: 12821 - protein, 229 aa, Aspergillus nidulans
  unsure (1)..(229): unsure at all Xaa locations
YMSWLGKNLIGHPCSPTYRRSPSDWSGHMSQANVAQVAPKGIDNARYVYKYAYGLCKAPKVQLVCKRVLNFMYVPGHLSHMLFKTLKNSPRAVVERHGADKKLSPVTKVIIAEGKEDITIKVSDEGGGIPRSAIPLVWTYMYTTVEQTPNLDPDFDKSDFKAPMAGFGYGLPISRLYARYFGGDLKLISMEGYVLLNDCYMALQLTXSRYGTDVYLHLNRLSSSSEPLQ

SEQ ID NO: 12822 - protein, 860 aa, Aspergillus nidulans
  unsure (1)..(860): unsure at all Xaa locations
GILERVECYNLMCHDHFQVELGPLINFIVGKNGSGKSAVLTAITLCLGGKASTTNRGQSLKSFIKEGKEXVFPPQEVLRFXLLKDSATIIVRIKNQGDGAYLPDDLGKSIIVERHFSKSGASSFKIKADNGRIFSTKRTELDAIIDHFTLQFENPMNVLSQDMARQFLSSSSPAEKYKFFVKGVQLEQLDQDYRLIEEYGDQIEEKIKSKQQDVSVLKNRRDAAERKLEMSDQQENLRERQRKLRRQAAWAQVEEQERVXSLILLLKSPDXFRQIRDSLIAEISSLDSKISEVEAEVARCDAAIREVEAEAITAAQYCREASAKVDNAQNERNDIEARVERSSEXTAXASGIVYVLPAPVNIYXSPSKAEQRRIREHVREANARIQQLQHQVDEETRRLADLHGGGYSRKLDELERAKQDAMEVRKQIDELEQNASQLSDDIRAAESQEKAAYQPVAQARRDLEEANSLLHNLNREGSGRNSGFPERMSALLKAIQQNRSFTETPVEPIGNFVTLLKPEWSSILESSFGATLNGFIVTSKRDLSILSEIMHRVSWSGFAYIAPFRLCCXXCNSPTPIFIGSGGSINTSQHEPDQQFNTVLRVLQVGLXSVSIXYGTNIKEQVDNELVRRQLVINHGIEQNLLIENLEEASSVLFDGERPRNAKRCFCINKSDRRRGILLSYSRNGEPSQAPVSVYSGSPRMKSDRDSQIRXESLFPVQHSIADQVNLVGCTRGGSESQTSSKRSRRRTALCPVSPHRCRQAFERNERKKNFLVIESQRKDDRIEELEESLQKEGSQDGDLEILQASLREAQEEKLTHEGSLDDAANAMTEMMQNLKRIKKELATKDAEIARLKDELRVAE

SEQ ID NO: 12823 - protein, 474 aa, Aspergillus nidulans
  unsure (1)..(474): unsure at all Xaa locations
FSTAPYVPPDAIFALTAEYNRRPSPVRANMGQSTYRGNYGLPWVLPSVQQARRGFNEKGLVHEYLPILRLKGLREGAARLVFGEGYTAMQEKLATSQAISGTGSLHLAGYLIRYCTLREKGGAADADAASDAVAARKVYIPSTTWSNHRLLFSSLGFTVGQFNYYNNATRSLNIDSYLAALRSADHGSVVLLHACAHNPTSLDPYIEQWKQIWDIIKERRLFPIFDAAYLGLNSGDYDKDAWAIRYFVNEQKVECAVCLSFAKNIGLYGTDPLYPSSDSCXNLEAGXQSQARALDAXILQPTPFSQSVLESLQRSEISNLPAFRAKIAEAIMSDDMLKNVWLEDLKTLSGRIAEMRRAFSTGXPDTLCVXCLLRFSNGFCKYGLLSRKLTATAAASANSWDYLVRQSGMFGFLGLERQVVRILRVSRVCHSLTVVRLITXDEYHIYMAENSRISSAGLDSGIVDYVARSIGEVL

SEQ ID NO: 12824 - protein, 299 aa, Aspergillus nidulans
  unsure (1)..(299): unsure at all Xaa locations
NQHVTKAFDLTGKVAAVTGGARGIGLEVSRGLAEAGANVRLSFSCIAXFADELRWLIIYNSSPTAIETAAEIAAANNVTARAYRANVTDQAEIEKTVQQIKKDFGHLDIIVVNSGITSNIPAEDYSVEEWRKIMGVNLDGAFYSAQAAAKIFKEQGRGNVIFTASVSATLVNVPQKQAAVRSLHGSYGHDXYGAVNASKAAVVQLARCLSVEWVDFCRVNCISPGFIETEILDAHPQEWRAKWHSMIPAHGVAQAYELKGVCISRDXAAKANITGVVFCASDASSYMTGADIVIDGGYT

SEQ ID NO: 12825 - protein, 291 aa, Aspergillus nidulans
FKLNTGATIPALGFGTWQDADAQETAVLEALRAGYRHIDTARVYGTEAAVGRAIKKSGIPRNQIFLTTKIWNNKHHPDDVAQALQDSLNDLDQDYVDLLLIHWPVAFKRGTEQFPKTEDGKPAVADTDYLDTYKALEKLLSTGKVKAIGVSNFSKAEMERILANATVPPAVHQLEGHPWLQQREFAEWHKKHGIHITHYSPFGNQNEVYSREGTIGRLIEDPVLVEIGKKYNKSAAQVALAWGVTEGHSVLPKSKTPERIKANLEGDFKLEEEDLKKIRGIDRKLRFNDSS

SEQ ID NO: 12826 - protein, 909 aa, Aspergillus nidulans
  unsure (1)..(909): unsure at all Xaa locations
PAAALVLFIQKPGGGLRFCVDYCALNTITKKDXYPLPLIHKTLNQIGRAKWFTKLDVSAAFHKIWIAKGQEWMTAFRTRYGLFEWLVTPFGLANAPSTFQKYINXALCEYLDEFCSAYVDDILVFTNRSRELHREHVXKVLVKLNKAGLFLDINKYEFERKETKYLGFIVRAGEGMSMDPEKIKAIKEWEAPTTVKGVRGFIGFANFYHQFIPDFSSLTRPLIELTKKDARFCWTEECQQSFGRLKECFITEPVLAPFDPDXETIVETDSSGHITGGTLSQYDLEGNLYPCAYFSKRHSPAESNYEIYDKELLAVVQCLEAWDTKLCLVSKFKVLTNHKNLEYFYLPRKLSEXYIXXSLFLSRFNFKFHYWKGSENEHANTLSXHDQDSPKGNNDWLESCTMQLYQEKYRXEVIDIPYPKATILPIAPQGGVPSLAEAQSGDDEYMEIRKLVREGARKLPPRLLLKVSMSECSIDAQDNLLFXGQRWVPCNKPLRTSLIQTAHDSALISHPGREQTYLVVSRTYFWPNMSKDIRQFVQNCDTCGRAKIWKEQKKGLLKLLPIPEHPWQYITLDFITDLPNSNGCTVILVLTDXLTKGVILESMAKMTSQEVAWTLVRTLIRRHGIPQTMVSDRGSQFVSRVXKQICQLLGIKQLLSTAFYPQTDRATEQANTVVETYLCLYICYDQGDXDKLIPIAELAINTRTSSATGVSPFYLTHGYDLSLFGLTEDLPEQSADQSPIQIRENIACMIKEAMDWAKASLAYSQQEAEHQANKKXAPAPTYKPGDKVWLNLWNIRTERPSKKLDWKNTKYTVTKLIGIHALQLNTPPGIHPVFYVDLVQLADNNKLPLQVQDDSQPPPILVNNKEEYYIDSVLDKQWKKIGRGGCWEYLVKXTGWAKPTWEPAHELEE

SEQ ID NO: 12827 - protein, 426 aa, Aspergillus nidulans
PKAMLISDLESTKYPEGGLEAWLIVLGAWCAMVPSMGLLNSLGTLHAWTSSYQLTDYSESEIGWIYGAYAFFLYVAGAQTGPIFDCYGPLYVVVPGSIGMVASLLCFSFSTGASSTSDLNIWHEAVADPVSEYYQIFLSFSVLGGLSACTLFNPAISVIGHWFNIRRGLATGIACTAGGLGGVAFPLIIMYAAPKIGFGWAIRIIAILSAVLLMVACLLMRTRLPRPSGKSAAIDFRALRDARYASTTAAVFLVEFAVFVPITYISSYALHAGIDTTLSYALIPLLNAGAVPGRFLPGLVADRLGRFNVMIATSLLCSILTLALWIPVDASPAGVICYAILFGFSSGAAISLTPVCISQVCKVEEYGQRNGTTFTIASVGNLTGIPIAGAILVANNGQHDALIGFGGGMYFPTTVASVVARGLCVG

SEQ ID NO: 12828 - protein, 219 aa, Aspergillus nidulans
  unsure (1)..(219): unsure at all Xaa locations
IDGGACVAMVGKDCVAIACDLRLGMQALTVSNNFPKIFNYAPGTYLGLTGLATDVSTVSDLFRLKVNMYRLREERHIAPQTLANLVSSTLYERRFGAYFVSPVIAGINNTTGKPFICGFDSIGCIDFAKDFIVSGTASDQLFGTCEGLWEPDMVRTFDLLXSLDRLTDLIVXSPEDLFETISQALLSAVDRDALSGWGAQVYIIEKDKVTQRLLKGRQD

SEQ ID NO: 12829 - protein, 495 aa, Aspergillus nidulans
  unsure (1)..(495): unsure at all Xaa locations
AEMVTYLPISSPFIRFAGRYVDDAFGVAAGYNFFVFEAAMVPMEVTGKDYLLPEXVRANVAQHAACSSITGPTRSLWQQYSLSYLFFLRASSAAKPAFFVLTSLKFLNVFAVKWYGESEFWLASSTVLLSVGLILFTFITLLGGNPLNDRFGFRYWNEPGSSAQHYKEGNLGRWLGSLACLINASFTIAGPDYISMAAGESGDPQRHLPRAHNDMLYRTTAFFISAALYLGILDPYNDKTMADAFDNEEPGAAASPYVIAMDRLGIPVLPHIVNAMILLAVFSAGNSYVYCGSRTLYGLALDAKAPRVFTRCTKSGVPIYCVATVLLIGLISFLQVSNSASVVLNWIISLGMLLILGLARGHNLTKLQVTASQLINFSVITFTYTRFRKALIAQGISRDTLPYKSLGQPYVAYIALVSTIIMAFVGGYEVFLPGNWDVPTFLFSYTMIGVFPVIYVGWKIIHRTSVRKPEEVDLFTGVDEIEEYTRNYRPEQARY

SEQ ID NO: 12830 - protein, 419 aa, Aspergillus nidulans
MASDAGKGDLGKMLDTYGNEFKIPDYTIKDIRDAIPSHCYNRSAIRSLSYVFRDLAVLASVFYVFHKYVTPETVPSYPARVALWTLYTVVQGLFGTGIWVLAHECGHQAFFTSKELNDTVGWILHSALLVPYFSWKISHGKHHKATGNLARDMVFVPKTREVYASRIKKTIYDLNEVMEETPLATATHSILQQLFGWPLYLLTNVTGHDNHERQPEGRGKGKRNGYFTGVNHFNPNSPLFEAKDAKLIILSDIGLAITASILYLIGSKFGWMNLLVWYGIPYLWVNHWLVAITYLQHTDPTLPHYQPESWTFARGAAATIDREFGFIGRHILHGIIETHVLHHYVSTIPFYHADEASEAIKKVMGSHYRSEAHTGPLGFLKALWTSARVCHWVEPTEGTKGENAGVLFFRNTNGIGVPP

SEQ ID NO: 12831 - protein, 933 aa, Aspergillus nidulans
  unsure (1)..(933): unsure at all Xaa locations
CIGYIRLRHCXHLRRIELLKAYRAAHSRVLSIEPFEAALRENTPLTSIADPKALTEYFNQISLKGDLVAEELKRVTTERDEFKNKLETAVKSEKAAREELDRLKQTASGEEQSNDSKDATSKPEQSHKEIKQEAEEFFSFDNEIPRLESELKEKQEEVESLKAQTETLKRDLSVARESTEGMVHNLESATRELAELRDFKDKQEAEMKNLKISKQSEIDEIKSKLEASETAVAETNAEVEKLSAELKQKAAEIEQLQAQASKPEDADQQAELAIKLEQVKQEKEANEKRLGVLQGLVDTLRTQLKETQDTMSGLKANMDQKTEDFEKLKKVIDFLDGNLEDNVKWQESKEKVANGQEVNFEELQQTLAPAYGSEAANEKLETTPQPANATAATGAGKKKSKKKKKGGKAGEDNSKLTETATPETAPAVSQPAESSSALAELEKKIADLEQQLREKEQAIERLDSRLKGEEDLKEEIESLRDDLLNIGQEHVEAKDKIKELVAEKAALEGTISKLEAEITDLRSNNAAKSADSEKAHNDLKDEYESLKVKFTTIETELSAAQQLATTRFKDITDLRESIQKIQPELKKLRGESAELRSTKDELKSKTAELRTLESKHDDLQAEVKALKTSISDRETEVKTLNQKIKQELDSRLKAEESLTVAQSDLRYIESRKQEAIEGKQKVLSELSNVQDELKTARARLREYEQQTSQLNKELEGLRDEISAKTAQHSSAQSLMNSMRDQASELGMQMKEARERCESLEEELADAHRLLSERTREGETMRRLLNDIEGRAEAKARDFKERMEAAIEERDRAEDEASAQGRRRARELEDLKAKLRDLEKALRSAEEDKEELEHSQKDWKRKRDHLEAQAETAVQELHDVQQAMARLREALDESEKNVRDLEKEKAELRRSVEQTNSRLEKIRKSNMLSEDSRF

SEQ ID NO: 12832 - protein, 414 aa, Aspergillus nidulans
MADALKAEGNKAFAAKDYPTAVTFTPLWRGKLGQAADQSSEKFTQAIELDSNNHVLYSNRSAVYAAQQEYEKALADAEKAVEIKPDWSKGHQRKGAAYRGIGDLCLYPSPSFCLYCADVYSGAHDAYEEALKLEPGNTQAQSGLDAVKRAINAEAQADGVTGDPMGGLSNIFNDPQLFQKLASNPKTSALLADGDFMNKLKKLQQNPNSIGEEIKDPRFLQVMSVLLGIDMNFGAPPQGGPSGAAAEAEEDVPMPDARPSPPKKEPEPEPEPEDEETIAKKKAQEAGDAEKKIGNDFYKKKQFDEAIEHYTKAWELNKDVTYLNNIGAAKFEKGDLQGAIETCKNAIEEGREHRADFKLIAKAFTRIGTAYEKLGDLDKAIENYNKSLTEHRTPDALTKKRNAEKARDKAKKEA

SEQ ID NO: 12833 - protein, 408 aa, Aspergillus nidulans
  unsure (1)..(408): unsure at all Xaa locations
VPMTLSTSSLTSITISTGSTSTCTDYSQITSAVASCTRATVLSNVAVPNESAIDLSNLQMGTTVTFGGLTTFGFTNSSSFDPINIGGKDITITTTEGSVIDGNGQAYWDGLGSNGGVPKPYHFIVVSKXRETQXFERLYVQNWPVHLFSISSCSNLISQNMVLNSTAGNEPNARNSGLVAVHDSDGFDVSSSYNITMRRNSVYNQDNCVAITSGTNMTVSEMQCSGGHGLSIGSVGGKSNVTNILVXFIALSTNDIMYXQNASSQTQLLFSTSATGWLTSVLQLGGLVGSLSAGILGEVLNGARIKTSYNTTGFVSNVNYSNIAVNNITISGIDLPTFYLNGGPTGIPSSGVIVENILSQNVTGWIALSGQDYYILCGTDSYSNLAFEDVYITGGGVPSSCNYDVTGC

SEQ ID NO: 12834 - protein, 286 aa, Aspergillus nidulans
ITSASEFNQVVFKEYANAPLARKFTSLFPGLGYAAGYKVGRTKRWLWLPLAHKTPQVLQRIYKYGGQPFARDYLAKHHGADFDKAFGKGTGKAIMHATAGSLIGIGEIVLLPLDVLKIKRQTNPEAFRGRGLFKIISDEGMGLYRGAGWTAARNAPGSFAVRCFLSQNVITLTMTLFGGSAFAKEYIYSLQDYNKASWAQNFVASVCGASASLIVSAPLDVIKTRIQNRNFENPESGFRIVSNMMKNEGPTAFFKGLTPKLLMTGPKLVFSFWLAQTLIPAFGQIV

SEQ ID NO: 12835 - protein, 538 aa, Aspergillus nidulans
  unsure (1)..(538): unsure at all Xaa locations
MATNSFRKLTFSGASRLGGCRRLPLTCRQLRFASDSGAAAATTKATAESAAESASINVKEAPKKAGRGLRRTVLGTSLALTLLVGYVYGTDTRASVHRYGVVPLIRALYPDAEDAHHIGVDTLKMLYKYGLHPRERGDPDGDGALATEVGGLLLXWKLRPXYLWRIGFGYTLSNPIGISGGLDKHAEIPDPLFAIGPAIVEVGGTTPLPQDGNPRPRVFRLPSQRAMINRYGLNSKGADHMAAILEQRVRDFAYANGFGAYDAAKQRVLDGEAGVPPGSLQPGKLLAVQVAKNKATPDGDIEAIKRDYVYCVDRVAKYADILVVNVSSPNTPGLRDLQATAPLTAILSAVVGAAKSVNRKTKPYVMVKVSPDEDSDEQVSGICDAVRASGVDGVIVGNTTNRRPDPIPQGYTLPAKEQATLKETGGYSGPQLFDRTVALVARYRSMLDAESETAGSAKDSAATIAQTEPGSENVPPVEAPSGLPRKVIFASGGITNGKQAHAVLDTGASVAMMYTGVVYGGVGTVTRVKQELRTAKKE

SEQ ID NO: 12836 - protein, 453 aa, Aspergillus nidulans
HELGGKRAIEDKNIGPLVKTSMNRCIQCTRCVRFMNDVAGAPELGTTGRGNDMQIGTYLEQNLDTELSGNIIDLCPVGALTSKPYAFRARPWELKHTESIDVHDALGSNVRIDTRGMEVMRVLPRLNDDINEEWINDKSRFACDGLKTQRLTTPLIRQEGKFVPATWEQALTEIASAYQKLQLKENEFKAISGHLVDAETMVAMKDLANKLGSDNLALDQPGGSSPIAHGVDIRSNYLFNSKIYGIEEADAILLVATNPRHEASVLNARIRKQYLRSDLEIGLVGEAFESTFDFEHLGSDVAALKAALSGNFGTKLASAKRPMIIVGSAAAEHKDSKAIFEAVGSFVEKHASNFNTPEWQGYNVLQRAASRAAAYEIGFTTPSPEVAQTTPKMVWLLGADEINQSEIPRKAFVIYQVHHGDRGAQIAHVVLPGSAYTQKSRDYINTAGRVQVT

SEQ ID NO: 12837 - protein, 385 aa, Aspergillus nidulans
DKMEFNTSKEVTVAPTFEDMHLKESLLRGIYAYGYESPSAVQSRAIVQICKGRDTIAQAQSGTGKTATFSISALQVIDTVVRETQGMQENDCCFSSLTLGALVLSPTRELATQIQSVIMALGDYMNVQCHACIGGTNIGEDIRKLDYGQHVVSGTPGRVADMIRRRHLRTRHIKMLVLDEADELLNRGFREQIYDVYRYLPPATQVVVVSATLPYDVLDMTTKFMTDPVRVLVKRDELTLEGIKQYFIAVEKEEWKFDTLCDLYDTLTITQAVIFCNTRRKVDWLTDKMREANFTVSSMHGEMPQKERDSIMQDFRQGNSRVLISTDVWARGIDVQQVSLVINYDLPTNRENYIHRIGRSGRFGRKGVAINFVTSDDVRILRDIE

SEQ ID NO: 12838 - protein, 634 aa, Aspergillus nidulans
  unsure (1)..(634): unsure at all Xaa locations
LSVTDAVNDDNSTISLSNNTMDTLGLFRGDTVTVRGKKRKETVLIVLADDDLDDGSARINRVVRHNLRVKHGDIITVHPCPDIKYVSFLENKGREXRLTALPRPQAKRIAVLPIADTVEGLTGSLFDVYLAPYFRDGYRPVKQGDLFTVRGGMRQVEFKVVEVDPPEFGIVAPDTIIHSEGEPIQREDEENNLNEVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILSIHTKNMKLGEDVDLETIAAETHGYVGSDLASLCSEAAMQQIREKMDLIDLDEDTIDGKVWTHWCYHENXRNALGVSNPSALRRVAVAEVPNVRWKDIGGLEKVKRELIESVQYPVDHPEKFQKFGLSPSRGVLFYGPPGTGKTMLAKAVANECAANFISVKGPELLSMWFGESESNIRDIFDKARAAAPCVVFLDELDSIAKSRGGSVGDAGGASDRVVNQLLTGKLYXFVLSYRRXINISSEMDGMTSKKNVFVVG

SEQ ID NO: 12839 - protein, 372 aa, Aspergillus nidulans
  unsure (1)..(372): unsure at all Xaa locations
NYASPRAGSAHPTPSKTPRNQHGPNLNVRSELYSLSPIRYDSQRILETPRKQPRYVNKVPYKVLDAPDLQDDFYLNLVDWGSSNVLGVGLGNSVYMWNSQTGRVTKLCELKDDTVTSVSWIQRVSRRLMNVWELMLINIXGTHLSIGTGKGMVQIWDAERCRRLRTMIGHTNRVGALAWNDHILTSGSRDRHIFHRDVRSPDQYLRRLSGHKQEVCGLRWNTEDGQLASGGNDNKLLVWDKLNETPLYRFSDHTAAVKAITWSPHQHHLLASGGGTADRTIKFWNTATGSLIKEVDTGSQVCNLAWSKNSDEIISTHGYSQNQIVIWKYPRMEQIVSLTGHTFRVLYLAMSPDGQTVVTGAGDETLRFWKIF

SEQ ID NO: 12840 - protein, 511 aa, Aspergillus nidulans
TNASSISDEGRVNALLILACIAFGSASFVFGFDDKVISPLAALTAFVRPPTPALSIDEHSQSQVQDFQGPNPVDGTLVLTARNQNLVFSVPLVGSIVGGVTASPLNNFLGRKWPLIGAYVVSIGGGFLQLFAKNLAQFVIGRFLNAITIGVANATAPLYLSEVVPPSMRGRSVTSINILSLLAGVISTIIVNETKDLDGHLQYMIPLAIQCALPVVILVATVFLPESPQWLVSKGRMEEAHRNLRKLRGSKMSDATVAEELRVMQLCEENERALSANVRFWEIFNRENLQRTLTAGSFYSFNQISGIILSTTYTTVFLTQLGVGDAFTFTVIASCCTLAGTLAAPLVIDRFGRRPTAFVGMSVLLLIDITAGSLAFNTGSESFVLGIAALGFIFNFFWGAGFYSLSALMPSEIATPKLRNHTMAYTIACAQTTAVITTFAVPQLTSADAAGLGAKTYLVFAGCMAFVLVFVYFFMPETKGRTFAEVDEMYDAGIPMWKWRNYKTATAARIG

SEQ ID NO: 12841 - protein, 928 aa, Aspergillus nidulans
  unsure (1)..(928): unsure at all Xaa locations
LGGLGSGFANNPEELKNLASRSLTLSPQILVEKSLRGWKEVEYEVVRDASNNCITVCNMENFDPLGIHTGDSIVVAPSQTLSDEEYHMLRTAAIKIVRHLGVVGECNVQYALQPDGLDYRVIEVNARLSRSSALASKATGYPLAYTAAKIGLGHTLPELPNAVTKTTTANFEPSLDYIVTKIPRWDLSKFQHVNRDIGSAMKSVGEVMAIGRTFEESFQKAIRQVDPRFVGFQGDKFENLDEVLKNPTDRRWLAVGQAMLHENYSVDKVHELTKIDKWFLYKLQNIVDNHNELKEIGSLFGVNKELMLKSKKLGFSDKQIAQLVGASEDDVRARRKGFGIRPWVKKIDTLAAEFPADTNYLYTTYNATSHDVTFDDHGTIILGSGVYRIGCSVEFDWCAVNATLSLRNMGKKTVMINYNPETYSTDFDTADKLYFEELSYERVMDIYELESASGVVVSVGGQLPQNIALRLQETGGANVLGTNPKDIDNAEDRHKFSQILDSIGVDQPAWKELTSVAEAERFAEAVGYPVLVRPSYVLSGAAMSVIHSQDELKEKLLNASAVSPDHPVVITKFIEGAQEIDVDAVASNGKLLLHAISEHVEPAGVHSGDATLVLPPASLEKPVMSRVKEIAEKVAKAWNITGPFNMQIIKADQEGAEPQLKVIECNLRASRSFPFVSKVLGTNFIDVATKALVGRDVPEPVDLMEVKRDYLATKVPQFSWTRLAGADPFLGVEMASTGEIACFGKDVVEAYWASLQSTMNFRVPEPGEGILLGGDITNPALAQIVDLLHPLGFKFFAASPEVKAHIESATKEHTPVQVIEFPKKDKRALREVFQKYDIRGCFNLAKTRGKTLLDEDYVMRRNAVDFGVPLFMETKVRHHTSGKXDLELINFTRTAQLFAQAMNQKLPRPEGIPSEVRTWSNFVGGKLL

SEQ ID NO: 12842 - protein, 220 aa, Aspergillus nidulans
  unsure (1)..(220): unsure at all Xaa locations
LSTAKMTTLHSFYPLGVEIPHYIANELSTPTLLAIFGTACTIVFSVTTSLAKKANSQISNSELYKTLWFALCRFLTAKQKRNPNREKNRRLIHLVLEGYYALNFLTLASSSHPLAQLWKEYALSDSRYLTPNSXVMCMEVITALFWGPLSFLLAGFIATNHPXWHPLQIIISLGQLYGDVLYYGTCAFEFLVNGLEFSRPERYYFWGYFMLLNMFWIDIP

SEQ ID NO: 12843 - protein, 295 aa, Aspergillus nidulans
  unsure (1)..(295): unsure at all Xaa locations
RAPFIVPALKKHTATVIMAHGLGDRLVPSQNGKRVADXLFLIAVQDGMPEPSRMALEIMNRVLMRRSNRVSLAHNWRRRGLFEEVTFIFPNAPMIPITSGTFDASFFHGSKTXAXGXDAADLKFFGXNFGMSMPGWYDITKLGRDVSPSLLIPLYGKQQLIEXQYSSISKKPSRTQDEAGILKSRDYFNSLIKEQMDQGIKPSRIVLGGFSQGGAMSLFSGITGQEKLGGVFGLSCYMLLSDRIKNYIPENFPNKKTPFFLAHGTEDDIVPHEFGKRSAEMAKELGLEDVTFNSY

SEQ ID NO: 12844 - protein, 598 aa, Aspergillus nidulans
LSLDSLGTMAVSNTLAARGGALSPSQTTSQMATTTVSVGGMTCGACTSAVEGAFNGVKGAGEVSVSLMMSRAAIHHDPTLLPPGKVAEIIEDCGFDATVISTDSSSIPSRSASDHGASEANVVTTTLAVAGMTCGACTSAVESGLAENPGVRSVNVSLLSERAVIEHDLSTVSAEQLAEIVEDRGFGARVLETSHPGLVLADPSLRIPRLSQMTTTVAIEGMTCGACTSSVQAAFDGVEGVIQFNISLLAERAIITHNPQILPSRKIVEIIEDAGFDAKVVSEVQALGQKGGPTQVTLDVHGLRDANSAAALEDSLMQKPGIISASVTLATSRLVVSYDTSMVGIRTIVAVIEAAGCNALLADSDDKNTQLESLAKTKEVLEWRRAFLFSLSSPIHVFVIDMILPMYLPTFNFGGIRIIPGLYLGDSVCLLLTIPVQFGIGKRFYITSYKSLRHRAPTMDVLVMLGTSAAFFYSVFTMIVAIVIDPHQRPNTVFDTSTMLITFITLGRWLENRAKGQTSAALSRLMSLAPSMTTIYDDPIAAEKMVEEWDKVDGQEQKTATNEMSTVSQKIIPTELIEVGDIVVLHPGDKVPADGVVI

SEQ ID NO: 12845 - protein, 408 aa, Aspergillus nidulans
  unsure (1)..(408): unsure at all Xaa locations
QPLSLLLKASPFIDELALYDVVNTPGVAADLSHISSVAVRHAYIEAVIXWTNSKTKISGYLPKEDGLKNALTGTDIVVIPAGIPRQYNMIYWSISPQYXWHXCCLVFRXPGMTRDDLFKINAGIVRDLVKGIAEYSPKAFILIISNPVNSTVPIAAEILKAAGVFDPARLFGVTTLDVVRAETFTQEFSGQKDPSAVTVPVVGGHSGETIVPLFSKVSPAFQIPADKYDALVNRGYSCKSLSNNVTSYXSSYRRPFGGDEVVKAKDGAGSATLSMAFAGFRSGILCVLGRRFXCXLLYRFAESVIKASKGQSGIVEPSYVYLPGVPGGADIAKATGVNFFSTPVELGVSIWNXGPXVSELMLTTQXPNGVQKAINILDGITDAEKKLLDTAIKGLKGNIDKGVEFAQS

SEQ ID NO: 12846 - protein, 363 aa, Aspergillus nidulans
GVVNTWGVYQTYYEQNQLSDISSSSIAWVGSLQSFLLMLFGVVTGPLFDAGYFRLLLGFGTIMLPFGFMMVSISSKFWHFILAQGVCVGLACGCLFVPAVAILPQYFRKRRGLANGIAATGSSIGGVIYPIMFNELQKKAGFHWATRAVGFLAFGTCLISFSLMRMRFLPTEKRKLIQLGAFKEPIFVLFSIGMFMGFLGFYNFLFYVQSYAIETGIVDGNLGFYLLAMLNAGSTFGRIAPNFLADHTGPLNMLIPAVSITAILSFVWIGVHTVPGIIVLSVLYGIFSGGFVSLPPVVMASITKDMRELGTRMGMVFAITSVGLLIGTPIGGAIMSNTHKYLGVQLFTGCAITVAAAIFLGVR

SEQ ID NO: 12847 - protein, 1061 aa, Aspergillus nidulans
DDADFIRQNPDLYGLRRSGRARTTRRVAESSSESESDDVAPRSKRRRPLASQISKAPTPSATQSTFSDDSDSDEYGGSRARASKAKRRRLLQASANNVPSHAEVRFSTRNAAKVSNYNEDDDDSMFEDDADDLTPNYWVNTVEDDRPAIDIVLNHRPKPGVDPSDPDIDRHQFEFYIKWQEKSHYHATWETTESLANCRSTRRLDNYVRKVLAEDLRLNYDEGVPPEDREKWNLDRERDVDAIEDHKIVERVIAMREGEDGTEYLVKWKRLFYDSCTWESEELISNIAQREIDRFLDRSSRPPVSDKKESHPSSRKPFEPIKGTPSFLHNGQLKEFQVKGVNFMAFNWVKNRNVVLADEMGLGKTVQTVAFISWLRHVRRQQGPFVVVVPLSTMPSWAETFDNWSPDLNYVVYNGNEASRNVLKEYELMVDGNPRRPKFNVLLTTYEYVLVDSSFLSQFNWQFMAVDEAHRLKNRDSQLYIKLQEFNSPARLLITGTPIQNNLAELSALLDFLNPGLVNVDADMDLNSEAASEKLAELTKAISPFMVRRTKTKVESDLPPKTEKIIRVELSDVQLEYYKNILTKNYAALNEGTKGQKQSLLNIMMELKKASNHPFMFPSAETKILEGSTRREDVLRALITSSGKMMLLDQLLAKLKRDGHRVLIFSQMVKMLDILGDYMEYRGYTYQRLDGTIPSASRRLAIEHYNAPDSSDFAFILSTRAGGLGINLMTADTVILFDSDWNPQADLQAMARAHRIGQTKPVSVYRLVSKDTVEEEVIERARNKLLLEFITIQRGVTDKEASEIQNKMARGGITLGEPNSTDDISRILKRRGQRMFEQTGNQAKLEQLDIDSVLANAELHQTEQAEGIQADGGEEFLKAFDYVDIKVDDLTWDDIIPKEQLEEIKAEEKKKADEKYLADVIEQNRPRKRIVAGDERDTRAERKAKRQARVQVSMNDDDGDDSEPNAKADPKRPLVEKEYRHLLRAFLRYGDIEDREEEVIREARLTERDRDTVKSALREITDKAAELVREDVARLEALENAGKVLTKKERKAVLFDLHGVK

SEQ ID NO: 12848 - protein, 345 aa, Aspergillus nidulans
  unsure (1)..(345): unsure at all Xaa locations
HEETVDRCWXRKDELEYWLTEHLRLNGVYWGLTALHLLGCPDGLPRDNAVDFVLSCQQENGGFGAAPGHDAHLLYTVSAVQILVTLDAVDELEKRGLGGKLKVGSCKYSPYHFGEGXRTHGXVFSVIAGLQDKETGSFMGDEWGELDTRFLYGALNALSLLGLLDLVDVAKAVSYVQRCENLDGGYGVTPGAESHAGQVFTCVGALAIAGRLDLVDKDRLGGWLSERQLDHGGLNGRPEKLADACYSWWVGASLAMIGKLNWIDGSKLAAYILRCQVCYSILALVLLANPPXDPEAGGFADRPGNAVDVFHTHFAIAGLSLLGYEGVEEVDPVXXVNDIPTAQFR

SEQ ID NO: 12849 - protein, 453 aa, Aspergillus nidulans
  unsure (1)..(453): unsure at all Xaa locations
PHPLLFAMLPPIPIPAEYGISPDTGFLPSEPPLEHLPDPYYAKWEWIVANIQALLLSRRMRRVVDNMPILSTSYLQAEPEWRRAYSILGFILHGYVWGGSTPAEVSGPTPMMIHAWHWQSLLDGPCXPYQRIPPQLTVPLFEVCDHLDLPPVATYAGLVLWNFKPIFSDEPMDDLDNLACINTITGTLDEQWFYLVSVAIEARGGPAISLVLQAIAARVGNTAVVIEYLQALAEMIDEIGAVLERMYEHNDPYVFYNKIRPYLAGSKNMADAGLPNGLLYDDGKKPEYRQYGGGSNAQSSLIQFLDIALGIEHRPTGETRPSSSENGGVAAGPRHGFIQEMRSYMPGPHRKFLEHMGAVANIREYVEARRSNKPLSLAYDACLSMLQSMRTKHIQMVSRYIITPSQKAREKPSRPASLNLATARHSEKPDGSKLRGTGGTALIPFLKQARNET

SEQ ID NO: 12850 - protein, 282 aa, Aspergillus nidulans
SIKRPNPPLPDSVFAMFSMKGRVAIITGGSGGIGYEVARALAEAGADIALWYNSSPAEKLAETLVKDFGVRAKAYKVAVQVFEQVQAAINAVVADFGGLDVMIANAGIPSKAGGLDDRLEDWHRVVDVDFSGAYYCARVAGEIFRKQGHGNLIFTASMSGHAVNVPQQQVCILFVSSWPELLRCSQFLLACYNACKAGIIHLAKSLAVEWADFARVNSVSPGYIDTAISGDCPFEMKEAWYGLTPLKRDADPRELKGVYLYLASDASTYTTGADIVVDGGYT

SEQ ID NO: 12851 - protein, 436 aa, Aspergillus nidulans
AQQRYETSRPRSKAQHQRATSHLPGGNTRSVLHATPFPLCMQAGKGNRLVDVDGYEVSDFSTASSPTLLSQARYIDCMGDMTACLYGHSHPVIMETVDSTMKSIGMNLGSSTSAEAHFAEALCDRFASIDHIRFCTSGTEANLYALSVARQSTNRTKVIVFEGAYHGGVLSFSHGIAPNNVDKDDWILGQYNDIDGAVQLITENKDIAAAVVVEGVQGAGGCIPGSAGFLHAIQDAARENGIIFILDEVMTSRLAPGGLQSILLHPDHGTPLKPDLTTFGKWIGGGLSIGAFGGRRDLMSVYDPRTSIIHHSGTFNNSTLAMNVGCKGLTLVYTPEACTSLNNLGDELRSGLQELAKGTKMVVTGLGAVMNIHFVRASGSRVVARTSDLEVNSGSVEEALRDLLWFYLIERGFWIARRGMISLILGTGVEEVEQLK

SEQ ID NO: 12852 - protein, 731 aa, Aspergillus nidulans
  unsure (1)..(731): unsure at all Xaa locations
MPQLGPADTHLTPNEAMSQLVGVTSSWIDLCSPDPLIADLSRQVFMLEVAYAAFCGIGYLLIPGPKLHHKGMHSDGVMYYARAIQDALVSAHTSSFISGXTWSTSGSRIRRDGXSCTSCREEFFDTEIEQPKIDLFGTWDAWDAIRRTCKYHSRLFVGKKIISDLSSILIIVAKIPASSSLPKHLPPMAVQSRWHSEPVHLFTIDSNTFIKNQKGYPVLSKAHQALISRFMRLRTAPWILLCDVGPIPGVETDNASSLPGSEYPSLAQAAASIKKHHDPTPHLSYMRNLQSRQPPRTAIERFGTGYQDYLQAPLQPLTVNLESITYEVFEKDPIKYEWYERAIAKALSDWVEQKKPTSNPDGRVVVAVVGAGRGPLVTRALKASAQSGVEIDLWVVEKNPNAFVLLQRHNENLWGGKASLVHSDMRAWKGPRVRKSTTLSTEPVGQSLGIEGQFLYTPDPNQKTADSPSLDAIEFEDSKIDIVVSELLGSFGDNELSPECLDGVNHLLNPVHGISIPASYTAHLTPISAPKLHADVTNQSITNPAAPETPYVVMLHAIDYLSTNQSDASAGNPARSSVATVPYEPTTPFVQTAWSFSHPNRDIPPQPASTSMISNAHNVRRTRLTFPVPNRGVCHGLAGYFETVLYRDVELSTNPVTMDSKSANMISWFPIYFPLKVRRPGXGXKGVDIXLVPRHLXMVPDNGEIVATMYRQTDDRKVWYEWMVEVFALEG

SEQ ID NO: 12853 - protein, 423 aa, Aspergillus nidulans
  unsure (1)..(423): unsure at all Xaa locations
IPQPKGLPVLGNLFSLDSKNPWGSFNKLAAASPSNRPIFKISILGHDIVFVTSAALLEEICDETRFRKCVTGPIVQIRDAVHDSLFTAYHSESEIWGVAHRIMKPLVSPEECEGVFNEMRETTDDLIKKWTASSKQRVNVCNDLDRSNTKRICLPSFTRRCLSMNGTEPAVIASCQNATMEAVNALAPDIPYMAYGSQTRYDSDIKIMRNYGAELVRQRRDDIPRRRTQGHLHALLHGVDSETGKKLSESQVLDEIINIFIGSATRANLLSFGLYYLATNPDVVTKAREELDAVVGSGPFEHAHLSQIPYTEGILRESLRLSATAPGFNIEPIPSPGNEPVLLAGGEYQVPRTQPLIALLTAVNRDPEVFEDPESFKPERMVGEKYDALPSGVKKGFGNGKRQCFGTRYAXGKESFGAGAVIK

SEQ ID NO: 12854 - protein, 337 aa, Aspergillus nidulans
  unsure (1)..(337): unsure at all Xaa locations
LSGSSKHYGPNVNSHYPVERRNFNSCGKXTQSSLVPLLLTXTQIGYGTGTAWFKKKGDTSINRDLVESIKTAIRLGYHHLDSAEVYGTERELGVAIKECGVPREQLFVTTKVNQNIANVPKALEDSLEKLQLSYVDLYVLLLSSLFHKLTMNRRCFQILIHQPFFAESPTELQDAWAAMEKVKEAGKARAIGVSTFLESPXETILDSARILAAINQIESLLYAQHGSLVPVPREEGYAVASYGPLTPVTRAKGGPLDPLLSELAGKYGVGEGEILLRWSLYRGAVAITTSGKESRLSTYLNVFKFQLTHEEVLKISRIGDQKHYRGFWSDKFAADDR

SEQ ID NO: 12855 - protein, 713 aa, Aspergillus nidulans
  unsure (1)..(713): unsure at all Xaa locations
QGTELLTQERAQSNIDVDTLGDLLHTKEALKKQDEILSVLKSEKVFDKSRNHVLGRTEKIQLALARGKRLQQLKKAHNWSDEDVHVANDLVSEPTPYGLHASMFLVCYPWXPQLGGGRIPVGXXLARWLGDTSRQGTPEQHKLFYERARNYEIIGCYAQTELGHGSNVRGLETTATWDPSDQTFIIHSPTLTASKWWIGSLGRTANHAVVMAQLYIGGKNYGPHPFVVQIRDMETHQPLENVYVGDIGPKFGYKXVFWVLWWDVADWASTMDNGFLLFNKLKIPHVNMLARFAQVDKATNKYIRPASPSLMYGTMTWVRSNIVLQAGGVLARGVTIAVRYCAVRRQFQDRDAKANAEENQVLNYKMVQIRLLPLLAAMYALHFTGRGMMRLYEENQERMTGAAQADQEKRGAGPEQLRAGSDLLADLHATSCGLKALASTTAGEGLEVCRRACGGHGYSNYSGIGPWYADYLPTLTWEGDNYMLTQQVARYVRPPSTTTYLITNISXLLKSARAVLAGKGTANDTSRILQAYLARRDKGASFDILGNDADIVAAFAWRTAHLTFETLKYRDVEKRSWNSLLINFWRLSTALSQYLVVKNFYEAVNSPEIRSSLDKDTASTLRSLFRLHALHTLDREASEFFSSAAVTVRQIGLTQTSEVPKLLDEIRPHAVRLVDSWKIPDWQLDSALGRSDGDVYPDLFKRASMQNPVNDLV

SEQ ID NO: 12856 - protein, 334 aa, Aspergillus nidulans
  unsure (1)..(334): unsure at all Xaa locations
NNAYSSGMKEDLNLYGNEYSLFGSFYNIGYMLFEIPSMMIMSRPKFARYFLPTMEVCWSVLTFAQSRLRNHHDIYGLRFLLGVLETPVSSGTMYILSSWYRGDELFKRAGVWFVSSNLGSFAGGYLQAAAHETLDGVHGMAGWRWLFIIDGCISLPIALGSFFFLPGLPHGEKVWWLTDADHRLCVQRMRNEGVRESRKIGKRMLRRVFTHWHFYIAVFTYILLVAVSLPSMCTGRXKLFVAVTNDSTSFQCTSYVAGQMILWLKDQADRYGTWTVSQINMIPTGVQAVSVFAGVLATSLVMVYPPWAVMGVVASVLLFSNVCLLVWDIPLGLK

SEQ ID NO: 12857 - protein, 657 aa, Aspergillus nidulans
  unsure (1)..(657): unsure at all Xaa locations
QDSLADMLSVLGMTYGDEEKLETLKYRLLTKSDDLGSWGHEYVRHLALEIGQEYQNRVNDEKEVDDLIKLAVSLVPYFLRHNAEADAVDLMSELEIIEEIPQFVDENTYSRVCLYMVSMVPLLTYPEDHQFLRTAHEIYVRYKELTKAIVLAIRLNDVDLIKSDLEATSDRSLKKQMAFLVSRQQIWLDDLGDDEQDETFMECLNNTSIPKHFKSLGKELNILDPIMPEDIYKTHLESSRGAGLTNVDSARHNLASAFVNAFANAGFGNDEMMIVEGDKGSWVWKTKDDGMLSTTASMGMLLHRDVDTGLDKIDKYTYASEDQIKAGALLSIGILNSGVRLDSDPALALLCDNENLEAKNIPMRVATIMGLGLAYAGSNKQEILDALLPIVEDVSLDMQLSAMAAVSLGLVFVGSSNHQVSEAIATTLMDEERQKQLKDKWTRFMALGLALLYFGRQEEVDVILDILKAVDHPMAKPTSVLASVCAWAGTGTVLKLQELLHICNDVIEESDEKQGEELVQSYAVLGLSLIAMGEDVGQDMILRQFGHLMHYGASIIRKAVPLAMGLISPSNPQMKVYDTLSRCSHDNDNDVAINAIFAMGLCGAGAKNSRXAHLXRHLTSYYHLHQNSLLVVRIAHGLLHMGMGTMALTPIXTDPQV

SEQ ID NO: 12858 - protein, 339 aa, Aspergillus nidulans
  unsure (1)..(339): unsure at all Xaa locations
RPVVLHIGKPIKYHQHFYSNDFLARFHVIQNDVLDIPSFIQALKEKRSVAXALHLACTLLTSAAYGDFVVTFRPHFQSGGEMGKWDDELIELLPSSVRIFASVGLGFNWADVEALGRRGIWYANGASASDEAVSDTTLYMILSVFRNFTRTQLAARTADPEIFTASHKLIASISHNPRGHILGLVGLGNISKKVAVKAQPLGMSVHYYDVVTRAQNVERALDVTYHDTRESLLEVSDCVSLHIPLNQYAKHLINRDTLKIMKPGASXSNTALGXVVDEEALIEALETGSPSAAGLDVHYHEPQVSPRLAAMDAVTLITHIAGGALNTRINFELNSMENI

SEQ ID NO: 12859 - protein, 1333 aa, Aspergillus nidulans
  unsure (1)..(1333): unsure at all Xaa locations
GLDLASVRSSFRGDVLYNDELDTHLAHLTVGETLTFASRARSVRHVPGAFSRRQLDTARRDVMMATFGLNHTIDTRVGDDFVRGVSGGERKRVSIAEASLAGAKFQCWDNSTRGLDSANAINFCSSLRLQADLLDVTSVVTLYQAPQAAYDVRLPKLSLFRYQLLLIKFVSFLLAFDRVTLIYEGRQIFFGHITEAKGYFEKLGFFGEFLSVNESCAFRSLTSFKAPSRQTIPDFLTSMTSAEERRVRPGFEESAPRSPDEFAERWRLSDERRKLLDELASYEQKHPPEVRMAEYDRSRRAEQAQQQRAKSAYTISYPQQVSLTLWRAYRRLLADPGFTIASLLFNVVMALILGSMFYNLKPDTSSFYYRGGIIYFSLLFNAFASQLEVIPSKLNFSVRWDSFSNLTGIXVLTIYAERPVVEKQNRYAFYHQSAQAIASYLMDLPYKIINMFVFNILIYFMANLRREAGAFFFFCLTTLLSTLVQSAVFRTLACITRTSEQAMIPSAILSLGLMIYTGFTTPPGYMPGWSRWMAYINPLWYGFEALMANEFHERDFPCASMVPTGQGYANLPSASQICSVVGSEVGSALVNGDSYISKSFDYWNVHKWRLVNSKNTIDTEGQCTNGSRSNRNIGILCGFLAIFFPTYVLAAELAKPPKTRGEILVFGRGKGFHRREQPLDAESQEKDRPVVADKTHGSLQSDTIIAGKDVFHWEDLCYDIKVKGGTRRLLDHIDGWVKPGVSTILMVRTITIKGIWSXASPSXGVSGAGKTTLLDVLATRVTTGVVTGQAMVNGKPTDPSFQHKVGYVQQQDLHLSTMTVREALQFSAVLRQSAEIPKSEKLAYVEQVIDTLEMREFADAVIGVPGEGLNVEQRKRLTIGVELAAKPQLLVFFDEPTSGLDSQTSWVISELIKKLTNSGQAVLCTIHQPSAILFNQFDRLLLIAPGGKTVYFGGEFFCLPLINGXSDNIQIXARVASTLIQYFKNWAPPWPTESKPKEWMLGVSNPACYGSKGLNWHQIWLAPPEYQAVKAKLGHLRNLRTLGSTRGEGLKVENSSQHQEFVASFWTQFSQVLQRTWKHFWRSPTYIWSKIILVVLSVRGTRRQLSARDXSYFDYQSLYLGFSFNVNNSIQGLQNQLWAIFMLLILFINITEQIMPMIQTQRALYEARERPSIIYRWTSKTLPVTXGFLHILTYLLKHTYLSNILIELVWQTLMAVLLYFCWYYPVGFVQNTTSDDQAIRGFAVFLFLWVYLLFTSTMAHFAIFWINLPETAGVLTSLLWMLCILFCGRVKTQHADFIVCXPENRVGVSMADLPKFWTFMYRVSPATYLVGGI

SEQ ID NO: 12860 - protein, 1160 aa, Aspergillus nidulans
  unsure (1)..(1160): unsure at all Xaa locations
MSLPQRPGKTSPRREETSAFREPSRRRRRESDSLSNNDPTSPRHHRHHRSHSSRHQHDIDEERAEEGGIRRKRSLVKPERGRMDPSHPNYLYRQKTQNMPTYNPMTGNEPLIHEEGEAETNSTPSMDSKRKDALYGAHGNVNKPMERVPTRHRSKKRKGSRKISKREAAAEKRRRKAMEQVRPPSLWTTYCSVITFWAPDFVLKCFGMPQKAQRSAWREKIGLISIILMIAAFVGFLTFGFTATVCGTPPTRLKINEIGSGYMIFHGQAYDLTKSTHPAAAGIPDMTNVLYDLPHKYGGQDGSFFFQEVNGACKGLITRTENSDIPTNSNGDLAWYFPCHAFNQDGSSEPNTTVSYYNGWACHTSGSARKSFYSLKNSGDVYFTWEDTKNTSRKLAVYSGNVLDLNLLNWFDDTQVNYPTKFKDLRDNDDIRGVDLTYYFQTGEDKQIGKCLSQIIKVGSIDTDTVGCIASQVVLYVSLIFILSIVIVKFAFALLFQWFLAPRFAAQKTSMGAVDSKARNQQIEDWSNDIYRPGPRLADPVPGDRMSKRASFLPTTSRFSSPYTVSNGGKQKPQWVTMASQNSTTRLVPPASGTTPSIYRQSHNGSGNVSVDNSRVNPSASRTSLVQDSRYSTVIPDSEGIGSAGYVHELVVPQPPPDWQPYGFPLAHAMCLVTCYSEGEEGIRTTLDSIALTDYPNSHKSIVVICDGIIKGKGEEFSTPDMVLRMMRDPIIPSEKVEAFSYVAVATGSKRHNMDEVYAGFYDYGEHSIIPVEKQQRVPMMIIVKCGTPAEATAAKPGNRGKRDSQIILMSFLQKVMFDERMTELEYEMFNGLLHVTGIPPDFYEVVLMVDADTKVFPDSLTHMISAMVKDPEVMGLCGETKIANKTDSWVTMIQVFECVLILSSCPVGRXXCYRYFVSHHQSKAFESVFGGVTCLPGCFSMYRIKAPKGGQNYWVPILANPDIVEHYSENVVDTLHKKNLLLLGEDRYLSTLMLRTFPKRKQIFVPQAVCKTVVPDKFMVLLSQRRRWINSTVHNLMELVLVRDLCGTFCFSMQFVIFVELVGTVVLPAAISFTIYVVVSSIIKQPVQIIPLVLLALILGLPGVLVVVTAHRLVYVLWMLVYLISLPIWNFVLPTYAYWKFDNFSWGDTRKTAGRRTRG

SEQ ID NO: 12861 - protein, 224 aa, Aspergillus nidulans
  unsure (1)..(224): unsure at all Xaa locations
VTLIVPFAYLSVLIGSLATFSSLYRKRKASTSRQITLKQIRSNHXPHPPQTGKATSLEPWFPSHLQRDIYFSLLHLDPPASATEKKVAVPESVLKAALLRRAQEDIRRVMTLRSQKQALSVLLQRGSVGDDLWQRFLRAEKEMEDEVRDVVTEVIALFAFSRNFIQXMGYADVTDEQANAYAPNWGQVIFQSANEMVNNEIVRERLDKHQKKLDEEKAWWEKKK

SEQ ID NO: 12862 - protein, 1035 aa, Aspergillus nidulans
  unsure (1)..(1035): unsure at all Xaa locations
VGDIVRVESEQPFPADLVLLASSEPEGLCYIETANLDGETNLKIKQAIPETSHLVSPADLSRLSGRIRSEQPNSSLYTYEATLTMHAGGGERELPLAPDQLMLRGATLRNTPWIHGVVVFTGHETKLMRNATATPIKRTAVERMVNIQILMLVSILVALSVVSSVGDLIIRQTEKDKLTYLDYGSTNPGKQFIMDIFTYWVLYSNLVPISLFVTIEIVKYSQAFLINSDLDIYYDVTDTPATCRTSSLVEELGQIEFIFSDKTGTLTCNMMEFKECTIGGIQYGEDVAEDRRATVEDGVEVGVHDFKKLRQNLESHPTKDAIHHFLTLLATCHTVIPERSEADPDKIKYQAASPDEGALVEGAARMGYKFSNRKPRSVIITVAGQEYEYELLAVCEFNSTRKRMSTIFRCPDGRIRIYIKGADTVILERLHQDNPIVEGTLQHLEEYASDGLRTLCLAMREIPEDEFQQWYQIFDKAATTVGGNRAEELDKAAELIEKDFYLLGATAIEDRLQDGVPDTIHTLQTAGIKIWVLTGDRQETAINIGMSCKLISEDMTLLIVNEDSAEATRDNLTKKLQAVQSQTEAEQMALIIDGRSLTFALEKDMEKLFLDLAVLCKAVVCWYVSHSLPERKALTVASRVSPLQKALVVKLVKRHLKSLLLAIGDGANDVSMIQAAHVGVGISGVEGLQAARSADVSIAQFRYLRKLLLVHGAWSYHRISRVILYSFYKNIALYMTQFWVSLLLVRIVSSXCSQYSFQNAFSGEVIYESWTLSFYNVFFTVLPPFAMGICDQFISARLLDRYPQLYQLGQKGLFFKRHSFWSWIANGFYHSLLLYIVSQLIFLYDLPQADGKVAGHWVWGSALYTAVLATVLGKAALITNIWTKYTFIAIPGSMIIWLAFLPAYGYAAPAIGFSEEYYGTIPRLFTSPIFYXMAIVLPCICLFRDYAWKYAKRMYYPQHYHHVQEIQKYNVQDYRPRMEQFQKAIRKVRQVQRMRKQRGYAFSQADEGGQMRVVNAYDTTRGRGRYGEMTSSRNL

SEQ ID NO: 12863 - protein, 686 aa, Aspergillus nidulans
  unsure (1)..(686): unsure at all Xaa locations
LPVHTIYRVQAALPRPIAYSSCIPAWPSYSDPSSSVMNISISKFASFLIATDLLGGAFQAETFDYVVVGGGTAGVTLAVRLAEASHSVALIEAGTYYEDSWPFAAIPGADVIPVGSDPDAKFGADWGFVTAPQAGADGRRIHFARGKCVGGSXVCLMQVENRIGMLIVERSSASNFMVYQRFVSCLNVTLGMXQHGLTFRRPTKDSMHMWAEAVNDTSYTFENTLPFYLRTVTFTPTDKSSRTANASVQYNAESFGASGGPLQVSYSSFVQSFSTWMKRGMAAIGLSESNDFNNGRLIGYQYCASTIKPGDKTRNSSQAAFLXKGKALPDNLTVHTQRLAKRILFDEHKSAIGVEVANGFGYLSNITASRESSISAGAFQYPQLLMVSGIGPAEQLAKHGIEVISDLQVGQNMWDHPFFALSYRVNVETLTRAANDLLYLGTTFLDYTTKHTGPLTNPVADFIAFEKIPSSHRTAFSAETEKHLAGFPEDWPEVEVCGCMTTLQSHLHRTKTEAIQYMSGAGYVGSFTGLMSTQPKDGYQYGSILGILITPTSGGNITLTSADTSDPPSINPNWLATEADQEAAIAIFKCIRDIFASDGMAPVILGDEYYPGNGTQADAEILRFIQKNVMTLWHPSCTNKMGTKDDPSAVLDSKARVFGVGGLRVANASSFPFLPPGHPQSTVCEL

SEQ ID NO: 12864 - protein, 568 aa, Aspergillus nidulans
  unsure (1)..(568): unsure at all Xaa locations
MGKGKICVAFSGGLDTSVICXSFRFCQLIPRVLQADREHTVKWLIDEGYEVVAFVSNIFNWNLIVCSDTNKLSAADVGQEGKAITLKCPPLLALXHSRLLEDFAAIKEKALKLGAVKAEVVDLRRTCFEKLLNFTKKXNXRSGKQASFVEELCFPAIACNAIYENVYLLGTSLARPVIARAQIEVAKVSLLICNLFLXALTYQLXTAGGCFAVSHGCTGKGNDQVRFELAFYALQPDIKVIAPWRDPRFYERFAGRNDLLAYAAEKGIPVTSTKAKPWSMDENLAHCSYEAGILEDPDITPPTDMWKLTVDPLAAPDKPEDFTVHFEKGLPVKLEYTENGQQKTATDAVDIFLTANAIARRNGIGRIDIVSLLXIDWVEPEANIYXVENRFIGIKSRGCYETPGLTCLRSAHVXVKLVRFPSDKSNLPFIVTLRGLVLDREVRALRDQFVTINYSKVCSALTXLSQCCLRSASSFTTGLYFSPEREFLEQAIPASQKSVNGKVRCRAYKGNMIILGRSSETEKLYDMSESSMDEIGDFAPTETTGFIGVSAIRLKKYGQMKQAAGEKL

SEQ ID NO: 12865 - protein, 273 aa, Aspergillus nidulans
  unsure (1)..(273): unsure at all Xaa locations
YDEEQVRLMDEVCIVLDDDDKPIGSASKKTCSCPSLQPLNPSLPRYHNSXSLIIMEALYCRRRSNIKIVQAHLMTNIDRGLLHRAFSVFLFDSQNRLLLQQRASEKITFPDMWTNTCCSHPLGIPGETGSQLDAAILGVNRAAQRKLNHELGIKPEEVPIEKFEFFTRIHYKAPSDGKWGEHESKSTRGDFGPDWLVGVQWLTKRSLLVDYILFIQADVVLEPNLNEVRDTRYVSADELKEMFKQTNLKFTPWFKLICNSMLFEWWSHLGSPS

SEQ ID NO: 12866 - protein, 434 aa, Aspergillus nidulans
  unsure (1)..(434): unsure at all Xaa locations
TSSAPSTVFPRSHVGFDSITSQIERKLLKRGFQFNVMCVGKSHLSPSSWPDVLDTKPMNRQTGLGKSTLINTIFASHLIDSKGRLTPNEPVRSTTEIQTVSHSGGRSVPSGTSFFNGPTVIEENGVRLRLNIVDTPGYGDQVNNDRWYKTTPVASXLHSGXHVTSWDPIVKYIKDQHSAYLRKELTAQRDRYIQDTRIHCCLFFIQPSGHAXVXKTYRHVLCTRSXLLICFXKVXKPIDIVVLKKLSDVVNVVPVIAKADSLTLEERQAFKERIKEEFAFHNLKMYPYDNDELDDEERAVNARIKVXISLASNXGISVXXYXDIIPFAVVGSEKTIVVNGQPVRGRQNRWGVINVEDESHCEFVSLRNFLTRTHLQDLIETTSQIHYETFRAKQLLALKESSAAGGHTSGSRPISPSADRELSRNSQRVTMNGY

SEQ ID NO: 12867 - protein, 116 aa, Aspergillus nidulans
  unsure (1)..(116): unsure at all Xaa locations
QNRXDSANIXTTDSQPQSNLQEEQKPDPNALIKSQYDNDPLLKSYIPSAPSERIMRALLAEPPLSYNASRAGPPLTGKAPRKFCCICGYWGKIRCRNCHQRTCGIECYKTHEDSRC

SEQ ID NO: 12868 - protein, 397 aa, Aspergillus nidulans
  unsure (1)..(397): unsure at all Xaa locations
PTLAMVPIPRACRLVGLYGRRSYSTAPSPSTRLNLPIDYKSTPLLHHTPSSLANSLNLPPSSTSKSMNLYTAINAALRTALSKSDKVMLFGEDVAFGGVFRCSMDLQTEFGSERVFNTPLTEQGIIGFAIGAAAEGMKPVAEIQFADYVFPAFDQIVNEAAKFRYREGATGGNAGGLVIRMPCGAVGHGALXVSMXRARIREANDPAGYHSQSPEALFAHIPGLQVVIPRSPSQAKGLLLASIFESKNPVVFMEPKCLYRAAVEHVPSEYYTIPLNKAEVIKPGNDVTIISYGQPLYLCSAAIAAAEKNLGASVELIDLRTIYPWDRQTVLDSVNKTGRAIVVHESMVNFGVGAEVAATIQTGAFLRLEAPVQRVAGWSTHTGLTYEKLILPDVTSE

SEQ ID NO: 12869 - protein, 544 aa, Aspergillus nidulans
  unsure (1)..(544): unsure at all Xaa locations
LSPRQLNVAVQVFSLICIFFEGYDQGVMGGVNAAPYYVTEVGIGKPDGTVTDTTHQGGIVSIYYLGCIFGCFAGGWLADRIGRINGLFIGAVFAVIGGALQAAIQSSDFMLVARVVTGVGTGGTYLISPYALLVMGLCXSNSATGITPVLVSETSSADHRGGFLGYVFIANCMFLAXFPLVLDAPHTDPADLGISVAYWLSFGLAFINNGYSDIRWRFLLAFQCVPAILLVFFIKMLPDSPRYYASVGRNEEARDMLTRLRSHKASQAEIEQEYMEIVAVAQDSKPSSPDPVYQDLDRQERAAGKQSQPTGLVVCVASDYGFVDRYHGMRILPGRIVLAKPRQAVTAYSPTLLSQAGYSSLTQNGLAGGLNTIGIVGTIISAQIVDRIGRRMCLMLGALSLFIVEVIVSLPLLSEXTPYXSAKAGSVYEASLHNPEKAADYAPAAVAMLFLFNLAYASTWGTVAFLVPTEIFPSDLRAQGNGFGITGWAIGVGMTTLVNPIMFASLKSRSYFLLAGFNLLWIPIVYLFYPETRNRSLESIDALF

SEQ ID NO: 12870 - protein, 316 aa, Aspergillus nidulans
MPAKMHSNYPSDSETAELRDSTESGYVSGGSSEEYLPEIVFTKPHLQFLNRQLQFLEPQGQLFHIFSSRQRRLTPLADVLRWCVTSLPHLYQTTAFGLTGLVIMDMLSKLSIPRPQMVNLIFLDTLHHFPETLKLVDNVRKRYPLQHIHVYKPQGVETEEEFAKKHGERLWEKDDQLYDWIAKVEPAQRAYRELNVHAVLTGRRRSQGGKRGDLDIIEVDEAGLIKINPLANWTFDQVKQYVKENDIPYNELLDKGYKSVGDYHSTSPVKENEDERSGRWKGQAKTECGIHNPRSKYAQYLMDMERSDRRKLCLKR

SEQ ID NO: 12871 - protein, 481 aa, Aspergillus nidulans
  unsure (1)..(481): unsure at all Xaa locations
MAFFTVALSLYYLLSRXDLYNICLLSXIGTYLYRVSTQAPVVQNHSCNTADGGYQCFPNVSHVWGQYSPYFSIEQESAISEDVPHGCEVTFVQVLSRHGARYPTESKSKAYSGLIEAIQKNATSFWGQYAFLESYNYTLGADDLTIFGENQMVDSGAKFYRRYKNLARKNTPFIRASGSDRVVASAEKFINGFRKAQLHDHGSKRATPVVNVIIPEIDGFNNTLDHSTCVSFENDERADEIEANFTAIMGPPIRKRLENDLPGIKLTNENVIYLMDMCSFDTMARTAHGTELSPFCAIFTEKEWLQYDYLQSLSKYYGYGAGSPLGPAQGIGFTNELIARLTQSPVQDNTSTNHTLDSNPATFPLDRKLYADFSHDNSMISIFFAMGLYNGTQPLSMDSVESIQEMDGYAASWTVPFGARAYFELMQCEKKEPLVRVLVNDRVVPLHGCAVDKFGRCTLDDWVEGLNFARSGGNWKTCFTL

SEQ ID NO: 12872 - protein, 221 aa, Aspergillus nidulans
LLAGTGAQVLLTGRSQPPIDSAKDQLGDKAHVVQCDITSLSNIEKLVEESKFVFADQIDFLFINAGYACLEPVAAVTEESFHRTINTNVFGAFFVAQKFIPLIRDGGAIVFTSSVSTKHGFPGLAAYSASKAAVSSLVQTLAAELVDRQIRVNAVCPGFIKTPTMGVSGVTPADLVAFGEEGEKLTPLARNGTPEEVAKAAVFLAFDATFTTGTDLAVDGG

SEQ ID NO: 12873 - protein, 455 aa, Aspergillus nidulans
  unsure (1)..(455): unsure at all Xaa locations
LQQNNXRRLLXVDPSASEAQLRSAYKKGALKYHPWXVTIXTRAKWSDRYPNVLCADKNPNNPEAAETFKEMSKAYEVLSDPQKRNIYDQLGEEGLEGGGGAGGMGAEDLFAQFFGGGGGFGGMFGGGMRDQGPKKARTIHHVHKVNLEDIYRGKVSKLALQKSVICPTCDGRGGKEGAVKTCAGCNGSGMKTMMRQMGPMIQRFQTVCPDCNGEGENIRDKDRCRNCHGKKTVVERKVLHVHVDRGVKNGHKIEFRGEGDQLPGVMPGDVVFEIEQKPHPRFQRKDDDLFYHAEIDLLTALAGGTINIEHLDDRWLSVTIAPGEVITPGKSFSFRARSARNSRGTNVTQLXVSSKVIKGQGMPSYRHHDHGNLYIQFDVKFPENHELRNLELLEQVLPPRQETNRPPADAMVEDFDLEEVDNSERSQARAHGAASMDEDDDDVPPGAERVQCASQ

SEQ ID NO: 12874 - protein, 298 aa, Aspergillus nidulans
  unsure (1)..(298): unsure at all Xaa locations
PQSQPXKHRTISSLSSQPTPTSKQTINPASTKSTQASMHPKQNIQSFGISYSPYNADNTCKSQEQVNMDIDRLTHYAFVRIYGADCDQAKKVITAARRHNLQVLAGVYDLHNLYGNLKTIIDAARPDLSTLHTISIGNELLSRGQNSAGEVTAAVENARAYLRTLGYTGPVVTIDTFSKVLEHPELCYVSDYCAANCHAFFDATQSPETAGSYVADVSRRLSEVSNGKRTLITESGWPHKGQSNGKAVPSKENQQKAIESLRKTFWDNHSDLVLFSAFDDMWKVDNQWTFGAEKYWGI

SEQ ID NO: 12875 - protein, 441 aa, Aspergillus nidulans
  unsure (1)..(441): unsure at all Xaa locations
VDTETMLQFYQRLFPFRYLFQWLNHGIVPSPDFGNREFALTLQNDAYLRYQSYPTADLXVGAHEVTWMIFXHLQCRFRKDILKMNPSRFEIGPVYNRNPRDRKTLGSGQLKPLAKELVFDIDLTDYDDIRTCCTKANICAKCWAFVTMAIKVVDTALRQDFGFQHILWVYSGRRGAHAWVCDSRARNLSDDRRRGIAGYLDLVRGGTNSGKRVNLKRPLHPHMTRSLEILKPYFVQTTLVDQDTFASPEQEQRLLSLLPDKGLNDSLRRKWESAPDRSSTNKWADIDALAKAGKSSTLNPATLREAKQDIVLEYTYPRLDSEVSKKMIHLLKSPFVIHPGTGRVCVPIDIRNVEKFDPLSVPTVSQLLSEIDSWDSDHPSSGAAETAEGEGSAPNASDAGGTRKLQDYEKTSLKPYIDYFRSFIAGLNKEERNGKRERHED

SEQ ID NO: 12876 - protein, 524 aa, Aspergillus nidulans
  unsure (1)..(524): unsure at all Xaa locations
ADPTNHITKAQARTITKRLAHVFRSEFGIGADGPGKDAVMCISANQVLLPAVFCGIIGAGGVYTAASTALTASEVSKQLRQSRSKVIVACPENRAKARDAARECGIPPDRVLVLESMGHRRLLCQGNFGRNYLQATAELDWERIADIDALENTTICLLYSSGTTGPPKGVMLSHMNLVSEALFTQLVLRDSKEGKPHLNVPYRTVGHLPTAHIAGCLGCFITPAVAGGTVYWMPRFNIDEFIDYCKKYAVTFLSTAPPVYHGIVRSDRVTDQFKTLVRAESGAAPLSLELQEQAEKMLGCTISQRWGMTESTGSVTTMPWGQSDNTGGISPLLPNMRLRLVDERMRDVRSGDEGEILLKGPMITKGYFENPEATAEAFTTDGWYKTGDIGVYKDGKIIMVDRKKVSTXASPSKXTANPRPELIKYKGLQVSPVEIEGFLLTHPGVADVAVVGARDPEAPGNELPRAYVVIKAGSSVSEAELKEYVKSNLAGHKQLRGGVVFIDEIPKSASGKILRRILRDQARS

SEQ ID NO: 12877 - protein, 174 aa, Aspergillus nidulans
  unsure (1)..(174): unsure at all Xaa locations
ALVHYDYEKAEDNEVDLREGEFVTEIEMVDKDWWLGSNAQGERGLFPSNYVELLEDGRQSRAESDTRPADAHESEALADPTPTSGSHVKPTAKALYDYEAAEDNELSFPEGAEIINIVSQQLPPSLLSTVLTKYSVPRVKIINYLVLQXEFPDDDWWLGEFRGKTGLFPANYVQ

SEQ ID NO: 12878 - protein, 503 aa, Aspergillus nidulans
  unsure (1)..(503): unsure at all Xaa locations
KKTQFATPTFKQQDYPYRLNFYDTPPTAEITLEQFEQWAIDRLKSANLDLYFCMTCCXLXIVLAEIEACSYRNKTAAETTAHITPLLQKFLPLSANTSSPKGAADPRIKNERQKDHYSHFILRLAFSATEDLRRRFARAETMLFRFRFQADDSRERRAFIDSLNLDWESVGEDERRELSEYLVAATPGLRRSDEDTWYKVDWERVPELVERRSVFLSKGKAYVPEREQLSMIIAEFTARLERALEVCEFSLQLSTNIELITTSSQSRALPRLDEDDRLSPILNHLSKNFGSAESVYTEGEGFVDGAPITAASIDPLSQHFPLCMRSLHMSLRKNNHLKHFGRLQYTLFLKGIGLSLEECILFWRQSFKGFTDEEFNSRYKYNVRHAYGDVGGDINRRGRGYPPYSCQKILSDTNPGAGQTHGCPYRHFSVDNLIGLLQSTGVNDKDLLRGVREDVEKTRYHIACNRVFEYTHKAEIKRAKEDGSAGEIELDTIVHPNTYFKRS

SEQ ID NO: 12879 - protein, 508 aa, Aspergillus nidulans
FLSNEFVPSKASTWYDLYDTASNSLVSRVPQSTDEELRAAVEAAQKAFPAWRATSIMARQQIMFKFVNLIRANLRKVCLRRITLEQGKTLCDAKGDVLRGLQVAETACGITTQITGEVLEVAKDMETRSYREPLGVVAAICPFSMFSRTRLFMANANESRLPAMIPLWCIPIATITGNTMVMKPSERDPGAAMILAELAREAGFPPGVINIIHGSAKTVDFILDAPEIKAISFVDGNRAGEYIYTRGSANGKRVQANLGAKNHAAVLPDANKNQTINAIVGAAFGAAGQRCMALSTLVTVGETKEWLPEMAERAKALNVNGGFEEGADLGPVISPESKKRIEDLIASAEEEGATILLDGRGYKPEKYPNGNFIGPTIITGVTPGMKCYKQEIFGPVLVCLEVETLDDAIELINKNEYGNGAAIFTRSGPTASRFQKDIEAGQVGINVPIPVPLPMFSFTGNKKSIAGGGANTFYGKPGLQFYTQQKTVTSLWRAEDAVSTKAHVVMPT

SEQ ID NO: 12880 - protein, 890 aa, Aspergillus nidulans
  unsure (1)..(890): unsure at all Xaa locations
LPPYIEELLILINFPSRLIQEIIRVRLSYARNMKDPAQQSPILVDQMITQFQILMRAAVDIKQRYLDIARPEPGWDLPPCIDESFDSVVLDALRYYFRLLNWKLQANKNTFKEAEILEQEWDFCNEIGRQLDSGDIEVAEQFRXGQHCPTXCYYANFYSVLTARAIHRLLIHFERELHVQEDEDPAELDKRFKGILDSTRIRQRKLYRFSRFLRQLFENASEYNLPADISWDFFEALFVSDHFLIKSNASSAQKGVYYFAHPALWNRPDEIAAILGTSFREEEVGKELTHVPYVLAVRPEKPLSWAGKEMQVELVEQPTDLRLGKLRLIVEGSQQRLVNARLELTHLTGIQLDMAIEQRANLSRVNAELNRIKKISFKLSMTIMDSVAILRRQLREKGVENTELIQASYAFATEFGKRSSNVDPNRRAMNSARLAELSLDWVSFICDDCDAADRKTFKWAVAALEFAMAITSSRHLLSMDDAHFARLRQKVAGCMSLLISHFDIMGARSSRAAQAEKQRMDESARSWKIGAGRILTDEEAMRLVREQRLISLNAIEEGRVEADAKRQALGRVLEGTNEADKSLAVLSSSATNVTLRWQQGQYIGGGTFGSVYAAINLDSNYLMAVKEIRLQDPQLIPKISQQIRDEMGVLEVLDHPNIVSYHGIEVHRDKVYIFMEYCSGGSLATLLEHGRVEDETVIMVYALQLLEGLAYLHQSGIVHRDIKPENILLDHNGIIKHVDFGAAQIYARHGKTFSAYGRPRPPEEXRWHXPXRQPGRTQPGQEQKTMTGTPMYMSPEVIRRRHQQARTPPGRRSISWSLGCVILEMATGRRPWLSLDNEWAIIYNIAQRNQPALASRDQLIDLGLDFRRLCYECDPMKRPTAAELLQHEWI

SEQ ID NO: 12881 - protein, 517 aa, Aspergillus nidulans
  unsure (1)..(517): unsure at all Xaa locations
SMTAPHGLQSSGSVKSKRGSRPSAGTTSQRSSKTHSLLSVGAAVPGTDMEASPSQSRSSSAEGSYSTSATTFDEGEPASTKSKETKGNVIVSVRVRPNVGGESSANPEWIVDARRGLLVYNGKEGGDTTMVRPLSCEISAPANXLLDNVFSAMENNARVYDSAAKRLVRRVMEGYHGTVFAYGMTGTGKTFSMQGTATSPGVIPLAITDIFSFIRETPHREFLLRVSYLEIYNEKIHDLLSASTGSSSEDIKLREDSKRGVYATPLKEEIVQSPTQLLRVIARGDHARRTGSTQFNARSSRSHAVVQIVVESRERVPTGTTQDRRSGLAPGGVRVSTLSLIDLAGSERAADDKERRTEGAHINKSLLTLGNIISRLSETKGKTAADKDGKHLPFRDSKLTRLLQPALSGNSLVSILCTVQLSSLVASETLNTLKFAARAKNNIVSHAKRAEEAFGGGGGDAGSRVLLERYRMEIQDLGCQLENQTKAQAEKELKLEKKKLDQEAQERHEEQMLEMQL

SEQ ID NO: 12882 - protein, 53 aa, Aspergillus nidulans
RAMYDYDADDHTSLSFRQGDVIQVLNQLETGWWDGVINGNVRGWFPSNYCAVI

SEQ ID NO: 12883 - protein, 765 aa, Aspergillus nidulans
SLAKDGVRVGVVNVRVYRPFVEEEFLRVLPKSVKTVGVLGQVANEQAVQEPGVRSTLYEDVLAAVTFATDREQAPSCIDIKYARSQRWDLINIAASFQLVSDKPIVQVDSTVEPLQLLDPATVQEFTFWDVDTSAAVDVATIISQTLAADSASNITTSKAFDNLIQGGVVRVDIRKSSKTLDAPYPVNAADTAYIGNVKLLSELDILSSVKNNGKVLLNVAGIKGDELEKKLPAAFKQAIAERGIGLHRFDASVIEEPALEPLALQVAFLHVALPAIEESAVKKLAAISGNADSLDKVSKDLEKTLLQAEIPESWKSPEEGAEVAQLVKDLKPNSFVPFDKDESEPATFLKDWQTVAKGLAFKEAYGAQNALRPDLPTKTFTVHVKENRRLTPVTYDRNIFHIEFDLGDSGLTYDIGEALGVHCENDPEDVLEFIKFYGLNADDVVEVPSREDPTVLENRTVYQALMQNVDIFGRPPKRFYEALAEFASDEKEKKDLLTLGGPEGAVEFKRRAEVDTVTYADILLEYPSAHPDFHDLVRIVSPLKRREYSIASCQKVTPNIVALMIVVVNWVDPRGRDRFGISTRYLSRLQPGTPVTVSVKSSVMKLPPKSTQPIIMAGLGTGLAPFRAFVQHRALEKAQGKEIGSVLLYMGSRHQREEYCYGEEWEAYQEAGVITLLGCAFSRDQPQKIYIQDRMRETIPEIVQAYIREEGSFYLCGPTWPVPDVTAVLEEAIAIEAKNTGKKIEPRKEIEKLKDEERYVLEVY

SEQ ID NO: 12884 - protein, 299 aa, Aspergillus nidulans
MRRLTQNADSVVSLWCLAHCRPLCSLIAHLVLDNAALSRIVADRLHVQDPSFQQTNRLACLLYNGAEGPLLTICRVSTVMSASITTLRYLGHMHNDLVGHIASLIPTPRSHFLLTSYTPFTGDNIDQAKTVRKTTVLDVMRRLLQPKNRMVSINPSKSSCYISILNIIQGEADPTDVHKSLLRIRERRLASFIPWGPASIQVALTKKSPYIQNTHRVSGLMLANHTSVATLFKRIVQQYDRLRKRNAFLEQYKKEAPFQDGLDEFDEARAVVMDLVGEYEAAERENYLDPDAGKDEVGV

SEQ ID NO: 12885 - protein, 440 aa, Aspergillus nidulans
  unsure (1)..(440): unsure at all Xaa locations
QIFADDVIEEKGENARLSAFVGAIAVGDLVKSTLGPKGMDKILQSAVSGGCADRGVSRLTVCRSTGEILVTNDGATILKAIALDNAAAKVLVNISKVQDDEVGDGTTSVTVLAAELLREAEKLVNRKIHPQTIIEGYRIASRAALDALDKVAVDRSDDMEKFRKDLHSIARTTLSSKVLAQDRDQFAALACDAVLRLRGSTDLSHIQIIKKAGGKLSDSYLDEGFILDKKIGVNQPKRLENAKILVANTAMDTDKVKIFGARVKVESTGKLAELEKAEREKMKAKVERIKAHGINCFVNRQLIYNWPEQLFTEAGIMSIEHADFDGIERLALVTGGEIALTFDHPDQVKLGSCDLIEEVIIGEDTLIKFSGVAAGQACTIVLRGATEQLLDQAERSLHDALAVLSXTVKDPRVTFCGGCPRMVMFKVASMFSKHHGRRTL

SEQ ID NO: 12886 - protein, 633 aa, Aspergillus nidulans
  unsure (1)..(633): unsure at all Xaa locations
TLGELLTLQSLQYGDYECLVFPWTGARWTYADLNDEADRVARGMLAMGIKKGDRVGIMAGNCEQYISIFFAAARVGAILVVLNNTYTPSELYYALDHTGTDSWFSNFFFLNGTQNTDHVXDCRLLFLTPRINKHSLEDVLAELGPHPKASGTSKALEEIVVIRGTYKDFTTYAQVIERGLPLPPNTLPERESQLQTEDVCNLQFTSGSTGNPKAAMLTHQYVPDHQPPPDPKPNGRXLTCASSNLVNNSRFIGDRMNLTSFDILCCPPPLFHCFGLVLGMLAVVTHGSKIIFPSETFDPLATLHAISDEKCTALHGVPTMFEAILSFDKPPNFDCSNLRTGIIAGAPVPRPLMKRLFEELNMRQYTSSYGISPGHLKPYKARLINCTGLTEASPTCFNALTTDSIETRLQTVGKVMPHAKAKIIDANGAIVPVGTRGELCMAGYQLTKGYWNNPEKTAETLVTDEEGTVWLKTGDEAVFTPEGYCTITGRFKDIIIRGMHSSPSSPIIPHPNLVFRGXCXRWSCLGGENIYPLEIEERLTAHPSISLSSVIGIQDSKYGEVVGAFIALAEGAKRPSDDELRAWTRETLGRHKAPQHVFVFGEEGVDATVPVTGSGKVRKVDLRKIAAVVLERR

SEQ ID NO: 12887 - protein, 422 aa, Aspergillus nidulans
  unsure (1)..(422): unsure at all Xaa locations
DGWNLYYHLGGYGPWIEKLDGPTQDIKPPAGCHVDQVHMVVSTSNAFHXYIFXPQNKWRRHGERYPTKNAGSRGLRIDFTGLRRIQISNASPGHLDLLERIKEANVTLNGSLSFLNNWDYFTSTPEEDFDQLTRTGPYSGMLGAFTTGTRLLTRYHHLLSSQSNFTFWASDCQRVIQTAQYFALGLLGLNWGDIGRAKLEIIPETFDRRADTLTPGDTCLRYLEDTENGHDKGMNMLALFQQSYAPAIAERLLFEQGNSALRALTNMDIFSMQEMCGFETLVRGSSPWCDVFSREDWENFEYARDLVHYYRAGPGNPYAGAMGWLWLNATAGLLQEGPKAGPLFFSLXVXLYPTSLXGFIVNACWLASTTGDIAPFLEALDILKDPKYDPELPATYRADDRVWKTSSVLPMGGRIILEGITC

SEQ ID NO: 12888 - protein, 523 aa, Aspergillus nidulans
  unsure (1)..(523): unsure at all Xaa locations
DVEQQRLGNKEASVPEMDSNSDMWAIDEKAEKKLIRKMDLYILPFVVLLYLFSFLDRGMLSGHVHANPLTLHHVQSNIGNARLYGLEEDLGLVGDQYQVAVSILFVTYCCVLNPSXSDDLHLTINGRQLFEVPSNLVIKKRYPSRYIAAIAIIWGVIATLTGITQNYGGLIACRLLLGVVEAGLFPGLMTYLTLFYSKHEIALRTGYLFSSAALAGACGGLLAYAIGFMDGVSGLKGWRWIMIIEGIPTVIIGIATWFFLADDPETAYYLNAEERALVVKCRSRHFGHTASAQKFHWADVKEGALDWRIYAFCIAQFGVDTMLYGYSTFLPTIIKGLGDWSVPEVQALTIPCYALGAVAYLIVAWFSDRTQRRGLFICVFAAISVVGYGILISDSSSGVHYFGALLVALGLYVAVGLPLAWLPTTLPRYAKRTFATGLQLTFGNVSGVMSPFLYKTEEGPRYVRGNAVTLALVGFAGIIYGIMWAYYLWKNKRREQGFEDEKAAGKTDEEIEEMGDMSPRYRY

SEQ ID NO: 12889 - protein, 308 aa, Aspergillus nidulans
  unsure (1)..(308): unsure at all Xaa locations
FRPATFARSYATVESAHARGISTSALAHASGTDWMCWTPYPTXRRPRSTDEPRLPSEKRKMHTYELDLKKTGPMMLNAFIRIKNEIDPTVAFRQSCREGMCGSCAMNIDGVNTLACLCTGRQNDSSLDMQQELTMAGRIPTDATKESRIYPLPHTYVVKDLVPDLTQIYKQYKSIKPYLQRDTKTEDVRTFDSVKVXNDXPFQGLENRQSPEDRKKLDGLYECILCFCCSTSCPSYWWNSEEYLGPAILLQSYRWLADSRDQKTAERKHAIDNSMSVYRCHTILNCTRTCPKGLNPARAISEIKKMLA

SEQ ID NO: 12890 - protein, 684 aa, Aspergillus nidulans
  unsure (1)..(684): unsure at all Xaa locations
CDECRLRKSRVFHSFRVILPWHEPNRXXCSKEKPTCAQCKQLDKECKYSPKITRSPLTRQYVCIXTVTPRLSSSLMPVLTLASRHLTYVEDRLQAFESALGRLFPGGDLDATVRSLLQDQDPLSKERSSSKSSSRHSTPAKTEADRHESAPEALPQQADGFDWAENRITLGDLTDGMAALSIKPEGAGYFGIRSIPTRFSTXCXSSFLGASSSVVPLRALLKHGFDLNIPSGSSKRVDNSDRVPLKSQLLNIAPSGVIEQAFMDAFFNNYHMSYPFVHEATFRAQFHEQLPRPHGPAWQILLNTILALGAWCIGDDNSDLDITFYQEARSRLQQMSVFEAGNLTLVQALLFLSNYAQKRNKPNTGWNFLGLAVRMSMSLGLHKEFHGWKISLLQREVRRRLWWGVYIFDSGAAKTFGRPILLPEDSVMDVKHVLNIHDEALTSTTTVVPPEVNEPTLYTGMLAQAKFHILTNSVYQRLISGPNPTPEETLSLQKPMEEWYNSLPDYIKNPAPGSMSDNFALVRSRLLWRDWNLRILIYRPILLRWASKRWTPNTPTEPEDPYEAECRMLCFRNAKLTISSITDFVNNYPCTRVGAWYMCAFPYFTTNXFSRCDLNXHSLPRYSYFLFQAGLIPIILLMTDPTSAEAPSWIQEIEATKALLMYPSLSNNNLAGRCLDVIYRLCAP

SEQ ID NO: 12891 - protein, 394 aa, Aspergillus nidulans
  unsure (1)..(394): unsure at all Xaa locations
SPHLDLLLXQCLGDKVHRPPIWVMRQGMLLSISPQAPSVLNTPYIDEWSTNSFDSCAGRYLPEYHEAKGNRDFFECCRDPEIASTITIQPVDRYEGLIDAAIIFSDILVIPQAMGMTVEMVDKKGPHFPEPLRSPTDGQYEKVMARDVDVKAELDYVYKAITLTRTKLNGRVPLIGFCGAPWTLLCYMVEGGGSKMFIQTKTWIYKYPKESQALLQKIAEICVEYLALQVAAGAQLVQVFDSWAGELSPASFQDFSLPYLRHISANLPRRLKEMGLEPVPMTVFAKGAWYALEDLCESGYNVVGLDWLHDPAEAFKIANGRVTIQGNADPGVLYGGREAIKQAVETMVAGFKKGKQGWIANLGHGMLFIRLYHADANFLGVTPFVNPDDLKIYF

SEQ ID NO: 12892 - protein, 201 aa, Aspergillus nidulans
  unsure (1)..(201): unsure at all Xaa locations
GQFLESVSPYVWANIGIAMCIGLSVVGAAWYDMTQXTARSRFLTTISRGIFLTGSSIVGGGVKAPRIRTKNLISIIFCEVVAIYGVIMAIVFSSKLNLATGDEIHSPSSYYTGYALFWGGITVGACNLICGISVGINGSGAALADAADSQLVSSASSCISGGQRLMFYRFVKILVVEIFSSVLGMFGLIVGLLVQGKATEF

SEQ ID NO: 12893 - protein, 174 aa, Aspergillus nidulans
  unsure (1)..(174): unsure at all Xaa locations
TVGKTSLITRFMYDSFDNTYQATIGIDFLSKVSRTRSAXGQLAGSSRALWRLRSMEMLTSGVVTMYLEDRTVRLQLWDTAGQERFRSLIPSYIRDSSVAVVVYDISNAKSFQNTRKWIDHVRGERGNDVIIVLVGNKTDLSHKREVTTAQGEEEAKKKGLMFIETSTKDGHNVK

SEQ ID NO: 12894 - protein, 617 aa, Aspergillus nidulans
  unsure (1)..(617): unsure at all Xaa locations
EGHPRFSFNKRQLPADATGVKKFKTPNGVTIRYKEPGKEGVCETTPGVNSYSGYVDLSPESHTFFYFFEARHDPANAPITLWLNGGPGSDSLIGLFEGLYCLTGLQEVDVLMGFLXELGPCAISENLTTYVNPYSWNEVSNLLFISQPLGVGMKELCLVXSCSFSLGHRIFVCGNRGRVAQSRHRCGRGXFFRWRPGSLSQNQRYPDRXFLQQRALSXFRAKAVLDTTELAAKATWEVVQGFLGGLPQLDSTIKSKDFNLWTESYGGHYGPAFFNHFYEQNQKIRNGTIDGIELNFNSLGIINGIIDEGIQVRDRQAAQQYLSDXKLGTFLPXVCGAQHLRHQSREYCLFSKWTTXLTSXKQVNETVYNYMKFANEMGNGCQDQIALCKATNRSSFADYALCSEATNMCRDNVGTYFYLRLWESNQLIIFHRGTPTTGYEQLEAYMDIRHPHNVSRXSXSRFSILTXEKDPTPPNLFVPFLQQDWVMNASWVNINYTSSNNEIYYAFQQTGDFVWPNFIEDLEEILTYPVRVSLIYGDADYICNWFGGQAVSLAVKYPHSKQFQAAGYTPLLVDGVEYGETREYGNFSFSRVYEAGHEVPYYQPAASLQLFNRTLFG

SEQ ID NO: 12895 - protein, 585 aa, Aspergillus nidulans
  unsure (1)..(585): unsure at all Xaa locations
SYALGNVAPNIQAFSDASAAATKILGTIERESPLNPMSTEGGKLTSVRGEIELRNIRHAYPSRPEVMVMDQFNLRIPAGKTTAFVGPSGSGKSTIIGLLERFYKPVAGAVLLDGHDIESLNLQWLRQQIALVGQEPQLFTATIYENIKYGLIGSDFEKESEREIRARVVKAARVAYARDFINKLPDGYETNIGSLALSGGQKQTIAIARTIVKEPKILLLDXATCALDTKSAGLVHAALNRAAEGRTTTDIAHPLSTINNTHNVRLMKGGRIGERRTHWLWLHKNGVYARLVQAQSMKECGDYDYGRDKELGILWLEEDDSDLNDYGTDGGDGTDMQARLWKRESAMFPGTAGPKSRRFSLWTLVKFIASFNKKEKYIMGLGLTLSLFAGGVQPAQSVLLAKAVNAISTPVSQPEKLRHDTNFWASMFLMTGLVTIFLFGTQGTLFAFSAEKLIRRARSSTFRVLLGQDITFFDEEDNTAGTLTSMLATEIKNLAGISGATLGTLLIVTVNLFGSLIVAYALGWKLALVCSSAVPLLLLSGFLRTWILSRFQARGRTVYQKSASDVSERVTAIRTVVSLTMEQVI

SEQ ID NO: 12896 - protein, 338 aa, Aspergillus nidulans
  unsure (1)..(338): unsure at all Xaa locations
DLTGNDEYARLSQRAEDYLLHPEPAQYEPFPGLIGSAVNIADGKLANGHISWNGGADSYYEYLIKMYVYDPERFGLYRDRWVAAAESSINHLASHPSTRPDVTFLATYNEEHQLGLTSQHLTCFDGGSFLLGGTLLDRQDFVDFGLDLVAGCHETYNSTLTGIGPEQFSWDPNGVPDSQKELFERAGFYINSGQYILRPEVIESFYYAWRVTGDGTVRSLSAASVGRPYXPLXYREWVWNAFTNINKYCRTATGFAGLENVNAANGGGRIDNQESFMFAEVLKYSFLTFAPGTFPXFWFTCGEYYXLQQEDDWQVQKGSGNTFVYNTEAHPFKVYTPQ

SEQ ID NO: 12897 - protein, 457 aa, Aspergillus nidulans
  unsure (1)..(457): unsure at all Xaa locations
MAPSAIDPPTSTSLPSSISSYRGYDHVHWYVGNAKQAASYYITRMGFKRIAYRGLETNSRAICSHVIRNGDITFVLTSPLRSLDQISRFTPEEQDLLREIHHHLEQHGDAVKDVAFEVDSVDAVFNAAVANGAKVVKGLTTVEDENGKVTMATIQTYGQTTHTLIERGAYRGTFLPGYRVETSLEDPISALLPGVLLNRIDHCVGNQDWNEMDKICEXYVLSLTKKNMYRGXXEQLEKALGFHRFWSVDDKQICTXVTFKANVTATMLIRSSEFSALKSIVMASPNDIVKMPINEPAKGKKQSQIEEYVDFYNGAGVQHIALLTDDIIRDITNLKARGVEFIKVPDTYYEDIKIRLKKAGLTLHEDFETIRALDILIDFDENGYLLQLFTKVTTHSHMNLPICKVTESXPMKRALMDRPTVFIEIIQRHNFSGFGAGNFKSLFEAIEREQALRGNLV

SEQ ID NO: 12898 - protein, 121 aa, Aspergillus nidulans
  unsure (1)..(121): unsure at all Xaa locations
TLSANRFLQRQRMQTDPPAGVSASPVADNVMTWYFLLIIIVSRGFXSGRXNAVIIGPADTPFEDGTFRLVMHFEEQYPNNAPGVKFISQMFHPNVYGTGELCLDILQNRWSPTYDVAAILT

SEQ ID NO: 12899 - protein, 560 aa, Aspergillus nidulans
  unsure (1)..(560): unsure at all Xaa locations
GELVALMGPSGCGKTTLLNVLARRAASSGAKSSGHCYVNGGEVDNATFGRITSYVEQEDALIGSLTVRETLKFAADLSLPGYVISVTTXNXLMILSMFRFVSRSERVERIHTLLESFGIQNQASTLVGTPIRKGISGGQKRRVSVASQLITCPKILFLDEPTSGLDSTASYEVISYVRKLARANRLVKCFCWPVQYXLAKLIIIASIHQPSTATFQLFDKLLLLSSGKTCYYGPVKQVPSYFGSIGYPIPPQTNPAEFILDIVSSDFMSEKNSMRNDVEAIQSAWSQSPESSRLKQQRTEFAEKGSRRVVVDEASRPGLLSITISLLHRLLIKSYRDVVAYGIRIVMYMGTFSSHIIFKYINMCRFGDHDGYCLAYVWGRSRSISSLSSMQLCVGSPTLSTTQLTSIQFFGSAFMSFMAVAYVPAYLEDRATFTKERANGLYGALPFIISNFIIGLPFLCTSAQRPQIPRPIRLSTQSPPRXHRNPIVLISILFSIVSYWLSNFRPSAPAFFTWVMWLFLDLVAAESLVVLVTSIFPNFVIALALVAFANGLWMSVGGFL

SEQ ID NO: 12900 - protein, 570 aa, Aspergillus nidulans
  unsure (1)..(570): unsure at all Xaa locations
KGYFXWEPXEDTLRDFNPLYQHRHEANFFGRGRLAGFGDDVADSVAKKYAKALEDRDREAGSIRAREILEMERRRREESTRNQLDKHWSEKKLEHMRERDWRIFKEDFNIATKGGSVPNPMRSWDESGLPKRLLELVDRSGYKEPTPIQRAAIPIRMQSRDLIGVAVTGSGKTAAFLLPLLCYIAELPRIDEFEWRKNDGPYAIVLAPTRELAQQIEIEAKKFTEPLGFNVVSIVGGHSFEEQAYSLRNGAEIIIATPGRLVDCIERRMLVLSQCCYVIMDEADRMIDLGFEEPVNKILDALPVTNEKPDTEEAEDSSAITRHLGSKDRSRQTHDYTATMPTAVERIARKYLRRPAIVTIESAGEAVYTVEQRVEMFAGEDKRKKRLDQILSSGAFKQPIIVFVNIKRTCDSIARDIKQWGFSSVTLHGSKTQEQRETALASVRNGSTDVLVATDLAGRGIDVPDVSLVINFNMATSIESYTHRIGRTGRAGKSGVAITFLGNEDADVMYVSSLLAYYTTMLTVTGTISKQMLIKSPISRVPEELRKHEAAQSKPTRGAGKKIEEASGFA

SEQ ID NO: 12901 - protein, 439 aa, Aspergillus nidulans
GLGQSKMSFCDDREVRLDSANKKIWLSLTCCCVDIYSIALTTLSSLMKKYNIDPNSVGRLEVGTETLLDKSKSVKSVLMQLFAPHGNTNIEGVDTVNACYGGTNALFNSINWVESSAWDGRDAVVVCGDIALYAKGAARPTGGAGCVAMLIGPDAPIIFEPGLRASYLTHAYDFYKPDLTSEYPVVDGHFSLRCYTEAVDACYKAYGAREKTLKEKTQNGTNGVTHDESKTALDRFDYVLFHAPTCKLVQKSYARMLYNDYLANPTHPSFAEVAPELRDLDYETSLTDKNVEKTFMGLTKKRFAERVRPGLDVATLCGNMYTATVYAGLCSLLSNLTFDPSQPKHIGFFSYDSGHASSLFSAKIVDDVSYIVEKLNLHKRLESRTVLSPTDYEAMCELREHAHLAKDFKPSGNPDTLFPGTYYLTEIDGMFRRKYETKA

SEQ ID NO: 12902 - protein, 353 aa, Aspergillus nidulans
MSSTTHSPIPPTMKSWLYSSTQPSVISNLSFTASAPSPPLPSYANQLLIKVFTTSLNPADHKVPQHATIPFTGGRTLICGLPASPGLDFAGKIVSVHPKNRTEFEPGQLVYGCLARPRTFGTTGEYILADANDVAHLPEGVSVDDAACLGVAVRTAYQSLKNYLDLSKFEGGSGPRVFINGGSGGCGVFAIQIAKMLGCQVTTTCSGRNIELVRDLGADEIIDYTTTNVTETLKTKGLVYDHVIDHIGLPGNLYAECHHFLKPSGVWVQVGAGSILTAFWRAITPRFLGGGRRWFVPLMMANSKEDLVEVGNLLKEGKLRTVKDGNRVWEFGDVKKAYELLASGRARGKIVIR

SEQ ID NO: 12903 - protein, 579 aa, Aspergillus nidulans
  unsure (1)..(579): unsure at all Xaa locations
MRALGLVGLVGVANAVCPYMTGELGRRDTNPDATEATEEFLSEYYLDDTDSYLTTDVGGPIEDQQSLKAGARGSTLLEDFIFRQKIQRFDHERVSDXGLFNCRLKRWMLTAQVPERAVHARGAGAHGVFTSYGDFSNITAASFLSAEGKETPVFVRFSTVAGSRGSSDLARDVHGFATRFYTDEGNFDIVGNNIPVFFIQDAIQFPDLIHAVKPKGDREIPQAATAHDAAWDFFSQQPSTLHTLLWAMAGHGIPRSFRHVDGFGVHTFRLVTEDGSTKLVKFHWKTLQGLASMVWEEAQQISGKNPDYMRQDLFESIEAGRYPEWEVWYPLFLLHSEDVYXPDSLNVQIMDEEDQLRFGFDLFDPTKIVPEEYVPLTPLGKMTLNRNPRNYFAETEQVMVGFLLPLLYPSLCRFXQXQFQPGHVVRGVDFTEDPLLQVRRRATNFFVFFTXADSKQGRLFSYLDTQLNRNGGPNFEQLPINQPRVAIHNNNRDGAGQMFIPLNPDAYSPNTLKGSTLKQANQTAGRGFFTAPDRTANGNLVRAKSSTFDDAWSQPRLFWNSLLPAEKQFVVNAIRFATA

SEQ ID NO: 12904 - protein, 1067 aa, Aspergillus nidulans
  unsure (1)..(1067): unsure at all Xaa locations
QSVFTLLPLLAQLPSGGASLPNNHGRVENCVRNHDGIHKFRHSNNTYQSMFPGVTWDEDQWVLTTSSLDQGHYQSRGSVANGYIGISVSSVGPFFELDLPVAGDVINGWPLYSRRQSFATISGFFDIQAETNGSNFPWMNQYGGESVISGVPHWSGLILDLGDDDYLDSTVDNVTLSDFKSSYDFKAGVLSWSYTWTPAGDKGSYAITYRLFANKLNVNQAVVDMEITPSQDGHATIVNVLDGYSAVRTDFVESQEDDGAIYSAVRPWGIPDVSAYFYANITGSKHVDLSSRRLIHGKPYVSANESSIAQAADVIFVANEKVRITKFVGAASTDAFPDPQATAKRAVSEALDAGYQRSLRSHVQEWASIMHEDSVDRYVNPTTGKLPDDDNIINSAIIAVANTYYLLQNTVGKNAIRAAQDAPLNVNSFSVGGLVSDSYAGLVFWDADVWMQPGLVASHPEAAQAVTNYRTKLYPQAKKNIETTYTGSKNATYIDPSAAIYPWTSGRFGNCTGTGACWDYQYHLNGDIGLSLIYQWVVSGDTNTFREKHFPIYDSVAALYGSIVERNGSYWTLTNMTDPVSFTAFAMQSAPLTIVDEYANHIDAGGFTMPMISETLEYANQFRQQFGLEPNETWTEISENVLVLRENGVTLEYTTMNGTAAVKQADIVLVTYPLATDNYTAETALTDLDYYANRQSADGPAMTWAIFSIAAGAVSPSGCSAYTYHQYSYAPYARAPFFQLSEQMLDNASINGGTHPAYPFLTGHGGANQVVLFGYLGLRLLPDDAIHIEPNLPPQIPYVKYRTFYWRGWPISAQSNYTHTVLQRSQSAPLDTADRRFANTSIPVFVGLADNATLHHLPPHGPXLVRNERSGTNNTVEVNLIQCSPVSSTVAFEQGQLPISVVDGTASTRWQPSSSNASAVTVNLGSTTGRSVQTVASGFHFDWAAAPPVNASVIFHDTPLSDPVAALSSPGPHVRIVANLTNIEQSGPYDPEATDLNEIKIPVGNTTRIELAQEVPVGRYATLVISGNQALAQADGEDHVGATVAEWAILGPKSGSPRRRIQPVPLL

SEQ ID NO: 12905 - protein, 310 aa, Aspergillus nidulans
  unsure (1)..(310): unsure at all Xaa locations
MRHACSTFGFFYLVGHGIPEEDRLQILKCTKRYFDLPMEEKMETWIGKAIGRSFRGYEPPALQVHQEGLLPDTKEVGARRPGNQTGYXSXKGFILGRETPADAPEAGTFHTGPNQWPKTLPDEEFRVPIMRYHAKMIEMVKVILKILALGLPAEWNCPSDVFDELTINPSAPLRLLYYAPQPVKHENQFGGMASINFFTPAVMLXKLIRDPVGAHTDFGNVSVLLQEEDSEGLEVFYPPTQTWVPVPAKPHSYVINMGDMMQKWTAGYYRSALHRVVNSNTKPRYSAPFFMNGNLDVKCYAWTDLEKXLP

SEQ ID NO: 12906 - protein, 263 aa, Aspergillus nidulans
  unsure (1)..(263): unsure at all Xaa locations
RCVVVGDGAVGKTCLLISYTTNKFPSEYVPTVFDNYAVTVMXVDFCVFAVTPRFDFRRLPASTRSAMRKEYSSPGFFVRTSGLILPILLSTLLIAVLWNRIGDEPYTLGLFDTAGQEDYDRLRPLSYPQTDVFLVCFSVTSPASFENVREKWFPEVHHHCPGVPCLIVGTQVDLRDDPAVRDKLARQKMQPIRKEDGDRMAKDLGAVKYVECSALTQYKLKDVFDEVGLSXVSLRARDXLKPSQAIVAALEPAPKKRSRCVLL

SEQ ID NO: 12907 - protein, 364 aa, Aspergillus nidulans
  unsure (1)..(364): unsure at all Xaa locations
QMXWSFSGHASFAHLKPVKCLVEPDEKYDIAIIGAPFDTAVSYRPGKSTLQYITSYVSILMRSRARFGPRAIRAASARQMAGTSYNTRAGINPYSSWATIKDCGDIPITPFDNGLAERQMYEAFLELGTRSPVTPASSEYGSKGISAGKSKLVTLGGDHSVALPALRALYQIYQKPITVLHFDAHLDTWNPVRYSAYWQSEQSAFNHGSFFHKASREGLICNSTSAHAGLRTRLTGIDDSDYTAPGTPEQGFMRIHADDIDELGGPMGVVNKIMERIGLDLDQPVYLSVDIDVLDPSTAPGTGTPEPGGWTTREFIRILRGIEKLNIVGADIVEVSPSYDNKGETTALAAAQVAYEIITSMVKN

SEQ ID NO: 12908 - protein, 471 aa, Aspergillus nidulans
  unsure (1)..(471): unsure at all Xaa locations
SGQYXTTTYTTGVRRTWKRLLDGHCGIVNIRHRDARYADLPCEIAAVVPSGARAEGRWTASEWLSKDVCLTPGQYWVWCEKLIKWXQDERKMARFAQYAMAAAEEALEDAEWKPKAEDQLEATGVCLGSGIGNFDEIYDAVVAYDTKGYKKLSPLFVPKLLINLGAGHISMKYGFMGPNHSATTACTTGAHSIGDAARFIACGDADVMLAGGAESCIHPLAIGGFARARSLATAYNDRPEKSSRPFDADRDGFVVGEGAGIVILEVTHPELAQNLGTDPTFXELEHAKARGARIYAEVKGYGCSGDAHHMTAPKANGGGALLAMKKALKNACLEPSAVDYINAHATSTVIGDAAENAAIKALLLGPGGKQKAADVNVSSTKGAIGHLLGGAGAVEALFTVLAIHEVGLTFXFCGTANCLLNVMPPTINLDRLNDGFDFNYAPNEAQERRIDLALTNSFGFGGTNSSLCFSK

SEQ ID NO: 12909 - protein, 339 aa, Aspergillus nidulans
  unsure (1)..(339): unsure at all Xaa locations
YLAHWLAVEGVQPSIPQNPTAADSRNLELMSKGPNANATLAAMSGNGNVAVKPLVKHVLSKELQLYFEKVCNAFLDESSEKYRTSGYASLREDPGLHQLVPYFVQFISEKVTHGLKXFFVLTQVMHMAEALVQNKSLYVDPMYDFSSTYISQLYXRTADRLTGPSILTCLIGRQLGGTADLSEQFALRDLAAALLGLIATKYSHSSHTLKPRLARSCLKTLLDPSKPFGAHYGAIIGLHAVGGSEAVRVLIIPNLPIYGNLLKDGLADDSARRPEAEKVLGLLLGILTALKEEKPVLTNGHGPGMVSEDIKRRLEGKLGAFVAEKVAELGDARVAHAIL

SEQ ID NO: 12910 - protein, 624 aa, Aspergillus nidulans
  unsure (1)..(624): unsure at all Xaa locations
DCISISLLRPRDYSLLSSSLIFLYSSVFSPSAGFRSSRXSFPSFFSLLSSSSLRKQPLFPHSTIFTEASTLPPTTTPTMPITIPPAEAPAIAPVPSPDPSSGQREYRSMAYFVNWVRPRLSFLLPQYRLLTLFHHKXAIYARHHNPQDLPVSHLTHILYAFANVRPETGEVYLSDTYSDIEKHYPTDSWNDQGNDNVYGCVKQLFLLKQQNRHLKVLLSVGGWTYSKNFARMAATEEGRRLFAKSAVELMGDLGMDGVDVDWEVSFACLRHEVGQNEGXYDRMPAVPENDDQASDFVELLRETREVCLPIISSTYQSXVGNAHKLNPGTRPYAADNDSDKPFLLSVASPAGASFFPPISQXPXVPYPNLPLQNDQLTEPGPSKYTTLHLSSMDRYLDFWNLMAYDYSGSWDTITGHNANLFASRQNPASTPFNTHTGGNAYLAAGIPASKINLGMPLYGRSFTHTDGPGTEFEGVGYEGSFEAGVWDYKALPKPGAEVVEVEEIAASFSYDEDKKEVISYDNVGVVRHKGVYLMRLGMGGGMWWESSGDREVGSGGSLIETVSLPFYRLLYLALVHMVWKTKGGCXYDGWVQLVDTLGGVNALDKSENQLEYPASRFENLRNGF

SEQ ID NO: 12911 - protein, 389 aa, Aspergillus nidulans
QKKKQTFITRTIWTFVMIAGFFIAMFSGHIYIIGLVTAVQIISFKEVIAIANVPSKEKNIRFTKSLNWYFLGTSMYFLYGESVIYYFKHILLVDRVLLPLASHHRFISFVLWIMGMFHLYEGIAHANLIGFVFFVASLQKGHYRFQFTQFAWTHMALYLIVVQAHFVMNNILEGMIWFFLPASLVITNDIFAYVCGITFGRTQLIQLSPKKTVEGFLGAWVCTIIFGYFMTNILMRYKYFICPVNDLGSNVLTGLECDPNPVFVPQAFEIPEWTGFGRTFYVAPMQFHILLFATFASLVAPFGGFFASGLKRSFKIKDFGESIPGHGGITDRMDCQFIMGFFAYMYYHSFIAVFKASVGDIIEAAINGLTVDEQLEVLRGLSKYLYNQG

SEQ ID NO: 12912 - protein, 353 aa, Aspergillus nidulans
GLISTYGAFQEFYQTVLLPDQSPSSISWVGSLQATLVVMVGVVSGPLVDLGYLRPLIISGSFLVVFGMMMTSLATQYYQVILAQGFCVGIGGGIAYIPALVVISMYFTTKRPIAIGCASIGSSVGSVVFPIMFRQLQPKIGFPWTVRCIAFINMFLAVITCTMLCRRPGEKVGARSLIDWKALKDIPFMLLSVSMLLVMLGYWIPLFYVPSYARTVLNTTTSLSFYVVSIINGASAFGRTVPYLLGSRVKPIGILISCVAGSAIAMFTWIAATNIPGFIVWSCYWGFLTGVLVTAPTSIVSHPSLCPDLKMLGTRMGMMWGISSLGSLAGTPIAGALVDLTEAQFLRAQVFAG

SEQ ID NO: 12913 - protein, 529 aa, Aspergillus nidulans
LENHLGPVESVVFSPDGKQLVSGSYDDTVKIWDPATGELLQNKDGHSGTVESLAFSPDGKLLASGSYDNTIDLWDSPTGELLQTFEGHPHSIWSVAFAPDGKELASASDDSTIKIWDLATGELQQTLDSHSQSVRSVAFSPDGKLLASSSLDSTIKVWNPATGELQQSLEGRSGWVKSVAFSPDGKKLASGSEKNTVKLWNPATGELLQTLEGHSQSVRSVAFSPDGKQLASSSSDTTIKLWNSTTGELQQTFKGHDLWIRAVAFSPDGKHLVSGSDDNTIKLWDLATSELQQSLEDHSRSVHAVAFSPDDKQLASSSLDSTIKLWDSATGELQRTLEGHSQGVRSVTFSPDGKLLASNSYDGTIKLWNPLTGELQQTLTGRSDWVDSVAFSPDGKQLASGYYDSTIKLWDSATGELLQTLEGHSDRIQSVVFSPDGKLLASGPTNKPARFWDPATGELLQIFEGHSKWVESVAFSPDGKLLASSSYGETIKLWDPVTGELLQTLNDPDESAGSVAFSPDGNRLASVDI

SEQ ID NO: 12914 - protein, 293 aa, Aspergillus nidulans
  unsure (1)..(293): unsure at all Xaa locations
MSLAGKVALITGASKGIGRATAQRLASEGASLVINYNTDAASAQALVDEIGQDRALAVQADASKLADIDRLVDAAVAKFGKIDILIPNAGILPMRDLEHTTEEDFDFTYNLMVKGPYFLAQVGSXFAYSCSFQSCSILCCFCSIFTPFIVVHELVVFFMLFGYPGSCLTGTEAAKHIPAGGRIILVSTGVTVLSNIAPAYLLYASAKAAVEQMARVMAKDLARNGILVNCVAPGPTTTGLFLNGKSDQMLKMVAGFSPFNRIGEPEEIANAVYFLCSKDSSWVSGQTLRVNGG

SEQ ID NO: 12915 - protein, 272 aa, Aspergillus nidulans
VYKGRNCQTGEMVALKEIHLDSEEGTPSTAIREISLMKELHHDNILSLYDVVHTENKLMLVFEYMDQDLNYYMDTHANHGQLEPAIVKSFAFQLLRGIAFCHDNRILHRDLKPQNLLINSKGQLKLADFGLARAFGIPVNTFSNEVVTLWYRAPDVLLGSRTYNTTIDIWSIGCIIAEMFTGRALFSRTTNEDQLQKIFRVMGTPSERTWPGVSQFPEYKSDFPVYPPQDLRQVVPRIDPYGLDLLRCMLRLQPDLRISAVDALRHPWFNDV

SEQ ID NO: 12916 - protein, 425 aa, Aspergillus nidulans
  unsure (1)..(425): unsure at all Xaa locations
KDYRYIKLQEEYIKDEQRFACRRGFAKPLTDLIKXELKRELVRAQEEIKRIQSVPLVIGQFMEAIDQKTTVILVVKAQANVGPSTGIVQSSTGSNYVVRILSTLDREKLKPSSSVALHRHSNALVDILPPEADSSIAMLGENEKPDVTYADVGGLDMQKQEIREAVELPLTHFDLYKQIGMFSSVYYNASFQFXLSFSVXVLDPPRGVLLYGPPGTGKTMLVKAVANSTTASFIRVNGSEFVQKYLGEGPRMVRDVFRMARENSPAIIFIDEIDAIATKRFDAQTGADREVQRILLELLNQMDGFEQTSNVKVIMATNRADTLDPALLRPGRLDRKIEFPSLRDRRERRLIFSTIASKMSLSPEVDLDSLIVRNEPLSGAVIAAIMQEAGLRAVRKNRYNIIQSDLEDAYSAQVKTGQEADRYVF

SEQ ID NO: 12917 - protein, 626 aa, Aspergillus nidulans
  unsure (1)..(626): unsure at all Xaa locations
GTDASQGKGQILSNINACVAVQSTVKSTLGPYGGDLLLVDSNGKQTITNDGATVMKVRLLLVGVRHKEKFADGLSAVXLLDIVHPAARILTDIARSQDAEVGDGTTSVVVLAGEILKEVRELVEQGVSAQTIVKGLRTSSAMAVNKVKEIAVDMIDAAGSEEKKIETLRRLAATAMNSKLIKRNSDFFTKSEXSGCRPECVGHGNNXPLLVVVDAVLSLDQDDLNEKLIGVKKVTGGGLQDSLFVNGVAFKKTFSYAGFEQQPKSFKNPKIVCLNVELELKSEKDNAEVRVEQVSEYQAIVDAEWQIIYNKLEAIYKSGAKVVLSKLPIGDLATQYVYADASLGAXFXRSSXIFADRDVFCAGRVASDDMDRVCQATGAAVQSTCSDIQDRHLGTCGSFEERQIGGERYNLFSECPKAKTVTLVLRGEAEQFIAEVERSLLDAIMIVKRALRNTTIVAGGGATELELSGYLHRYADQTVPYKQQAVVKAFAKALEVIPRQLCDNAGFDATDILNRLRVEHHKGNTWAGVDFDHEGVRDNMAAFVWEPSLVKVNAIQAAVEAACLILSVDETISESSXHVLTLLRNKSLTSTTENQEFAAPQAPSRGLPPGAAQRALGGGRGRGMPR

SEQ ID NO: 12918 - protein, 1943 aa, Aspergillus nidulans
  unsure (1)..(1943): unsure at all Xaa locations
MSGYPQGSGYQHGNYDDGYDHQGHGDAYYQDDHHAQAGYYDNQDYGDGYYDRGXLPFILKTCLAFVLIFFLVGYGDHGYQHDGYYDAGHHDDYYGDQYYAQGGQGRGRHGRDSEEESETFSDFTMRSETARAADMDYYGRGDERYNSYTDSQYGHGGYGYRPPSSQVSYGGNRSSGASTPVYGMDYGNGLPAGQRSREPYPAWASDGQVPVSKEEIEDIFIDLVNKFGFQRDSMRNMYDHLMTQLDSRASRMTPNQALLSLHADYIGGDNANYRRWYFAAHLDLDDAVGFANMKLGKADRKTRKARKAAKKKAQENPEDVEGTLEALEGDNSLEAAEYRWKTRMNRMSQHERVRQLALYLLCWGEANQVRFLPEALCFIFKCADDFYNSPECQNRVEPVEEFTYLNEIITPLYQYCRDQGYEILDGKYVRRERDHNQIIGYDDMNQLFWYPEGIERIVLEDKTRLVDIPTAERWTKLKEVNWKKVFFKTYKETRSWFHLVTNFNRIWVIHLGAFWFFTAYNAPTIYTKNYRQQLNNKPPGAYYWSAVGFGGALVSFIQIMATIFEWMYVPRRWAGAQHLTKRLLFLLLVFVINLAPGVVVFGFSSVLPGKVPLVVGIVHFFIALATFFFFSIMPLGGLFGSYLKKHGRQYVASQTFTASFPRLKGNDMWMSYGLWVCVFGAKLAESYFFLTLSIKDPIRYLSPYHVHQCAGVKYIGDKICYYQPQILLGLMFFMDLTLFFLDSYLWYIICNTIFSVARSFYLGVSIWSPWRNIFSRLPKRIYSKVLATTDMEIKYKPKVLISQVWNAIIISMYREHLLAIDHVQKLLYHQVPSEQEGKRTLRAPTFFVSQEDQSFKTEFFPRGSEAERRISFFAQSLSTPMPEPLPVDNMPTFTVLIPHYSEKILLSLREIIREDEPYSRVTLLEYLKQLHPHEWDCFVKDTKILADETSQFNGDYEKNEKDAAKSKIDDLPFYCIGFKSAAPEYTLRTRIWSSLRSQTLYRTVSGMMNYSRAIKLLYRVENPEVVQMFGGNSEKLEHELERMARRKFKICVSMQRYAKFTKEERENTEFLLRAYPDLQIAYLDEEPPANEGEEPRLYSALIDGHCELLENGMRKPKFRIQLSGNPILGDGKSDNQNHSIIFYRGEYIQVIDANQDNYLEECLKIRSVLAEFEELTTDNVSPYTPGVASSSEAPVAILGAREYIFSENIGVLGDVAAGKEQTFGTLFARTLAQIGGKLHYGHPDFLNGIFMTTRGGISKAQKGLHLNEDIYAGMNAMVRGGRIKHCEYFQCGKGRDLGFGSILNFTTKIGTGMGEQMLSREYYYLGTQLPLDRFLSFYYAHPGFHINNMFIMLSVQMFMIVLINLGALKHETINCNYNSDLPITDPLMPTFCAPLTPIINWVNRCVISIFIVFFISFVPLAVQELTERGLWRMATRLAKHFGSFSFMFEVFVCQIYSNAVHQNLSFGGARYIATGRGFATARIPFGVLYSRFAGPSIYTGFRLLIMLLFSTSTTWTASLIWFWVSLLALCISPFLFNPHQFAWNDFFIDYRDYIRWLSRGNSRSHASSWIGFCRLSRTRITGYKRKLLGVPSEKGSGDVPRARITNIFFSEIVAPLGLRAGTLVPFPYINFWTGVSADVDGGNDPSRAILRIAIVAFGPIGINAGVAAVFFGMACCMGPILSMCCKKFGAVLAAIAHAIAVIILLVIFEVMFFLEHWSWPRCVMGMIAMAAIQRFVYKLIIALALTREFKHDQSNIAWWTGKWYNMGWHSLSQPGREFLCKITELGYFSADFVIGHLLLFIMLPALCVPYIDKFHSVILFWLRPRXRPLIYSVVDSXSLTLKSSRQIRPPIYSLKQSKLRKRRVVRFAILYFAMLILFLVLLIAPLIARNQDLNLKMSGILLELMQPLDSNNNDTMTSYTGSGVPKGMEPIACPSSYLTNLNN

SEQ ID NO: 12919 - protein, 304 aa, Aspergillus nidulans
  unsure (1)..(304): unsure at all Xaa locations
PIDYICGMPSKGVRSALIDAFNYWLKVEEAKLENVKELGGFFHNAXLILDDIEDCSPKRRGQPATHVLFGHSQAINSANYMFIQAVRATRSFHNPEAMDILLEELENLYLGQSWDLQWKYNLTCPSIDDYTNMIDNKTGGMFRLLLRLLQNEAGPGGGYGCDQAPGLSLLLDRLTTQFGRFFQIRDDYMNLRNSSYAQQKGCCEDLDEGKFSYPIVYCAAKYPDFKVLISGVFRQRPASATMNVQPLPAEIKQYVVEFLSXRETFQHCRNHLIHLERLIVKTIGEIEDVTQDTNPVLRLLLEDL

SEQ ID NO: 12920 - protein, 1704 aa, Aspergillus nidulans
  unsure (1)..(1704): unsure at all Xaa locations
GKSTLQNEILGDLGIEFGSTPEKPEDTPLDELGASMQATFSGQLGKQSSSLIARLVSSKMPGGFNITAVRKYLETRWGLGPGRQDGVLLLALTMEPASRIGSEPDAKVFLDDVANKYAANSGISLNVPTASGDGGASAGGMLMDPAAIDALTKDQRALFKQQLEIIARYLKMDLRDGQKAFVASQETQKTLQAHVDLWQAEHGDFYASGIEPSFDPLKARVYDSSWNWARQDALSMYYDIIFGRLKVVDREIVSQCIRIMIRSNPLLLEFMQYHIDNCPTERGETYQLAKELGEQLIENCKEVLGVSPVYKDVAVPTGPQTTIDARGNIEYQEVPRASARKLEHYVKQMAEGGPISEYSNRAKVQNDLRSVYKLIRRQHRLSKSSQLQFNALYKDVVRALSMNENQIMPQENGSTKKPGRNGSVRNGSPRAGKVETIPFLHLKKKNEHGWDYSKKLTGIYLDVLESAARSGLTFQGKNVLMTGAGAGSIGAEVLQGLISGGAKVIVTTSRYSREVTEYYQAMYARYGARGSQLVVVPFNQGSKQDVEALVDYIYDTKKGLGWDLDFIVPFAAIPENGREIDSIDSKSELAHRIMLTNLLRLLGSVKAQKQANGFETRPAQVILPLSPNHGTFGNDGLYSESKLALETLFNRWYSENWSNYLTICGAVIGWTRGTGLMSGNNMVAERVEKLGVRTFSQQEMAFNLLGLMAPAIVNLCQLDPVWADLNGGLQFIPDLKDLMTRLRTEIMETSDVRRAVIKETAIENKVVNGEDSEVLYKKVIAEPRANIKFQFPNLPTWDEDIKPLNENLKGMVNLDKVVVVTGFSEVGPWGNSRTRWEMEASGKFSLEGCVEMAWIMGLIRHHNGPIKGKTYSGWVDSKTGEPVDDKDVKAKYEKYILEHSGIRLIEPELFKGYDPKKKQLLQEIVIEEDLEPFEASKETAEEFKREHGEKVEIFEVLESGEYTVRLKKGATLLIPKALQFDRLVAGQVPTGWDARRYGIPEDIIEQVDPVTLFVLVCTAEAMLSAGVTDPYEFYKYVHLSEVGNCIGSGIGGTHALRGMYKDRYLDKPLQKDILQESFINTMSAWVNMLLLSSTGPIKTPVGACATAVESVDIGYETIVEGKARVCFVGGFDDFQEEGSYEFANMKATSNAEDEFAHGRTPQEMSRPTTTTRAGFMESQGCGMQLIMSAQLALDMGVPIYGIIALTTTATDKIGRSVPAPGQGVLTTARENPGKFPSPLLDIKYRRRQLELRKRQIREWQESELLYLQEEAEAIKAQNPADFVVEEYLQERAQHINREAIRQEKDAQFSLGNNFWKQDSRIAPLRGALATWGLTVDDIGVASFHGTSTVANDKNESDVICQQMKHLGRKKGNALLGIFQKYLTGHPKGAAGAWMFNGCLQVLDSGLVPGNRNADNVDKVMEKFDYIVYPSRSIQTDGIKAFSVTSFGFGQKGAQVIGIHPKYLYATLDRAQFEAYRAKVETRQKKAYRYFHNGLVNNSIFVAKSIAPMEAKLQSKVFMNPDYRVAADRKLSELDYPPKPPVATDAGSESTKAVIESLAKAHATENSKIGVDVESIDSINISNETFIERNFTASEQQYCQNAPSPQSSFAGRWSAKEAVFKSLGVCSKGAGAPLKDIEIENDSNGAPTVKVRSLNMFHVQFYIXANDFXLHGVAAEAAKEAGVKHISVSISHSDMQAVAVAISQF

SEQ ID NO: 12921 - protein, 340 aa, Aspergillus nidulans
LEGHSDWIETVTFSPDGRLLASGSNDTTIKLWDPASGGLKQTLEGHSSSVQSVAFSPNGQLLASGSSDTTIKLWNSASDSLKHTMEGHSDRVESVAFSPNGQVLASCSENTTKLWNPAIGSLKHTIEGHSDWALSVAFSPDGQLLLSGSAEKTIKLWDSATCGLKHTLGGHSNWVLPLVFSPDGRLLASGSNDATIKLWDPPSGSLKHTLEGHSNKIESLAFSPNGQLLASGSSDATIKLWDTATGSFRHTLKGHSDMVLSVVFSPDSQLLESGSGDNTIKLWDPATGILKHSMRTPGIVRSIEFSIELPQLITNLGTFSIQAWHTGYPSRSSGKKTAVS

SEQ ID NO: 12922 - protein, 190 aa, Aspergillus nidulans
IDEPGFVDLLVKRYPNGKASTHLHSLKPGDNLFILASIPGFNWTPNKFSHVYLIAGGAGITPIYQLAQGILDNPADKTKITVIFGVNTEKDMLLREEFDAYQRAYPDRIDVLYTVSRPGSEFRPAPNVRSGYVTRQVLAEVMGGPDEADTKIFVCGPPAMEKALVGGGFGQGQPGILQQLGYPRDRIYRF

SEQ ID NO: 12923 - protein, 272 aa, Aspergillus nidulans
LKSQPDEDTTTGIKALLAHEASPTFPAKIWHKCGPKGVNEHAQKLMDLWLEKNPHLRHELLTDESADQYVRENYADWPDVLETYMALQVPILKADFLRVLILYADGGIWSDLDVQDEVPVSECIPATSTEDTEDPVNVGGGIKFDGWQFTSWTIMAKPHLLHFKNVIEYVVKQLKTTAIENHVSLSQVTKAMVGEVVAVTGPQAITMALLQSVSEETGQDITKQHIRQLKEPKLLGDILVLPQAAFAALQGGNPTDQGPYLVSHQYAGSWKN

SEQ ID NO: 12924 - protein, 494 aa, Aspergillus nidulans
  unsure (1)..(494): unsure at all Xaa locations
ALLSERGVSTGDFVAVFTTNSPEMVAIIYALSKLGAVAALININLRGMNLLVSYMIEAHRSECRXYIRHCLNVSGSKLIISTPDLAQFVCSDMPHLSFNISSFDGISTASDLITPADLQQYSSSNLTAAKRTPADLSALIYTSGTTGKPKACAIRNMMTLITSTPHSQDVKHPSRYFPLRIYCSLPLFHGTAYFTGLCASVGYAGTLCIRRKFSASKFWKDVHDSRATRILYIGELCRYLMATPASPYDQNHACIVASGNGLRGDIWERFRERFNVPEIREFYRSTEGVAKYDNFGFGSWGAGKVGFSGPIKRFFEDDTVIVKYDPDTEMPYRDPKTGFCVRVRVGEEGEAIGRVRNRGLLTEYLKNEEATEKKLLRDVFEKGDLFQRTGDLFVQDSDGWIKFQDRVGDTFRWKGENVSAGEIRDHISAIPGVYDAVVYGVRLGAYDGQAGAAGITLEEHTEAAANEFMGKLRAELKKKGVPSYAIPRLVRLTE

SEQ ID NO: 12925 - protein, 509 aa, Aspergillus nidulans
  unsure (1)..(509): unsure at all Xaa locations
MSSPQQRLSSISNQLSGSSAAASREKLLAKNPDDVVCLLRIMGEFYVSRFGGRVITLAVRTPLTKARKGGLKDTRLDDLLISLLTVCWEISHPPGLLVXSNGWNRVVRERSKLDPNLVEDVCVGNTLCPGQAYVARSAVLAAGFPITTAASVANRFCSSGLLAIQNIANQIIAGSIDIGIAVGAESMSTNADGGAPDLSEAILSHPIASQNTQPMGQTSENVAGQFGIAREQHDQFAAKSYQKAERAQKAGWFEDEIVPVKTQIKDPKTGEIKSIIVDRDDGIRYGTTAESLGKIRSAFPQWKPSNTTGGNASQITDGAAALVLMKRSRAQELGQPILGKFAGATVVGLEPRIMGIGPTYAIPKILSKFGLTNNEVDIFEINEAFASMVHSPLVVVCGGNHXYSTGRLCVQKLGLDEAKVNPRGGAMXGVSSLXEDCWLTIIVPSVHPLGATGARQVVTALSELRRTNKRVAVTSMCVGTVSTIFSEMHQPFTNGLVVGHGYGGIFVSE

SEQ ID NO: 12926 - protein, 116 aa, Aspergillus nidulans
HVTGPPDSQRNFLVVDAKTENSTIENAFQNFTQERNDIAVLLINQHVCLLVDCLSSSISHTACNILTTSTIAERIRHVIDSYSEAFPAVLEIPSKDHPYDPEKDSVLKRVRRLFGE

SEQ ID NO: 12927 - protein, 209 aa, Aspergillus nidulans
  unsure (1)..(209): unsure at all Xaa locations
AWLYLLAVLINAVNLFLQVFFTIMYSDLEWXAFIYTSNPAALLSNQSATGRWRKFFMVSANLVLSDYINPIDLCNRLNAYIIPEAGVHAFLTFLFVINGYWLAIALNLPLLAFNAKKCVPSSPSLTTSLRALELGSDSLTCRIYDNQHLLDATEIFRKLNVHKKVDLPFTSXGGESRTLTSELXESFIKLGFHLLMFFFYLYSMIVALI

SEQ ID NO: 12928 - protein, 421 aa, Aspergillus nidulans
  unsure (1)..(421): unsure at all Xaa locations
NTLLVAVAAGTAMAAPQLKKRAGFTCTASTFSACXGSLLIXAVFGVTEAGAEFGEKSIPGVWVMPRGPSGCDLGXRTQMQGTDYTFPDTESILTLISKGFNTFRIPFLMERLTPEMTGSFDEGYLKNLTSVRPWLCSSMXDFFXRIRSSNAVTDAGAWAIVDAQNFGRLYAPGLPYRSIYXXTQQRRIISSASDFQTWWKNVAAEFADNKNVIFDTSMSFLFVRRSCFISLVYYSLHGSXSXHVWGRQRIHDMDQTLVLDLNQAAINGIRAAGATSQYIFVEGNSYTGAWTWTDNNDNLKSLTDPQDKIVYEMHQYLDTDGSGTHETCVSETIGAERVESATQWLKDNGKLGVIGEFAGGNNEICRAAVKSLLDALKENDDVWLGALWWAAGPWWEDYMFSMEPTDGIAYTGMLSTLEAYM

SEQ ID NO: 12929 - protein, 308 aa, Aspergillus nidulans
SVAFSPDSRQIAAGFKDGKIFIWDAAGTLQKTLERHPGAIMSIAFSPDVKQLVTCSTDSTIKRWDITIGGVQEAVGHSKHVTTMVLSPDGKVIASGSADKTIKLWDAATGDLQKTLTGHLDTVEKVVFSLDNRQIVSCSSEAVKIWDAATGKVQNSFESDDVFTIVAVSPDGKHIASGHCNGRIKLWDMATGSLLKTMAGYRSKFDSLVTTEVFDIQLQEAIFNTQITGLVFSPDAKLILSTSTDRAIKLWDAATGDLQKRLPCHSDSIITDAFSRSSGYPNWIFSVAFSSDGQHIAAASADKTIRVW

SEQ ID NO: 12930 - protein, 381 aa, Aspergillus nidulans
  unsure (1)..(381): unsure at all Xaa locations
FAGKILQDDKTVEFYNIEEKGFIVCMVSKVXAFQVFLXYNRTNYEIPQPKTQPSSQSPSTPAKSVTSTPAPPPAPAPSTNTSTTATSGPVPATPSPASSGAAQSSASTFNDPSALLTGSQSEEVINQMMSMGFEREQINRAMRAAFFNPDRAIEYLLNVSLVVFQFTXQLLISAFAIKGIPENIQQEQQQRSAATTPAAPQAAAASGAPPATSGEDEPVNLFEAAAQAGEGRGGAGGASGGEPQSLDFLRNHPAFQQLRQLVQQQPQMLEPILQQVGQGNPQIAQLIGQNEEAFLQLLSEEDDAALPPGTTQIHVTEEERDAIERVCFRFLGRSFSLSXLSPSSCRLGFPRDLVIQAYFACDKNEELAANYLFENSDDGDD

SEQ ID NO: 12931 - protein, 856 aa, Aspergillus nidulans
  unsure (1)..(856): unsure at all Xaa locations
LEIDTSKVPEARRPKAATFKFLQAAIQEMAFPQQECFLITDLYGENTIGFTKVIKMVNRVLDILEIQGQLKKPSDTAMAAPAAGRKLTKREHILKELLETERDYVHHLQNLQALKKELEDTGALTGDASHQIFLNLNNLLDFSQRFLIRLEQHYARPEEQQNWGELFIQHEEAFRQYEPFIANQMRCDKTCQKEWDKIQAAPRSPDLQQMVAQPATLNGFFVKPFQRLTKYPLMLSVSISEXLLEFDSILIIRYQELRKQIEDPDLQADISRAIDSIQSVLDAANDAIDKEQLAAAFVELDERVDDWKALKIETFGELLXFGTLTVIKIDNNKDSERXVSKCYTPQSDLRXQLVNMSAITYHIYLFERILLCCKDINPNKQKSRLVGGSKDKPNTSKGKPRLVLKGRIYMANVTDIVWLQKPGKPKFIXQCEPPHGNKDLLGSYRIQIFWKGDPGVVDNFIIRYQNEDTMRKWYKDINTQREIQAEQRSARNTGTSDSEFTYMKSLSNIPNPYQQEYDVEEQSTKEAAFFSEFPMSRNASSTSLRTRSATGGSGSSGPPLSTSRPRYPAMPDSTLSVHTQFPGGSMSPGERNGNSYFSPTESARSSSQSVDTLTIARXPPVTPWGDDNNPYTAPALSRATSRDGSNSGYFNGAPPNGRSAQRPSLPPMSGSNQSSNSAVPEDASASSPDIHHHNPESRRYMGVHTMQTVDNVPVPPIPAHMANMKAPVNRSQNNSPTNQSLPIRTNTSHAFHEPQYSDGRAAAPLSDQPTSPLSHEPEEEPFMPTQLKAKVNFDENYVTLVISSNIGFRTLTDRVDAKLARFTNRSIGSKTVRLRYQDEDGDFVTIDSDEAVQLAF

SEQ ID NO: 12932 - protein, 433 aa, Aspergillus nidulans
FINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGTSIFSGLCRYFVANIRTGLAAAVHTKNVNTAI

SEQ ID NO: 12933 - protein, 417 aa, Aspergillus nidulans
SENQLMVRDAISGICAGFPNTYWQECDQLERDPKEFHAALAKAGWLGIALPEEHGGAGLGMTRVKHQQHIPIARPRLTQKKASSEATIMMQTITQSGAGMAGAQSIHANVYATQPLAKFGNEQQLTETIPNIINGKWRTCFGVTEPNTGLETLALQTRAELNSTGTHYSITGQKIWITCAQVARKMILLARTKPREEVSKPTQGLSMFCIDIDKNEPGLELKKIKKMGGRAVDANEVFFDKYQVPASTLIGRENEGFRMILHGMNAERCLLAGEALGLGYVALERAAEYANTRHVFGRAIGKNQAIAHPLADVYMKLEAAKLATYHAARLYDASRTDESIPAHSVGVAANSAKYLAAEAAFTACERAVLTHGGMGYAMEYDVERWLRECLVPRIAPVSREMILNYVSEKVLGLPRSY

SEQ ID NO: 12934 - protein, 615 aa, Aspergillus nidulans
  unsure (1)..(615): unsure at all Xaa locations
RPPFVCAITGKSYSTKVLVDRVEFLSRSLAQELGWSPNDGGAGGXSCRYLQLEYGRXHSFALLFLCYKLMKKKKXLDFFALCWAVHRLNGICLPLHPFSIVPEVVAHMKRAKCRVIFTCQSLVANTLEAARELSIPGDKIYTTALPEAYLQNPEPIDQFKSVDQLIAEGEKLQRLPPLQWEKGRAKIQVAYYCATSGTSGKQVGGSSREWRXWLTGNLXKLAKITHYNFIANVMQVCMHESYAKNGRNEIAFGAIPLTHGYGLNIGHIMVYRGDTYVICPRFDMQLMLKTIERFRVERLYVVCILRPRNASQTNCAGSPILAALAANPFLLDLHDLSSVQATVTGAAALDRSIAAKLNKLRPTWKINHAYGIVNNPSASXRLIXDKXASTETGVVATLTSPHDVWHGSSGSLLPSFEIRLVKPDGTDAEGLDEPGEVHFNSPSCFLGYVGDDESNKNTFDEKGWLKSGDIGVFRKSPNGHAHLFILERIKDMIKVKVRRFLEWNFKYMSKVNLMNTKQGEQVLPRDIESVLLSHPAVIDAAVIGVPDELSGERAKAYIVRSKTVMEDLDEDDLADEIDEFVQGKLHESHWLHDRIVFLEKLPKSESGKVLKKDLK

SEQ ID NO: 12935 - protein, 372 aa, Aspergillus nidulans
  unsure (1)..(372): unsure at all Xaa locations
NNASLLSHKQTFDMYLANVKKTDDPAVQYEFAVFMVNAMLEMPDDVLEGGKPSISVEKGKTSNDITRSHLLKEAKSILQGLANRSYPFAQYYLADGYASGLFSKGKEDYDRAFPLFVAASKHGHVEACYRTALCYEFGMGTRVEASRAQQFYRQAASKNHPGAMLRMAKACLAGDMGLGKRYREGIKWLKRAAESSDAQYNSAPYELGLLHETGYGDDVFVDPSYAAQLFTKSADLGHVEACYRLGDAYEHGKLNCPKDPALSIHFYTGAAQGGHPLAMMAQCEWYLVGAEPVLEKDEFEAYEWAKQAAELGELSDTVYNNSGXCKTGLAKAQYAVGYFTEMGIGCRRDPLEANVWYVKAADQGDTRAVHRI

SEQ ID NO: 12936 - protein, 358 aa, Aspergillus nidulans
  unsure (1)..(358): unsure at all Xaa locations
LAGGGAGMMEALVCHPLGTEHPIQSHKRKHXQIVLDTIKVRMQLSRRSHGTWCKFPNSLWVGAQLLIXLQVKPRGFVKTGVEIVKKETALGLYKGLGAVLGGIIPKMAIRFTSYEQYKQLLADKNTGAVSSKATFLGTPTLVLIAHYTVRVDAVRYXRVMNSRLAAGVTEAVAVVNPMEVIKIRLQAQHHSLADPLDAPKYRSAPHALFTVIKEEGFMALYRGVSLTALRQGTNQAANFTAYTELKAFLQRSQPEYSNSQLPSYQTTVIGLISGAVGPFSNAPIDTIKTRLQKTRAEPGQSAVNRIMTIAKDMFKQEGASAFYKGITPRVMRVAPGQAVTFTVYEFLKGKLEASNWAF

SEQ ID NO: 12937 - protein, 444 aa, Aspergillus nidulans
  unsure (1)..(444): unsure at all Xaa locations
MKNVVRRKLTGYVGFANLPNQWHRKSVRKGFNFNVMVVGELHIRRSEKESISLTISLGESGLGKSTLVNTLFNTSLYPPKERAGPSHDIIPKTVSIQSISADIEENGVRLRLTVVDTPGFGDFVNNDDSWRPIVENIEQRYDAYLEAENKVNRTNIIDNRIHACVYFIQPTGHSLKPLDIEVMRRLHTKVNLIPVIAKADTLTDDEISMFKKRVXICKVQYFENFSSNKIIPRILADIQHHSIQIFEGPRYELDDEETIAENQEIMSKVPFAVVGANSEVATSDGRKVRGRSYPWGIIEVDNEEHCDFVKLRQMLIRTHMEELKEHTNNHLYENYRSDKLTQMGVAQDPSVFKEVNPAVKQEEERALHEQKLAKMEAEMKMVFQQKVAEKESKLKQSEDELYARHREMKEQLDRQRAELEEKKARLESGRPLEEKGKRKGFSLR

SEQ ID NO: 12938 - protein, 371 aa, Aspergillus nidulans
  unsure (1)..(371): unsure at all Xaa locations
HIEVDPEHNGHLFFWHYQNRHIANRQRTIIWLNGGPGCSSMDGALMEIGPYRLKDNETLEYNEGSWDEFANLLFVDQPVGTGFSFANTNSYLHELDEMAAQFITFLEKWFAVFPEYERDDVCPNLDVCLMMSSKLTCGTXQIYIAGESYAGQYIPYIAKAIQDRNKDIHEKQSSSARWNLRGLLIGNGWISPAEQYPAYLSFAYEEGLVEEGSKLGKELETLLSICKSKMETGPKISITDCEAVLNKLLDKTVDSNNQCINMYDIRLRDGSCGTTWPPDLVDVKPYLHTYEVIQALNISPEKESGWDECDGNVGAAFRPQKSEPSVKLLPGLLESGIEILLFSGDKDLICNHVGTEQLISNMKWAGGTGFE

SEQ ID NO: 12939 - protein, 411 aa, Aspergillus nidulans
  unsure (1)..(411): unsure at all Xaa locations
KTPNDIVLLSAVRSPITRAFKGGFRDSHPEDLLIPILQASLQRANISPDSVNDVLIGNVLAELGFAKTGRTALNAAGFNPTKTTFHTVNRQCSSSLQAITHIAHAIAVGQIEVGIAGGVESMSRNYNPARGIPRDVSPLLKECGVKEATDCLLPMLVTSENVAKRYGVGRTEQDQFAAESQRKAVVAQEEGRFSEIVPVRARRLSSETENETFEFVDRDDGVRQGVTVEKLAALKPVLEGGASTAGNSYVFLPMPLFYANTXSSASQISDGASITILASRAWAESHGLRPIARFAGTQVAGCAPDEMGIGPIDAIKRLYKHSGVSQSDVDIFELNEAFASQSIHCIRELGIDMAKVNPNGGAIALGHPIGATGARQTATLLAELARSDKEVGVVSMCASTGMGVASLFIRE

SEQ ID NO: 12940 - protein, 344 aa, Aspergillus nidulans
  unsure (1)..(344): unsure at all Xaa locations
SDEIVWQVINQQFCSYKLKYVPTVELIFHHQKLPFNXFSFLKPIDXXFSYHQTTKGQNFCRNEYNVTGLCNRQSCPLANSRYATIRSDPETGAMYLYMKTIERAHMPSKLWERIRLSSNYAKALEQVDSRLIYWPKFLIHKCKQRLTRLTQVAIRMKKLAREEERLGERVVPKLAPKIRRREETRERKAESAAKVERAIERELIERLRSGAYGDQPLNVDESIWKKVLRGLERSGEGERDEDMDDGELEEEEDEEGVGEVEYVSDLEEDEDLEDLEDWLGNDSGASSDDYSDEDEEDSDEASGSEDDGEEEQKKTKPGSKRKFAAPPPKPRKKGPRVEIEYETE

SEQ ID NO: 12941 - protein, 370 aa, Aspergillus nidulans
  unsure (1)..(370): unsure at all Xaa locations
PPPKQSEDGRDQWPSRAAFLLAAMGGCAGQGNLIRYPSVVYNNYGLQWFIPYFLAIFFVAIPALILEISIGQAYRGGTVIAFNNINRRLKGVGIGPILVSFIVTQYFTVNLAWIMNYFRNSFRSPLPWEGRIEEFYMGDVIHQCXSCGRGVEYGRQTRSFVHGVPPASGFWGKQLAGVPSSGFSSGVSIFRAVGLTGRVVYWTMGLPIVTTIIFVGRSLSLENASEGVKLLWATWRGGQLASGTVWQTAVGQVFFSTGIGFGYFTSYASYNAKHSNAVMDALLICGSNVLFENFAAFAVFGVVGYLHRWPEDGVRLGAFVVGFLTLPEAVLHMPGSNFWAILLFFTLVVLGFSSAFVMLDAVATLVVDSG

SEQ ID NO: 12942 - protein, 716 aa, Aspergillus nidulans
  unsure (1)..(716): unsure at all Xaa locations
FSLVHQNRAQKLLAYLGDVAVNGSSIKGQIGEPKLKGDIIKPTLHDAAGKPIDVSSPCTKGWKQILDQEGPEAWAKAVRANKGCLIMDTTWRDAHQSLLATRVRTIDLLNIAHETSHALSNAYSLECWGGATFDVAMRFLYEDPWDRLRKVRKAVPNIPFQMLLRGANGVAYSSLPDNAIYHFCKQAKRCGVDIFRVFDALNDIDQLEVGIKAVHAAGGVVEATVCYSGDMLNPSKKYNLEYYLKLVDKIVALKPHVLGIKDMAGVLKPQAARLLIGSIRERYPDLPIHVHTHDSAGTGVASMIACAQAGADAVDAATDSLSGMTSQPSIGAILASLEGTEQDPGLDSAQVRALDSYWAQLRLLYSPFEAGLTGPDPXVYEHXFPGGQXTNLIFQASQLGLGQQWGETNKAYEVCNDLIGDIVKVTPTYRPWGRSAQFIVVNKLTPEDVSTAAGELDFPGSVHEFLEGLMGQPYGGFTEPLRSKALRDRRKLDKRPGLFLEPLDLAKIKNDLREKYGSATEYDVASYAMYPKVFEDYKKFVQKYGDLSVLPTRFFLAKPEIGEEFHVELEKGKVLILKLLAIGPLSDQTGQREVFYEVNGEVRQVSVDDKKASVENIARPKADVTDSSQVGAPMSGVVVEIRVHEGSEVKKGDPIAVLSAMKMVCLCLSIRVLGSSLIMHXEMVISAPHSGKVSGLLVKEGDSVDGQDLICKIAKA

SEQ ID NO: 12943 - protein, 655 aa, Aspergillus nidulans
  unsure (1)..(655): unsure at all Xaa locations
KGSSSSEDAQLGAVFSVSGPVVVAENMIGCAMYELVSDTSLCSAFLGYRSSCCHRXSSSTRALLLTIDDXCRVGHDQLVGEVIRIDADKATIQVYEETGTASAYYDMSSIXQYCSXAGLTVGDPVMRTGKPLSVELGPGLMETIYDGIQRPLKAISDESGSIYIPRGIKVNALDRKKKWDFKPGKYKVGDHITGGDIWGTVFENSLLNDHKILLPPRAKGTITRIAEAGSYTVEEQLLEIEFNGVKTTHGMMHTWPVRVPRPVNEKQSADSPFIVGQRVLDSLFPSVLGGTVCIPGAFGCGKTVISQSVSKFSNSDVIVYVGCGERGNEMAEVLMDFPEVCSLNVAEYRQYXRACSSSIDIGGRKEPIMKRTCLIANTSNMPVAAREASIYTGITIAEYFRDQGKNVAMMADSSSRWAEALRELSGRLGEMPADQGFPAYLGAKLASFYERAGKSTALGSPEREGSVSIVAAVSPPGGDFSDPVTTSTMSIVQVFWGLDKKLAQRKHFPSINTGISYSKYTPVLDRYYEKHHPEFPRLREQVRELLSKSEDLDQVVQLVGKAALGDSDKITLDVAAMVKDDFLQQNGYSDYDQFCPLWKTEYMMKAFMGYHDEAQKAIAQGQSWPKVRDATTDIQTSLRNMKFEVPDNQEEVSAK

SEQ ID NO: 12944 - protein, 448 aa, Aspergillus nidulans
  unsure (1)..(448): unsure at all Xaa locations
PDPGADSVSAAFVNERAPYLVPTYVRPAPIMVKGQGCYLWDMENRRYLDLTAGIAVNSLGHCDPEISKIIAEQVRTLVSYYTYKYQKCXRVNXAETLLHASNLYHNAWVGALSKDLIILTRESGAMRDAAQVFIANSGTEANEAAIKFARKTGRARDPSGAKHEIVSFHNSFHGRTMGALSATPNPKYQTPFSPMLPGFKYGKYNDVAQLKDLVTEKTCGVIVEPIQGEGGVNVATPEFLSALRKRCDDVGAVLIFDEIQCGLSRTGSFWAHAHPSLVPSSGEAAHPDILTTAKALGNGIPIGATIVSGKTVADNIKAGDHGTTFGGNPLACRVAHHIIHRLASPELQKSVQDKSAILVAGFQALQQKYPDLVSEVRGRGLILGLQLSKDFSARAGEIVTAARERGMLIITAGEGCLRFVPPLTITEEQLKTALRILEQAFDAVKAXA

SEQ ID NO: 12945 - protein, 480 aa, Aspergillus nidulans
  unsure (1)..(480): unsure at all Xaa locations
ERDTKGGTRFTGCTSIREFEFLGKLGEGTFGXVPSIPSLNIVDMVLLTREVYKARAKRDGSIVALKKILMHNERDGVSFIDSLXKKXAAIXSSKFPITALREIKLLKMLSHTNIMQLREMAVERSKGTSLIIPHDEKIXLEKRRGRKKPSMYMVFPYMEHDLSGLLENPEVHFSEAQIKCYMIQLLEGLKYLHGVLLCSGNIMGILFSDLVQNCILHRDMKGXSACILKDVLGXPSAAANLLISNQGILQIADFGLARPFDEAPPQPGKGAGEAKRDYTTLVVTRWYRPPELLLQLRRYTSAIDMWGVGXIALQSYLSSFXHLQLRFGEMFKGKPILAGNSDLNQAQLIFSLVGTPTEENMPGWSSLPGCEGVKHFGNRPGNLAEVFKEXSHLRSAVSIGFVIKSLTYYSQGPMAISLLTELLKLDWRKRVNAIDALKHPYFSTPPLPARPGDLPSFEDSHELDRRRFRGQRAAMPPAPA

SEQ ID NO: 12946 - protein, 531 aa, Aspergillus nidulans
  unsure (1)..(531): unsure at all Xaa locations
AYWLGSMRPAELPKTSTTKLYELEPPRHDVSPSNLQAAWADFVEIIGKENVSTEHADLTSHAGSDWSSYKTKEGEKPFLVLYPSSTEEVSRIMKVCHQRLIPVTPYSGGTSLEGHFAPTRGGVCIXFGRMNRILALHKSDXDGVVQPALGWEELNEELAGEGLFFPSDSAPGAMIGGMVGTGCSGTNAYKYGTMRDWVLSMTVVLADGTIIKTKQRPRKSSAGYDLTRLFIGSEGTLGLITEATLKLTVKPKSQSVAVASFPSVHSAALCVTRVVEEGIPVAGVEILDDVQMKCINASGTTSRQWKEAPTIFFKFAGTPNGVKEQIGLVQKLASSSQAKSFEFARGDEEMRSLWSARKEALWSVMAMRRGPEDHVWTTDVAVPMSRLPDIIEATKQDMTQSGLLAGICGHVGDGNFHGKLTIKTQGSADLVAIILWNDAERQTAEGVVHRMVKRAVEMEGTVTGEHGVGLIKRDYLPHELGESTVDAMRRVSCFPLSQPWLLMLFVQLKLALDPLRLLNCDKVIRVEQPKP

SEQ ID NO: 12947 - protein, 731 aa, Aspergillus nidulans
  unsure (1)..(731): unsure at all Xaa locations
KMYGAHSSGSSHDAGQPSFEHKEKPKTRHIYDVEGLDRSKLNAIFENPLAGVPRDELFEDVDRFCQNHGLMEYKELFRXGALISQNPAVAETLAELTEEEREALQRETTHKWSQPWMLYFMRSTSSSNXLCRVLKIGTAMCSMAAAVQGMDETANNGAVLSILGLILXLLFFFAYKDXXYQLLGIESPRFSDMMQDYITGLVVGAPYLACAIIGCWLTEPMNRYFARRGTIFISCVIAAVASVWEGVANSWVNLFLARFVLGLGIGSKSSTVPVYAAECSPAPIRGALVMQWQMXVPRIVRMPDHSNVIXVDAFGIMLGNIMGVAFMGVEEDLSWRLMLGSTVVLPIIVCFQVYFCPESPRWLIEHNKIPKAFKSFRVLRNTDLQAARDLYYAYVGVQLEREINKGKNFFTMFLELFTVPRNRRATLASWIVMFLQQFCGVNVIAYYSTSIFLNSGYTVQEALLASMGTGILNWVFAIPAFLTIDTWGRRNLLLFTFPFLSIWLLWAGFSFWIESNIPTSRKRVAMVTTGMYLFEVFYSPGEGPVPFTYSAEAFPLHVREVGMSWATATTWCFNFILSFTWPMLERAFKPQGAFGWYAAWCLIGWWLVLLFVPETKGTSITITDLILTNEYILTHLELTLEELDRVFSVKTRRHARYQLRNAVWHFRTWVLRHKLEPMPKLYEEPDSPTTPSPPDVEVEPKVRSENVENVGAXLGKTSTKQRRTESLTGRG

SEQ ID NO: 12948 - protein, 718 aa, Aspergillus nidulans
AHLLGEELYRKLGEYLSRHLEWVHGESMGHTDEALLSFYIREWQRYTTAAKYINHLFRYLNRHWVKREIDEGKKNVYDVYTQHLVKWKEDFFLKVHEKVMGAVLKLVEKQRNGETIEQSRIKSIVDSFVSLGLDETDPTKSTLEIYRYYFQRPFLEATRIYYEDESRQFVAGHSVVEYIKKAEIRLEEEKARVGLYLNNDISKDLTSTCLDVLVTAHSELLRDEFQPLLDNERQDDLARMYRLLSRIKDGLDPLRTKFEAHVRRAGLSAVEKVAAEGDSFEPKMYVDALLSVHTRYHSLVKEAFNGESEFVRSLDNACREFVNRNKICKSGSTKTPELLAKYTDSLLKRGSKAAEESELEEMLVQIMTVFKYIEDKDVFQKFYSKMLAKRLVHVSSVSDDAETSMISKLKEACGFEYTNKLQRMFQDIQISKDLNSSYKDWLEKSFLDDDDRKKLVDSHFQILGTGFWPLTAPSTSFLAPPEIVKTSERFQKFYCDKHNGRKLTWLWQLCKGELKANYIKNTKVPYTFLVSTYQMGILLLFNESDTLTYSDIQKATTLTPEILDPNLSIFLKAKVLNISPEGSKPGPDSTFSLNYNFKNKKIKVNLNIQIRSEQKVETDDTHKTIEEDRKLLLQVCLLALSTQVIVLYLLTILCNSSAIVRIMKSRKKMKHVQLVQEVIHQVKSRFPPQVPDIKKNIEALMEKDYIERLDGDEIAYIA

SEQ ID NO: 12949 - protein, 606 aa, Aspergillus nidulans
  unsure (1)..(606): unsure at all Xaa locations
MSYAHVKPPSEIHRAWWKESSVYQIWPASFKDSNDDGIGDIPGIISKLDYIRDLGVDIVWLCPSYKSPQVDMGYDIADYYSIADEYGTVADVEKLIKGCHDRGMKLLMDLVVNHTSDKHEWFKKSRSSKDNEFRDWYVWKAPRYDENGNRQPPTNWGIALPRFLSSSLHSLRXCXHXAESAWEFDEATGEYYLHLYAVEQPDLNWENPAVRKAVHDIVRFWLDKGADGFRMDVINFISKDQAFPDAPEQDKDAVWQWGDQVLRKRSSAPXVSAGYWEDTXGIRHLXRRGMPFVKDTNEVLKAVRYDRNEINMIFNFEHVDIDHGPWGNKFKPGGWKLTDLKAFFERWQVFMYDNGGWNALYWENHDQPRSIDRYVNPPQALRPAAGKMLATILALHAGSPFIYQGQEIGMGNVPIEWGMEEYKDIDCLNHWKGYVFFSLEMEQHXLWXVAGTRPTDTEVQKIARQEYRKKSRDNARTPVQWSSEPNAGFTGPNVKPWMSVNPEYTRVNAADQVKDPNSLYHYWASVLHLRKTYLDIFVYGNYELVDRDSQEVYAYTRACHTSKALVLANWTDRGLTWNAAAHKADQFEQVLLDTYESPNAAQGRFS

SEQ ID NO: 12950 - protein, 308 aa, Aspergillus nidulans
KKPALEGDRVLVKVSHSGVCGTDLHYKAADMVLGHEGVGYVEEVGPDVKDLKKGDRVGWGYEHDCCGRCKHCLSGFETFCPERAMYGFADLDQGSFASHAVWREAFLFKLPDGLDNESAAPLMCGGSTVYNALVGAEVTPTDTVGIVGIGGLGHLAIQFAAKMGCYVIVFSGTDSKKEEAMKLGAKEFVATKDAKELKTSRKLNNLIVTTSFLPEWELFLNVLDNRATISPLTVSDKPFTIPNQEMLVKGLRVQGGIVAARQVHREMLQFAAFHGVKPIVMRYPMNEKGINECMKTLEEGKMRYRGVL

SEQ ID NO: 12951 - protein, 561 aa, Aspergillus nidulans
  unsure (1)..(561): unsure at all Xaa locations
IVLRSNDVMISVPPSRSGSSSSEEEIETTAEEEDSEDYCKGGYHPVQIGELYNNGRYVVVRKLGWGHFSTVWLSRDTTTGKHVALKVVRSAAHYTETAIDEIKLLNRIVQANPSHPGRKHVVSLLDSFEHKGPHGVHVCMVFEVLGENLLGLIKKWNHRGIPMPLVKQITKQVLLGLDYLHRECGIIHTDLKPENVLIEIGDVEQIVKTYVKEEAKKEQKEDNRNGRRRRRTLITGSQPLPSPLNTTFEFKHSSQNSHSSLSQVINESPGXNFQISENXTMLIGTGTSEAPSMRQLLGIKDEDEQQKQREKTAYVERLLEGTSLTDDSDLLEREVSGISLDKPSSDEDIDCGIISVKIADLGNACWVGHHFTNDIQTRQYRSPEVILGSKWGASTDIWSMACMVSFAPIFHGDNXLAXVFELITGDYLFDPQSGTRYGKDDDHIAQVIELLGPFPKSLCLSGRWSQEIFNRKGELRNIHRLRHWSLPDVLREKYHFSVAQAKAISDFLLPMLEVLPERRANAGGMASHEWMKDTRGMQEVDLGLTPGSRGEGIEGWATEVK

SEQ ID NO: 12952 - protein, 470 aa, Aspergillus nidulans
  unsure (1)..(470): unsure at all Xaa locations
TVANMFNKLSGQPESYEKKYAHPSLCLLRQXLTVVSLQSLYRFGRTLGAGTYGIVREADCSSGKVAVKIILKRNVRVNERMVYDELDLLQKLNHPHIVHFVDWFESKVCICACFRXRGPRLTATRINFYIVTQLATGGELFDRICEYGKFTEKDASQTIRQVLDAVNYLHQRNIVHRGLFLPXFPFQSKGFDQCSSSDLKPENLLYLTRDLDSQLVLADFGIAKMLDNPAEVLTSMAGSFGYAAPXVMLKQGHGKAVDIWSLGVITYTLLCGYSPFRSENLADLIEECRSGRVVFHERYWKDVSKDAKDFILSLLQVDPAQRPTSEEALKHPWLKGESASDRDLLPEIRAYIARSRLKRGIEIIKLANRIEALKMQEEDEEDIPSAVDVQASEASDKSGLSPFPALSTENSNTHPASTGNGESGGTKKRSLSKIARGAIFREVVLAKVREMKENEEREKVEREARERAHS

SEQ ID NO: 12953 - protein, 157 aa, Aspergillus nidulans
SVTAVAAHGSIAAIGGDDSTVQICDIAGTSLTPKHDFKASRDVVSAMAFSPDGSKLAIGDSRGRVLVYKVADGSLVNDRWTAHTSRITSIAWNDNGAHIVSGALDTNIFVWSLTNPGDWLQVSNAHKEGVNGVAWIAGGSKVASAGADAAVKVWKVE

SEQ ID NO: 12954 - protein, 265 aa, Aspergillus nidulans
GLPAGSKETIHGLNTYLTGNRTTPYAIVVMYSDVFGLSLPNNKLIADAYAKSGEWLDYLPDFFKGDRVPLSMAEHLIPVDATKQSVFRKYTGLLASIPSFFNWQNRHRQGPTDAICMEFLRALRRERKGMKIGMVGFCWVGEYAIGAGLEENMIDIDGARVPLVDALVALHPSHLAIPDDDKTLVVPVSLGWRAEDSLVDFKQMNMVKGVHADNKASGREVPGIAHHEYKPGRHGFAVRGNPDDPQERKYLEDSVTQVLTWFGRW

SEQ ID NO: 12955 - protein, 214 aa, Aspergillus nidulans
  unsure (1)..(214): unsure at all Xaa locations
KCCISGFTWSGTPTGRTGKVANNDVYIAGDGTDVAILFIAGLFGWTFPNVRLLADHFAREIGATIFVPDYFGGEVLDFDLLAAEKFDQVDLKGFIARNGREQREGEIFETARALKRDLGFKKVGAVGYCYGGWASLRLGAKXHAEQGKPLIDCISIGHPSLLTKKDIDEVSVPVQVLAPEIDPMYSAETKSYTFETLQRLNKPFDYRHFPGVAH

SEQ ID NO: 12956 - protein, 337 aa, Aspergillus nidulans
  unsure (1)..(337): unsure at all Xaa locations
YKVTRGLLDRFGPKRVIDTPITEAGFCGLAVGAALAGLHPIVSHPSMQAQAQKKPAGHCXQGRLNQCEFMTFNFAMQAIDQIINSAAKTHYMSGGIQPCNITFRGPNGFAAGVAAQHSQDYSAWYGSIPGLKVVAPWSAEDAKGLMKAAIRDPNPVAVLENEYVNHLKITPSKRITTNRVQTLYGQAFPMSEAAQKDDSSLPIGKAKIERPGKDLTIVSLSRCVGQSLNAAAELKQKYGVEAEVINLRSVKPLDVETIIQSLKKTGRLMCVESGFPMFGVSSEILALSMEYGFDYLTAPAVRVTGAEVPTPYAVGLETMSFPQEDTIVGQAAKLLRL

SEQ ID NO: 12957 - protein, 487 aa, Aspergillus nidulans
AFENASTSVAASQMRNALNALAETVPDPNERKRFEAEMDNFFALFRRFLNDKAKGNVVNWDRIAPPQPSQVVNYDDIGKESSVEFLNKLAVVKLNGGLGTSMGCVGPKSVIEVREGMSFLDLSVRQIEHLNRTYNVNVPFVLMNSFNTDQDTQSIIKKYQGHNVDIITFNQSRYPRIIKDSLLPAPKSFDAPLQDWYPPGHGDVFESLYNSGTLDKLLERGVEYIFLSNADNLGAVVDTRILQHMIDTKAEYIMELTDKTKADVKGGTIIDYEGKVRLLEIAQVPKEHVNEFKSIKKFKYFNTNNIWMNLRAIKRVVEENELEMEIIANEKSIPADKKGEADQAIYQLETAVGAAIRHFKNAHGVNVPRRRFLPVKTCSDLLLVKSDLYRLEHGQLVMDPNRFGGVPVIKLGSDFKKVSDFQKRIPSIPRIVELDHLTITGAVNLGRNVTLKGTVIIVATEGSTIDIPPGSVLENCVVQGSLRILEH

SEQ ID NO: 12958 - protein, 401 aa, Aspergillus nidulans
  unsure (1)..(401): unsure at all Xaa locations
TITKLRPIAIEKIQAVHEWVETRCIPAQGIMKAQLAKDRWKMPPLMRHLREEAKQRGLFNLFLPKEFEESPGLTNLEXACCAEIMGKVYWAGQTMNCHAPETGNIELLAKYCNEQQKEQWLKPLLRGEFASAYSMTEPDVASSDATKIAISIRREGDEYMINGRKLFATKWNPEVKLYILMGCTDPNNPNPRRRHSMLLIPSDTPGFRMRQNLSIMGHDCAPESHGEYVYDNVRIPVSNVVLGEGGAFEIAQGRLGPGRIHHCMRLIGQAELAFDYALVRATDERKKPRGKLIWQFDSNIERIAQMRLKLDALRLVVFNAADTMDALGNKSGRYVIAQSKILVPIAVAKIVDECMQLYGGQGLTQHTPLPEIWTYARFVRVADGPDAAHRIRSGETSXRRR

SEQ ID NO: 12959 - protein, 267 aa, Aspergillus nidulans
  unsure (1)..(267): unsure at all Xaa locations
LEGHIALISGSSQGFGRGIFETFLREGALVLGLDLQAIDGQVEGFPENRAYQITANVAEEGDLEESGNWPXPVWLCSSNYVYQLETSIARFGKAPSIVHHNAGWPYPNKSGLDVTVEEFDRLFNVNVRSIYLASKVLVPEMKKNGPGSTIVISSENAIRPGATQTWYNATKAGVSSATKSMALEFARDQLRFNTICPTSGNTPLLNKFAGISDGPVPPEIIKAKCEAIPIGRLVEPSDVANVALFLAEPASSIISGVEILVDGARCV

SEQ ID NO: 12960 - protein, 256 aa, Aspergillus nidulans
MKLLALSLASLASAATITRRADFCGQWDTATAGNFIVYNNLWGQDNADSGSQCTGVDSANGNSVSWHTTWSWSGGSSSVKSYANAAYQFTATQLSSLSSIPSTWEWSKSCKLRLRLLAVINAVNRYSTTDVVANVAYDLFTSSSIGGDSEYEIMIWLAALGGAGPISSTGSSIATVTLGGVTWNLYSGPNGSMQVYSFVASSTTESFSADLMDFINYLVENQGLSNSQYLTHVQAGTEPFTGSDATLTVSSYSVSV

SEQ ID NO: 12961 - protein, 307 aa, Aspergillus nidulans
  unsure (1)..(307): unsure at all Xaa locations
MDSLTTHPATAQQARAFTSPSSLSFPGGTAFPGGADLTPPSDKDANMATNGQSANGNVNGQQQGANAANGNGVMPATPAATPGASAPGSGIVPTLQXVYSVVIFLVHQNTEQRLLLKNIVATVNLDCRLDLKTIALHARNAEYNPKVLFSTPPXVDXIRVQCGXTGFPLAFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMMKPKIVLLIFVSGKIVLTGAKVREEIYQAFELIYPVLS

SEQ ID NO: 12962 - protein, 1028 aa, Aspergillus nidulans
  unsure (1)..(1028): unsure at all Xaa locations
RVIVTTSRFSSSVVRKYQDLYTQVGSRGSELVVVPFNQASVQDVTALVNYIYDAQGGLHWDLDHILPFAAMPENGRTIEKIDPHSELAHRTMMVNTVRLLGAVKARKEAQGSRTRPTQVILPLSPNHGVFGGDGLYSESKLGLEALFNRWHSEDWSDYLSVCGAVIGWTRGTGLMSGNNLVAEGIEELGCRTFSQQEMAQCLLCLMFNTMCSLCEEAPLYADLSGRMGAVQNLRQKVAGLRTEINETANTRRALLEELAMEARCSEGPTPTIDSEPAKATATPTLTAHVRLDFPPTVDYNQEIKPLTADLQGMVDLDRVVVVTGFGEIGPWGNARTRWEMEAYGEFSLEGCVEMAWLHGLIRYENSSSPGWVDAKTNERVHDHEVKHKYEEHILSHTGIRLIEPDRFGANYHPEHKQLLHEVLIQEDFPELEVPEATAQQMKLEHGNKVDIIPDPEGGDQCRVVLKKGAKLMVPKALRLDRMVIGQIPTGWDARKYGIPEDVISQVDPVTLYMLACSIEALLSSGITDPYEIYRYIHVSEAGNCVGSSLGGFNSLQQMYRGRYMEKEVQKDILQETFVNTIGAWMNMLLMSSAGPIRTPVGACATAIESVELGYDTLISGKAKFCFVGGGDDFGEEVLYEFANMKATANTVDEFEQGREASEMSRPAASTRNGFMESHGCGVQILTTARLAIEMGLPVRGVIAFVETSSDKASRSVPAPGRGILSKAREVRSSSPSSSLISSPLLNISIPAKRLDFRKKQIEFARETALEELQLEIAHVEESEVEDYIRERTAQINAEAQKDLRNAQYHLGNAFWQNDPSIAPLRGALAVWGLTIDDLDVASFHGTSTKLNEKNECSLIQAQLSHLGRAKGNVILGVFQKYLTGHPKGAAGAWMLNGALQILDTGIVPGNRNLDNVEAELQKNEQIAFLNRSLDTGRGSMRAVSVTSFGFGQKGAQTIVVHPKYLFATLEEQEYEEYLDKRAKRQKKADSFFYRGLASNRLFELKTAPPWAPQKELETLLDPTVRFXA

SEQ ID NO: 12963 - protein, 281 aa, Aspergillus nidulans
  unsure (1)..(281): unsure at all Xaa locations
DPFERSRLPDIXSRRKLLGKKAIITGGDSGIGRAVAILFAMEGASSLITYLPEEEEDAQETKRRVEEAGQKCYLLATDLRRKENCKKVVETALEKLGGIDILVNNAGTQTMLPDISDLDEXVQDLTRTTHCADDDFYSRSQWESTFDTNIHPVFYLSKYTMPHLKSGSSIINCASVNPYIGRPDLLDYTSTKGAMVAFTRGLSNQQCSKGIRVNAVCPGPVWTPLIPATMTTEAIEQFSGTPMGRAGQPSEIATCFVFLASQDSSFISGQCLHPNGGVVLN

SEQ ID NO: 12964 - protein, 619 aa, Aspergillus nidulans
TEPSTDGVFRENDARPEKDAANDVLEGPPVLPPMPQEPSLADAFEPVKDTGPRTNQGPETPKSSHRQPTSAVSTPPQATQYSPEQPSPGKELTLFLQYRSKIKKYVLSEGASGLTIGRLQLAFIEKFAWNTHNNGADLPEIYIQDPISGIRHELEDLSDVKDRSVLVLNVDALDEVKKHFDDELGGVRRLLEGVKGALDGQGNMMQRVSDRQVEAVKEIARLAAAPAVSSRGAPATGEVRRGPISGSASQMAELSSLRRDLAVLRQTYTDFSADIASSMGAIRAKADTVKSSAVEASVPSYEGDAGRARVNLGKKELAEESERLVARVDDLQDLIEDLRKDVVSRGVRPLPRQLETVGKDISAVTKEIKKMQEFLKREKPIWTKIWEKELQLVCEERDQLTMQEDLAADLQDDLEKAAQTFALVEQATKQQAMQNGNSGPTLRNTSRNVVIDPAVDPMKAKDSVLGEVRALQPNHESRLEAIERAEKARQKELETRRVDLFQKELGTFVQEGKLKKSGGFEEAERLRRAKDERNRKEMWNIAQARAAEIEKAEAEAAAASTPSAAEPYSDDAALERTEAPESPKGKAPVSDGDVGEEKKDEEAPAESQDNQESHKTDPE

SEQ ID NO: 12965 - protein, 243 aa, Aspergillus nidulans
  unsure (1)..(243): unsure at all Xaa locations
AERILMNEFKALSQEPWVNVELQNDDIFRWTIGLIVLNPDSLFYGGYFKASMKFPTNYPYSPPGTLFCPXVLRPAILLTMLVEFRFHRPLYHPNIYTDGKLCISILHSPGEDEMSGELASERWSPAQRVESVLISILSLLDDAEVSSPANVDASVLLRKDFEAYKERVRKCVEDSKADIPEGFEMPTHESTIRSAPKQVKDDDSDFWAESDVDDDMFGGSGSDQEEVDSDAFEQGDDSMSDDE

SEQ ID NO: 12966 - protein, 179 aa, Aspergillus nidulans
HRDLKPQNLLINKKGQLKLGDFGLARAFGIPVDTFSNEVVTLWYRAPDVLLGSRTYNTSIDIWSAGCIMAELYTGRPLFPGTTNEDQLQKIFRLMGTPSERSWPGISQLPEYRANFHVYATQDLGLILPQIDPLGLDLLNRMLQLRPEMRIDAHGALQHPWFHDLPQLQAQLQQQQMAG

SEQ ID NO: 12967 - protein, 329 aa, Aspergillus nidulans
  unsure (1)..(329): unsure at all Xaa locations
EDKTHINIVVIGHVDSGKSTTTGKTSSHPTVLDQTLTNNRHLIYKCGGIDQRTIEKFEKEAAELGKGSFKYAWVLDKLKSERERGITIDIALWKFQTPKYEVTVIGMYIXSCTTXLHLTIQLDAPGHRDFIKNMITGTSQADCAILIIASGTGEFEAGISKDGQTREHALLAFTLGVRQLIVALNKMDTCQWSEARYNEIVKETSGFIKKVGYNPKAVAFVPISGFHGDNMLEPSANCPWYKGWEKETKAGKVTGKTLLEAIDAIEPPVRPSNMPLRLPLQDVYKISGIGTVPVGRVETGVITPGMVVTFAPANVTTEVKSVEMHHQQL

SEQ ID NO: 12968 - protein, 590 aa, Aspergillus nidulans
  unsure (1)..(590): unsure at all Xaa locations
MSVQTVSIQPFGDQKPGTYVNALCFPVDVSLTAVFQSGLRKKVKIFQQENYTESFLTSIFLSIPEGAQDAFLVIGGDGRYYNSDVIQKIAKIGAAYGVKKLIVGQNGILSTPAASNLIRKRKATGGILLTASHNPGGTTLLDTEXTSQLTGXAPDNDFGIKYNLTNGAPAPEQVTNKIYEVSKSLTSYKYIDLPEVDTTTVGTRSYGPLEVEVVHSTEDYVSMMKEIFDFDLIRSFLKKHPDFKVLFDGMHGVTGPYGIDIFVNELGLPSSSTMNCIPKPDFGGGHPDPNLVYAHELVEAVDKNGIHFGAASDGDGDRNMIYGANTFVSPGDSLAIIAHHAKLIPWFQKHGVDGLARSMPTSGAVDRVAKAQGLQSYEVPTGWKFFCNLFDNKKMSICGEESFGTGSNHIREKDGVWAIVAWLNVIAGVAEQKPNETPSIASIQAEFWETDGRTFFTRYDYENVDSDGANKLIAALSEKAVDTRAHLLAAPSLAERVVDSGNFAYTDLDGSVTKNQGLYVKFDDGSRLVVRLSGTGSSGATIRLYVEKYEGDKSKYQMATQDYLKDNVGLALELLKFKEFVGREEPDVKT

SEQ ID NO: 12969 - protein, 230 aa, Aspergillus nidulans
MSTNSDLRVTLYTYFRSSCSARLRIALALRSISYTSVPINLLKGEQSSTKNTAVNPSATVPTLIIEHVDRSQSPITITQSLAALEYLDEAFPDNPNPLLPPISNPQQRALVRSLASIIACDIQPVTNLRILQRVAPFGVDRAAWSKDLIEAGFAAYEAIARDSAGVFSVGDTITMADVCLIPAVWGAERAGVNLGQYPTIKRVAEALEKENAVKEGHWRTQQDTPTEFRC

SEQ ID NO: 12970 - protein, 330 aa, Aspergillus nidulans
LVPKPISTQPFTLLTSYLPFTNEAQRQWWLDSGSLFSRFLQASQYTTGQQYKHLLFFHRYLLPFLGTYPPTWFSIVSRQGLAIEYSLNFQASGNPVIRSAFEPLSYASGKDAADPLNKRPTEDLLAGLVEQGLEGFDMTLFDHVRDTIFISDEETAALENPDAYGIKTHTALGFDMKGDNTVVKCYMHPRWKSLATGVPVAKLIRDSLERIKDQFDCEQALELVDEYMEDSGSWDLRTFIAWDCVPLAQTRLKIYGIINEVSLGKVEELWTMGGRLNDETTLEGLSLLRRLLHLLEVNKDDRLFSKGDEEKLEYGPTVDGFLPLFWNYEI

SEQ ID NO: 12971 - protein, 219 aa, Aspergillus nidulans
ISKDRIRIKIASTWEGIQAAHILQSQHGINCNLTLMFSLVQAIAAAEAGAFLISPFVGRILDWYKAAHKRDFSKEEDPGVKSVQSIFNYYKKFGYKTIVMGASFRNVGEITELAGCDYLTISVRCHPSTIIFEGVSLTNHSPGLLEELYNSKDAVPKKLDAASATTLDITKRSYLNDEALFRFDFNEEAMAVEKLREGISKFAADAVTLKDILKQKVQA

SEQ ID NO: 12972 - protein, 379 aa, Aspergillus nidulans
  unsure (1)..(379): unsure at all Xaa locations
DWFKSYKVRGNCPAREKNGCSGRHRLLKHGSXVAPSYLDVVARGLLIXVHPSFVDCPGHDILMSTMLSGAAVMDAALLLIAGNETCPQPQTSEHLAAIEIMKLSHIIILQNKVDLMREDGALQHYQSILKFIRGTVADGSPIIPISAQLKYNIDAVNEYLVSHIPVPVRDFTASPHMIVIRSFDVNKPGAEIDELKGGVAGGSILTGVLKLNDEIEIRPGLVTKDENGKIQCRPIFSRVVSLFAEHNDLKFAVPGGLIGVGTRVDPTLCRADRLVGFVLGHRGRLPAIYTELEVNYFLLRRLLGVKTADGKQAKVAKLAKNEVLMVNIGSTATGAKVVGVKADAAKLSLTSPACTEVGEKIAISRRIEKHWRLIGWANI

SEQ ID NO: 12973 - protein, 983 aa, Aspergillus nidulans
  unsure (1)..(983): unsure at all Xaa locations
DHSRRSLLLLLALTPTSWPLLSPRPATGSRTRTRTLELRVSVSFSPGMSYPNPNSEAGSGGGSITSWQKRQAGGLRRWPTRRVDLIKGRVLSVDYPVPSAILNSVEPQYRDSASSSEEFTHLRCMXCLXSTRWGIDRVXLMMEMFRYAATCDPDDFTLRNGYNLRASMYNRYTELLIAITYYNEDKVLTARTLHGVMQNIRDIVNLKKTQFWNKGGPAWQKIVVCLVFDGISPCDKETLDVLATVGIYQDGIMKHDIDGKETTAHIVRRHRNPXXSASSXLAQFEYTTQLSITPSLQLVRPQRDDPTNLPPVQMIFCLKQKNSKKINSHRWLFNAFGRILNPEVCVLIDAGTKPGHKSLLALWEAFYNNKNLGGACGEIHALLGPRWEKLANPLVAAQNFEYKISNILDKPLESMFGYVSVLPGAFSAYRYRAIMGRPLEQYFHGDHTPPKRLGKTAIEGMNIFKKNMFLAEDRILCFELVAEAGQKWTLSYVKASKGETDVPEGTYRPFRANKILIMLCTAPPEFLSQRRRWLNGSFAASLYSVMHFARIYKSGHNMVRLFFLHVQLLYNVCQLIMTWFSLGMPLLSSLVSVYXQLLASYWLTTSVIMDIVGTPSATNKYKGWPFGNEVSPIFNNVVKVLYLVFLMHQFFLALGNRPKGYVFXHRLPVRLGXQIXLAIRLILSFLYFSLVQIYILILSFYLVAQAFSGGNIDLDFDHGVGGFFASFFTSTTGLVLVALASTYGTYFIGSILYCDPWHLITSSWAYFIGMPSTINILNVYAFCNWHDVSWGTKGSDNAAASLPSAQTKKAPGGGDGDAKGTFVEELDKPQADIDTEFEFTVRRALAEYKEPEPDKTVSLDDSYKTFRTNLVLTWALSNSLLALLINNAGVSTLCLTVSPASLLQTSPGPFRDXLLHYGLRLSMVLVCGGVWLTVFFLQTTSTVRTAWYFKCLLWATSGLSIFRFAGALYFLAKTGVLCCFVRR

SEQ ID NO: 12974 - protein, 937 aa, Aspergillus nidulans
  unsure (1)..(937): unsure at all Xaa locations
LLPKCFEYIVRTQLEDGSWETYASDVDGILNTAASLLALETHAESRIASTDPPVEEMKERIGRARAALSRQLQAWSVKDTVHVGFEIILPALLRLLREKGHEFEFDGRAELDRLNRIKLSKFRPEYLYSARTTALHSLEAFVGMIDFDKVAHQKVNGSFMFSPSSTAAFLMFSSSWDDECEQYLRLVLQNGAGGGTGGMPSAYPSKYFEVSWVRGQLARLESKLTELQALTTLLDNGYSTGDLGIEDTDSLGEMLRDALVKGGGIVGFGTIPQHGSITLPHVANHSVVXAPSIQADADDTAKSLIAVSLLDKPVSAQGLIDAFEGPMHFRTYHGERDPSFTANSNVLLALLNTPDAATVSPQIEKAAAFLCDVWWTADSEIGDKWVSLLFATEMEIAERXLSQNLSPYYPSMLMAEAFGKLCKVWANARPXSISSQFIKDQVSVCLNQALVRTLQTQNENGSWGSHSHEETAYAILTIAHACQLPVVNQLWTNVQLAVSRGRKFLQNSAGDKAEYLWVEKVTYRSILLSKSYVLAALKVSFERSYPACLANLFIVSKKRVIEFSRFHSMLPLFSSMELWKVRAAIVEGYLLLPQLRDRRLAVFSRTGMEEDKYFEYIPFTWTLCNNRRNTFLSTKTLVEMMVISFLNYQADEFMEAVVGRLNSSQRSMTRSCIDEIFRDLKDKPELNDAIQAQSGPRNADANGHRILPQAKRIKMGSQLPSDVSRVLSAFVHHVMDHPSVKAAAPLEYERVKNELQVFLLSHIEQADDNGRFAAQLESTRDDFETARSSFYRWVSSTSSDHTSCPYSFAFYQCLLGFEQASHNAACFQTCEEKYVAEAMCRHLAVMCRMYNDYGSLARDRDEKNLNCVNFPEFAQAGPKSDAVRQKQLFSLAEFERSNMKRGLEVLTEMAAQDRAKMRMLEKVQMFCDVTDVYGQIY

SEQ ID NO: 12975 - protein, 241 aa, Aspergillus nidulans
GNRFFNMDEIRDRSSPYPQMLPSATQFAESMTKMGLHPDDILVVYDALEVGLYSSPRVAWACRHFGQRDVHVLNNFPRYVAEGLPLSTGPLSTLPPAALEYPIKNPDSKEVISYDELRGLLLSDKKSDIQIIDARIPGRFSGAEPEMNPALRSGHMPSALNVPLASIMDKDKVILPAEELKARFQAAGVDGQLPVVLTCNSGVTAAALDLALQLSGYRMERRLYDGSWMEWTRRTQDEGLV

SEQ ID NO: 12976 - protein, 535 aa, Aspergillus nidulans
  unsure (1)..(535): unsure at all Xaa locations
LQVMTVLXXTASRPWTTGKGVSEPRVIVQLRFKAYGPLTAYNHPEGATLGLLAASMSIGSILAIPVVPYVADLFGRRFGVVLGCMIMIGGVAMVSIGYKIALFVVGRIILGFGLGIAQVSALEIDGERGDXLGFRNASPLLVTELVHPQHRAIYSTIYNSLWYVGSLIGACVALGMLPRCLXPGCLLTVLGTNNIKGNDWSWRVPCLLQGVPSVCQLIFIWVCGFTRCLEIKLTWPRFVPESPRWLISKGKSEKAKKILAYVHAQGDEDDELVNVEFDEIQQTIALEKQLEGSGWSELWSTPGNRHRSIILISIGFFSQWSGNGIVSYFLPKVCHSYLSQNPRPAENXRQQVLELIGITDSHKVLTINSVLNAVNVVSATGICFFVDKLGRRKLFLTSVTCMLLCFISTTIALARFPHGPGGADDHAGNAVIVFIFLYYISYNIGFSGLLVSYSSEILPYRLRAKGLTLMFFCVALSLLFNQYVNPIALLDIGWKYYIVYCVWLLFELFVVWKYYVETKNTPLEEIVKFFDGDQA

SEQ ID NO: 12977 - protein, 654 aa, Aspergillus nidulans
  unsure (1)..(654): unsure at all Xaa locations
MAASSSLDHLSNRMKLEWHSKLNTEMVPAKNLRRTSIICTIGMFSAXSANRQFXILRFXLTSRSLGPKTNSVEKINALRRGTATXXSQSCLKLTPSVAGLNVVRMNFSHGSYEVILSRICTWTSSDAVXHILYHQSVIDHAREAEKQQAGRPVAIALDTVSSARLEPSRCRSDSSLERPEIRTGNTVGDKDIPIKAGHEMNISTDEQYATASDDQNMXVSXSFEYVSRRLTWRLXVCRYKNITKVISAGKLIYVDDGILSFEVLEVVDDKTLRVRCLNNGNISSRKGVNLPGTDVDLPALSEKDISDLKFGVKNKVDMVFASFIRRGSDIRHIREVLGEEGREIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPCEAVTMMSETCLLAEVAIPHFNVFDELRNLAPRPTDTVESIAMAAVSASLELNAGAIVVLTTRYVLFRDFXSNIADNAIVETLARMISKYRPVCPIIMVSRNPAATRVSPVLLNIRTRWLTFIVLPPVRGVWPFYFPEKKPDFNVKIWQEDVDRRLKWGINHGLKLGIINKGDNIVCVQGGAAVWGHTNTVRVVPAEENLGLSE

SEQ ID NO: 12978 - protein, 629 aa, Aspergillus nidulans
  unsure (1)..(629): unsure at all Xaa locations
FSTLGGLLFGYDQGVISGVITMESFGARFPHIFTDSDLKAGLCQRSCWVSSRVFTYFHNSLYFPYFPHIFFPPRFTSFPTFSFMFCTKLTFPAAWFGSLINGPIADRLGRKMSINLAVVIFIVGSAIQCAAVNVGMLFAGRAVAGLAVGMLTMVVPLYISEVSIPEIRGGLVVVQQRXFDYPSQNQPEPQADCLXSSVTIGILVSYWIDYGSNYIGGARCAPNVPYAGSSFDPYTDVPAGGCTGQSEASWRLPLAVQIAPAIILGAGMLFFPDSPRWLLMKERDDEALSALSRLRRQARDAPVLRNEYLEIRASIMLENSFARENFPNLSGIRLHAAQVXSAYEHGRXXYGADLFSQYLSFLTTWARFRRLAIGCCVMFFQQFMGCNGMVSIRNMPFIXFYLIYILTWPAIIYYAPTIFSQLGLDGNTSSLLATGVYGIVNCLSTLPALFFIDKVGRRVLLMAGATGTCISLVIVGAIVGAYGASLVDHKAAGWAGIAFIYIYDVNFSYSFGRSLSLVXISGRAXRGKKTDYYCIAPIGWVLPSEIFNLSIRSKAISITTSATWMCNLXVLHFLKEKYHRLASFLTFVRSIIGLVTPDMLDSISWGTYIFFAAFCLLALAFTFFFIPET

SEQ ID NO: 12979 - protein, 643 aa, Aspergillus nidulans
  unsure (1)..(643): unsure at all Xaa locations
LSEWVLDAVSSMGFTRMTPVQASAIPLFMAHKDVVVEAVTGSGKTLSFLIPVVEKLLRLEEPIKKHHVGAIIVSPTRYLAXSRSSXWRCPCXLFARELRSQIYNVLTSLLAFHPASAAVINTSETEDVPRPKHSSSVLRVVPQLLLGGSTSPAEDLSTFLKRSPNLLVATPGRLLELLSSPHVYCPQSSFEMLVLDEADRLLDLGFKETLQNILRRLPKQRRTGLFSASVSEAVDQIVRVGLRNPVKVVVKVKGASGVDDKRTPARLALLYLLYSHILIXCSLQMTYLTQPPTGKFPALKHILNSVQPTPSKSIFFVSTCSGVDYLSVILPLILGNDFQLIPLHGKHPANVRQKNFNRFVNAHNPAILLTTDVASRGLDIPSVDLVVQIDPPSDPKTFIHRCGRAGRAVVRGLSVVLLHPGREEDYVSFLEVRKTPVAPFPHPITVSDAEAAAATETARKVVKADRAIHDRGQKAFVSWLRSYSKHQASSIFRVATWDWEGLGKAWGLLKLPKMPELKNFKGDKTLGVQMDWDTYAYKDKQREEASLRAPTRDAESGQQQTTNKKRPNETVAWSNNAENRNKKAKRRDMKQVRQERKRWEKMTEEEKKKALETEQMLEQIRAKNEEQRRLKRAAAKADKDAEE

SEQ ID NO: 12980 - protein, 494 aa, Aspergillus nidulans
  unsure (1)..(494): unsure at all Xaa locations
MVHLKTLAGSAVFASLATAAVLPRQSASLNDLFVAAGKSYFGTCSDQALLQNSQNEAIVASQFGVITPENSMKWDALETWVFPSETVDFGRADGNVGTASQGNFGWSGADYLVCSLAVGVDYFGSAGADQVXVDYATQHNKKVRGHTLGGQLPPVSTSGSLTDPVWHSQLPSWVSSIGDANTLRSVMTNHINEVVGRYKGKIMHWVCLTRTHSRHKQRKNAXERDRLTEMSAGRVNEIFNEDGTFRNSVFYNLLGEDFVRIAFETARAADPDAKLYINDYKXVTLLLLRTSSDSGLAWTSASYAKTQAMASYVKKWLAEGVPIDGIGEWTLVYSIAQLDXRSSRLPGPTTGTLGGRLADQVLTYRSSSHWSSTEAAGXVFSALGCTAVTLTTPNSAVLSANTGVSEVAITELDIAGAASSDYLNVSSPIHWPSGSGXRECRSCSTPASNEQKCVGITVWGVSDKDSWRASDSPLLFDGNYQPKDAYNAIVNALS

SEQ ID NO: 12981 - protein, 525 aa, Aspergillus nidulans
  unsure (1)..(525): unsure at all Xaa locations
QRYPERFSENVHKRGKAAKELVNVFFHENIERARDRNMRWVFATERRISLKRILLTGVITVQSAELDKMMRDPNISQDAKVKEAEMVGKKESTFLRFLRTPETPANFQTIKIIGKGAFGEVKLVQRKSDNKIYALKSLIKSEMFKKDQLAHVRAERDILADSKDNPWLVKLHASFQDPAYLYLLMEFLPGGDLMTMLIKYEIFSEDITRFYMAEIVMAIEAVHKLGFLHRXEXQSWSLVPYTACXYTCTIEDIKPDNILLDRGGHVKLTDFGLSTGGKKTHDNSYYQNLLKNSTSKDKNRNSGYFNDAINLTVSNRGQINTWRKSRRAMAYSTVGTPDYIAPEIFNGQGYTYLCDWWSVGAIMFECLVGWPPFCAEDTTDTYRKIVNWRECLYFPEELTLSRESEGLIRRYVMSAIHLSCLSNRRSASLCDAEHRIGNEGGQYGGATQIKNHPFFRGVVWDQLRKIRAPFEPRLTSNIDVSYFPIDEIPQEDTSAIHRAQARAMPDEQNAEMSLPFIGYTYKAFN

SEQ ID NO: 12982 - protein, 452 aa, Aspergillus nidulans
  unsure (1)..(452): unsure at all Xaa locations
ALLSCIHGRPDIQAXECLCRRIQDKYLDIXAKIYQGLDCARPHRRACHNGVXYSQCSPAVSRALSTPVERTPLVLPASNGHSIIPNGHSIIPNGKTAVAVTNGADNQHQHKGKEEEIISAPVHYISTLPGKDIRGKLISAFNEWFQIPDEQLEIIKRAVGLLHVASLLXGSFTLTHQTIQFRQIDNLCTRRIDDIEDYSKLRRGFPVAHSIFGIPQTINSANYAYFQAQNEVLKLRRCEKALRIFTEELLRLHRGQGMDLYWRDSLTCPSEEEYLDMVANKTGGLFRLAIKLIQLESDVDEFVRPLEFLPLFXTRAEQTXLRRRDCVPLVDLLGIIFQIRDDYQNLQSDQYAKNKGFGEDITEGKFSYPIVHSIRSSSRTGVGSDSSLQLLSILRQKTEDEAVKKYTIQILEKTGSFEFTRQKLRDLTARARDMLTELRERSGAGAGAAGLL

SEQ ID NO: 12983 - protein, 477 aa, Aspergillus nidulans
SPSTTTSSRSFSNPSTTPDQKRIKMQRKQSSPLAPAFMVSAPGKVIVYGEHAVVHGKAAMAAAISLRSYLLVTTLSKSQRTITLNFRDTNLNHTWDIDQLPWDLFHHPSKKKYYYDLVTTLDQELYDAIQPHVEDISPDAPEEMRKIHKRSASAFLYLFLSLGSPQSAGAIYTLRSTIPIGAGLGSSASVCVCMSAALLVQIRTLAGPHPDQPPDEAEVQIERINRWAFVGEMCIHGNPSGVDNTVSAGGKAVIFRRGDYSKPPSVTSLPTFPELPLLLVDTRQGRSTAVEVAKVGALRKEWPVVTESILDAIDNVTASAEKVIREPNPEGLSEKTLQQLGTLIRINHGFLVSLGVSHPRLERIRELVDYADIGWTKLTGAGGGGCAITLLRPDLNDDSLRQLKSQLQDENFGIYETTLGGDGVGVLWPAVLRNGTDEEGGEEIDQQKFENAVGTEGIERLVGVGVQEKREGWKFWK

SEQ ID NO: 12984 - protein, 458 aa, Aspergillus nidulans
IEIIFSKPLTLKNMLAMSEKIREQFRAGLESSPINMLPSYNHALPTGLEQGTFLALDVGGSTMRVALIELCGQGKMEVLRVSSSLIDNDVKLLEGTSFFDWMAEKIEEMLREVGTNYGREEAPLSMGLSWSFPIEQTSISSGLVIHMGKGFRCSMGTVGQELGSLIVQSCQKRGLNVRVDAIVNDSSAALLSRAYVDPTTRMSLILGTGTNVAIHFPVHAIGLGKFGKRPQGWFDYAKHVIINSEMSMFGGGVLPMTRWDDILNRTHLRPDYQPLEYMATGRYLGEIVRLIIVDAVETAQLFGGELPHSMRDAYSLDTSIVAFIEADTSPFLTASAALLQKEHTMSRPPSPEDLRFLLRVCRTISKRAAGYLATAIHSMWCLRNEAEISQGPPSPSFKGPRDVTVTESGSNSDCLSIACDGSVINKYPGFRDRCQAYLDQLTQETNTSKVSQISEEGS

SEQ ID NO: 12985 - protein, 882 aa, Aspergillus nidulans
  unsure (1)..(882): unsure at all Xaa locations
GLYETLGVDPEPGSGMPLDWVEGCAICVAIVIVVMVGSLNDYQKERAFVKLNKKKEDREVTVIRSGKAVRLSVHEVLVGDILHLEPGDLVPVDGIFIDGHNVKCDESSATGESDQLKKTGGEQVMRLLEQGHTKQQDMDPFIISGSKVLEGVGTCLVTSVGVNSSYGKILMAMRQDMEPTPLQKKLDRLASAIAKLGASSAIFLFLILLFRFLGGLSGNDRSGTEKASQVTDILIVAITVIVVAVPEGLPLAVTLALAFATTRMVKLNNLVRVLKSCETMGNATTVCSDKTGTLTTNKMTVVTGTFGDEDFDDKNQTGKTRRSAAFASSLSPQQKCMIIESVAINSTAFEGEENGVPGFVGSKTETALLGFARNVLGMGPLAEVRANATVVQLMPFDSGRKCMGAVIRLSDNKYRFLVKGASEILLRYSSFVWRPSGPVDLVSSERERLEQVILDYAKQSLRTIALVSREFSEWPPRHAVDPDDPSQADLGLLLQDMSFIGVVGIQDPIRPGVPEAVAKCHHAGVAVRMVTGDNMVTAKAIATDCGIYTGGIVMEGPHFRTLSDAEFDEVLPQLQVLARSSPEDKRILVTKLRALGEIVAVTGDGTNDGPALKAANIGFSMGIAGTEVAKEASAIVLMDDNFSSILTALMWGRAVNDAVRKFLQFQITVNITAVLLTFISSVADSEMRSVLTAVQLLWINLIMXVSSVFLITSIINPIRDSLAALALATDPPTEEILNRKPIKGGAPLISITMWKMIIGQSIFQLIVTLTLHFGPRQNFLDYSDDVRRSIVFNTFVWMQIFNEFNNRRLDNRFNIFTGLHRNWFFIGINCIMVGCQIVIAFYGGAAFSIVQIHDEQWAICILVAAISLPWAVVVRLFPDAWF

SEQ ID NO: 12986 - protein, 492 aa, Aspergillus nidulans
  unsure (1)..(492): unsure at all Xaa locations
RQEQGMSLWQGLRLYPKAVAWSVLLSSTLIMEGYDLALLGSLYASPAFNQRYGVQAANGDWGVPASWQSALSNGARVGEVIGLIISGFVSERLGYRWTMIYALIAMNAVIFLFFFAVNVQMLLSAEILAGIPWGIFQTLPAAYASEVCPVVLRPYLTTYINMCWVMGQFIAAGVNRGSFQRMDQWSYRVPFAVQWAWPLPILTGILFAPESPWWHVRRGDIARAKHALQRLTSPQDASFDADATIAMIQHTNELEKSLSAGTSYLDCFRGVNRRRTEIVCGICIGQTLSGQNIMGYFAYFCVQAGLPEIHSFNLSLGQXALGVLGTIGSWFMRSEMGRRTIHLLGLSLLFTLLIIRGSLSFAPDSNNARKWAIGAMLMVFTLVYDISIGPVTYSLVSELSSTRLKAKTINLARAGYNISNIVVNVLTNYQLNDSAWAWGARSAYFWAGTCLLCLCWSAMRVPEPKGRTYEELDLLFEQRVPAWRFKKTAVDP

SEQ ID NO: 12987 - protein, 574 aa, Aspergillus nidulans
QVYPASFKDSNGDGWGDIPGVIEKVPYLHSLGVDVVWLSPMYDSPMLDMGYDVSDYENVLPAYGTVVDVEKLVEECHKYGMRLILDLVINHTSDQHKWFLESRSSKDNPKRDWYFLRPPRYDKQGNRMPPSNYQGVFCGSTCSFTLSDCWTRLIRTGTWDEHTQEYYLHLYAKEQPDLNWDNLETRKAIYDSAVRFWLDRGVDGFRVDTVNKYSKYTDFPDAPITDPKSYIQPAIGMWCNGPRIHEFIREMYDEALEPYGDVVTVGELANTPDPAHVLRYVGASAKQLSMVFHLDIGHIGMGSLEDKYVLQPWKLTEMKSIVAKWQTFIEGTDGWTTAFCENHDNGRSVSRFASDAPEHRERSAKMLALMMVAMTGTLFLYQGQEIGMINAPRDWPIDEYKDIEGLGYYREAQAQVASGVDPMREERIMDGLRVLARDHSRLPMQWDDSPEAGFTTGVPWMRTHDLYREINVKKQEGDPDSVLSFWKKVLLLRKRYRHLFIHGAFEVLDFDNLDTFCFIKSRGEERALVVLNFSAGEQPFTQAEMAADMELLVGNYAEAELCEKLRPYEGRIYI

SEQ ID NO: 12988 - protein, 124 aa, Aspergillus nidulans
LASLKVNARRCVRQFPDFPSPGILFEDILPIFSDHSTHEALVRCLELHILETLADEKPDVIVALEARGFLMGPSLALKLGAGFVPVRKRGKLPGPCETQGYEKEYGQDFFQMQSDAIKPGQKVI

SEQ ID NO: 12989 - protein, 329 aa, Aspergillus nidulans
  unsure (1)..(329): unsure at all Xaa locations
ATLREIEGRLKSIKNIKKITNTMKVIASTRLTRAQKAMDDSRAYGQTSNTLFEQAETKALEDKKTLLVVASSDKGLCGGIHSGLSKAARRALEANPNSDLVVLGEKAKAQLSRTNPNAIVLSFANVCKDIPTFADAQAVADQIALLPTDYASVKVIYNKFVNAQSYEPDTVEAYSEEAITQSRXFRFPFQKLFSTDCCSNFSAYEADEETLSNLREYALANSLFWAMAEGHACEISVSLCLRYVXPIILIQXQARRNAMEASILEERVVEIXLNXPFSRTASKNAGEMIDKXVSAKFCGRNSVLIPLQVPILYNRQRQAAITGELVEII

SEQ ID NO: 12990 - protein, 600 aa, Aspergillus nidulans
  unsure (1)..(600): unsure at all Xaa locations
SDHTAEPRPRLRDDRHGTRCAGEVVAARNDVCGVGVAYDSRIAGIRILSGPIDDTDEASAINYAYQENDIYSCSWGPPDDGATMDAPGILVSRAIVNGVQKGRDGKGSIFVFAAGNGAASGDNCNFDGYTNSIYSITVGAIDREGQHPQYSESCSAQLVVAYSSGISDAISTTDVGTDRCYSVHGGTSAAGPLVGGAISLALSVRPELTWRDAQYIVLETAVPVHEDDGSWQVTKSGRKFSHDWGYGKIDVYSLVQKAKTWELVKPQAWYHSPWLRVQHEVPQGDKGVAASWEVTEQMMKDANLEKLEHVTVTMNVNHTRRGDLSVELRSPEGIVSHLSTPRKNDNAEVGYIDWTFMTVAHWYVPSHTQHLILINSXPGVESGVGTWTVIVKDSTVNDNVGEFIDWRLNLWGMAVDGAKQKLHPLPDEHDDDHSIEDAIVVTTSVQPAPTATEAPVKPSHTVDRPVKVELTWTGSASETETPTPTPTPASDSFLPSFFPTFGASKHTQVWIYAAISSIIVFCIGLGIYFHVQRRRRLRNDRDDYDFEMIEDEDEAKAMNGSSRRRGGELYNAFAGESEEEPLFSDEDDDKPYRDQTTGAE

SEQ ID NO: 12991 - protein, 319 aa, Aspergillus nidulans
  unsure (1)..(319): unsure at all Xaa locations
QVIREPYDYIAGIPGKEIRRKLLEAFNHWYKVDEQSCQAIATTVGMAHNASLLYVASSLWLNRVFTSXXALHSIDDIQDSSKLRRGVPCAHEVFGIAQTINSANYVYFLAQNQLFRLRTWPQAISVFNEEMVNLHRGQGMELFWRDNLLPPSMDDYLQMIANKTGGLFRMIVRLLQTSSRQVIDVEQLVDVLGLYFQILDDYKNIQRREGSSSSNQIENXRRLTTSHXMAAQKGFFEDLTEGKFSFPICHAIGEGAKNRTALLHMLRLKTDDMKIKQEAVCILDNAGSLDYTREVLYGLDRKARSLLREFQDSEPFHGG

SEQ ID NO: 12992 - protein, 310 aa, Aspergillus nidulans
  unsure (1)..(310): unsure at all Xaa locations
IDLDECIERLYRKELLADSVIEAICAKAKELLMKESNVVHIAAPVTVVGDIHGQFFDMIEIFKIGGFCPNTNYLFLGSFQHTXNADFSNQFCLTIQGDYVDRGLFSVETISLLVCLKLRYPSRVHLIRGNHESRGVTQSYGFYTECARKYGNANVWHYFTDMFDFLTLAVVINDQIFCVHGGLSPSIHSIDQIKIIDRFREIPHEGPMADLVWSDPDTERDEFSLSPRGAGYTFGAQVVRKFLEVNSMSHILRAHQLCQEGYQVLYDDRLSTVWSAPNYCYRCGNLASVLEVSDTGERFFNIFDAAPEND

SEQ ID NO: 12993 - protein, 196 aa, Aspergillus nidulans
  unsure (1)..(196): unsure at all Xaa locations
SLGLNTGEPTGDPNDPRTCIIKTLALEVQGRPDVVIDVSAPGALEKLKDKPFTIKEGAHFRIKVTFEVHHDVLSGLKYLQVVKRKGIRVSKDQEMLVSLGEXRRPCQDRFIECANWYXGSYAPCTTGKPIYEKKCKSFLSPMERLQYXLLHLSVQEEEAPSGMMARGHYNAESKFIDDDDKVHLHFHWSFDIAKDW

SEQ ID NO: 12994 - protein, 464 aa, Aspergillus nidulans
  unsure (1)..(464): unsure at all Xaa locations
HVGNYTLGRLIGKGSFGKVYLASHKLTNHSKVPAELSTKPSRFMLIMFRSVLKSSDKEDTNLAREIHHHRQFLHPHIARLYEVIVTEKLVWLVLEYCLVXAALRDHMLDVLQQLGDELYNYLLRIWPLPIDKVKKIFTQLVGAVSYVHSKQCVHRDLKLENILLDKHENVKLCDFGFTREYEGKASYLQTFCGTVCYSAPEMLKAEKYAGEKVDVWSLGIILYALIAGELPYDDDDDQVTKARILNEEPKFNDKFPDDAKALINLLLSKRPLLRPSLDEVLAHPFLSEYAAEQLAILKLPRPPPFSTSLEKTTLHRMKSAGINIDDVVDSVMAQRCDALAGWWALLIEKEQRKEAKRERKRRERDAEAKNIRRLSAASSRLEKISAALVEVDEEGYSTAPLHERGRRGSPESTLPACRPXITNAPGATSTISQSHHTTASSSSRQRLNSLPQLHPPSPSRAATQ

SEQ ID NO: 12995 - protein, 715 aa, Aspergillus nidulans
RTHLRTDYVRPCPSLRILPRARLPSLSTNIAAPLSSSSIRNYASGRPHPPGGTHRMNLGGEPEKAALEQYGVDLTAKAKAGKLDPVIGRDSEIHRTIQVLSRRTKNNPVLIGAAGTGKTAVLEGLAQRIVQGDVPESIKGKRVIALDLGSLIAGAKFRGDFEERLKSVLKEVEEAQGGVILFIDELHTLLGLGKAEGSIDASNLLKPALSRGELQCCGATTLNEYRLIEKDVALARRFQPIQVGEPSVAATISILRGIKDKYEVHHGVRITDGALVAAATYSNRYITDRFLPDKAIDLVDEAASALRLQQESKPDIIRELDRDITTIQIELESLRKETDISSRERREKLEEDLKAKREESRKLTEIWEKEKAEIESLKRTKEELERTRFELEQAQREGNFAKAGELRYSKIPSLEAKLPKEGDEQKDPQSTLIHDSVTADDIGAVVSRTTGIPVSKLMAGEVEKLIHMEDTLRQSVRGQDEALSAVANAVRMQRAGLSGENRPLASFMFLGPTGVGKTELCKKMAEFRFSTETAVVRFDISEFQEKHTISRLIGSPAGYVGYDDAGQLTEAVRRKPYAVLLFDEFEKAHRDISALLLQVLDEGFLTDAQGHKVDFRNTLIVLTSNLGADLLIGADPIHSSKASTDGEITPELKKAVMDVVQQAYPPEFLNRIDEFIVFKRLSREALRDIVDIRIKELQSRLDDRRMTLQLTMRTR

SEQ ID NO: 12996 - protein, 543 aa, Aspergillus nidulans
  unsure (1)..(543): unsure at all Xaa locations
MLSTLKVASRQAASRNASVRSVFAGARCASTWSNVPQGPPVRLXRIEIHQNDAFFFLTLRLVXDAILGITEAYKADSFKEKINLGVGAYRKEPQSSSKTFFLSDLRLVLIAVSANLQLXTVADLCSFTPGDDQGKPYVLPSVRAAEDKVVASRFDKEYAGITGIPSFTKAAAQLAYGADSPVLKEDRLVITQSISGTGALRIGGAFLQRFYPGAKKIYLPTPSWANHNAVFKDSGLEVEKYRYYNKDTIGLDFEGLVEDLKAAPNNSIILLHACAHNPTGVDPTQDQWRQISNVMKEKGHFAFFDMAYQGFASGNADTDAFAPRHFVEQGHNIALCQSFAKNMGRLSYLVASRHARXLNLQGLYGERVGAFSLVCESAEEKKRVDSQIKILIRPFYSNPPVHGARVASTIMNDPALNKQWLGEVKGMADRIIEMRALLKKNLEELGSKHDWTHITSPGTXFCGIKEAHQYXHSQIGMFAYTGLKPEQMEALAKEVRPRLNHNVSSVSNAXXHSVYATKDGRISVAGITTGNVKRLAESIYKVT

SEQ ID NO: 12997 - protein, 300 aa, Aspergillus nidulans
  unsure (1)..(300): unsure at all Xaa locations
ERPKVFTGGDQGWVNLKLSDIEILSHNTKRLRFEFPDKEAVSGLHIACEFSERTYYGXMNLQHYPAALLTKYSPPDGSNPDIRPYTPTSDEGTLLIHHSSGAGVICXLTITDQPGYLELVVKRYPNGPMSEHLHNMNVDQRLDFKGPLPKYPWEANKHKHICLVAGGTGITPMYQLAREIFKNPEDKTKVTLVFGNVSEEDILLKREFEDLENTYPQRFRAFYVLDNPPEGWTGGKGYITKELLKTVLPEPKEENIKIFVCGPPGMYKAISGPKVSPKDQGELTGILKELGYSKDQVYKF

SEQ ID NO: 12998 - protein, 168 aa, Aspergillus nidulans
  unsure (1)..(168): unsure at all Xaa locations
AQTTKNSVVIKVGMVGDAQIGKTSLMVKYVEGSWDEDYIQTLGXVLRPLRCRWLLIAPGVNFMEKTISIRNTEITFSIWDLGGQREFVNMLPLVCNDAVAILFMFDLTRKSTLNSIKEWYRQGRGFNKTAIPFLVGTKYDHFVNFPREDQEEISIQVCAAAAAGSSRL

SEQ ID NO: 12999 - protein, 347 aa, Aspergillus nidulans
SALGPSECRSTLLVFQEWSIVFGIVISYWTSFGTRYMAGEWSWRLPFLLQIMPLFNLAAGIMVLSFSPRWLASKGRNKEALQSFSRLRRLPITDRRVRQEYMDSQAELSFHHQINAERLPDLQGGRIKNAILREMASWEDCFRKRTWRRIHIAIMIPFFQQFSGINALIYYSPTFETMGFDLSIQLIMSGVLNSLQLVGCTSTVWTMDTLGRRKLLFAGSVSETISHNIIAALVGRYSSNWASHQTAGWVSAAFLLVYMVAFGAAWGPVGLAIPSGMLTCAILQLVYSHLIRRFIRIFPSSLRAKGVAIATCSNWLNNFIIGLITLPLIERTGYGTYVFFAVFCGIM

SEQ ID NO: 13000 - protein, 391 aa, Aspergillus nidulans
  unsure (1)..(391): unsure at all Xaa locations
GLIPGDGIGREVIPVSRIXVQTSGANETDTELLTXAGRRILEALPASLNLKFNFVDLDAGYDCFKRTGTALPDKTVEVLKKECDGALFGAVQVSCTSLYLLIGQTXTSLGSSPSTKVAGYSSPIVALRKKLDLFANVRPVKTTAGTSAGKPIDLVIVRENTEDLYVKEESTEETPNGKVARAIKQISERASSRIATIAGEIALRRQNIRDGAAASGLRTKPMVTITHKSNVLSQTDGLFRETARAALAAQKFSSVEVEEQIVDSMVYKLFRQPEYYDVIVAPNLYGDILSDGAAALVGSLGLVPSANVGDNFAIGEPCHGSAPDIEGKNIANPIATLRSVALMLEFLGEEQAAAKIYAAVDGNLDEGKYLSPDMGGKATTTEVLEDVLKRL

SEQ ID NO: 13001 - protein, 209 aa, Aspergillus nidulans
  unsure (1)..(209): unsure at all Xaa locations
TGRCXSTXPVFGVLGCTSAIVFTTFGAAYGTAKAGVGVCSSGVLRPELIVKRPLPLPSGXPYQISISXYVPDIVPVVMAGILAIYGLVVSVQIANNLAQEVALYTSLLQLGAGLAVGLCGLAAGXLRSSLSWVIVSNGCXAAIGIVSDAGVRGAAQQPRLYVGMILVLIFAEVLGKXIQLHQYEEGXXSCRGMAGLYGLIVALLMNARA

SEQ ID NO: 13002 - protein, 265 aa, Aspergillus nidulans
  unsure (1)..(265): unsure at all Xaa locations
FSLKGRTALVTGGGRGCGLAFARGLAEAGADVAVLRHHRSTARVSRDXEGLXCSDGVLQVRTPVSAEPFVRSXRRRVDVSSQDSLKDGFAQFQQDFDGKLDICVPCAGINRHTCFLGFTYEEHHDLLSINVLGLYFTAQYAAKQMIANGTHHGSIILVASMASYVAVRDQNCSAYCGTKGAVRAMCPAIAKELTEYGIRVNSISPGYVNTEMTAAFSHLVEGWKAETINKRIAEPEDIMGACVFLASDASSYMTGQDIVVDGGVT

SEQ ID NO: 13003 - protein, 585 aa, Aspergillus nidulans
KTTLLVAPLSTVNNWVSQVKEHLRDGALTSYVFHGSSRTTSVDELSKYDLVITTYSIVLSELSGRGSRRAGSSPLTKMNMFRIVLDEAHTIREQSAAQTQAIFRLNAQRRWSVTGTPIQNRLDDLLSVTKFLGIYPYDDRSRFNMHILSRFKTGDATVLASLRVLVDSFTLRRVKDKIDLPARHDKIVMLEFSESEAQLHEFFRKESNVMMRVIAGEDKSKMKGRMYHHILKAMMILRQISAHGKELLDSDERARIKGLSVHDAIDLEEGPSADAVATDKKAYEMFTLMQESSADMCAICSKRLEEPNPDANGSSVPGKVDIIAFILPCFDVLCPECFSGRKQVFNNRVGDQDSFDVKCDVCEGWISASYSAITAAGLQDYLMEQAREKQTRKQAKVLGEYEGPHTKTKALLSHLLATAEESAKLPEGEAPIKSVVFSAWTSHLDLIEIALRDQGLTGYTRLDGTMSLPARNKALDNFRDDNNTTILLATIGAGGVGLNLTAASHVYIMEPQYNPAAVAQAIDRVHRLGQTREVTTVQFIMKDSIEEKIAELAKKKQQLADMSLNRGKLDKAEVQEQRMREYRSL

SEQ ID NO: 13004 - protein, 403 aa, Aspergillus nidulans
VGASTRSLHADDVLNVVTDVAPPIHVATTLRYSDDPAKLMPAADLNGVSIPKIIPFQRLTAQTLEEQSSYIYSRLTAPTTTRFEAILSSLLNGQTISYSSGLSAFHAALTLLNPRRISIGKGYHGCHGVIDIFNRLNGLQKLDLDCPAEQLEAGDVIHLETPVNPEGTSFNIEQYAKKAHSRGAYLIVDGTFAPPPLQDPFKFGADLVLHSGSKYFGGHSDVLCGVLATQNKDWAQQLLRDRVFLGGVMGNLEGWLGVRSLRTLEVRVQRLSQNATNLVLWLHNALQTPSPAPGSDEEATQKVLEQVFHSSLQKDDESWLLKQMPNGFGPVFSITMREEDYARHLPSKLALFQHATSLGGVESLIEWRTMSDKTVDRRLLRVSIGLENWEDLKRDLVNAFRAL

SEQ ID NO: 13005 - protein, 590 aa, Aspergillus nidulans
  unsure (1)..(590): unsure at all Xaa locations
VLATQAIANVVKSSFGPSGLDKMMVDEIGVCLLRTPQSMAIPLTSARDVTVTNDGATILSLLDIEHPAGKILVDLAQQQDREVRTVHNXCIKALVLNLPGRDGTTSVVLIAAELLRRGNELMKNRIHPTTIINGYRLALREAVKYMNENIATKVDHLGKDSLVNIAKTSMSSKIIGADADFFANLCVDAMLLVKTTNQKNEVKYPVKAVNLLKAHGKSGTESVLVNGYALNCTVASQAMKTRITDAKIACLDMNLQKERMKLGVQITVDDPDQLEKIRERESGIVIERVEKILKSGANVILTTKGIDDMVLKLFVEKGAMAVRRCKKEDLRRIAKATGATLVSTLSDLNGDEKFEASYLGHADEVVQERISDDECILVKGTKVHTSASIILRGPNDFSLDEMERSVHDSLCAVKRTLESGSIVPGGGAVETALHMYLEEFAVTVVRNMAPASSHSFXQNPIGLPEQLAIGEFAQSLLIVPKTLAVNAAKDSSELVAQLRKRHALSQRVQEGEANEKEKAVAKKKEYRNYGLDLTKGRVHDCLKAGVLEPSMGKLKQLKSAVEACIAIMRIDTMIKLDPERKEDDGHGHDH

SEQ ID NO: 13006 - protein, 272 aa, Aspergillus nidulans
  unsure (1)..(272): unsure at all Xaa locations
DSAIMYGNEKACGRAIAASGIDRSQIFFTTKIPPDSMGYNATKRAIDSSLRTAEQEYFDLWVAPTXLKESPQLIGMXILLHAPYGGKEARRGSWKALVEAQRAGKTKSIGVSNYGIHHLDELEAYIQSSGDDGVRESKIDVGQYELHPWLDRSEIVEWLQKRNIIVQAYSPLAHGTRMREPLLKKLGYKYGKSPAQIMIRWGLQKVSVLCSRIRLAPXKTVLILTVPGFVPLPKQSLLAHPGNTEVSDFELDEEDMKSLHTGEYSPTDWDPT

SEQ ID NO: 13007 - protein, 244 aa, Aspergillus nidulans
GQFFDLLEIFRLNGFPSDTHAYLFNGDFVDRGSWSTEIALLLYAYKWLRPNGIFLNRGNHETDDMNKVYGFEGECRAKYNETMFKVFSESFSALPLATLIGNKYLVLHGGLFSDDKTTLDDIRKLNRHNQKQPGQQGLMMEMLWTDPQTEPGRGPSKRGVGLQFGPDVTKRFCENNGLEAIIRSHEVRMNGYEVEHDGRCITVFSAPKYCDTTENKGAFIKIGPELKLEYQVFEAVPHPDIKPM

SEQ ID NO: 13008 - protein, 712 aa, Aspergillus nidulans
  unsure (1)..(712): unsure at all Xaa locations
RMFIDPTSGNPRKFLIDVDSTLHSLLEREDSDRNMQITIEDVGPKVRTALXXSXDKQYXPXFXVFSLGTAASHGYNRFDVRGTYMLSNLLQELTIAKDYGRKQIVLDEERLSENPVSRLSRLIKNSFWNSLTRRIDGRNIEVAGRDPKDWTDDPRPRIYVPPGAPEQLEYYRRNREEKPELRLDVQEXAXEITPXYVRDLNEKPGLLALAMEEKYDEKTGKTDFAGVPFVVPGGRFNELYGWDSYMESLGLLASNRVDLAKAMVINFCFCIKHYGKILNANRSYYLTRSQPPFLTDMALRVYDRIQNEPGAMDFLRHAILAAIKEYYSVWMAEPRLDPVSGLSRYRSPGIGVPPETEASHFLHLLTPYAEKHGMEFKEFVQAYNYGKVKEPELDEYFMHDRAVRESGHDTSYRLERVCGNLATVDLNSLLYKYEVDIARVIRVYFKDKLEIPVEFRTPATKDIQSESSSVWDRRARRRKMRMDTYLWDEEKGMYFDYDTVKQERTNYESATTLWAMWAGLVTPRQASAMITKALPRFEEFGGIVSGTXESRGAVGLNRPTRQWDYPYGWAPQQMLAWTGFARYGYQEEAERLAYKWLYMITKAFVDFNGVVVEKYDVTRPIDPHRVDAEYGNQGVDFKGAPREGYAPTVSIFDCCMLTIANXVRWVNASYVYGLEMLNAHQRRALGAVTPWETYSKAVSAQGSDTVLENRSE

SEQ ID NO: 13009 - protein, 1343 aa, Aspergillus nidulans
  unsure (1)..(1343): unsure at all Xaa locations
WSHGLGAHCCCCPAASPSYXQPTKGPSVQXPDGALSLSPTLSSKDDVRREHASVVEVKATSSETFCLLYALVRLWLLHKWLTTWKRNPEESENEXPLYEVMDRGTQVRATQLRLWKDFKRSHMHSQPFKLEAIVNHIKLACTLVDTGCLAYRAISQEFVQWNKIPTIPIKPLPVDGIGGDLVITRIVRARLDIGGHSEEGSYLYVLPYLLGYDLILGNPWLKRHDGRLEPKRNRLYLRTTKTRLYNTITHPPKPLSLQSLTAAAFQAIKRQATKTGSKTTIFAASLRDIEKALNPKTPTDPRMKLPPEYMDFLNLFEPDNAKSLPPHRGEGIDHKIELVRTNGKEPEIPWGPLYNMSREELVVLRKELTELLDKNFNRVSSSPAAAPVLFVRKPGGGLRFCVDYRALNAITKKDRYPLPLIHETLNQIGRAKWFTKLDVSAAFHKIRIAKGQEWMTAFRTRYGLFEWLVTPFGLANAPSTFQKYINWALREYLDEFCSAYVDDILVFTDGSRELHREHVRKVLVKLNKAGLFLDINKCEFERKETKYLGFIVRAGEGVSMDPEKIKAIKEWEAPTTVKGVRGFIGFANFYRQFIPDFSSLTRPLIELTKKDARFCWTEECQQSFVRLKECFMTEPVLAPFDPDRETIVETDSSGHTTGGTLSQYDLEGNLHPCAYFSKRHSPAGSNYEIYDKELLAVVRCLEAWDAEFRSVSKFKVLTDHKNLEYFYSPRKLSERHVRWSLFLSRFNFKFYYRKGSENERADALSRRDQDSPKGNDDRLESRTMQLLQEKHRGEAIDIPYPKATILPIAPQGGVPTWAEAQSGDDEYMEIRKLVREGARKLPPRLLLKVSMSECSIDAQDNLLFRGRRWVPRNEPLRTSLIKTAHDSALIGHPGREQTYLVVSRTYFWPNMSKDIRRFVRNCDTCGRAKTWKEQKKGLLKPLPIPERPWQHITLDFITDLPNSNGCTVILVLTDRLTKGVILESMAKTTSQEVAWTLVRTLIRRHGIPQTMVSDRGSQCVSGVWKRICQLLGIKRLLSTAFHPQTDGATERANAVVETYLRSYVCYDQGDWDKLIPIAELAINARTSSATGVSPFYLTHGYDLSPFGLTEDLPEQSADQSPIQIGENIARTIKEAMDWAKASLAYSQQEAERQANKKRAPAPTYKPGDKVWLNLRNIRTERPSKKLDWKNAKYTVTKLIGTHALQLNTPPGIHPVFHVDLVRLADNDKLPSQVQDDSQPPPILVNNEEEYYVDSVLDKRWKKIGRGGRWEYLVKWTGWAKPTWEPAHELEETEAAQAYELQQEQQKEDHPNPEPTEQEKRTGSRRTRSYDKINPPVPQLEHGE

SEQ ID NO: 13010 - protein, 110 aa, Aspergillus nidulans
  unsure (1)..(110): unsure at all Xaa locations
IVTIVMAGILGIYGLVVSVLIANNLAQTVALYTSLLQLGAGLAVGLCGLAAGXGKPAEPSFSSXLLAVGXLMSGFAIGIVGDAGVRGTAQQPRLYVGMILVLIFAEVLGM

SEQ ID NO: 13011 - protein, 699 aa, Aspergillus nidulans
  unsure (1)..(699): unsure at all Xaa locations
FIAPLAFFGSAHAQEDDSVQENYGTVIGIDLGTTYSYVNXGEXKSEPKLTGASCVGVMQNGKVEILVNDQGNRITPSYVAFTDEERLVGDAAKNQYAANPKRTIFDIKXVFSKYLVERFLTRVGVLIGRKYDEADVQRDIKNYPFKVVNKDGKPNVKVDVNQTPKTLSPEEVSAMVLGKMKEIAEGYLGKKVTHAVVTVPAYFNDAQRQATKDAGTIAGLNVLRVVNEPTAAAIAYGLDKGSEERQVIVYDLGGGTFDVSLLSIDDGVFEVLATAGDVHLGGEDFDHRVMDHFVKQYNKKNNVDVTKDLKAMGKLKREVEKAKRTLSSQMSTRIEIEAFHNGQDFSETLTRAKFEELNMDLFKKTLKPVEQVLKDAKVSKADIDDIVLVGGSTRIPKVQAMLEEFFDGKKASKGINPDEAVAFGAAVQGGVLSGVEGTESIVLMDVNPLTLGIETTGGVMTKLIPRNTVIPTRKSQIFSTAADNQPTVLIQACKFLISSSTKVSPFXRSTDEGERSLTKANNLLGKFELTGIPPAPRGVPQIEVSFDLDANGILKVGASDKGTGKAESITITNDKGRLTQEEIDRMVAEAEEFAEEDRAIKAKIEARNSLENYAFSLKNQVNDENGLGGQIDEDDKQTILDAVKEVNDWLEENGASATTEDFEEQKEQLSNVAYPITSKLYGSAPPTEEDDDEYGHDEL

SEQ ID NO: 13012 - protein, 413 aa, Aspergillus nidulans
  unsure (1)..(413): unsure at all Xaa locations
IPKVQTVALVREIGGPVEFPNDYPVPTPGNNEVLAKVLYTGVCLSGNFRSHTSLCLDHISNGERQLTVYFVDLHTKDAVAPGPDGIPITKFKLPHIGGHEGVGRIVALGPGCGPDLKLGTLVGIRFASRVCRRCEYCLAGTEQYCLKGTNPLHHEDGSFQEYIALDADYLTILPDDVDPKTIAPVLCAGITAYKVEWARAGYRSTCXXYSRQFLGANIRAGHWLVVVGAGGGLGHMAGEIPIERHLNPNSRHREQQSNTAKVLGAQDDWIDAPDKTRFRSECGATEFVDFVNTDPVQRVHEITXPRRTFCGVTAGSGKAFAHVCEMLRTGGTLSCVGVPSGDAKFETPICTIVIKALKVVGSVVGSLSECMEAVELTRRGLVKPKIQVRPLRDLSLVYEEMERGSISGRIVLE

SEQ ID NO: 13013 - protein, 352 aa, Aspergillus nidulans
ELLTSGNTTVYEFNPWEFGCFDPTVYGFAPLEYLGSRFINGSIPRNESCVRGFDNAGFVMGTSSSLFNQFFLQLNGTSLPDFLKDVIGDVLADIGEDDNDIAVYSPNPFYGWLPQNSPYAGEENLDVVDGGEDLQNLPLHPLIQPLRHVDVYFAIDSSADVNDWPNGTALVATYERSLNSTGIGNGTEFPAIPDQNTIVNLGLNTRPTFFGCDSTNTSAPLVVYIANRPFVYQSEETISNFSTFQLSTSLEQRDNSIQNGYAVATMGNSTEDSNWSACVGCAILSRSFDRTNEQVPDICTQCFDRYCWNGTLNSTTPAPYYPAAVLGSGSSKLFPTVLSSVVAASIAIATMV

SEQ ID NO: 13014 - protein, 1122 aa, Aspergillus nidulans
  unsure (1)..(1122): unsure at all Xaa locations
LTDQVVKNRDRDRAAGYKPRELGVTWQGLSVEVPTAEASVNENLFSQFNIPQVAKDYFRKPPVRPILSDSHGCVKPGEMLLVLGRPGSGCTTLLNLLSNRRQGYRMIKGDVRFGTMDPKEAERYRGQIVMNTEEELFYPHLQVGATMDFATKLKVPAHLPDGADSIDGYVKETKDFLLESMGISHTAHTKVGNEFVRGVSGGERKRELQLTIFKSQELIIKGVSIIECLATRGSVFCWDNSTRGLDASTSLEWAKALRAMTDVNGLATIVTLYQAGNGIYNLFDKVLVLDEGKQIYYGPAAEAKPFMEELGFVYTEGGNIGEWHTKSXXISFLTRDNRRFLTGVTVPTERRIKPGYESRFPRNADEIRALYEKSPIYSQMIAEYDYPQTPLAKERTEAFKESVAWEQAKELPKGSSLTVGFWSQLLACTIRQYQILWGEKSTFLMKQVLSLAMALIAGSCFYDAPDDSSGLFIKGGGVFFAVLYNNIVAMSEVTESFKGRPVLVKHKSFAMYHPAAFCLAQIMADFPVLLFQCTIFSVVMYWMIGLKHTAAAFFTFWAILFTITLVSLKSRNGKXQPCXPTLFNSAXQAMFRCIGAAFKTFEAASKISGTAVKGIVMYAGYMIPKPDVRNWFVELYYTNPFAYAFQAALSNEFHDQHIACVGENLIPSGPGYEDAGCRPPSLAGVGGALPGAAYVTGGSVYGSLHYKFTQLWRTTAVAWVSLGPLAGLTIIFTTFWNAGAGSGSTLFVPREKIKQHQRHKDEESQSQVGAATARDGGDTSLDEGNISRNTSIFTWQNLTYTVNTPTGERVLLDKVNGYVKPGMLGALMGSSGAGKTTLLDVLAQRKTDGTIKGSIMVDGRPLPVSFQRSAGYCEQLDIHEEYATVREALEFSALLRQPRTTPRRGKVEIVDTIINLLELQDLADTLIGGVGNGISVEQRKRVTIGVELVAKPSILIFLDEPTSGLDGQSAYNTVRFLRKLADIGQAILVTIHQPSAQLFAEFDTLLLLARGGKTVYFGDIGENGRTIKQYFGKYGAQCPVEANPAEFMIDVVTGAIPEVKDNDWHQIWLESPENAKMIKDLEDMIADAASKPPGTHDDGFEFSMPLWEQIKIVTHRMNVSLY

SEQ ID NO: 13015 - protein, 431 aa, Aspergillus nidulans
TNTPDTILAHIDRRLYLDDSHPLAITRKLIESQFPRPVYGNYSEKDPIVTTAQNFDVLGFPADHPGRSRTDTYYLNEKTVLRTHTSAHQQAYFQQISRNEETRPEEVGYTVVADVYRRDAIDRSHYPVFIQMEGAMLWKRPADKPLEHAKQTAAAIMKDVYSIPSHSVPVEDPNPTIHPQRNPLQADYHSEEEVEAIAAHLKRSLERMVIKVFSEAQKASAASEGAEAETLRVRWVEAYFPFTSPSWELEVFWQGDWLEILGCGVVKQELLNNSDVPNRVGWAFGLGLERIAMLLFNIPDIRLFWSKDERFLSQFKAGQITRFEPFSKYPACYKDVAFWLPSAATSGGSAAGGAVPVHENDIMEIVRGVGGNLVEDVKLIDEFIHPKTNRKSLCYRINYRSLERTLTNEETNDLHDKVRQKLVSQLCVELR

SEQ ID NO: 13016 - protein, 388 aa, Aspergillus nidulans
  unsure (1)..(388): unsure at all Xaa locations
MSIPTMQWAQVAEKVGGPLVYKQIPVPKPGPDQILVKIRYSGVCHTDLHAMMGHWPIPVKMPLVGGHEGAGIVVAKGELVHEFEIGDQAGIKWLNGSCGECEFCRQSDDPLCARAQLSGYTVDGTFQQYALGKASHASKIPAGVPLDAAAPVLCAGITVYKGLKEAGVRPGQTVAIVGAGGGLGSLAQQYAKAMGIRVVAVDGGDEKRAMCESLGTEVCTCSQSQEASNXPGQTYVDFTKSKDLVADVKAATPDGLGAHAVILLAVSEKPFQQATEYVRSRGTIVAIGLPPDAYLKAPVINTVVRMITIKGSYVGNRQDGVEALDFFARGLIKAPFKTAPLKDLPKIYELMGALTPISDLILFARYIXILMACEQGRIAGRYVLEMPE

SEQ ID NO: 13017 - protein, 300 aa, Aspergillus nidulans
  unsure (1)..(300): unsure at all Xaa locations
STSLLDHIFTMSKPGDYNAVRRDIAAQLKKPGYDDGSAGPVFVRLAWFVPDTELLLYPDGDRXQAFNRHSSGTYDAASDTGGSNGAGMRYEAEGGDPANAGLQHGRAFLEPVKEKHPWITYSDLWTLAGVVAIEEMGGPKIPWLPGRTDFVDDSKVPPRGRLPDGAQGADHLRFIFYRMGFNDQEIVALAGGHNLGRCHADRSGFQGPWVNNPTRFSNQFFKLLLNMEWKPKTLENGVSQFVYIDPEAEDHEEPLMMLPTDVALRDDPAFRPWVERYAKHKDLFFDHFSKAFAKLIELGI

SEQ ID NO: 13018 - protein, 513 aa, Aspergillus nidulans
  unsure (1)..(513): unsure at all Xaa locations
TLTFXGGITCAMPFGSLVGALASSFLADKYSRVTAIQFSSTLWIIGSVVRIVYLLFDLIXLFSFQCAANGIPLLVVGRVIAGLCVGIASAMVPVYIAEVSPKHIRGRMISLQQWAITWGILIQYFIQYGASNVDGGPDNETQSTAAFRIPWGIQIVPGVIYFVGLFLYPKSPRWLASKDRWDECMHVLARLHGNGDMNHPLVLAQYKEIQDALALEREQASTSYQELIKPRIAKRVFLGMSLQMWSQLSGMNVMMVRMFFAIRAQSNXQTQYYIVYIMQSTGAGSPLLTASIQYILNTALTLPAILWLDRFGRRPAILIGFTMQAIFLYIEGGLQAGYGRSTRPSDDLNAISWTVADHPGVGKAIIAMSYLFVCSFATTIGPTSWTYPAEIYPAKVRAKAVSLATASNWTWNCLLALFVPPLLWNINWKMYMIVRLPTHQPLHPYKQDTNGVLCTVAAFNTVAALNMFLTAPETKGYTLEEMDEVFESGIAPWKKRKISSRLEQIEREIAEGN

SEQ ID NO: 13019 - protein, 661 aa, Aspergillus nidulans
  unsure (1)..(661): unsure at all Xaa locations
TYDYVIVGAGVSGLTVANRLSENKKLSVLIIEAGGLYVSSFFLLVLPRASVQEILIDLATKTKTLSLFLALAGNAIGTKYDWNLTYAVNPDLGNRTVSIPQGKAVGGSSLLNRMVFDRGSKADYDRWEALGNPGWGWRDLFPFFKKYAYARPRAIELIXSTXSENFTPPSEDVIDEWNATYDPAVHGTTGNVQSSYAPWIWPSTKQFISAITSLGVHVPRDGASGDALGGFFVPHSQDAISVTRSDARRAYWDAVSKRPNVHLLTGQRVTRMISKRTSRRVQITGVEVCTYPSSQPLFTVYEQXRMNXCEXFHQFAAHRSGARTIVNARKEVLLAAGAIHTPQLLQLSGIGDRATLNRHNISTVADVPGVGRNLQDHLHVPVVFSCRXQARDSTTALTMTVDFPLTATNLTTNSTFAAESWALYRTHKTGPYADATGDFLAFFPTVNFTSQADVLQGIAADQNPQAYLDKDTPPSIVDGTPSSINSSQADSPLRMSAARNHLGGRHVCLGLQHPFSRGSVRLASSDPFAQPLADPAYLRNPVDVRILIEAIKYARSLTTTLSLAAFNPVELVPGGSITSDEDLEAYVRGAVDSLFHPSGTCAVGKFELGGVVDVDFKVHGVKGLRVVDASVLPMLPATHIQSSVYAVAEKVSSLLFLESYP

SEQ ID NO: 13020 - protein, 550 aa, Aspergillus nidulans
  unsure (1)..(550): unsure at all Xaa locations
KANWRVFAITLYMGIALFEYGFDKGAIAGFQAMPGFLQVFGYQTESGEWDIHVQRSISFPQHFLFSPIAXYTSLFCXHCRLTDXAGPQQIITSFMILGSVIGSLLTGFVGARIGRRYGLMLGSLIVIICVVIMSETTVLGALYFSRLLIGIGNGLLLNFTVLYLQECTPPRFRGLCLSMVTCWITIGTTIGMVSLLHSPYPWFEDXERKLLIXTXVINHQTNGMMSREAYRIPLYVCYPAPAILILTLPLLPESPRWLLQHGKPEAALRSLQFFRQGAYDEVAVQQEFEEMKAAAARERDQEIHQNKWLLFFELFRGHNLRRTIIAVAVGTANAAVGAMFILSYGTYFFQVVRHPLPFIPSLGLTGSPTGKCRRSIQVDIVTNCVGLAGLFTTWAIVTHVGRRRIILAGCVICTLPMLVMAAVYSAPNVSADGAGIALVVIVSIYVFGFNFGLEPYVYLVAGEMPSQNLRGYTMGLSTAVSFVFAWLSAFTTPYFINPGELNWGPKYGYIWFGSGIITTAFLWYYLPEVRGRTLEEIDEMFRNNVPTRAF

SEQ ID NO: 13021 - protein, 481 aa, Aspergillus nidulans
  unsure (1)..(481): unsure at all Xaa locations
MVLDYSKWDALELSDDSDIEVHPNVDKRSFIRAKQAQIHQQREQRRLNIKTLKYERIINDGLLSRIEKLLTSFKEKEGSSSNPEEVIFSTLMELASNPEDDQPPSPPEGVHTQEREQPKYSQMMSSLVDQVKAEVEESKHDNVFEAYVKGVQGHKDKVQELQKELLTKLAELEKEEGSKITSESIHTGFDTSHVSKAKAKDKVPASERATSVELLNPKAATEPSNQESNDNEAVDDPDSIQASALAKKFAKIDRNDYRALHQFISDHPEIVAEKETDGLLVEAFNSQMEGKETYARQCVHQGLLLQYCRSLGPDGISLFFKRXVSXSHVCREVXACRVVTDXSLVXYHDKGHQAGTLFRNDVNETYNKIKTRAAELAKDSSASNDPAGVEQIQLHAVDPNTKITINIPRSESNEPVEIEARKIFESFSKELQTALESESLDEVNKVLGKMSVEEAEDVVEKLGESGMLSLEEGIVDATTEE

SEQ ID NO: 13022 - protein, 479 aa, Aspergillus nidulans
  unsure (1)..(479): unsure at all Xaa locations
MQGNITALYDIGCVLGSIVSYFVGERLGRRTMLIAGGGIMVIGTVILASSDTVAQLIVGSYSPXASKSPGTLGLPLSTDVXXVELVGRIVTGVGNGMNSSTAPVYQSECAPAAYRGALLTLQGTVTILGVVIAYWVRAQGSGMGYISLKLTAHRMDYGPSFTESSLQWRFPLAFQAVFAIFLVLQVIGLPETPRWLVQHDRHEDAREVVAAITDRDVNDPQVVRTVLDIQVGLEEEQKGGPFKFKELFAWGEEQNLRRLLVIISVELGQQFTGSNMINYYGPVMFQTTMNMGRNLSMILGGAIQCTYLVGSAIPVLLMDRFGRRTLLIVCSVGLCFCFVMVSILLSLGSTNAAYGATAFIFIFQIFYGIGWLPVPWFYPSEISTTRTRTRMQAIASAWNWMAVFAVVKITPLAFRMVLQPSPSRITRADGIENIGWRTFVIFAVLNAAFIPMVYFFYPETKGLELEDIPLLFSKGGFTG

SEQ ID NO: 13023 - protein, 522 aa, Aspergillus nidulans
  unsure (1)..(522): unsure at all Xaa locations
VRQVCIIGAGKEGVITGIILASHNPEVEFCVADTDEELIRLWKSDTLPFSEPGLENMFFDDGALHATRSEDEKEDGKHANIDHGQDQDQQRLTGKETAAHVERRKKLSNLTFSADIHAALVPAQLVFLCLEMDPSAGASSVPSPILRLKSFPLLLTRSXDESSSHSYLDSALYTIALASRGHKIIVQRSTAPYGATAYIKNRVCRPLPINPAPNASVRXLTRNTLVTSNIFAKATHTVLANPVLAVPFPGSLIASMITPSSVIIGHIFSSTASTPAITALKRLYASFVPEDRIVTMDAYSAELGTISAKAVIVQQMMALNSVHMICGKVEASPGNVGWILGGLDIAAVRTGVWMRREVRCLVNLAKGLGMEEVKAYWEGVLKLEGMKYRRDVRNFLETLNQGEDRKKAALILTDAMGDQETALVLLDELKRAEVTIRAWVDCATKEQSHNVLQTVRGRVEGLEVANSLESACAGSNVVILHGSLGIRDEAMQAIRXNMERPNRLLNLGDRMDEMKMRHVGFR

SEQ ID NO: 13024 - protein, 198 aa, Aspergillus nidulans
DSTIPPLFRAKLADYFRSGYDRGHQVPAADAKWSQEAMDGTFALTNMCPQVGEGFNRDYWAHFEEFCRDLTKRYPSVRIITGPLYLPHRDADGKWRVNYEVIGTPPNVAVPTHFYKVVYAEEGPGLPSGKVALGRFVLPNARISNDKRLAEFEVPLETVERASGLEFASKLEHTRRKRLCQEVRCDIVVREFNNAKKK

SEQ ID NO: 13025 - protein, 501 aa, Aspergillus nidulans
  unsure (1)..(501): unsure at all Xaa locations
GHIHDEPRPEAKPVEKLRYEFGGPIGVSALMVGFPLVMYYMFIGAKVYDGKLPLPESNQSITDFLVHFVDLAYEHAYPHKKAWTIYWSFLIFEGFAYLYLPGVYRVGKPLPHLNGHQLPYYCSAAWSWFVTIGLALGLHFTGIFRLDALITEFGPIMSVAIASGWMVSVIAYVSALARGAQHRMTGNHIYDFFMGAELNPRLFKWIDMKMFFEVRIPWFILFLLTLATALKQYEQLGFVSGEVCFLLMAHFLYTNACAKGEDLIIPSWYVKIMSFSPENQESXYLGLXDMYYEKWGFMLIFWNLAGVPMSYCHCTLYLAYHDPSTYRWNPVTLIIWAGLYLFFYWIWDTCNSQKNVFRAEERGASVDRKSFPQLPWRSVKNPKTIKTADGGLILCDGWCTSNNHSKSLLFSGYVYXWLVQLTDGIARKMHYTCDWFFAISWGLITGFDSPFPWFYSIFFTIMIIHRARRDIRRCRERYGEAWKEYEKQVPWLFIPVSLPLF

SEQ ID NO: 13026 - protein, 935 aa, Aspergillus nidulans
  unsure (1)..(935): unsure at all Xaa locations
MSFLGSISPNLPRSQSVVSHNLPQAHGLDENDDIYHNHSTTAQPGASEKDKSEDGETLHENEPDGEARVTLLARQLTRHSTRLTAKSTLENPFFLDDSDSTLNPNSPNFRVRDWMKMLLEIRSRDPERYPDRTAGIAFKNLSVHGFGSPTDYQKDVMNVLLEIGTIARRLAGMKMPKIQILRDFEGLVRSGEMLVVLGRPGSGCSTFLKTIAGEMNGIQVSDDAVLNYQGQPPSTSGSLAILXIRFXHLSSRHSSKNMQNSFRGEAIYTAENDIHFPQLSVGDTLMFSALARAPRNRLEGVSRKQYAEHMRDVVMAMLGLSHTINTRVGNDFIRGVSGGERKRVSIAEATLSQAPLQCWDNSTRGLDSANALEFCKNLALMSKYTGSTACVAIYQASQSAYDVFDKVTVLYEGRQIYFGNTKDAKKFFVDMGFECPERQTTADFLTSHTSPAERLVRPGYEGRVPCTPDEFADACETSESRAQLMRELMXYDRQSPIGGPSWYAVVDARKSMQSXRQRVNSAYPISIWQQVSVCAVRGFQRLRGDFSLLTASLIGTFMMALIIGSVFFDLPDDASSFYYRGALLFFAVLLNAFSSALEILTLYSQRPIVEEQSRYAFYHPFAEAVASMIWDTPYKLVNSFTFNVPLYLMTYLRRDAAAFFTFWIFSVVTTFTMCMIFRTIASTSRSLSQALVPAAMLILGMVIYTGFTIPTQNMLGWPRWMNYINPIAYSFESFMVNEFDGRQFECCVIIPSGDEYNNVSMQYRICSTVGAESGSRIVDGGQYLELSYQYTKSHLWRNMGILIGFMVFFAFTYLLGTEYISEQKAKGEVLLFRRGRQPDLSTTEADPDEPIQPSNAPKTEESAPQNTARIQRQTAIFHWEDVCYDIKIKGQPRRILDNVDGWVKPAPATALMGVPEQEKTTLLDVLATRVTMGVV

SEQ ID NO: 13027 - protein, 445 aa, Aspergillus nidulans
  unsure (1)..(445): unsure at all Xaa locations
GITEVQIIQWYVEEGARVEEWKPLCQYQSDKAGCRCWFPLALDALVRANIHIXITSRYEGIVKKLHFQADDTVPTGRGKKLPRNIFLAMLISACLXALCDIEVDDAQYPEDHPPTESNAETSPPARTTIDSQPVPRPTTPLPASPAAEIPSNGAKGRYATLATPAVRGLLKQLNVNIEDVKGTGKDGRVLKEDIHRFVAMRDAPSATPSLSQDADTAVNLTHIQTQMFKTMTRSLTIPHFGYADELNINNITALRKKIANDKSDPRKITFLSFVVKAVSLALNDYPILNAKLDTSNADKPQLIMRPRHNIGIAMDTPQGLIVPNIKDVGSRSILDVAQEISRLSALGKEGKLTPADLSGGTITVSNIGNIGGTYVSPVLVPNELAILGIGRARTIPVFDDAGQVTKGEVVNFSWSADHRVVDGATMARMASKVKELIESPERMLL

SEQ ID NO: 13028 - protein, 538 aa, Aspergillus nidulans
  unsure (1)..(538): unsure at all Xaa locations
FIMGFMLRKPDDAAGSAAPAILIGLFVAFGGVLYGXVSCSFRWSTLGLPNMLXYDTGTISGILAMKYWRRQFSTGYVNPNDHIPDVTSSQSSMIVSLLSAGTFFGALTGAPVADYFGRRIAMILDCFVFCFGVVLQTAATAIPLFDAGRFFSGFGDGLLSATDSLYQAETALKWIRGTIVGAYQLAITIGLLLAAIDNNSTKDRNDTGCYRIPVAVQFAWAIILVVGMIILPETPRFLIKQDNHEAAIKSLARLRRLDINDLAVVEELEEIKANHEYELSVGKASYLEILRGSIGKRLATGCAVQALQQLAGVNFICFVPLSLTRRLAMSLTVTVYYGTTFFQHSGINNSFVITLITNIVNVVSTLPGLWMVEKWGRRPLLLFGAVGMCVSQFIVAIVGTTTDSGVANKVLIAFVCVYIFFFASSWGPVAWVVTGELFPLKARAKCLSITTAANWLLNWAIAYATPYMVDSGPGNANLQSKVFFIWGGFCLIAGIFVWTCIYKTKGLTLWEVDALYAKVPVAWRSKGFVPSVHYTDVR

SEQ ID NO: 13029 - protein, 214 aa, Aspergillus nidulans
DSIERIDQRYDPPPNQNVIRSRLQTPGIAKTTFIAAILTYRMFDVGGQRSERKKWIHCFKNVTTILFLVAISEYDQLLFEDETVNRMQEALTLFDSICNSRWFVKTSIILFLNKIDRFKEKLPVSPMKNYFPDYEGGADYAAACDYILNRFVSLNQAEQKQIYTHFTCATDTTQIRFVMAAVNGKLLSFTVGSSFANALGRYYIQENLRLCGLI

SEQ ID NO: 13030 - protein, 551 aa, Aspergillus nidulans
  unsure (1)..(551): unsure at all Xaa locations
GGLETGFFQIQFKDPKHFTWLLCSFASMGGLLSGIDQSTISGANLYLPKDLHLDARQNSLVNSGMPLGAVGGALILSPCNEYLGRKWSIIISLILYTIGAALEAGSINYGGFDFHLWSYMTAGXRGLPRHDVAARVILGVGVGLEGGTVPVYVAETVERRIRGNLVSLYQFNIALGEVLGYAISAMFLRVPGNWRYILGSSLVFSTIMFVGYVEPYLQIHTKSCXPLVSXNAFLPESPRFLVHQGKTLDAYKVWKRIRGIQTVEARDEFFVMTASVRQEENEVHEGAHNKRFPWMDFFTXAPPSALGALSAHHNRPDSAPYXHVYSVPRARRSLIYANIMIILGQMTGINAIMYYMSVLMNQIGFNEENANYMSLVGGGSLLLGTIPAIFLMESFGRRFWAIVTLPGFFIGLVLIGASYQVDLKTDLMTVEALYLTGLIVYQGFFGCYACLTWVVPSEVYPTYLRSYGMTTSDALLFLMSFIVTYNFTAMQEAMGKTGLSLGFYGGIAAVGWVYQVFFMPETKDKTLEEIEEVFSRPTMDIVRENWAGVKE

SEQ ID NO: 13031 - protein, 604 aa, Aspergillus nidulans
  unsure (1)..(604): unsure at all Xaa locations
VQAIADVLGPDAVTMDEDDIDMHSYTEVSTSHCATRPVAVVRPKNTEEVSSIARICSEYKIPMSMPPRERFYNRQELTSTAMIVPFGGGSSVEGHFTAPYSGLSIDFSQMNQIVAFHEDEYGILEMDCTLADTXXMDVVVQPGVNWMDLNREIKDSGLFLPMDPSPTVSSLTFHCEYYSHGSRHLIGGMVATNCRYLLPPELKETQIRADTMSVVEPNAVRYGTMKDWVINLTVVLADGSIIKTRHRARYVPRSLDFVHHERNCLSNKPRKSSAGYNLTGLFTGSEGTLGMITEITLKLAPIPEKQSVAVATFQSIREAVACASKIIRQGIPIAALELMDEVQMQVLNRNGGAGGRMWREEPTLLLKXVHFCNSLVTANSYNSLCMIRFAGTSQSIDADIGRVQRIIPEEGGKSFEFARTEAEKGNLWAARKEAVWAMLAQRPEGTQLWSTDVAVPLSRTPEIIGRWQVLAYLSGSMLYXDLSSXVQIYQRKSAEGLGLFSSILGHVRDGNFHQAVVYDPSSPTQTQIVQECVRKMVHKAVEMEGTVSVCPLEVLYXRITNLAGVSQGEHGIGLGKKECLLEELGLETVALMRTFKRSVDPKXV

SEQ ID NO: 13032 - protein, 201 aa, Aspergillus nidulans
  unsure (1)..(201): unsure at all Xaa locations
VEKYRPVFLDDVVGNTETVERLKIIAKDGNMPHVIISGMPGIGKTTSILCLARQLLGDSYKEAVLELNASDERGIAAPKLAIIVFXLVGLXRYDVVRNRIKGFAQKKVTLPPGRHKIVILDEADRYVYAHVFXTCHLRGFXMTSGAQQALRRTMEIYSSTTRFAFACNQSNKIIEPLQSRCAILRYARLTDAQIVNDLKQV

SEQ ID NO: 13033 - protein, 541 aa, Aspergillus nidulans
  unsure (1)..(541): unsure at all Xaa locations
TLHSPSKLVLFLPXPRDKCYTLPASTKMTFMGLVGSSLATARICMILIPAFLLFGYNQSNLGGVLDYPSFTRNFPSIDTSNTKGAVKDHNATVQGNQYQSPILLLRLLLCLLAALSTFSYLPTASSLGTIVAVYTLGCLVGSLGVTQLGNRIGRRKSLIVSAVVATVGLVIQASSYSLGQLVVGRLVSGAGNGGVNAIVPVWQSECTQPKSRGKNVVIVGVFIASGIAAAGWVNVGLSYLEESEVAWRLPLAIPILFTLPLMTLTMTFPESPRWLISNGRREEAHAAIWALTGREESTAEMQELERVLQQTPTQERGFMDLLIPGPQRLFYRLCLAVGINFCAQMTGANVISYYGKTIFRDSLGLSGDKASLLNAGVLTWKIFAAISAYLSVDRFGRKPLFITACLGMGLSMAGLAGTVWAIENRPGSTLGASVAATFFLFLFMTFFPLGFLGANFLLGSEIAPQDLRVHLAAVGTAAHWLFNFVIAEITPVAFTTIKYRYYIVYAVIGVSASIMVYFFCPETKGRSLEEMDSLFSEPEAW

SEQ ID NO: 13034 - protein, 287 aa, Aspergillus nidulans
  unsure (1)..(287): unsure at all Xaa locations
GKFDTEFINRLPPSCKYICHNGAGYARSHIFSLPAEPXLIETSGEGYDPIDTDACAKRGIVVTNAPDPVTDATADLAVFMLLEPLRQFNPAMNSLRVGIFKTGVAVGNDPQGKVLGILGMGRIGRAIKKRCDPFGLKTVYHNRTVLAPEQAAGAEYVSFDKLLAESDIISVNVPLTGQTKQLIGAAELAKMKRGVIIVNTARGAILDEAALADALESGHVGAAGLDVYEREPEVNEKLLKQERALMVPHVGTHTAETLAKMETWAMENARRAITGEALLSPVPEHQG

SEQ ID NO: 13035 - protein, 367 aa, Aspergillus nidulans
  unsure (1)..(367): unsure at all Xaa locations
VITQMTQFNASIGYLSSIQQGVYVASILLSSSVSSLTSGRVSDRISRRYGILIGNVISLLGTVISACSPNFASLIVASLVTGAGMGQDISVTTVYLVEIAPVAIRGVAACLLQTCVVFGIMTGYFIAFGSSNIAGNSWSWIVPFIVQAVVAAVLSLGMVLVPFSPSWLAQIGRNNDAKKVLFKLRPVATVEAEFEEIRQSLDPEKQQQTASIKEIFKRKYRSRTVLGIFLKSFQQLTGVPQDPQLFFFXHSXGXHGHLQIDVVLYYAPILFQQAGFTSQRASFLSSGVIGIVMLACTVPPQIXVDCWGRKTPLIIGGAAMAICFIVIGSLYARFGRTEGNKVALASDSAQWVVIVLIYFFVANFSRS

SEQ ID NO: 13036 - protein, 211 aa, Aspergillus nidulans
  unsure (1)..(211): unsure at all Xaa locations
DVSNPDSVNNALSEVIAKHGKIDHLVTSAGFTENFDAISYPYDRMQKLWGVNVDGTYLFATGVAKHLMERKAPGSIVMIGSMSGAIVNVPQPQAPYNAAKAAVRHLASSFAVEWAGHGIRVNCISPGYMLTALXVPESLQNSXARTICXFVATRTRKILDENPELRDKWISLIPTGKMGVPEDLMGAVTFLLSDASKYITGADLRVDGGYT

SEQ ID NO: 13037 - protein, 467 aa, Aspergillus nidulans
  unsure (1)..(467): unsure at all Xaa locations
AGSKVVEKGSVDGAPAAKLHITELPMTWSNWYQHVNWLNCFFVLFIPLVGCIGAIWTPLRLHTAIFAIIYYFNAGLGITAGRFFLAVSAMGALRERINXPFLSRYHRLWAHCCYKATLPLQIYLALAGAGAGQGSIRWWSRGHRAHHRYTDTEKDPYSVRKGFWYSHIGWIIMKQNYKKVGRSDASDLDADPVVIWQHKNYINTALFMTLIFPTLVCGLGWGDWRGGFIYGGILRVFFIQQATNCVNSLAHWIGEQPFDDRNSPRDHVITALVTLGEGYHNFHHEFPSDYRNAIEWWQYDPTKWMIWIWKQVGLAYDLKQFRANEIEKGRLQQMQKKVDARRAALDWGVPLKELPVFSWDEFIAESANRALVAIGGVIHDVSDFIKEHPGGKTFISSAVGKDATAMFNGGVYQHSNAAHNLLAMKRVGVVRGGGEVEIWKDAKQPSKVSFPEMVRAGEQITRRTVPV

SEQ ID NO: 13038 - protein, 817 aa, Aspergillus nidulans
  unsure (1)..(817): unsure at all Xaa locations
INNVESNDTVDRNAVLDDHDAEKILPYEADDSPFPEVRAVVRPVDDVELPLNTIRMWIIGILFTIVCAPLAVXPLTFSLSGADXECYLKVGSGLNQFFSLRQPSVRISALVAQLVAYPIGCAWAKWMPLGWLNPDRRFNIKEHALITIMANVSFGSAAATQVIEAMVKFYHMPSQGGFQILLCITTQLFGFGVAGMVSRWLVEPATMIWPQVLSNAALLSTLHSKSNKVADGWTITRQKFFLLVFVGGALWYFLPGYLFTALSMFSFVCWIAPTNVVVNQLFGQKTGLGMSLLTLDWSQVVFANDSPLLVPFWAGLNVMGSFVLFFWILVPIIYYTNTWYSAYLPLLDSNTFDNTGRMYDTRRVMNINNGTVNVEAYRNYSPMFIPAGFAVTYGVAFANLTGIFVHTALYHGKDLLQQWSGRHKKDIHSRLMQSYTPVPWWWFGAVSLLMFILSIVNNEVWETRLPAWGVLLAFVLPIIYFIPVGIIKALTNITSNQLNLITEFIGGYAFLGKPVANMAFKFYGYVTVSQGLEXVPTVNYHVSPMSLNAIPDLSQDMKLAHYLHIAPRTLFFAQGLATLIGAIVQCGVTVFMLTRFEGICTPHADGGFTCPHGLVTFSSSLIWGYVVNSTTXSIDLXLIVITKPGALGPARNFSPGQIYGNLLWFFLAGPVVVIITYLLGRRWKAANYISWPVAFGAMSMVPPATGINFSSWWVVNVIFNGLVKRKRPAWWSKYSTSSLASVLLQKCVPGXQYPDYVLSAALDSGVAVSTVVIFFCIMLPAGPLRWWGNEVFMRTADGRGTPWKTVPPHERFGPSTW

SEQ ID NO: 13039 - protein, 354 aa, Aspergillus nidulans
KVWHNPVHERNEKNETETQKACFKFLDLTSRSFSAVIKELHPELLLPVCVFYLALRGLDTIEDDTSIPLETKEPLLRNFKDFLEQDGWTFDGNRPEEKDRELLVQFHNVVTEFRNMKPAYQVIIKDITDKMGNGMADYARKATFEDASVKTVEEYDLYCYYVAGLVGEGLTRLFVEAEFGNPALLKRTRLHKSMGLFLQKTNIIRDIREDEDDGRRFWPKSIWSKHVDNFEDLFKPENREAALNCNSEMVLNALEHVEDCLFYLAGLREQSVFNFCAIPQAMAIATLELCFRNYTMFERNIKITKGDACQLMTESTQNLRVLCDVFRRYVRRIHKKNTPKDPNFLKISIVCGKV

SEQ ID NO: 13040 - protein, 1322 aa, Aspergillus nidulans
  unsure (1)..(1322): unsure at all Xaa locations
LTPEEKRVFYQLFQAADTTNLGVITGEIAVPFFEKTKLPPETLGLVCRNPSIVKCARCISSNGLIRSRRXIWQIADKENRGLLTPSGFGIVMRLIGHAQAGRAPTDELALQRKWSCSLELLHLLRSGTFPXLPAWCXRTIAGPLPKFDGITVDAAAPSPRDAGASSPQPAPGPIRVPPLNPEDVNKFVSLFEKSDVTRSGTISVSIDLVPXILLYVDVXTLPPGETAKQIFERARLPNEILGRIWNLADTKQRGVLDTTEFIIAMHLLTSFKSGIMRGIPQVLPPGLYEAAARRGASRPSFSGPRPGLDVPPVPAIPKQFTGPQRTQSPINRQQFGTPLSTQSTGGDWLISPQEKLQFDNYFNTVDTTKSGVISGDQAVAFFTKAQLPEETLAQIWDLADIDADGQLTRDEFAVAMYLIRQQFTNKGPLPQTLPPALIPPSMRRPSSTHAAPVPAPVAASSHPPAPVHTAADDLFGLDPFATGPAPSAPAPVPAQVPQSTGNSNSPFATPSSPTRQTSPPGSATAFKPFIPTSTFGQSLQPQATGASSVPSTAKSPQPSDDLLGDNDPEESNKLTQETTELANLSNQIGSLANEMQNVQTKRSATEQELSQTSQQKRDFESRLAQARAMYEQEVKHFKELEERLRTSKAETTKLQQEYALIDGSRQDLQNQYNQVSADLAADQQENASLKEKIREANAAVAQLKPALEKIRSEARQQKGLAAINKKQLATVEGERDKIQEELGELSKEQTVEPEGGCVPCQQPSXSGKPGYLYNXPANXSLLQTHDDWLEXENNVTSPQISNDQQRAFDNLFGPSFGAAPATAATPPPPTSFRADSRTDSVRSPSGSGVPTPSISPPPSSAGAFGSEPPPPALSRQMTPNALPLTGTLSETTSTKVSPPISRFGTQEASSVGTPSQAEGSDARPTSASPFDETEDSKERFPTVPGAFETPSGTTTSQGSEEKPADTKDPSFDELFGGPAHQRSKSQQNNDFEEAFAAMKAPNAANTQGAPESEFPPIREIDDDDDDSTDSETQLGFDDNFTPVFPQSHAVSKSDQIEPSQLDAFPAPGASSTPTGPPPAAEAQPSPPKYDEDAEKQASGNIPPEFGGLLPGRADPTLPPDAPHSIETTTGAPIVGGEAQNNVTKAAPPAQAPNGGKAPDFEAAFSGLNLAPAKEADDDDDDDDFPQSEGKPNMDFDFSFDSGASQHEKAAAPTSTSGTASSDFFSFDQNAHASASSGPVNPNAKSEDHDWDALFAPLDNMKSPGTEATNATAPSTSSPSSKQPGWALQTDTQDDPNLQRLTGMGFPRDASLAALEQFDYNID

SEQ ID NO: 13041 - protein, 287 aa, Aspergillus nidulans
VEPYNSILTTHTTLEHSDCSFMVDNEAIYDICRRNLGIERPSYENLNRLIAQVVSSITASLRFDGSLNVDLNEFQTNLVPYPRIHFPLVAYSPVISADKASHEANSVQDITMSCFEPNNQMVKCDPRNGKYMATCLLYRGDVVPKETHAAVATLKTKRTIQFVDWCPTGFKIGICYQPPQQVPNGDLAKVNRAVYVPVLPLEKEKSESNSCIVCMLSNTTAISEAWSALDHKFDLMYSKRAFVHWYVGEGMEEGEFSEAREDLAALERDYEEVASDSLEEEGEEVEY

SEQ ID NO: 13042 - protein, 416 aa, Aspergillus nidulans
  unsure (1)..(416): unsure at all Xaa locations
SVVGAGVLAMPLAISHMGIVLGISVILWSGVTAGFGLYLQSRCAQYLDKGSASFFALSQITYPNAAVIFDAAIAIKCFGVGVSYLIIIGDLMPGVVQGFVGEAAYDFLVDRHFWVTAFMYDYWSXLVVCVADRTRLIIIPLSYLRRLTSLKYTSIAALVSMAYLVILVVYHFIIGDTKEGRGPIRVIRWAGAVPTLSSFPVIVFAFTCHQNVCLLLAGGNXRANPCRCFSILNEISNNSHFRTTAVVLASIGSSATTYILVAITGYLSFGNSVGGNIVGMYRQAYWATIGRAAIVILVMFSYPLQCHPCRASVDAVLHWRPKRFTRSRSEGSPHRHPLLAAGPRGSRTPEPMSDLRFSVITTSILILSYIVAMSVSSLEAVLAYVGSTGSTSISFILPGMFYYKISAPDSAAHQRL

SEQ ID NO: 13043 - protein, 536 aa, Aspergillus nidulans
  unsure (1)..(536): unsure at all Xaa locations
YDYVIVGGGTAGCVIASRLAQYLPNKRILLIEAGPSDYMDDRVLNLREWLNLLGGELDYDYPTVEQPMGKNTYSAGIQGTSXLSRGNSHIRHSRAKVLGGCSSHNTLISFRPFEYDCKRWESQGCTGWSFETFTRVLDSLRNTVQAVHDRHRNHLCKDWIRSCSTALNIPIIHDFNKEIRSNGELXQGVGFFSVAYNPDDGRRSSASVAYIPPILRGDEKRPNLTILTNAWVSRVNVDGDTVTGVDITLQSGAKHTLRPKKETILCAGAVDTPRLLLHSGLGPKQQLASLGIPVVKDIPGVGENLLDHPESIIIWELNQPVPPNQTTMDSDAGIFLRREAPNAAGSDGSAADVMMHCYQIPFCLNTSRLGYDTPVDAFCMTPNIPRPRSRGRLYLTSSDPTVKPALDFRYFTDPEGYDAATIVHGLKAAREIAKQSPFKDWIKREVAPGPKVQTDEELSEYGRRVAHTVYHPAVQTKMGDVTRDPMAVVDPKLKIRGLKNVRIADAGVFPEMPTINPMLTVLAIGERAAELIAEEA

SEQ ID NO: 13044 - protein, 509 aa, Aspergillus nidulans
  unsure (1)..(509): unsure at all Xaa locations
MTPSLQRQLFYDGKPQHASSGRTFQSINPADATLLAEIPVASQSDIDAAITAAERAFPSWAQTPPIARARILQKAAALLRERNDEIARVETLDSGKAYSETSTVDVVTGADVLEYYANLVGGGGLNGETTQLREEAWVYSKKAPLGVCVGIGAWNYPIQMXAPFSPFRENFLKDKQXPRLTDXALWKSAPCLAAGNTMVYKPSEFTSLHGQTLAEIYKEAGLPDGVFNVVYGAGDVGSYLTSHPTVAKVSFTGQVSTGMKVSGAAAGNMKYVTMELGGKSPLLILPDADLENACDGAMMANFYSTRQVCTNRTRVSFPKSMKKDFESRLVEKMQYIRPGPLFDENTNFGPLSSAVHQEKVTAYIRHGIEQDKATLLYGGLGKPSLPKDLEAGFWVRPTIFTDCTDDMRIVKEEIFGPVMSILTYDSVEEAVKRANTTELGLAAGVFTKDLNLAHRIIDQLEAGITWVNTWGESPAEMAVGGWKKSGLGVENGRRGIEAWVRNKSTLVDM

SEQ ID NO: 13045 - protein, 541 aa, Aspergillus nidulans
YTEPYRPQYHFTPAQNWINDPNGLLYHNGTYHMFYQYNPGGVAHEAMSWGHATSQDLTHWDERPVALTARGFPGKNISEQFFSGSAVYDVDNSSGYGNGMGTAAPMVAMYTSFVCYPSLLIEWSLDEMGLVLTKTVCLGQTLPSGKKVRASQQSQSLAYSLDSGETWTTDDAVNPILLQPPHPYESQYKEWRDPNVFWHAPTKKWILTTALSDLHKLLIYTSTDLKNWTLASEFGPYNAVGGVWECPSFFPLPVDNDESNVKWVAIIGLNPGGPPGTVGSGNQYILGQFNGTHFLPDAESLHEQGEANWLDYGPDFYAALVYNGLPEFQRTVIAWMSNWQYAEKVPTTVWRNAMTIPRRLGLKTINGKVLVVQEPEANWAAIMSKPQTTRILSLPANSTRNLGSLGKTLAANLTFSAGEQNGSSFGISLLATQNFTTQTLIGYNFATKHIFVDRRASGNTSFDETFASVYRAPLEPADDGTVTLRIFADWSSVEVFGGQGETTLTAQVFPPEGATHARLFANGAGVEDVLLSVSKVGSVWN

SEQ ID NO: 13046 - protein, 311 aa, Aspergillus nidulans
KHAVAMSVVHAFKTSGFLYLKNHGIPPSVTSRVFKSSASFFGRPQDQKDTLGWTTPQANRGYVRTGREKLSTVDDQADRTVPDIKESMEIGREGVEGLPNRWPDQLDEEGKDFKNVMLEFFEMCKELHIKVMQAIALGMNLPVHFFDEYVDKGDNNLRLLHYPAVHKDVFKKNPGQVRAAEHSDYGSITLLFQDRRGGLQARSPEGTWVDVTPFPDTVVINAGDLLARWSNDTIKSTKHRVIEPPKVPGAEDDDTDMYPERYSVAYFCNPNMDKFIEAIPGTYGEGEGLSKAKYPGITSGDYLVQRLSATY

SEQ ID NO: 13047 - protein, 271 aa, Aspergillus nidulans
  unsure (1)..(271): unsure at all Xaa locations
GLGRTMALTLATNGASKVFIIGRREDSLRETVSLAPDSAKQNIIPVPADVTSQESLQSAYETIAAQTGYVDLLIANSGIVGPPAIIKRKDDGSLLPISELKDYLWNIPMAEFTKVFEVNTTGAYYTAIAFLPLLDAANKRRPAPEKNKLSPPLAQIIMTSSIAGYSRQVPLDFAYNLSKGAVNHLVKALSTSLTEYGIRVNGIAPGLFYSEISVGALXAGDKGVQMGIPADKIPMTRAGGEEDIAGLVLWMAGASGGYLNGNITVIDGGRL

SEQ ID NO: 13048 - protein, 841 aa, Aspergillus nidulans
  unsure (1)..(841): unsure at all Xaa locations
WSNLNVLHRNTLPPWAHFYSYPNEEAALTFNRDEGLFQSLNGTWKFHYDASPFEAPIWNTANTTEWDDIIVPGVWQMQGYGRPQYTNIHYPIPVTPPNVSYMNPTGSYWREFDVPADWDGQQIRLRYEGVDSAFHVWVNGEEVGYSQGSRNPSEFDITGYLSSEGTNTLATRVYQWSDGTYLEDQDQWWLSGIFRDVYLVPFPSSAITDFFIQPEVDDGFASGTLKVNVTIQGEHGNLSVKVLSPGGNVVDEWTGSSSTIYSKDIKGDDFLLWSAETPNLYTVLIEFNGRTISQKVGFRRVEMSGSNFLVNGQPIIIYGVNRHEHNYTSGRTVPYESMRADLIRMKQSNINAIRTAHYPQHPSFYDVADELGFYVITEADLECHGFRDIAGSEENAAAWTSDNPEWTHAYLDRAEQLVERYKNHPSVIMWSLGNECQYGQNQAAMYKWIKERDPSRFVHYEQDHNAETADIYSQMYSSPDTMLEHMANHTDKPLILCEFAQXVSPPSITAGCXLLQAMGNGPGGLKEYIELFRSHPLSQGGLVWEFNNHGLLKKEGDLEYYAYGGDFGDEPNDADFVMDGLTLSDHTPMPSLLEYAKIIQPVSVNLTDDSSSMVITNHYAFVDLSGLDVSWHIVQDGETTEAQELDLPPVPAGESRTVDLPLDPSSLSKETWLTIEFKLKEDKAWAVRGHVVAWDQLYFPGSSASTSSSKRSTPISRQTSGGLEVKQNQTSLRIITGTSIFGFNLIQGNVTWEANGASLFQRGPELSFIRAMTQNDEGQSGNEAEWDDAWVGTMHTQVRDVTWRSSDTEAIVHFKVRVAPQVLEWGVEADLIYTISTEDSV

SEQ ID NO: 13049 - protein, 345 aa, Aspergillus nidulans
  unsure (1)..(345): unsure at all Xaa locations
PEYLQQIDSTMAALRASNLLGDPFALATSSIAMVCHEGRSVGMRLTRCXLGWLIAFIASIAADVQDPYPSFQWWAIAYSFCCNVGVIVVFLTDTGLTYGVAVRLLCPCQHALTDKTQVVGYLAASLVMNSISANSMFNSKSTSSFQAAGAGFILLCMVNVSHYMLFDSNMFXDWQIVWTFYFGSAPQAKHRGFIDSFALNKENQGSYGANRPMSSAYGARPETTTSRPQMYTSAQLNGFETSSPVSGYHGGAPGETRSPSQARFTSLGGPNASNPDTVGEIPPPTEYPYKAKAIYKYEANPEDANEIGFEKGEELEVSDVSGRWWQARKANGETGIAPSNYLILL

SEQ ID NO: 13050 - protein, 241 aa, Aspergillus nidulans
EVVVLTGGSSGIGRQIAQLLGNRGIKVAILDIQPPQDGQANLPSTVRYHKCDITSPSAIAEAAAAIRTTMGEPTILINNAGILSSRTILGSTESQTRLQFEVNTLSHYWLAKEFLPGMIKNNHGMVVTVASQAGYTVTPNMVDYSATKAAAIAFHEGLGAELVTRYNAPRVRTVLITQSFVNTGLIDKLTPEDTWLHPLLNPETVAEGIVEQVLSGKSGHVLLPGSTGWLAKCFRGFPLWF

SEQ ID NO: 13051 - protein, 622 aa, Aspergillus nidulans
  unsure (1)..(622): unsure at all Xaa locations
NFHTLSPTFFLPRAAAIEPDVGSVHSKIXRVAFINFGCHAQGPRRYTTLQQITKCYERTYQETADRARGLAYFLKKHGYKRVGILCPNTPAFLESIFGIAAAGAVNVCKALILCSSNXVYIRXYAYYSREYRLKEDDIAYIFTHSDAEIIIADKEYLPLLSAYRAAKPHVRVILDTDTDATEGQLAGPFDEAILEGLNYDRDTGRKGWSALESQAASEDDVIALAYTSGTTARPKGVEYTHRGCYLAAMGNIIESGLNFQGRRCKYLWTLPMFHAMGRFXQXDLFSLASDXCSISRLDFPWAVTAVRGTHYCLRKIDYPQIWKLLKQEGVTHFNAAPTVNTLLCSSPEAEPLPEPVHVTVAASPPTPHLFEQMTGLNLHPVHVYGMTETYGPITKGYYMTAWENLPRKEKFARMARQGHGFLTSLPVRVIQTEVPEGTIIDVKQDGKKIGEIVFVGNICARGYYKDPEATRKLFAGGVLHSGDLAVWHPDGAIQILDRAKDIIISGRSHRAFFSPPHCYTDTSVGGENISSVALESMLVTHPDILEAGVVAVPDSHWGERPKAFVTVKPGRQLKGKDVVDWARNTSGISKFMVPREVEVVAELPKTSTGKLRKNVLREWAKD

SEQ ID NO: 13052 - protein, 822 aa, Aspergillus nidulans
  unsure (1)..(822): unsure at all Xaa locations
SDLPVLFPYPRIYPEQYAYMCDLKKTLDAGGHCVLEMPSGTGKTVTLLSLIVAYQQHYPEHRKLIYCSRTMSEIEKALAELRELMKFRSEQLGYTEDFRALGLTSRKNLCLHPSVKREKSGTVVDARCRSLTAGFVKEKKEKGEDVELCVYHEVXNGTAHCMECAADFIQNLDLLEPHNLVPPGVFTLDGLLNYGEQHKQCPYFSARRMVSHTXXERTFIYQPLTPVQMPYCNVIIYSYHYLLDPKIAERVSKEFSKDCIVVFDEAHNIDNVCIESLSIDITEDSLRKATRGANNLERKIQDVKSSDAEKLNNEYMKLVEGLREAEQARDEDQFISNPVLPDDLLKEAVPGNIRRAEHFVAFLKRFIEYLKTRMKVTHTISETPLSFLNHVKELTFIERKPLRFCAERLTSLVRTLELINIEDYQPLQEVATFATLVSTYDKGFLLILEPFESEAATVPNPVLHFTCLDAAIAIKPVFDRFSSVVITSGTLSPLEMYPKMLGFTTVMQESYSMTLARRSFLPMIVTRGSDQAQISSSFQIRNDPGVVRNYGNIVLEFSRITPDGVVVFFPSYLYMESIISMWQGMGILDSIWNYKLILVETPDAQESSLALETYRTACCNGRGALLFCVARGKVSEGIDFDHHYGRAVLCIGVPFQYTESRILKARLEFLRENYRIRENDFLSFDAMRHAAQCLGRVLRGKDDYGIMVLADRRFQKKRNQLPKWISQALLESETNLSTDMAVATAKNFLRTMAQPFKAKDQEGISTWSLADLERHRQKQIQEQERLQRETFAQGDRTNGSRNGAGDEFDEGIDEDLMMLDAQ

SEQ ID NO: 13053 - protein, 1623 aa, Aspergillus nidulans
VRVVNKHLCQDEDIHTVLAPLALEPEEKFHIIQTYYQAISMTQFVSPKWTSSLLSDALCRRANIVTVFNGQGVEGYFSELQHLYDTYGGLLAEPLYALSKQLKGLASDVRAQDMYPHGLDVIGWLENPEARPSTDYLLSAPVSQPLIGLVQLLNYAITCKILNKSPGEFARHLSGSAGHSQGIVVAAMLATVVSWPTFFDAASTALQVLFWIGCRSQQCYPSHSIPPSLVDQSERLSPMLSVKGASRESLLKYLDEHNRHLPPAQQGSLALINGRQQFVVAGNPLSLYAFANKLRAASNNSSTTNTARVPFSQRPLLITARFLPISVPFHTSLLEDAEAQILEDLRSVHVPGNSLLFPVLRTDNGADLREFDNLVPELVHMVVCGVVDWDRATRFPTATHLLDFGPGRETGIGALLASTKAGTAARVILSTTLTGPSKKTLGYMPELLSRRRPVVYNTSWEQDFAPRLVRVGDDILLDTKFSRALGLPPVMVAGMTPTTVSPDFVAEVINANYHIEIAGGGYHDAAGMRSALTRLVNLIPAGRGITVNLIYANPRAMGWQIPLLVQLRQEGLPITGLTTLAGVPSPDIASEYIRNHVLIHISFKRGSKEAINNVLRIAESNPGFPIILQWTGGRAGGHHSYEDFHEPILDRYAQIRAYPNLILVAGSGFGGSDDTIPYITGSWSKKLGYAAMPFDGVLVGSRVMTAKEARTSPAVKQAIVDTPGVPDSQWEGTYKKATGGIITVKSEMGEPIHKLATRGVLLWAELDKEVFSLPAAQQVQELQRRKGSLMKRLNADFQKVWFGIDQQGNPVEISEMTYAEVLTRAVDLLYLKDQQAWIDPSYRSFVADFIRCVENRLSARQPRPRAVFQSALQLDRPQVFLSEFLQAYPAALEDVIVREDEDQLVKLYKQPGRKPLPFIVALDESFEYWFKKDSLWQSERLEAVTNQDVGRICILHGPVAAQYTKVANEPVKHILDNIHKPHVQAILEAQYTGDTSRVPTLDYLYSAGAVSPMLSPQDELLLPHVKHSRSYDPPTLAYDLKGPEENLPTEKQWLALIGGTKPSWRKALLTLNEIVQGKMLVENPIKGLFAPRAGLSVRIIQAGRPQKTVILMRQKSSQGQEKDEATVEIRALSTSEIMLTLRAPMTGGSAGNPPVDLVLYFTYKPTYGNNPIHEVMGTRNQRISRFYEQLWVGNAGDEGTSLQKSADDVQVLTREAILNFTKAIDNRNSAYNGKKNSKLLAPLDMAIVVAWKPLMRCLFTDAVNGDILKLLHLKNDFRVIDNASPMREGDVLSSTAAIESIRIRPDSGKVVRAVATIFKKARPIITVASEFILQGRYEDYHNTFETKEEQVYKLPLKSKRDVVLLASKPWFRIAAADLSLDDHLDDELTFRLKSSYHFRDANTYSQIETCGTVSCAVGNKDMTIGTVMFKSNSHFLKNPVIDFLTRRGFAYDEVKQLPNAVPLAADVRIEMPTSSDQYAAASGDSNPIHLSRAFARYAATTKVRVIHGMQTSGLVRGVVELHAAGNDPRRMKAWSASFKGKVSPGETLLVDISHTGMNNGRLIVVATARSESSSVEVFRATAEVAQKPGAYLFTGQGSQKPAMGMDLYETSQAARDVWHTAEQ

SEQ ID NO: 13054 - protein, 916 aa, Aspergillus nidulans
  unsure (1)..(916): unsure at all Xaa locations
WLSDAWSSFVDLIKVSLAWASLHVRLLTTDSHAETIDIIIMTLGYLAMYLSFASLFFSMKQLGSKFWLATTVLFSGMFAFLFGLLVTTKFGVPINILLLSEGLPFLVTTIGFEKPIILTRAVLSASIDKKRQGSATSTPSSIQDSIQTAIREQGFEIIRDYCIEISILIAGAASGVQGGLRQFCFLAAWILFFDCLLLFTFYTTILCIKLESHVSGAMXPFARLWRKMVLRRVLPEKVASSNDWFGAGSDNSDADDASVFGRKIKSNNVRRFKFLMVGGFVLVNVVNMTAIPFRNSSLSPLCNVFSPTPIDPFKVAENGLDAIYVSAKSQKLETLVTVVPPIKYKLEYPSVHYAKLGESQSIEIEYTDQLLDAVGGHVLNGVLKSIEDPVISKWIIAVLTLSIVLNGYLFNAARWSIKEPQAAPAPKEPAKPKVYPKIDLNAGPKRSMEECEAMLKAKKAAYLSDEELIELSLSGKLPGYALEKSLENEELMSRVDAFTRAVKIRRAVVSRTPATSAVTSSLETSKLPYKDYNYALVHGACCENVIGTLPLPLGVAGPLVIDGQSYFIPMATTEGVLVASASRGAKAINAGGGAVTVLTGDGMTRGPCVGFPTLARAAAAKVWLDSEEGKSVMTAAFNSTSRFARLQHLKTALAGTYLYIRFKTTTGDAMGMNMISKGVEKALHVMATECGFDDMATISVSGNFCTDKKAAALNWIDGRGKSVVAEAIIPGDVVRNVLKSDVDALVELNTSKNLIGSAMAGSLGGFNAHASNIVTAIFLATGQDPAQNVESSSCITTMKKXVYTLMSFSPGRRXPRFSTNGNLQIAVSMPSIEVGTIGGGTILEAQGAMLDLLGVRGSHPTNPGDNARQLARIVAAAVLAGELSLCSALAAGHLVRAHMAHNRSAAPTRSATPVSA

SEQ ID NO: 13055 - protein, 660 aa, Aspergillus nidulans
GIKTADQVLRKNPNHGDTLAMKALIMSNQGEQQEAFALAKEALKNDMKSHICWHVYGLLYRAEKNYEEAIKAYRFALRIEPDSQPIQRDLALLQMQMRDYQGYIQSRSTMLQARPGFRQNWTALAIAHHLSGDLEEAEKVLTTYEETLKTPPPLSDMEHSEATLYKNMIIAESGNIQKALEHLESVGHRCSDVLAVMEMKADYLLRLDKKEEAAAAYTALLERNSENSLYYDGLIKAKGISSDDHKALKALYDSWAEKYPRGDAPRRIPLDFLEGDDFKQAADAYLQRMLKKGVPSLFANIKLLYTNSSKRDTVQELVEGYVSNPPANGAADGSENTEFLSSAYYFLAQHYNYHLSRDLSKALQNVDKALELSPKAVEYQMTKARIWKHYGNLEKAAEEMENARKMDEKDRHINSKAAKYQLRNNNNDKALDKMSKFTRNETVGGALGDLHEMQCVWYLTEDGEAYLRQKKLGLALKRFHAVYNIFDVWHEDQFDFHSFSLRKGMIRAYVDMVRWEDRLREHPFYTRAALSAIKAYILLHDQPDLAHGPLPEINGADGDDAERKKALKKAKKEQQRLEKLEQEKREAARKAAANPKSLDGEVKKEDPDPLGNKLAQTQEPLKEALKFLTPLLEHSPKNIEAQCLGFEVHLRRGMFQEFRK

SEQ ID NO: 13056 - protein, 354 aa, Aspergillus nidulans
  unsure (1)..(354): unsure at all Xaa locations
AVVRDGFPRPVPDTPSNVLEQFKMAGKTIVVTGAADGIGYAVAEAMAEAGGDVALWYHSCVTLXDPAENAKIVAKRQQCADRCMCRNDAAIAKAEGLTKEHGVRAVAYKVDVRIAGSWPGSIVXVRASVFLTFCSNCTVSDPDAVQSTISTVVKDFGKIDVFVANAGTFPETPIKLVFLSFPLPNCRRWTWHKLTSAKGMAISKPILSQTLPEYKAQLSVNIDGIVYCAKFAGEVFARQRTGNLIITSSMSAHIVNVPTDQPIYNATKAFVTHFGKSLAREWREFARVNIVSPGFFDTKMGASPETVNEAYRMAVLGRQGSTKEIKGIYLYLASDASSYMTGSDVLIDGGYVLP

SEQ ID NO: 13057 - protein, 344 aa, Aspergillus nidulans
  unsure (1)..(344): unsure at all Xaa locations
AKQHARKVASKLGVRDGLIYLVGKATINWGDSDQPRPFRQRRYFYYLSGVDEADCYLTYDIRNDLLTIYVPNFSLQHAIWMGPTLTVXEARQRYDADRFRYYAALRSDLNSWVDQYNKDSPIYVLHSSQKPEISAKELRLDEKSLLPAMDAAREVKDEYEIRMIRKANEISALAHRNILQNIHRMSNESEIEGLFLDTCVSHGAKNQSYEIIAGSGPNAAVLHYVKNDEPLNGRQLVCLDAGAEWNCYASDVTRTIPLGKDWPSSHAKDIYAIVEEMQEECIRRVKPGLRFRDLHELAHIIAIKGLQELGVLKAGTVEEIRRSGASSIFFPHGLGHHVGLEVHD

SEQ ID NO: 13058 - protein, 1686 aa, Aspergillus nidulans
  unsure (1)..(1686): unsure at all Xaa locations
KSEKPMEPFQVRLNCVDHYQANPSEFDPPLPYRDGNNEKGYMPKVPVIRIFGTTETGQKICVHVHGAFPYLYVQYDGDLSPDSGSSXLVPLFFFLQLMSLLVRSAARSLHLSIDHALAVSYRRNAHDKKTVFVAHITLVKGVPFYGYHVGYRFFFKIYLLNPIYITRLADLLLQGAVMKRPIQPYESHLQYVPQWMCDYNLFGCAFMKCGKAKFRSPIPEYLDLPDLSHRWHDRSIPPGWILDESVLPKQSHCPLEADVCVQDILNRLEISERSIHHDFREFLNPLTSNEKLVPSMAGLWEDEKRRRKKKLGLDDPDSSPFSTEDLVSFSSDPRKASQGDWIHKDELQLLVRQITAEERERDNNRDMTLDAHLQENPYAKDVKTALQSIEDFFTDADGLTNLQLPYNSGIDYSEEQAVDYVDEDAVRATESNSGLYSSDEDGMIDIFSDDDYDNSENEMAQVDLENDLQQDERSNAISKTHGPRVSAPSVDGLAGNSSGLEGPRSDALEARNAISFKAPTQQNVQSGRSSVTRSKYEENLDKSSQSQESSSLVQFWTANADSSNKKIRMPSRATEPSSSDGQSISSQKTIRLKALSQYGTLNFPVVKDPNDPMTILRFSQEASGSKELMDVVAKEASSSGKSSSTLQPRSSDEKELSSSSDNIATDFAGLISDAFNIPPSTRLCCFRRACPSPKEVSSTINAYGLSDIIYQNAHYSIDADVPDRPRDYAGKEFQLGGIGIRYLPDFDPSGRLPAMLAEENIGQKEKRDWQELDHQLRVGSTARFWEFTPVPPSRSEVITWYNGEQQKSLAATTKTEEQYEEKEYRGKVLSQIEGPTQKNEHGFKYSQHKKSTSVEHQTQYMSTMSLEVHVNTRGVLLPNPEEDEIAAFFWCVNSEDEPQEEDDSLSVVNMGVVFQGEEEYPESKISKALRFECEHESTELDLINRLVDIVRLHDPDIITGYEVHNSSWGFIIERARKKYDFDLCDELSRVKSHAHGRFGKEADKWGFDHTSSIRITGRHIINIWRAMRSEMNLLQYTMENVVFHLLHRRIPHYSFRDLTAWYQSDKPRDFMKVINYYTSRVQMNIEILNANELIPRTSEQARLLGIDFYSVFSRGSQFKVESLMFRIAKPENFILVSPSRKQVGQQNALECLPLVMEPQSDFYTSPLIVLDFQSLYPSIMIAYNYCYSTFLGRVQSWRGRNKMGFLDYNRPPSMLELLKDHINIAPNGMIYARSEVRKSLLAKMLTEILETRVMVKTGMKVDKDDRALQRLLNNRQLALKLIANVTYGYTSASFSGRMPCSEIADSIVQSGRETLEKAIAFIHSVERWGAEVVYGDTDSLFVYLKGRTRDQAFDIGEEIAQAVTNMNPHPVKLKFEKVYHPCVLLAKKRYVGFKYEHRNQKEPEFDAKGIETVRRDGTPAEQKIEEKALKLLFRTADLSQVKSYFQSQCTKIMQGRVSVQDFCFARAVKLGTYSENGTLPAGALISTKKMLEDPRAEPQYGERVPYVVVTGAPGSRLIDRCVPPETLLQDAQLDLDAEYYITKNIIPPLERIFNLVGANVRQWYDEMPKVHRIRRVEGTSSLAGGKSSIRTLESYMKASSCVVCKAKLYDAEIPVCSDCVRQPHVSLLELVSRQRHAEQRVATLERICRSCMDVPFGDEVKCDSLDCPVFYARTRGLAHWRHTNSV

SEQ ID NO: 13059 - protein, 1040 aa, Aspergillus nidulans
  unsure (1)..(1040): unsure at all Xaa locations
RGKNVLFENCSXYSTDLLLPSLLGASDSFLSGNTANYIDEMYVAWRKDPSSVHISWQTYFRNMEEGKMPISQAFQPPPTLVPTPTGGVHQEMPGAGLGLSQGTDVTKHLKVQLLVRAYQRRGHHKAKIDPLGIRGEAEAFGYSKPKELELDHYGFTERDLDEEFDLGPGILPRFATEGRKKMSLREIIAACEKIYCGSYGVEYIHIPDRKPCDWIRDRFEVPEPYKYSVDDKRRILDRLIWSSSFEAFLATKFPNDKRFGLEGCETLVPGMKALIDRSVDYGIKDIVIGMPHRGRLNVLSNVVRKPNESIFSEFAGSAEPSDEGSGDVKYHLGMNFERPTPSGKRVQLSLVANPSHLEAEDPVVLGKTRAIQHYNNDEKNFDSAMGVLLHGDAAFAAQGIVYETMGFHSLPAYSTGGTIHIVVNNQIGFTTDPRFARSTPYCSDIAKSIDAPVFHVNADDVEAVNYVCQVAADWRAEFKRDVVIDIVCYRKQGHNETDQPSFTQPLMYKRVAEKKLQLDMYVEKLISEGTFTKEDIDEHKKWVWGMLNDSFDRSKDYQPTGKEWLTSAWNGFKTPKELATEVLPHLPTAVEPPILKNVADKISGAPEGFTLHRNLKRILGNRKKTVEEGKNIDWATAEALAFGSLVSEGYHVRVSGQDVERGTFSQRHAVLHDQETEATYTPLQHISKDQGSFVISNSSLSEFGAXVSLEILFRNSLTCLQPGFEYGYSLTSPNALVMWEDQFGDFANNAQCIIDQFIASGESKWLQRSGLVLSLPHGYDGQGHEHSSGRMERYLQLCNEEPRVFPSQDKLDRQHQDCNMQVAYMTSPANLFHLLRRQIHRQFRKRMLFPPLQYGPKLIKSSPCIFFSKSLLRHPLARSSIEEFTGDSHFQWIIPDPAHGTAIDEPEKIERVILCSGQVYAALTKHREANNIRNTAITRVEQLHPFPWAQLKENLDSYPNARNIVWAQEEPLNAGSWSYVQPRIETLLNETEHHNRRHVMYAGRPPSASVATGLKSVHVKEEQEMLEEAFSVHQERLKGE

SEQ ID NO: 13060 - protein, 325 aa, Aspergillus nidulans
  unsure (1)..(325): unsure at all Xaa locations
GHDSAGAVVQVRDSVTSMKVGDRAGIKPMMDTCGACTSCWSDEESYCARDVHTALTIPGVHQQLSGGRSDIRVINIGGASTYQQYVVSPARYATPIPEGIPDEIAAPIMCSASTIYRSLVESRLQAGDWAVFPGGGVCRSYHMSMPGLQDXQSQGGVGIQGVQLASAIAMRPIVVDTGEEKKNLALKMGAEAFIDFKTVPDAAAAVVEIADGIGGHGVFVTAQAAYPTALAYLGTRIGGDLMCIGIAPAGTMSIPVDPNLLLFRNTRIQGTLVASRHDTIKALDFARRGKLKQICEVWPVERLPEAVDRLRKGLVAGRMVVDFNQ

SEQ ID NO: 13061 - protein, 399 aa, Aspergillus nidulans
  unsure (1)..(399): unsure at all Xaa locations
MTSPSTIKQRFLSKPNQLGVVAVGFNGGQVRIPTARRCSVDHLCIAVHYSLAQGHLAPCRRRMLTXLVPXHQCKLGVEAAPMALVEAGLLDQLRDDLDYEIHYDNTVHYYEKEIPAEDPDHRGMKKPRAVSAVTETLSSQVYEHSKEGKFTLTLGGDHSIAIGSIFRNARAXRERLGREIGVIWVDAHADINIPEMSPSGNIHGMPMAFLTRLATEEKKDIFGWLQEEHKVNLRKLVYIGLRDVDRGEKKLLREHGIKAFSMHDVDRYYPLPIRICPRLALGLVWVLRPGDKCCXRWLXPRIGRVVEMALAHIGNDTPIHLSFDVDALDPQWAPSTGTPVRGGLTLREGDFICECVHETGNLISMDLVEVNPSLEAVGASDTIRTGCSLVRSALGDTLL

SEQ ID NO: 13062 - protein, 447 aa, Aspergillus nidulans
DSVETKKPKRPKAAEHAERDDESKRTKNKFAGILSKFERSAKVKKATEKLHREDETPVQDENVAQPVIAQGLEPIPQPKPVVEEAEKPTYSSLPPWLANPVRASAETRAKFSDLGIEPKLLRVLEVNGYKEAFAVQAAVIPLLLKGPNNHTGDICVSAATGSGKTLSYVLPLVTELEQIPAPRLRGLIVVPTRELVKQAREACEFCTAGTGLRVGSAVGNVAIKDEQRSLMRIEHVYSPESVESRRKAELTGEEWADFSLQDYISNTTDLGETLPGYIHRGEPNVDILICTPGRLVDHIRYTKGFTLKHLQWLVIDEADRLLNESFQEWVDVVMQSLDARKAYGAFGPSGRFLADLGMSLQTKEPRKVVLSATMTKDVSKLNSLRLTNPRLVVVGGSDQTTTADDESGVVVHADERFTLPTTLREYSIAVGDGEHKPLYLLRLLLSE

SEQ ID NO: 13063 - protein, 470 aa, Aspergillus nidulans
  unsure (1)..(470): unsure at all Xaa locations
FFKKPWIDQSILILYXKLIDRGHKVIIITHAYKGRTGVRYLTNGLKVYHVPFLVIYRETTMPTVFSFFPIFRNIVIREQIQIVHGHQSLSSFCHEAILHARTMGLRTAFTDHSLFGFADAGSILTNKLLKFTLSDVDHVICVSHTWXVCCASFSVQSSXCCLQKENTVLRASLDPLMVSVIPNAVVAENFRPLHATARANERQSGGGSQIQPPPRPIGPNDIITIVVISRLFYNKGTDLLIAAIPRILASHPNVRFIIAGSGPKAIDLEQMLERNVLQDKVEMLGAIRHEEVRDVMVRGHIYLHPSLTEAFGTVIVEAASCGLYVVCTRVGGIPEVLPQHMTTFAKPEEDDIVLATSKAISALRSNKVRTERFHDQVKVMYSWTDVARRTERVYKGISGDISPQEFYGYYPGEIQEAGDRVRNFALIDRLKRYYGCGVWAGKLFCLCVVIDFLLYTFLEMWFPRANIDIA

SEQ ID NO: 13064 - protein, 260 aa, Aspergillus nidulans
EYSVLLLGLDNAGKTTLLSQIKALYQHRPDGTPAPNPGRTVPTVGQNVSTISIAGHVLKIWDVGGQISMRNLWQSYYSSCHAIIFVVDSTDVGQNPDITRLPSLSARASSSRKPSTPRPGSGAAESSAEREVDADGDGDGGNDSVNTFAEQLASINAPDSDFGRLDECRQVLESVLRNADVAGVPILVLANKQDREDSVEVVRIKEGFVRKVFEGETGGVVRDSRVLPISALMGSGVREAVEWVQSRVKWNKEGRPPVMR

SEQ ID NO: 13065 - protein, 432 aa, Aspergillus nidulans
  unsure (1)..(432): unsure at all Xaa locations
VADWYMVIRRQFKDRDDASKNSPELPVLDYPTVQIRILPLLATAFALHYTGLAMQNVYSRTRRQIESGDFSSLAYMHSMSSGLKSLCTTLAADGIETCRRALGGHGYGGGSGLVQLNADYLSKVTVEGDNWMITQQTAAYLIKKMGSVVSASVAKVEKDEIDVQFTTYFPKIQGGETDRGDRQCDYDILRNDGDLVQAFQHRATALVSITMHAEYSMPSYSNTRLRPTMSTESAWXEKEDGHPSXHNYTDXAKVLNLSSVEQELTSSAQSQSILVTQFYNALSSDTELSAAVKDVLWDLYRLFSLSTLETEKYECTFRYMLQKMQLIAXTNVRXSFHTTPHRNTTSTQSLERINELTSRIRPHAVRLVDAWQIPDYLLDRXIAIQSSILLRVKTADCGFSALGRYDGRVYEDLFHRAHRVNPLNKTTVNPNY

SEQ ID NO: 13066 - protein, 540 aa, Aspergillus nidulans
  unsure (1)..(540): unsure at all Xaa locations
DIKSGSTTQIDLAMDPILERRVIRKCDLHVVPILTLLFLFAFLDRINIGNARLLGLEEELGMEGRQYNVALFVFFILYILLEVPSNMVLKKIKPSWWLSGIMAGWGIVTICQGVTQSFGGLVACRVIIGGLEAGFMPGLSLPPFYTPSALGNSADFWIGSVYLINMYYRRHELQRRLNFFFSASIFAGAVSGVXLFSSPFLYFSIKQRNTNTDEQFLAYAIANMDGNGGYKGWRWIFILEGLATVVIAIIAKFIIVDWPESATFLNEEERACLLRRLAEDQGEAQMNRFDKKAMKRTFSDPKIYLGTDSLKRFSCFMFWTGHSDXYACRPIMYFGIVNTGYAVSFFTPTILQQLGWTSIRAQVMSIPIYVVAMVITLSTAWLSDRLAHRYAFTLAGVLIATMGYVMLLCQTSIPVGARYFALFAITGGGYLTQPILMGWLSNNMAGHYKQSIASAMQIGFGNCGGLVASNVFFDSEKPGFRTGFGVSLGMTWVCGVSCAVFLACLVRENRVRSQGKRDWRFGLEEEEKRNLGDDYPTFRF

SEQ ID NO: 13067 - protein, 503 aa, Aspergillus nidulans
  unsure (1)..(503): unsure at all Xaa locations
WWKRKNMRKLYIYIIILILTNTANGFDGSMMNGLQTLSYWQEYFNHPRGAILGLFNASMSLGSLIGLFFVPYLIDWRGRKIGLVVGCLIMLLAVGLQSGARNFGMFVAARILIGFGDCIVLGSAPLLIAEIAHPQDRAVLVTLSGASYHSGAFIASWVTLGTLEIRXTMISHWGFEVVTDGAXSDWSWRLPSLLQAICTIVIVIGVWWMPESPRWLIYRDRHPEALDILVKFHAEGDENDEFVQLEYAEIKAAIALDKQIGHTGWVDFFRSRGNRKRIYLITALGLFSQWSGNGLISYYLKYVMDGVGITNPQTQLGINAGMKTEGLVTNFVFAFFIEKLGRRPMYLVSTIGTCVVFNIWTIVSARYEIAPNKGLGYAFVFFTFLYGLFYDIKXVPLHFPVDLRRQNANLGTDRSGLMATYTTEILPYGLRAKGFTWLNFCVTGALFFNQYINAIALEALAWKYYIVYCVFLGFEVFVIYSFLIETRYTPMEEIAKYFDGDSA

SEQ ID NO: 13068 - protein, 549 aa, Aspergillus nidulans
  unsure (1)..(549): unsure at all Xaa locations
GIIGPGLLVGSGKAFSEGGPAGVLISFSLVGIIVYFVMXGTXXARRKGSRXMPXQALGEMATAIPVTGSFTEYAQRFVDDSLAFGLGWAYWYLWVTVLANEYNAVSLVIMYWTDAVPQWAWILIFWILFLGLANFGVRAYGEMEFWLSLYVSPCVRLVKRALADPRRIKVLALIVFFILAICISTGGIGGDVIGFKYWHNPGAFADSINGVARTFVVAGTLYAGTEMYVATFETFFGDTDLAIRVGITAGESSNPQKAVPIAIRQVFWRILVFYIGRVLPISDIHTRLIKATGTMFFIGILMPYTEPQLLNSSSYGANSPLTIALSSAGILPAAHLINALIVVSVISAGIGSLYVASRTILFMARNGKAPKILGRTNAAGVPWVAIIFSNIFTCIVFLTLGESAGKVYNALITLSGVATFLVWTSICIAHIRFRAALTAQGQSPSTLPFRAALYPYGTYFALVLNIFMIFFQGYTAFLNPFSSDDFVINYILLPVFVLFVVGWKVWHKTKIVRLEDMDIWTGRRERAPEVEESSRWKGKGWREKVWRGV

SEQ ID NO: 13069 - protein, 487 aa, Aspergillus nidulans
  unsure (1)..(487): unsure at all Xaa locations
LLIAINCVAALSILFFGYDQGMMSGVNNSKDYIDLMGFGYTEMKDGHPSPVVTNSLLQGGIVSVYYLGTLFGALVGGWTGDKVGRIKTIAFGSVWAMFGAALQCSAQNHDWMICGXPSCPIPVFLXLFXLTXVARFINGIGTGILNAIVPVWATETAEHTSRGQFIAIEFTLNIFGVVLAYWLELXAIEEANLDHALTIIQGLSFIDNGASPFRWRFPIAFQIIFLLVLFAAVWFFPESPRWLVRVGREQEARYILGRLRGSSGEDAIRAEGEFQDILSVAEAERSMGHSTSYLAMLFGYKTGKLHLGRRVQLVVWLQIMQEWVGIAGVTVCTSPLRXCRAQANGSADAPTIFSIAGFDSMKSQWISGLNNVFYMVCRPSLGWYRHMLTEQFATMICVFTLDRIGRRWTLYWGAAAQGIAMFLAGGFSRVSIDARDAGNMARAESFGAAAASMVFVFTAVFGATWLTVPWIYPAEIYPLAVRAKGNA

SEQ ID NO: 13070 - protein, 221 aa, Aspergillus nidulans
  unsure (1)..(221): unsure at all Xaa locations
QGAFKYGGYEYFKKFYSDLVGVENAARYKTPLYLAASASAELIADVALCPFEAVKVRTQTTIPPEFRSTFGGISAVVAKEGTAGXAGAYAALTXYXXGQLYKGLYPLWGRQIPYTMMKFASFENIVEAIYHYLPGQKSDYNKGAQTAVAFTGGYLAGILCAIVSHPADVMVSKLNANRLPGEAFGAATGRIYKEIGFMGLWNGLPVRIIMIGTLVSSYTVI

SEQ ID NO: 13071 - protein, 446 aa, Aspergillus nidulans
  unsure (1)..(446): unsure at all Xaa locations
QFSPGQIESNYDEITDSFDSMELKPELLRGMXRYSPVSKEKVGAFSDSFRHPGVYAYGFERPSAIQQRAILPIVKGKFRHSTQPVLALMDCFRQRVIAQAQSGTGKTATFSISALQKLDPNVKACQALIVAPTRELAQQIQKVVIAIGDFMNIQCHACIGGTAVRDDMNALREGPQIVVGTPGRIHDMIQRRVLKTDQMKMFILDEADEMLSVCFSLXFXSHDIYXHLQRGFTEQIYDIFQLLPQSTQVVLLSATMPQDVLEVTTKFMRDPVRILVKKQELTLEGIKQFYIAVEKEEWKLDTLSDLYETVTITQAVIFCNTRRKVDWLTDKLTARDFTVSAMHGDMEQAQRDVIMKEFRSGSSRVLIATDLLARGIDVQQVSLVINYDLPANRENYIHRIGRGGRFGRKGVAINFVTADDVRMMREIEQFYSTQIEEMPMNVADLI

SEQ ID NO: 13072 - protein, 928 aa, Aspergillus nidulans
TNIGLITARLYRPWVGAEIANSIPRSIEKIAVLEQVRKTTRWGPSFMDLLSSLTPAAVGGRSPQIVGYRLGYVEPSTAVQALRGIIQNLSSPSPIQSLEIGSSNVPTLQTPLEQPRIENAYLKILNQLFGERLYLANQLSSNNAGISSTIAASPEYGFGSLIARKEHRQRFIREVEAASKSNSFATDVVSKWLADWALNATDATKANRLAPDVIARLSNDGSALSKQLLQTKKLFYSESQWLIGSDAWAYDLGNSGVHHVLASGADVNMLVIDSQPYSERSAADPTRRKKDIGLYAMNFGNAYVASVAVYSSYTQVLQAMAEAEQFKGPSIVVAYLPYNQENDSALTVLQETKKAVDLGYWPLYRWNPANEDKGEPKFALDSERVKRELEEFLRRDNQLTQLMNRQPKFSSVLSESYGTEVRAIQKRKAKDSYEKLLEGLFGAPLTILFASDGGNAATLAKRLGNRGRARGLKTLVMAMEDYPFEDLPTEEIVVFITSTAGQGEFPQNGLALWEYVKNTGDLDLSTINYSVFGLGDSHYWPRKEDKIYYNKPAKDLDARIAFLGGRKLTDIGLGDDQDPDAFQTGYSEWEPRIWQALGVDKVEGLPEEPAPLTNEDIKIQSNYLRGTIAEGLLDESTGAISASDQQLTKFHGTYMQDDRDVRDERKAQGLEPAYSFMIRCRLPGGVATPSQWLQMDAISSAYGNETMKLTTRQTFQFHGVVKRNLRGAMRAINKALMTTIAACGDVNRNVMCSSLPELSYYHREVHAVSKKISDHLLPATTAYHEIWLQDENDKKVQVAGDAVVDQEPLYGPTYLPRKFKITIAIPPHNDTDVYAHDIGLIAIKGADGHLEGFNILAGGGMGTTHNNKKTYPQTGRMFGYVPADQAHIVCEKIMLVQRDYGDRKNRKHARLKYTIEDMGVQAYKHKVK

SEQ ID NO: 13073 - protein, 247 aa, Aspergillus nidulans
  unsure (1)..(247): unsure at all Xaa locations
LSRKLVIIGDGACGKTSLLSVFTLGYFPTVEYSLLSVQXAVTNRYFIALCRSFPSRVFTPRSYLIYPQVPTVFESYVTDCRVDGRSVQLALWDTAGQEDYERLRPLAYSKAHVILIGFAVDTPDSLENVKIKVRRYRFTXVFIYGLLTYLIYTVIEEANERCPGVPIILVGLKKDLRENPGAIEEMRKKSLRFVSPKEGSETATQIKARKYLECSSLTGEGVDDVFEAATRAALLTFDKRKSSCCIV

SEQ ID NO: 13074 - protein, 339 aa, Aspergillus nidulans
  unsure (1)..(339): unsure at all Xaa locations
MAMEGLHKVFPGMDYTPWGVQHPECDKWPPSQNNVTRDMAVLSRLTNTVRLYGTDCNQTEMVLHAIDRLELTDMKLWLGVWIDTNTTTNERQLSQLYDILDKRSDHSVFKGAIIGNEALYRAGSTKEEARKNIIDYMRQVRKHFNDHNIDIKVATSDLGDNWDETLADATDVVMSNVHPFFGGVEVSKAAGWTWSFWNSHNAPLTQGTNKGNIIAEVGWPSGGGNDCGDGANCKDDTSGAVAGVKQMNQFMADWVCPALENGTDYFWYVSSIHLPCIPSILGVISTDRNYRFEAFDEPWKVKFNKGDEQWEDKWGLMDPGRNLKPGIEIPDCGGKTAAX

SEQ ID NO: 13075 - protein, 1111 aa, Aspergillus nidulans
  unsure (1)..(1111): unsure at all Xaa locations
DIENKKTTLVEVVQSLGEYVNDEDPLLRGKAVSYLSAVIKALPPKFLTRQQVQVLTTFFCDRIGDAGAVTGLETLQKLDRFTKEMAXGIGDSVSVSYLYRIAASPRRVWNHEGXPAEYRLFENFNTLQSRAQSQRFQVYQLLNELMSNHRSWFVAASFRRLPYTDGLVLHNMGDTSLVGMVDLMTGEKDPRNLMLVFSILKVIMVEWDISRHVEVSLFNHDAFEANSXLKKLLFDSVYNYFPITFRPPPNDPYGITAQDLKDRLQDCISSTSHFAPHSIPALLDKLDSTSQNVKVCNNNLTPPCTXSNMLKERRTNALIACINSYNPDTVSTYSITIWETLKFEVLNAQEELLSDLSLKALHDIARRLSEGVMQIHDQLPLAQYLRPITKECNEQLREPQQKQAKPAQKILKAVSEASAPSFTLVAQVVIAPLLTLYQGADGITKQRALLETLTLLFESAISVFGEWTTRNPETSAENPLLEFKDQFSEIFGQALMSTVKEEVSFRVSALKGFLRLSVLRDYFHESEIGLFVQYLDEILLTEEPVGRDDLKREAIAALAEVSKHQPRLIMDITFPAFVATLPDSDEGTDTSYLPTLETLAQISVEKAIFETLVRRLLTKLSLLLQKEQPGSVAYPRAILMTIFYVMNQRRLDGEPGLEMYYDKIVVAMCRNAAATALGKAKNNILGDTTVLDVLGRLCNLIVRSLPRLKQDEVTKNIYALFALPEDFQPVPFAQSPSEDQRRTMILSTYLLAGLPVDSKLPHSTPNMADLLSYLVKLSIAETSPQIQLAILRHIALLVNKFLPKSELEIANTLLNSFLFTDTTTALEPTPEAVRTVFWLSKALILRLAPTTTQILTSLLHLLSSPSEQTSTTASRGFAILLKDDDVLSPINGANIRLLSNQRVFTTLVPLISTKIREININSSGTTMMAAEQDKAYMKPAHLTALSGILSTIPPALDMRELPTLLPLLLQSLDLQTATRDSFAVRAATLQTLSVIIRENGVGVIEECGHVQSLVTRLLKTAEHKPLPAASASEKTGEGAAVNAPRLRVDALRCLFLLAQPRNAENAPAVAKAGKLSPLLPVRSQVLRALKVVLDDPKRDVRKAAVDARGAW

SEQ ID NO: 13076 - protein, 239 aa, Aspergillus nidulans
  unsure (1)..(239): unsure at all Xaa locations
MAASVSKIMGKIFETKKMRILMLGLDSAGKTSTLPIHVPLKLSRAFTDFHSNLYKLKLTNQDVTTIPTVGFNVESVTYKNVKFNVXDVGGQDKIRPLWRHYFQNTQGIIFVVDSNDRDRIVEAREELQRMXTEDELRDALLLVFANKQDLPVRTTLTWSINIRCXFEFSXNAMSPAEITQQLGLQSLTRRPWVSXPDHSGLSSISNTFLVHPSTCATTGDGLYEGLEWLAETLRKTGRD

SEQ ID NO: 13077 - protein, 642 aa, Aspergillus nidulans
QLSESLSRKALTAPVPAPAGKNFENVTSNTRVPAASSLMDIPNVVSFFDSMPEEMKTYLMYQLLKRCPKPTLHFVADVVNPALKCDFLTLLPPELSLNIVKYFDVQTMCRAAQVSKKWRHIINSDEKSWKELLDRDGFTLPEGELQRAIREGWGWQFPNGLEDYEKDLSLSSLISEPSGSALSPLAGPSDRSTAVNRRPKRKANSRVLSRKLAKRMISSSGTDQSDSSDWKKDVSVAEGPYAAANAAAAAVPYPDIGLPSLRGLHLYKSLYQRHYCMRKGWMKPGVKPRHIAFRAHDRHVVTCLQFDTDKILTGSDDTNINVYDTKTGVLRATLEGHEGGVWALEYYGNTLVSGSTDRSVRVWDIERARCTQIFHGHTSTVRCLQIVLPVEVGKKADGTSDMMPKEPLIITGSRDSNLRVWKLPKPGDPGYYQSGPNVDDTDCPYFVRVLTGHQHSVRAIAAHGDTLVSGSYDCTVRVWKISTGETVHRLSGHSLKVYSVVLDHKRNRCISGSMDNMVKVWSLETGSILYNLEGHTSLVGLLDLKCDRLVSAAADSTLRIWDPETGQCKSMLSAHTGAITCFQHDGQKVISGSDRTLKMWDIRTGECVRDLLTNLGGVWQIKFNERRCVAAVQRDGMTYIEV

SEQ ID NO: 13078 - protein, 539 aa, Aspergillus nidulans
  unsure (1)..(539): unsure at all Xaa locations
DHQYVDSTSSVRPTVVNPYNETPIPYEAHAASASDVDAAVAAAKTAYKTSWASFSPAQRQACMLKFADLVERDAERLAILESLPTGKPVTPTIHFDIAHMLEVWRCTLRAPHTDISAIFYFQRDSRLIYIEIDYAGWTDKISGESYPESNGVYKIVRHEPLGVCAGIASWNATFMYIGWKIAPAVAAGNCFIFKPSEKSPFGTLALGALFAEAGFPAGVVQILNGGAETGAALARHMDIAKISFTGSLGGGKAVQEAATKSNLKKVTLELGGKSPAVVFADAELERALGGXGYSLSIWLGNRGMVLLLILKSXRCRVCGFLFNSGQVCVGTFSIYSIVFGFNPAILTKKSTSRVLVQKPIFEKFTQGLKSAFEQTSSTLGADPLDKNVSYGPIVDKAQFDKIMSYIAIGKQTATLLTGGERKGDKGFFIKPTIFVNPEPESPIVKEEIFGPVMVVQTFETEEEAIALANATVYGLAASVYTSNIDRALRVSSALECGGVAVNSPFLPQVNTAFGGIKASGKGRELGLYGLLEYTEAKSV

SEQ ID NO: 13079 - protein, 357 aa, Aspergillus nidulans
  unsure (1)..(357): unsure at all Xaa locations
DISSQLHSGYSHPLSMSWQAERQLTKSVAXKYSLPLLRLNFAFTAVASFMPDLTXLXEMLIYSFFITDNPDEETPIPSLPNQHRRGLNRLVPFLRPLVQKGLRSVILFGVPLHPSAKDALGTSADDPAGPVVQAIRLLRSRFPELYIVTDVCICEYTSHGHCGILREDGTLDNAQSVDRISDVALAYASAGAHCVAPSDMNDGRVRAIKLKLIEAGLAHRVLLMSYSAKFSGCLYGPFRDAAGSCPSFGDRRCYQLPPGGRRLARRAIQRDIGEGADIIMVKPASSYLDIIRDAKELAKDIPIAAYQVSGEYAMIHAGAKAGVFDLKSMAFESTEGILRAGAGIIVSYFVPEFLDWL

SEQ ID NO: 13080 - protein, 315 aa, Aspergillus nidulans
  unsure (1)..(315): unsure at all Xaa locations
SMSADFWAGYISGAIGIIIGNPLDLIKVRLQASSSANGPVSPRQLTRFESTSSLVRGMXTPAWLSTTIRHFLILPGAAAPILGYGALNALLFVSYNRALMLLDRSVTDPTNPQNCALYKLWLAGPXAELPAGQFPPQQNSSNAEHSLTLARESHRGQSAKDIVRTRGWRGLYFAGGITCARDSIGYGFXYVFPKLFDRRRLFTGXQLLVLRYCKRLMSSPDGEDTSNTALKVLFCGGIAGIVTWASVFPLDVIKTRLQASTIADYAEARPLLQAQTSKQTLGSFDLAREMYRAEGFKAFYRGIGVCSLRAFIVNA

SEQ ID NO: 13081 - protein, 337 aa, Aspergillus nidulans
TAYYSVDKRNGKSVAIKIIDVENAEDEVEDIIQEIAILSELNSPYVTRYHGSYLKGSSLWIVMEFCSGGSCSDLMRPGPIPEEYIVIIIRELLKGLDYLHSDKKLHRDVKGAQSPVTIGNMVQYSRLIAANILLTSGGQVKLADFGVSSQLSATMTKKNTFVGTPFWMAPEVIKQSGYDYKADIWSLGITAIELANGEPPYSDIHPMKVLFLIPKNPPPTLQGAYSKAFKNFVELCLRRDPRERPTAKELLEHPFIKRAKKTNYLTELIERYERWQAVSGNQKADEDDELDQEPAAAPKTTEEEDDLWDFGTVRPVGRGHALNPMRVTDLNARGYGT

SEQ ID NO: 13082 - protein, 421 aa, Aspergillus nidulans
  unsure (1)..(421): unsure at all Xaa locations
RAIAQLRACRLIPEAQVRELCYKARELLIEEGNVVCVDAPVTICGDIHGQFHDLMELFRVGGDVPDTNYLFMGDFVDRGFYSLESFLLLLCLKVRYPDRITLIRGNHESRQITTVYGFYDECIRKYGSANVWRYCCEVFDYLALGALVLGASSELEPSGPSYNDTTQSTMSTDDSELETEVLNSKGEVLMNTYRPRSRTSLDNGNTSPSRDQSQTPMRSGAPGTGASGSAFGSNNSSRTGAVLCVHGGLSPLIDTVDKIRLIDRKQEVPHEGAMCDLLWSDPDEIDGWGLSPRGAGFLFGADIVKQFNYKNDLSLIARAHQLVMEGXKEMFDAGIVTVWYALNXCYGCGNADAILELGEDTSSGGTVTRSNGDQGRSNGILSSGVDKQALRSPGRRYRVFEAAAQDTRGMPAKKPVADYFL

SEQ ID NO: 13083 - protein, 363 aa, Aspergillus nidulans
  unsure (1)..(363): unsure at all Xaa locations
MSLTNCRFYEEKYPEVDSYVMVNVKQVMRSDCKYSHLEQQINIPTPHIXIAEMGAYVKLLEYDNIDGMILLSELSRRRIRSIQKLIRIGRNEVVIVLRVDKEKGECNVSSXRENFXPFVFDVRLIDLSKRRVSPEDVIKCEERYNKSKAVHSILRHVAEATQTPLETLYQQIAWPLNRKYGHSHDAFKISITXGSSSXTSELRVTHIILIGTPDVWADVEFPNEAVKKELTQYIGKRLTPHPTKVRADIEVTCFGYDGIDAVKNALRTAEAENTPENQIKVKLVAPPLYVLTSQCLDKTHGIKMLEEAIERIETTIKASGGGCTVKMAPKAVTEHDDAALQELMEKRERENMEVSGDESQSES

SEQ ID NO: 13084 - protein, 363 aa, Aspergillus nidulans
  unsure (1)..(363): unsure at all Xaa locations
DGAVIRNIEACQAISQTVQTSLGPYGRNKIVINHLQKMILTSDAATILRELEVVHPAAKLLVMASQQQDAEMGDGTNLVIVLAGELLKKAEELLRLGLKTSDIVQGYEKAQNFALNLLEGGFLIFQXNVPECPRLRGHIXLKDAIDLEVDRLQDLRSQTELTKALRTVVASKQSGTEQLLASLVAEAVLSVLPKNPVNFNVDNVRVVKIMGGSLEQSRVIKGMVFGREPEGSIKKAHKAKVGVFSCPIDISQTETKGTVLLKNAQDMLDFTKGEEERLEAAIKELYDSGLRVVVAGAQVGDLALHYLNRFNILVIKILSKFELRRLCRVVGATPLARLGAPMPDEMGSVDVVETTEIGGDRVT

SEQ ID NO: 13085 - protein, 316 aa, Aspergillus nidulans
GLTNAVYASKEVILSGGSLDTPRILMHSGIGPADHLKEFGIPVFKDVPCIGQGLRDHPFVPICYLRNPSTNDRNAFYGSQEAMDAAMKQWLVDGSGPWARHGAQLMMGWLKSDAVTKSAEFAALPKDVQTFLNRPTVPHYEVSAGFPLHMLAPELTKDYSYVCLLAFLMNEQSAGEVRLQSSNPEVPLLFNANFMAHPYDRRVCVEAVREVLAVTNHPAFAKDTVNMILGPKSDSEEDILDHWRNTIVSSWHMTGTVKMGKRGEQDAAVDKSFRLMGVDGLRVADMSVVPVLANNHTQATAYVTGSTAADVLIKEY

SEQ ID NO: 13086 - protein, 503 aa, Aspergillus nidulans
STVVEEATRIARQFEYSPEQVQRGVKEYIREVEEGLSEEGTTLSQIPTFVTSVPNGTEKVRIPLCEQSEAGSDIVAIGLYLAVDLGGTNFRVCSIDLHGNHTFSLTQSKIMIPREMMTSGSAKELFLFLARQIESFLRIHHNEHFEAHLKRKIAGTAREEDLFDLGFTFSFPVRQLGINKGTLIRWTKGFDIPDAVGQDVCALLQNAIEELNLPVRVAALVNDTVGTLMARSYTSPGETGTFLGAIFGTGTNGAYVEKLNKITKMAKIEHSDYDKSTGEMIINAEWGSFDNHLSVLPTTEYDRQLDADSNNPGIQMFEKRVSGMFLGEILRLVLLDLHKSQGLFKPASGSDVFIPESSSLYRQWGIDTSLLSIVEADKSKDFEQVKSALKDHLKVERASENDCKAVQTVVHAIGKRAARLAAVPIAATLISTGKLKEELVDIGVDGSLVEFYPNFEGYMREAMREVPEVGDAGDKKVRIGISKDGSGVGAALIALVASKEGTK

SEQ ID NO: 13087 - protein, 475 aa, Aspergillus nidulans
  unsure (1)..(475): unsure at all Xaa locations
ASRGYATAFKWEDPLLASELYTEDELAIQETARQYCQERLQPRVLVSGPLQVMRHFIIWQSPDPHRSSLLTPXLSLDAYRNENYDRKILEEMGELGLLGASIEGYGCAGVSTVASGLITKEVERVDSGYRSGMSVQSSLAMTAIHESGTQELKDRLVPELAKGKLAGCFGLTEPNHGSDPGSMETIAREHPTKKGVYLLSGSKTWITNSPISDILIVWAKLQSTGKIRGFVVERSKCPPGTLETPALKNKSALRASITGMIQLDDCPVPVENMFPDVEGLTGPFTCLNSARLGIAFGAMGALEDCIDRARTYALERKQFKGNPLAKYQLIQKKLADAVTDATYGTLAATQVARLKDAGKCTPEMISLVKRQNCDRALANSRTWVFPRSYQPRQSSMIQKMSXPAFLNRLQEVFGGNAASDEYHIARHVANLFVVQTYEGQSDIHGKCFSTFDCSTILISNXPLILGRAITGVQAF

SEQ ID NO: 13088 - protein, 126 aa, Aspergillus nidulans
GDSPYSGGVFFLTIHFPTDYPFKPPKVNFNTRIYHPNINSNGSICLDILRDQWSPALTISKVRHRNFVPLNLSTNTKCFAVLLSICSMLTDPNPDDPLVPEIAHVYKTDRPRYEATAREWTRKYAI

SEQ ID NO: 13089 - protein, 706 aa, Aspergillus nidulans
SFDFSFEAVRENLFRVTFTSPSHPPPPYPSVTKPKTSLNGIEVATSSSPSQIDIEVGDVKAAVNWENTPVVSLSWKGDSKPLYRDLPLRSYVIDGDGIAHYTEHDRKALHVGLGEKSAPMDLTNRHFQLSATDSFGYDVYNTDPLYKHIPLLIKATPAGCVAIFSTTHARGTWSVGSEVDGLWGHFKVYRQDFGGLEQYLIVGRTLREVVRSYAELVGFPLAVPRWAYGYISGGYRYSAMDEPPAHQALMEFADKLKEHDIPCSAHQMSSGYSIAEHEPKVRTVFTWNRYRFPDPERWIAEYHSRGIRLLTNIKPFTLASHPDFQKLIDGNGFFKDPETGEPGYMRLWSAGGGTGGDGCHVDFTSAVAFKWWYNGVQFLKRSGIDGMWNDNNEYTLPNDDWQLALDEPTVAEAAKKQTDNNTVGLWGRAMHTELMGKASHDALRDLEPNVRPFVLTRSATAGTMRYSASTWSGDNVTSWESMKGANALSLNAAMSLLQASPLCPNQSILKLSLTSRQCEGHDIGGFEGPQPSPELLLRWIQLGIYSPRFAINCFKTSPNNNEVGEVIEPWMYPEVTPQVRATIKRRYEILPYIYNLGLESHFYASPPQRWVGWGYESDPEVWSKKLKRGEEQFWFGETILVGGVYEPGVNVAKVYLPRKAGDEFDYGFVNMNAPYTYYASGQWVEVPSKWKESIALLAKIGGAIPV

SEQ ID NO: 13090 - protein, 172 aa, Aspergillus nidulans
  unsure (1)..(172): unsure at all Xaa locations
YNRFXQTATGQITTKELGTVMRSLGQNPSESELQDMINEVDADNNGTIDFPGTRTPQSTSHQPRNVLMLNEFLTMMARKMKDTDSEEEIREAFKVFDRDNNGFISAAELRHVMTSIGEKLTDDEVDEMIREADQDGDGRIDCTLAPRLSLTVEEVXYXSAADNEFVQLMMQK

SEQ ID NO: 13091 - protein, 604 aa, Aspergillus nidulans
  unsure (1)..(604): unsure at all Xaa locations
PGAEKTYIEHYSQPAHDITEIAKDNRIHWTKHAEQYPIADYISLPTASPAPIPKIQYDFPAESWFARIWRKRKQGAVKEAFKHAWKGYKSNAWLRDELSPLSGGYRTSFAGWAATLVDALDTLIIMDLTDEFEEALEALEHIDFSTTDSIQINVFETNIRYLGGLLGAHDLTEGRYPILLKKATEIADFLYGSFDTRNRMPQSRWEWTRXECILVTAWTGQLRPSKXLFHHIDSSXIRSGQTIHPSGNTILAELGSLNLEFTRMSQLTGDQKYFDAIQRISDHLESAQKETLVPGLWPMMVDAESMRFSDPRYTIGGMADSAYEYLPKEHMLLEGRTQQYQRMYESAIPAIKERMLFRPMTKGGEDILFSGNIYAGTKASRKKVEAQAEHLKCYLGGTIGIGAKVFNRPEELSIARKLTDGCIWAYDIMPSGIMPEVMYLSPCDDLENCPWDEQKWYRDVRARPPPHANIADTEEAAKLLIEKFDLVPGVAEIADARYMLRXALKQLTXAKFAECLVGPEAIESVFIMYRITGDKKYQDAAWRMFNSIEKATRTKYAHAAINDVREENPKQLDYMESFWLAETLQYFYLIFSEPELISLDDYVL

SEQ ID NO: 13092 - protein, 362 aa, Aspergillus nidulans
  unsure (1)..(362): unsure at all Xaa locations
LDGHNDFPEFIRYFYHNHIYQSNFSDQIALPGHVDFPRLAKGGVRGQFWSVYVAWYVAPAPIYPYSSQNVECXXCSHDSPPEPDYEYVHDTLQQIDLVHRLASLYPGYLEIVPDTTAFRHTFESSPTKIASFLGVEGLHQIGSSASTLRLYHSLGARYVTLTHMCHNEYADSATPSKPRHNGLSAKGRDMVLEMNRLGMAVDISHVSAKTMHDALDTSKAPVIFSHSSVYALCPHERNVPDDVLLRLAENGGVIMITFLDEYTRCDNPLAATLSDVADHIQYVGELIGYEYVGLGSDFDGMVTTIQGLEDVSKYPDLIKELLDRGVSVKDAAGIIGGNILRVMGEIERVAREMNEEGITPLE

SEQ ID NO: 13093 - protein, 572 aa, Aspergillus nidulans
  unsure (1)..(572): unsure at all Xaa locations
CHEFVASLPLHSDSKRRTQHPRVHRESNQSPEAPSTRRLRSSDNIQRRASIXECRHHKKPLACLXAEKEDXFAGGSGAVLFEREYYTEYIPNFXRXARTATCEIHWLICSDNNLKPAEVRTPTKARYRDALGSPPVTPKHRVQVGAKALTPRTPRQLGTPTTTQTVYTQARQLFARGANSGRIIGREVEKEKLASFIADGMKFKKGGCMYVSGPPGTGKSALVKEVLDEVEIKPARVAQLNCASMRTARDVYSKLTEDLCDDDDVFKKSEADRLKSMFLSDKKQASKHEMFLVMLDEIDHLLTSDAGILQSLFEWSLQGESKLLLIGIANALDLTDRSLPQLKAKNLKPLLLPFLPYNASQIAGVVIERLRSLLPEGQVEDPNFIPFVQPAAIQLCAKKVRSQTGDLRKAFELIKRAIDVIEQETIQKHDMQNLNSPSKTILVENNNLSSSPKHSLAKGTSALPYTIMTAPRASIAHVAKITSSVFGQGTTQRLQCLNLQQKAAICALVALDRKRRENDIPQTPSKSKNLAPTVKQIFDAYCTLCRTDNILHPLTATEFKDVLGSLETLGLV

SEQ ID NO: 13094 - protein, 401 aa, Aspergillus nidulans
  unsure (1)..(401): unsure at all Xaa locations
PSRTLQARAVCTPKAGGSSSIDDVPAIVKSISACGDGGTIVFPEDSTYYLNSVLDLAGCSGCELQVEGLLKFASDTDYWNGRTAMINVKNIDGLTIRSLTGSGVIDGNGQKAYSPRFPFSIYELHLXTNRDGQVDRFAQDSSYDRLTPLYITGGGDIKVSDFRLKNAPNVFVSVKGGTTNAVFSDMRLDATSKSETLPENTDGFDIGESTYVAISGPSVSKSHDCVAFKPGCVSVTVANVTCTGSHGLSVGALGKSSDDIVQNVRVEGATMISSTKAAGIKTYPSGGDHGLSTVTNVTWKDITIQNCDYAIQIQSCYGEDEEYCETNPGDAVFSGIAFEGFSGTTSSKYDPVTGNLNCGEDGKCDVSVVDYSVKAPSGGGKVLCANTPSSLGISCSSGASG

SEQ ID NO: 13095 - protein, 1041 aa, Aspergillus nidulans
  unsure (1)..(1041): unsure at all Xaa locations
MGVPDELPPGSSETDTIVSSSQPTNRSPMDLISEAESLNLRRIATNQSKAQCRPGSAAVPSHDNPPNDDLEDATLDPNSASFSLEKWLRAAVSDASQHGLSTPSGGIPLQKSDRLRAQARRLQLQPTVGSVLTAPLRFASCCDTGESSLDRILHGFDGVMKTGELLLVLGRPGAGCSTFLKTVCGETNGLHIDADSVLHYNGIPSEXTAVTGSXNSWANEIQXGYHSSRMMKEFKGEVVYNQEVHLSCLVHCSSTHSMLTPDQGRQALSPLTVRQTLEFAAAARTPAHRFQNMSRDEFASYAASVVMAIFGLSHTHNTKVGNDFVRGVSGGERKRVSIAEMALRXHHSQHWDNSSRGLDSATALKFVQALRLSADLAGAAHAVAIYQASQSIYEVFDKVTVLYEGRMIFFGPTGTAKEYFERMGWVCPARQTTGDFLTSITNPLERKARAGMEDVVPKTPKDFEIYWRQSPEYKTLLGEMTEFETQHPTGNDEQASAELRARKENSQSRNSRAASPYILSIPMQIKLNTKRAYQRIWNDMSSTMSTVVGQIVIALITGSVFYDSPNTTAGFQSRGGTLFYAVLLNALTAMSEITSLYSQRPIVEKQASYAFYHPATEAIAGVVSDVPVKFLLAVAFNVIMYFLANLRPXTSAVLHYFLMSFTVMFVMSAVFRTMAAVTKNAAQAMGLAGVLMLALVVYTGYVLPVPSMHPWFEWIHYLNPIYYAFEAMIANEFHGRDFDCIAFVPSYADLDGDSFLAPRSGSVAGERMVSGDSYINFNYTYTYSHVWRNFGVLLAFLIGFMAIYFLASELNSSTTSTAEALVFRRGHVPEYMRPGYTRPTDEEKAVTQSDIKPSSPSPTNTDLPLPPQRDIFTWKDISYDIEIKGEPRRLLDDVSGWVKPGTLTALMGVSGAGKTTLLDVLAHRTTMGVITGDMFVNGKGLDASFQRKTGYVQQQDLHLETATVRESLRFSALLRQPASVSIREKHDYVESVIEMLGMGDFAEAVVGTPGEGTECRTEELLTIGVELAAKPKLLLFLDEPT

SEQ ID NO: 13096 - protein, 309 aa, Aspergillus nidulans
  unsure (1)..(309): unsure at all Xaa locations
PFPDDVPTAPLLRLSLKDLLAGNETEIEKLSKACEDIGFFYLDMRDAGTVTQILEDADKLFEIGAGLFELPLGEKKKYDLSSQKSYFGYKAQGAAVVDRQGNLDRNEFYNVSPLRCLFSWYRLHXNISRFRKTTSWAYLDHSQPQTLXIKNRHILESFIKYSHSIVTLILSILNTSLGLPESTLTNIHRLHAVSGDQVRFVKAPPQPADDRRTALGEHTDFGSVTILFNRLGGLQVLPPGADAEWQYVKPLPGHVIVNLGDAMVKFTNGLLRSNIHRVVSPPGDQADTTRFSLVYFSRPEDDVPLRRLE

SEQ ID NO: 13097 - protein, 530 aa, Aspergillus nidulans
MNTDKYTDKANKALQDALELTIEHSNAELYPVHLAVALLDPSQNEDDGPSLHPSHGDSTSLFRQVVERAHGDVQLLHRGLMKRLVKLPSQDPPPETRSISAPFRKVLTAAADLSKTQKDSYIAVDHLIQAVCQDSTVQAALKDANVPNVKLIDNAIQQIRGTRRVDSKTADAESENENLKKFTIDMTALAREGKIDPVIGREEEIRRVIRILSRRTKNNPVLIGEPGVGKTTIVEGLARRIVNADIPASLSQCKLLSLDVGSLVAGSKYRGEFEERLKGVLKEIEESKETIVLFVDEIHLLMGAGASGEGGMDAANLLKPMLARGQLHCIGATTLGEYRKYIEKDAAFERRFQQVLVKEPTVSETISILRGLKEKYEGHHGSVRILDAVIVTAATLAARYLTARRLPDSAVDLIDEAAAAVRVARESEPEALDNLERKHRQLQIEIHALKREKDEASKARLQAAEQEAANVIEELRPMRQKYESEKQRNKAIQDAKTKLDNLKNKQEEAERSGDTETAADLKYYAIPETQ

SEQ ID NO: 13098 - protein, 393 aa, Aspergillus nidulans
PDHGLRAWLQVLCMHLVFLNTWGVSNGFSIFNQLYTKTLPESSSTISWIGSIQISLLFFFGVFAGRATDAGYFRLMYMAGAFFQVFGFFMLSLCKDYWQIFLAQGICMLISNGLTFGPGLAVTSSYFSRNRGLAVGIAAAGATTGGMIYPVLIHQLLDIHSLSFGWTVRIAAFVMLITQISGLLFFHPRLPPRPSGPFLDSAAFKEKPFVFFALSMFLNLWGLYFAFFYMGTFARDRLAVRDTQNFILIQNGVGVLGRILPTRLADRVTGKFNILIPLNFTAAVVVYAWIAVHTVAGLYVFTVIYGLAGGAAQSLFPATATTMITDVRKTGTRIGMILSFVGIATLTGPAIDGALIQAMQGEYTGAQVFSGTCIVLRAGSALAARVAKTGWKL

SEQ ID NO: 13099 - protein, 470 aa, Aspergillus nidulans
SLVGFSARSRHIGEAAKTQETSNLKNTVGNLKRLIGRAFSDPEIQIEQEYSVAQLCDVNGQAGVEVSYLGKKEKFSAIQLVAMYLTKIRDITSKELKLPVTDVTISVPAWFTDIQRRAMLDASEIAGLKVLRLINDTTATALGYGITKLDLPGPEEKPRRVMFVDIGYSDYTATIVEFRKGELNVKATACDRHFGGRNFDKALTDHFADEFKEKFKIDIRTNPKAWARTLVAAEKLKKILSANTVAPMSIESLMEDIDVRAMVKREELEDMVRPLLDRVTVPLEQALAEAKLKPEDIDFVEMVGGCTRVPAIKQAVNKFFGKNLSFTLNQDEAIARGCAFSCAILSPVFRVRDFSVHDIVSYPIEFTWEQSPDIPDEDTSLTVFNKGNVMPSTKILTFYRKQPFDLEARYANPEALPGKVNPWVGRFSVKGVKADANDDFMICKLKARLNLHGILNLESGYYVEDVEVEK

SEQ ID NO: 13100 - protein, 358 aa, Aspergillus nidulans
TMKAAQWDPKLQKVVVNRVPIRTPGPNQILVKLASASLCHSDILAINQPNMAEPFTLGHEGAGYVAELGTKCTDKGFREGDPVGFLHINGCCFECEGCMVHNNNCTQGTPVVSGFGGIRDFGFFQEYAAVDWQNIIHLPYQLDSKRSSAIFCAGITGMLGTAMSDRSVADRTPAFHAVDSCNLTAGQWFAAIGAGGLGQLAVQYANAMGYRVIATDINDGALETCKRQGADVIINSLSRPDYANEVKKLTPGGVHPTAVFSGAPAAYRGAPSIVRPRGLLMVIGISSSLLELSTFDLAIGTYVVKSESTSIPQRMAKAVDFTAKHGITPEIKVRSGLEDVDEMVCDMQAGRSSKRMAV

SEQ ID NO: 13101 - protein, 346 aa, Aspergillus nidulans
  unsure (1)..(346): unsure at all Xaa locations
MSLXCRXPTMATSGCGSFGIIRKVKRKSDGFCKADRRACGVTYSQGTVXILCRKEINYIKMSTKEREQLTAEFNILSSLRHPNIVAYYHREHLKASQDLYLYMEYCGGGDLSMVIKNLKRTNKYAEEDFVWRILSQLVTALYRCHYGTDPAEVGSNLLGPAPKPSGLKGKQAQMTILHRDLKPENIFLGSDNTVKLGDFGLSKLMHSHDFASTYVGTPFYMSPEICAAEKYTLRSDIWAVGCIMYELCQREPPFNARTHIQLVQKIREGKFAPLPDFYSSELKNVIASCLRVNPDHRPDTRTLINTPVIRLMRREVELNNLSRAARKREEATMQKAKDVEQAFAKL

SEQ ID NO: 13102 - protein, 558 aa, Aspergillus nidulans
  unsure (1)..(558): unsure at all Xaa locations
RNRRCALPVNQDSADFELDSWIVXDPAELDQITTLPNGIRVATESLPGPFAGVGVYVDAGSRYEDASLRGVSHIMDRLAFKSTKTRTADQMHETLESLGGNIQCASSRESLMYQSASFNSAVPTTLGLLAETIRDPLITEEEVLQQLATAEYEINEIWAKPELILPELVHTAAYKDNTLGHPLLCPRERLTEINKAVVEKYRATFFRPERMVVAFAGVPHHEAVRLTESLFGDMQGPSTNNGPSLSGTGVDTTLSDSKSEGQFAAAPQFTPTSTVASAPATTDSSILSKLPFLKKFGSNNPSSSESAPVDLTQASHYTGGFLTLPPIPPPANPMLPRLSYIHLAFEALPISDPDIYALATLQTLLGGGGSFSAGGPGKGMYSRLYTNVLNQHGWVESCIAFNHGYTDSGIFGISASCSPTRINQMVEVMCRELQNLTLDTGYTSLQPQEVNRAKNQLRSSLLMNLESRMVELEDLGRQVQVHGRKIGVTEMCKHIESLTVEDLRRSARKVFGGQVHNKGQGTGKPTVVLQEGELEGFKLRPFAWDEIQERIARWKLGR

SEQ ID NO: 13103 - protein, 691 aa, Aspergillus nidulans
  unsure (1)..(691): unsure at all Xaa locations
QELWGHSAPESTRIYHFTKTIAEKHGIPLRSYNDLWNWSISEPAKFWEEIWLYTSIIAHRPYDQVRILSAASYELSTFXLNAGNGLRDLLFPRPQFFEGASLNFAENLLYPACSPDENAVAIIAATEADREYISWKELRDRVRRCANALKGAGLQKGDRVAGFLGNHANTVVAMLATTSIGAFWTGVSPDTGVHAVLERLTQIEPKILFADNASLYNGKVHSAAAKTSQIVCELPKLEALVIFPTIGSVEIKLEEVSLRQGKAYTYADFLLTASNPAAPLEFASLPPEHPVYILYSSGTTGAPKPIVHGSLGTLLQHKKEHVLHCDIYPGDRLFYFTTTTWMMWHWLVSGLASGATIVLYDGSPFRPLDPEGGAGEMAMPRLIDELQITHFGTSAKYLSMLEQAALNPREYPHRPVSLQTLKAIFSTGSPLAPSTFEYVYSSIHPDIMLGSITGGTDILSLFCSGCPILPVYKGEIQCRSLAMAVSVYDYAGNDISSSGEPGDLVCTRPFPAQPVMFWPPGPIGVEKYRKSYFDVFGPSIWHHGDFVRLNPETGGVVMLGRSDGVLKPAGVRFGSAEIYNILLKHFADEIEDSLCVGRRREGIDTDETVVLFVKLASPSDSLPPDLASRIQATIRRELSPRHVPGIVDVCPEIPVTSNGKKVENAVKQILCGLNIKIGASVANASCLDWYR

SEQ ID NO: 13104 - protein, 582 aa, Aspergillus nidulans
LRRRTTQNMNEPPTTLFQPPSPEEARRLAKQHAQFGPIGHPSHRYSSRHPGGPFPEPVMDEPPYYYLITTYISYLILIAFGHVRDFFGKRFREENYRHLKPRNGYAALNSDFDNFYVRRLKLRINDCFERPVTGVPGRYITLIDRATDDHNKNFYLTGTTTDTLNLSSYNYLGFAQSEGPCADITEETIRKYGITPVSTRAEVGTQDLHVELEELVASFVGKEASMVFSMGFGTNANIFPALVGKGDLIISDELNHASIRFGARLSGASIAMFKHNDMHDLEAKLREAISQGQPRTHRPWKKILVVVEGLYSMEGSMCNLPGLIALKKRYKFYLFVDEAHSVGAIGPRGRGVCDYFGIDTKEVDILMGTLTKSFGANGGYIAADKVMIDKLRATNSGMFYGESTSPAVIAQIISALRLIKGELIPGQGEERLQRLAFNSRYLRLGLKRLGFIVYGHDDSPIIPVLLFNPAKMPAFSHEMLKRKISVVIVGYPATPLVSSRARFCVSAAHTKEDLDRILTACDEIGNILQLKFSTGVAGGALPMNDDMAPPPEKEVQWQQKRNPRIVPPRWRIEDVIRRGVQD

SEQ ID NO: 13105 - protein, 252 aa, Aspergillus nidulans
RIFITGSSDGIGQAAAKVLSEQGHSVVLHARNADRAASAQEAVPGAEAVLVGDLSSIAETKALAEEANKLPPFDTVIHNAGIGYGATASQEITADKISAVFAVNTLAPYILTCLMHKPKARLLYMSSDSHYGGDESLRNITQSHSYGNTKLHDVMLANAFSRRWGNAIQVVSMHPGWVRTKMGGVMAPGALDRPARVLADWAIGKGDLARLKSGTFFTTSGPESAHPGADNVQKQEELLRICKEVSGVGVPG

SEQ ID NO: 13106 - protein, 197 aa, Aspergillus nidulans
  unsure (1)..(197): unsure at all Xaa locations
SSVDKDEVDRLRKRFMKLDKVPTQPVQTEKTFLNNGLDNSGTIDRDEFLSLPQVSTNPLATRCAASNSISVQYHLTRXLESTEMIAIFDEDGGGDVDFQEFVSGLSAFSSKGNKEEKLRFAFKVYDIDRDGYISNGELFIVLKMMVGNNLKDVQLQQIVDKTIMEADKDHDGKISFEEFTDMVESTDVNLSMTLSMW

SEQ ID NO: 13107 - protein, 244 aa, Aspergillus nidulans
IVTGANQGIGLGIAEVILANSAAHVYSLDISTPGDPFNELAQKNPKRFSFIQTDVTSEESVQAALDQIVSEQGRLDGMIANAGATKHQPALDFTMDQVKRLFELNVFGAWNCATAAAKTFIKLGIKGSIVFTASMTSYRPNRAAPSAPYGGTKAAVRNMTHTLAMEWAKHGIRVNSISPGFVKTALTYYVETSPDWDTKMKYYGGMPRLAIPQELGGAYVYLLSDTATYTTGIDIPIAGIVGAW

SEQ ID NO: 13108 - protein, 159 aa, Aspergillus nidulans
FTLFDLDRDRHLDYHELRVAFRALGFTLPKQELISLLTTYGVPRPQVQQQAAAQQSQQQPKTAPTTNPQHPSNLLMPLSAFQAVTAVKILERDPRDEILRAFELFDEGGKGYIDLEDLRRVARELGETGLEEEELRAMIEEFDLEGVGGVTREAFVSIC

SEQ ID NO: 13109 - protein, 378 aa, Aspergillus nidulans
YGVFLAYYLSHDVFPNTSALMYAFTGGLSISCALLVAPLATYLIHVLGTRAVLNIGVFFETLSLIASSFVSQRWQIFLSQGVCFGIGMGFLFVGSVGITPQWFHRRRSLAMGINAAGSGLGGLTYSLAVGAIIPRLGLSWAFRILGIVSCVVNLVCANLLRDRNTAVGSRFKAFHFPLFKRPEFLLFLGWGIFSMLGYVAILFSMSNFAVSVGLSAHQASIISALLNLGQGLGRPFVGMFSDKLGRINIATFLSFLCGVFCLLIWTFARSMGLVSFFAVLVGTVAGTYWATVAPVLAEIIDLKDLPGGLSITWIVLVAPTTVAEPIALLLRDNDSPSRIYLHVQLFTGLMYIAAAVCLWTVRGWKVGENLRVKQEKSA

SEQ ID NO: 13110 - protein, 1046 aa, Aspergillus nidulans
  unsure (1)..(1046): unsure at all Xaa locations
TMKSLRRDYSTDPSTANVTSKVFVRSTKSGKVQKIVRELYLRQDIPCSSRLCXFAPFGCTDGCKWKXXERTXIFRESLFANITLYVVPFVLLKQPAGTTAFPRRHYIVPDTNALLNGMNLFEHTGAFYDVIILQTVLEELKNQSLPLYNRLLALIKTDEKRFYLFFNEFRLETHVRREQDESINDRNDRAVRTVAKWYMDHLRAVTKSKKEKSIPAIVVITDDKENLRKAKEESVTALSLENYVSGLEDADRLLDMINESREAREAKEARGELYYPEYYSMSKIMTGLRAGNLHQGVFNVSPYNYLEGQVKVAAFDKPLIIMGRHNSNRAISGDVVVVEILPKDQWKSPSTKIVDEEAVTKNDNPEGEDNETVITEKERRALQEEVRQAHGKNHEGRPQPTAKVVGVVKRNWRQYVGTVDPTSTGSQTTGRRQQNVFVLPMEKKVPKIRVRTRQATELLGQRILVTIDAWNRDSRYPTGHFIRSLGELETKSAETEALLLEWDVQYKPFPKAVLECLPPEGHDWRVPASKDDIGWRGRRDLRDLLICSIDPPGCQDIDDALHARKLPNGNFEVGVHIADVSHFVKPNNAMDLEASVRGTTVYLVDKRIDMLPHLLGTDLCSLKPYVERYAFSVLWEMTPDAEVVSADFTKSVIRSREAFSYEQAQLRIDDPSKTDELTESMRTLLHLSKILRQKRMDAGALNLASPEVRIEADNDEVGDPLADVKTKAMLATNSLVEEFMLHANITVAAKIYSTFPQTAMLRRHATPPPQNFEELINQLTKKRDMRLDVSSSRALADSLDRCTDAENPFFNTLVRILATRCMTSAEYFCAGAHAESEFRHYGLASPIYTHFTSPIRRYADLLVHRQLAAAINYEGEDGRATIEGSITRNRLEDICRNINYRHRNAQHAGRASIEYYVGQALKARSEKLATNGVDIGIEEDGYVMRVFENGVVVFVPRFGIEGVVRLEDFVLPSDEALRSVEDRRELVTRRESEFDPEEYTLKVSNKGHQERSVAVELFQRVKVNISSVKEETGRGVGKRRVRILIL

SEQ ID NO: 13111 - protein, 516 aa, Aspergillus nidulans
  unsure (1)..(516): unsure at all Xaa locations
MAAPAQKFKVADIVRLSTQLVEGEYHVXLEXSLAAFGRREIELAEIEMPGLMAIRAKYGPAQPLKGARIAGCLHMSTFRIPEXLWNELTFPQPFQTAVLIETLTALGAEVTWTSCNIFSTQDHAAAAIAAAGVPVYVDSQSYWSTKLIXAASPWKGETEEEYNWCLEQQLSAFKDGQKLNLILDDGGDLTSLVHTKYPEQLQGCYGLSEETTTGVHHLYRMLKEGKLLVPAINVNDSVTKSKFDNLYGCRESLIDGIKRATDVMIAGKVAVVAGFGDVGKGCAQALHTMGARVLVTEIDPINALQAAVQGYEVVTMEEAAPLGQIFVTTTGCRDILVGKHFEVMRNDAIVCSKHPSTTLIKMXLNVXTSAHFDIEIDVAWLKANAKSVQNIKPQVDRYLMPNGRHIILLAEGRLVNLGCATGHSSFVMSCSFSNQVLAQIALFKAEDKDFGQKYPEFGTSGKKPVGVYVLPKILDEQVAYLHLSHVNAKLSTLTPVQAEYLGLDAKGPYKADHYRY

SEQ ID NO: 13112 - protein, 1155 aa, Aspergillus nidulans
  unsure (1)..(1155): unsure at all Xaa locations
MPADIRSFFGGKSSQGSASSPTKPPAKKEVCVXSPMLNLCPVFCSCLVXWMAVNFAIKQTPARNKRTIRGNLXHMDHCIDKVTGGRKVVNDSEDDDDVVVTDAPVSRAKPSSKSXALLVELQLRPLTHDRRKPAVPEGEPTTASDYFASSKKKGRTKSSNADTNNKPSKSSATKTESPEATVGTAEQKDATRAGSRRDTNKATVRLDDEKLGDDDIFATEYGKAGKGNDDYKEEEDDDDSDDFDPLAKPVNGARGRPVSKKRSALGEDDEDVIMEDAPRRPASAAKPATSQTQRKRKSEAVDKDDDDIQATSKSVGTGARSKKPKALTAKQDQSDSKEIQDIFDSIPTIKAPSPPPPQGSDEKKKFVFGGGKSRDPVSGGAELPVGAENCLAGLTFVFTGVLDTLGREEGQALVKRYGGKVTTAPSGKTSFVVLGSDAGPSKLATISKHKLKTISEEGLFELIRRLPANGGDGKAAEKYEAKKKEEDEKIRKMAAEIDAEEKRNEAERRKEVKSGQTTQDVKDKKENNADDQLWTSKYAPTSLNMICGNKGAVEKLQAWLRNWRKSAKANFTKPGKDGSGLYRSVMIHGPPGIGKTTAAHLVAKLEGYDVVESNASDTRSKKLVESGLLGVLDTTSLQGYFSTSNKKVESGKKNLVLIMDEVDGMSAGDRGGVGAMAAIAKKTQIPLILICNERRLPKMKPFDHVTFEIPFRRPTVEQVRARLLTICFREKMKIPPQVLDSLIEGTHADIRQVINMLSAVRLDRSEQGDQTGQDYSLDYDQGKQMSKAWEKHIILKPWDIVGKILNPQMFSQSSTATLNDKSELYFNDHEFSYLMLQENYLRTKPTRANNYEGKERKLKLLELADNAASSISDGDLVDRMIHGSQQQWSLMPTHAIFSFVRPASFMFGNMMERPAFTSWLGQNSKQGLIIVFGVIAREADVVHAGKLSRYVKEIQGRMRVRASGDRHEVRQQYIPLLWDRLVKRLMVDGKDSVEDVVDFMDSYFLTRDDWDALVELGLGPMDESKVKLETQTKAAFTRVYNQRSHPLPYMKASNVLAPKKAPKEKPDIEDAIDESDEDDVLVDDTKDDEDSDEIDLKKDKLIRVPKKSTAKKSSKSSTSAKGKGKSKKTSADDFIDDEDDDAPKPKKARGKKAKS

SEQ ID NO: 13113 - protein, 408 aa, Aspergillus nidulans
  unsure (1)..(408): unsure at all Xaa locations
LLVDKHRPRSLDTLSYHHELSARLRSLVWKSPAILKKLKLXYLFQAQSGDFPHLLMYGPSGAGKKTRTIATLKELYGPGVEKIKIDNRVFQTTSNRKLEFNIVSSVYHLEITPSDVGTYDRVVVQELLKEIAQTQQVDLSAKQRFKVVVINEADHLTRDAQAALRRTMEKYSPNMRLILLANSTSNIIAPIRSRTLLVRVAAPSEEDICTILSTSAKREGWNEAPELNKRIAKESGRNLRRALLMFEAIYAQRYASXLPLLCGANKVLRSEKVSDDTPIPPPDWEALISVIAEEILAERSPARLLQVRARLYDLLTHCIPATTILKVCXLIMENGESTNHVXTLTFKLIAKIDDTLKPEVIKWSAFYEHRITQGSVRVPLSCXXCQSXLRTESIFHLEAFVAKFMRIY

SEQ ID NO: 13114 - protein, 323 aa, Aspergillus nidulans
  unsure (1)..(323): unsure at all Xaa locations
MGHEDAVYLAKLAEQAERYEGSFSLFLGRCWNSWPRYXRSSIXEMVENMKVVAASDVELTVEERNLLSVAYKNVIGARRASWRIVTSIEQKEESKGNESQVALIKEYRQKIEGELAKICQDILDVLDQHLIKSAQSGESKVFYHKMYVSVVVHLCHPSXHISTPTGRGDYHRYLAEFAVGDNRKAAADASLEAYKSATEVAQTDLAPTHPIRLGLALNFSVFYYEILNSPDQACHLAKLAFDDAIAGMXRINVRSRRSTNFRCRADTLSEESYKDSTLIMQLLRDNLVSXIHAMLGTVLLTXFRLSGPPLRPEPAAENAPAEK

SEQ ID NO: 13115 - protein, 551 aa, Aspergillus nidulans
  unsure (1)..(551): unsure at all Xaa locations
MYRLEAATSRLEDMAMSLDEHDAQKKTADNSAALEPQASERPTPTAPAAPAAAPLPPQIEDFDTLISKDVGNFVQLGQKIGGLVAEQVXCQVSXXLLNALLICFXSNAVLEAFKAERTYLYVSTKAKKPEIQPPELMTGLHTASDAINNLRESNRASPLIDHLSAVAEGIVALGWFFDPKPADFVSEMLGGIQYYGNKVLKEYKEKYAFCTGGHVAPWFTDRLAGDRTHYDYIQAYYQIFKSLSSYLRKHYPKGLTWNDKDGIDAQEALRQVKNSSDSAAGGAGTPPPPPPVPTLNIPGGGAPPPPPPPPPPPMISEQQSSGASSDMSAVFAQLNQGDAVTQGLRKVDKSQMTHKNPSLRASSTVPGSPSSSSRSKSPAPSKKPKPESMRSRKPPRKDLEGTKWFIENFDNPGDIVEIPAKQNQSILISRCNKTIIKVSSKANAIAIDNCHGLSIIVDSLVSSLDVVKCSKFALQIDGVAPTLLMDQVDGATVYLSSQSLGTELFSSKCTAVNVMLPPKEGTDEDTKECPVPEQIKTSVKDGVLVSEIVEH

SEQ ID NO: 13116 - protein, 510 aa, Aspergillus nidulans
  unsure (1)..(510): unsure at all Xaa locations
KQRHXQLAVLDGGTGFLKVGYAAQVRLSSPRVSLLSLGLRNDFTLILQNFPEHQFPSIVGRPILRTEEQAGDIVVKDIMCGDEAAAARSMLQISYPCMSTSRSFYTSPWNAREFRSPDSQWXCVYTLGLIPMTAMXMENGIVKKWDDMQHLWNYTFYDKMKIDPTGRKILLTEPPMNPLKNREQMAEIMLEHYNFGGVYVAIQAVLALYAQGQCQRQPKITQLLIWRTLGLSSGVVVDSGDGVTTSIPVYESTVLNHHIRRLDVAGRDVTRNLIALLLRRGYALNRTADFETVRQMKEKLAYVSCDLELDRKLSEETTVLVESYTLPDGRVIRVGSERFEAPECLFQPHLVDVDQPGMAELLFNTIQGTDVDVRSSLYKAIVLSGGSSMYPGLPTRLEKELKQLWLTRVLKGDPERLSVRIYHTNCSVIXARADSTQQKFKVRIEDPPRRRHMVFLGGAVLANLVRSWFPFYCRAHPFTYRIMKQIADKEDMWVTKQEWEEQGARALAKL

SEQ ID NO: 13117 - protein, 1043 aa, Aspergillus nidulans
  unsure (1)..(1043): unsure at all Xaa locations
DSEVEVSLEGLPDDPTELCTLLENERAAKNFWVIIALAYAKQKQIDHAIDILNKGLASVAQGATKEKLGLLGWVCWLYLLKSREAPRVVSDVGLGTEARTKDYYIQQATGILNEASRLNPSFPPLFLARGVLSLLRASLHPPRPVRPGAVDNSERVESLRQALKQFDESSKAFGGRNAMAILGRARAHYLLGRYAEALEGYQKVLMRMPGLTDPDPRIGIGCCLWQLGFKEQAKAAWERALALVCQFEECILDVVVVLIQYLPHLXNPDSKVANILLAVYYLYDSSRHATTDPAFGSLYKVAMTQYTQKAFKLDKEYPMTCALFGSYFLLRKAYSTVDTLARKSIENTDVMQIASDGWYLLGRKCHYEGDLAKAAEFYHRSDQARGGGDKGYLPAKFGSVQMQVSNKDYDGAKFQLEKIIQQTKNPECMTLLAALYAEEVFAAQKSGMKEDKSAEAKKAITLFEAVRALWKDESKKITPDESVLVYLSRLYEQNAPDKSMQCLTQLEELQLAEISDEERPEGLEDEEMKAALRVNLPPQLLNNMGCFLYQSSQLNMARSMFQAALDSCARSQEREGELDTDALVTTISYNLGRAFEASDMPDEAKKVYEALLERHSDYTEASARLTYLALRRSPTDEGPKKMAKLYETDSTNLEVRALFGWYLSKSKKRAANIAEDHEQRHHKHTLQYFDKHDRYALTGMGNVHLLFARDMRRDTDQEKEKRRKMYERAVEFFDKALQLDPRNAYAAQGIAIALVDDRKDLSTAVQIFSKIRDSLRDASVYLNLGHVYAELRQYTRSIEHYEAALSKDRARDAQILACLGRVWLLKGKQEMSLAAMKTALDYAQRAHSVAPTQAHLEFNVAFVQNQIASLTYSLPETQRTAQDVQDAADGLRTAVETFGRIAQAKNPPYPAESLEQRANMSKTIIKQLERALQSQKEYEEKNAAKLQQAREAREAEIRRREEEVRKAEEAERERKQRIAEERQRLVEEAQRLALSGQKRTGPRRSGDDYXIRNRRKGQAKKKSAGSSKRXKQRREDDFINDDE

SEQ ID NO: 13118 - protein, 204 aa, Aspergillus nidulans
LLTLPDIFGFFPQTLQGADILATSSKQKYRIFMPDFFEGEPADITWFPPSNEDQKNKLGNFFQTKAALPRPSPKIPGVVSEANSYAPSGGAFESWSILGYCWGGKITVLSSGSENKTFKAAVQCHPAMLDPNDAKGVNIPMALLASKDEKPDDVSQFGANLKVDHYVETFPTQIHGWMAARSQLEDEQVRKEYERGYQTALDFL

SEQ ID NO: 13119 - protein, 520 aa, Aspergillus nidulans
  unsure (1)..(520): unsure at all Xaa locations
LAQAFSPDGSNAVVIGPGNPALTDTYAQLHWHISAVHEKLAKLGVGHGAAVNLHLINSRDSIVGFVATCWHRAIAAPLNPAYKQDEFEFYIDDLSSTLVLIPRESYAQNAPRSSQVESIKRLLRSATGTGRRLCSMXRSWASXRAKETLASRPLSPDDIALVLHTSGTTGRPKAVCEHFPQEFDWELYXLLRQVPLTHKNLTTTMSECRGIASDIGLNSVLGNIQATYKLTPQDRTYLVMPLFHVHGLLAAFLAPLASGGSVIVPTKFSAHQFWSDFIEYKANWYSAVPTIHQILLKSPLPNPIPQIRFIRSCSSPLSPKTFQDLEKTLNAPVLEAYAMTEAAHQMTSNPLPPAKRQPGSVGIGQGVEIKILDQSGNEVPQGHEAEICVRGEECTKGYLTIQLANKSSFTKDGFFRTGDQGKKDPDGYVIITGRIKELINKGGEKISPIELDNTLLQNPNVGEAVCFAIPDPGHYGEDIGAAVVLKSGQNATEDELKSWVQEKLAKFKTPKQVSQLSLCP

SEQ ID NO: 13120 - protein, 534 aa, Aspergillus nidulans
DQALHQLQQQQSKLLDKIDDLRNIGVGSLVELPQLIVCGNQSSGKSSVLEAISRVGFPQKSNVCTRFATEVILRRNPVSRIKISIEPGPSRINEEERKRLQSFRHEQFSTKNDLPALIEKAKECMGVSESGGLGFSDDILKVEISGPDKPELTLVDLPGLYYSTSREQGLAGIGIVRSLTEKYMQNSRSIILAVISAKTDYHLQEVLNIAARFDPGGKRTLGIITQPDILEANSEEEDTYLQFMKNEKVRLHLGWHALRNRSFETRDVSDNARDEQEKEFFSQGRWTSLPREVLGVDTLRRRLSSVLLEHIRHNLPGLIGDIQQKISDREQRLAKLGSPRSTIQQQRGFLLQISSSFERIAAQALNGMYADPFFGGLGDAKGTSDIRRLRAVLRQLNELFAEAMSIRGCRRTIVDESTSGSASTTASMPGSENPYIDGWAAEYIDRGALEAEVSKQARENRGIELPGSANQLLVGSLFRDQSHPWEELAKAHLLRACDSVRYFVFLVLQYLADEHTSSLLAASVIEPELERMKQ

SEQ ID NO: 13121 - protein, 421 aa, Aspergillus nidulans
LTPNEIVNIQFTSGTTAMPKAACLSHRSILNNGAQIGDRMRLSPADTVCCPPPLFHCFGSVLGYMATATHGSAIVFPAEAFNARDTLRAVQEEQCTALYGVPTMFLEELGLLESGQVPHKGFEYLRTGIAAGSSIPAELMKKLHKTLNLTELTICYGMTETSPVSAMTTTDDPIDKRINTVGRLMPHVEAKVVDPLDRNKILPINSRGELAVSGYLLMKGYWGDPEKTAEVMLKDKDGKVWMHVCLSITRSTCSKDLTQGYRLTGDEATISPDGYVTITGRIKDLIIRGGENIHPLEIENCLLTFPGVADVSVVGVPDAHYGEVVAAFVIWKQAHQNTEEQAETGEKLRKFVREKLSAHLGRSLFFFLLIFRTLGLIRAVLILLRIVPKYIFFLEPTDSFPKTASGKIQKFKLKETAIKLL

SEQ ID NO: 13122 - protein, 356 aa, Aspergillus nidulans
  unsure (1)..(356): unsure at all Xaa locations
LGFGTWQSAPGQVGEAVYQALKVGYRHLDLATIYQNQREVAEGIKRAYKDIPGLKREDIFIVRQFLYPEQLVGPLDXQFACRTSKLWNTQHDPAVVEKALDDCLAELELDYLDLYLVHWPVAFKTGDNYFPLDESSDHPDGDVLIDDSISIVDTWKAMTKLPKEKARAIGVSNHTVEHLEAIINATGVVPAANQIERHPVLQSNDLIEYAAKKNIHITAYSVRPXSVVRRLQPKLMKKLGLRNNMFNIPLLVAHPEVKAVAEEASKRLGKTVTPAQVILNWSQEGGHSVIPKSVTASRIAENFQEVELTKEELAKVSKLGEERRRYNTPYVANKPRWNINIFGEEDEKPAKHKVIV

SEQ ID NO: 13123 - protein, 836 aa, Aspergillus nidulans
  unsure (1)..(836): unsure at all Xaa locations
RRVWTAFVWALTFWIPSFVLRYVGRMKRPDVRIAWREKVVLVLLILLFNGIVCFYIIAFGDLLCPGKDKVWNEKEVSWRSTSSNFYVSIHGYVYDITKFAKVTHGDTSPEATPSLMEPLAGKVLDAYFPPPLTRMCGNYVNDLAINLQNNDTSATEDQPLAVHKSGPRNRPDTTTKLHNITWYEQDFLPKINEYYKGKLVWSKDTVKKQAESSSERKWVIAHNKIYDLTDYFYTLDMMNSESSYDWLPSAITDLVKNNPGQDVSDKWPLMSSPFREAQSCLDYVFYKGDTDFRDGPRCTVNNWILLAFTILICAVVLVKFLAALQLGSKPVQQLQDRFVIYMAPTYSEAEDSVCKGLNSLSALRYDNKIELIFVICNSMIDGGGNERRTPKIVLDILGVDPKIEPSSLPVKSIGQGNEQLNYGKVYSGLYEYEGNVVPYVVVVKVGKESEQNKSKPGNRGKRDSQVLLLNFLSRVHHRAPMSPLELEVFHQINNVIGVDPELYEYCLMVDADTSVREDSLNRQDAACANDARIAGICGERSLQTEEPSWCTMIQVYEYFISHHLAKAFKSLFGSVTCLPGWXVYYPTVIHTSLTTQFCMYRLRTADRGRPLIISEKLLEEYSDNNVDTLHKKNLLALGEDRYLTTLMTKHFPTMSYKFIPDAFASTAAPETWSVLLSQRRRWINSTIHNLVELAALKDLCGFCCFSMRFVVMVDLLGTIILPATCVYLGYLIYRVASDTGPFPMISIVMLAGIYGLQAIIFIIKRQWQHIGWMIIYLCAYPIYSFILPLYSFWKQDDFSWGNTRVVIEEKGSKRIVAVEDEQFDPRSIPLQRWDDY

SEQ ID NO: 13124 - protein, 546 aa, Aspergillus nidulans
  unsure (1)..(546): unsure at all Xaa locations
GPNSLDSRYQNTQRGLKTRHVQLMALGGTIGSCAFTLPPSSYPVLLEXLFXTGAQGTGLFVGSGQALNIGGPLSLFLGYVFISTLVYCIVTGIAEVGAYLPVHGGTMSYHGFRYVSRSLGFAMGYLYWYSLGILVPYEIVAASLVIDYWPNGVPLAAWITIMLVVIVVLNYMPVGIYGETEFWFAGIKIITLIGLLLLSFILFWGGGPNRQRLGFHYWKDPGAMNTYLVTSNENTGRFIGLLQCIVKSAIAFIFAPELIIVTAGEMESPRRNVPKAGRRYIYRLVIFYLLGALAIGVICSSQDQALLTGDTNNASASPFVAAIQNAGIPVLRHIVNAAILTSAWSAGNSFLYMSSRSLYGLAVSGNAPSIFKSCNRFGVPWLAVTVSALFSLLSYLAVSSGSYTVFNWLINFTNTSGFISWICCCIVYFRFNAAIKAQGVEKPYSSRLQPYGIWVGLSFAIFLLLINGFTCFFPQNWSAANFFTAYIGIPAFALLYVGHRIWFWSDPWAWKSTEVDLQTGLQEILAAEKPARPRDTIGRKLMRWLS

SEQ ID NO: 13125 - protein, 331 aa, Aspergillus nidulans
  unsure (1)..(331): unsure at all Xaa locations
MGSVSKANVPKIDVSPLFGDDQAAKMRVAQQIDAASRDTGFFYAVNHGINVQRLSQKTMEFHMSITPEXKWDLAIRAYNKEHQDQVRAGYYLSIPGKKAVESFCYLNPNFTPDHPRIQAKTPTHEVNVWPDETKHPGFQDFAEQYYWDVFGLSSALLKGYALALGKEENFFARHFKPDDTLASVVLIRYPYLDPYPEAAIKTAADGTKLSFEWHEDVSLITVLYQSNVQNLQVETAAGYQDIEADDTGYLINCGSYMAHLTNNYYKAPIHRVKWVNAERQSLPFFVNLGYDSVIDPFDPREPNGKSDREPLSYGDYLQNGLVSLINKNGQT

SEQ ID NO: 13126 - protein, 471 aa, Aspergillus nidulans
  unsure (1)..(471): unsure at all Xaa locations
SQRVEVHNNSTTSAQTLPAGDTKTESESAAITAAAHPLSALPTPVLLRSLLIATISSKPSLLIPSLSALSFLCKPRAGPLLNVDRNPILHFILKATFYRQFCAGETPDEVRSTIRQLAGMGFQGTIMTYATESGFAAKTKMQTGLGVSTKMYGKQEVTEPTLARGEAFCPHIEAWRKETVETIELLGANDYLALKLVSFLLWHLLLTSXHRLQAQVPPAPPRSGLTFPPPAQMLSALDEISTKCAAKGVRILVDAESHHFLTGILRVTLDLMRNSIKDGHARIYNTYQAYLKSTPATIARHLQAASDVGFTLGLKLVRGAYIFSDERSLIHETKADTDAAYNGIAQGVLCRQLGAFGTEKPFPSVELFLASHNKESVMKAHALRLQRLKEGLPTVPVGFGQLHGISDEVSFRLLTLKNERNEPMVYKCSTWGRLSECLAYLVRRAVENRDAVGRTEDEYRALKREMARRVK

SEQ ID NO: 13127 - protein, 234 aa, Aspergillus nidulans
IDIESFKKYCAYLSSHLTGLVYSGTNAEAFLLTRDKRFAAIKAAREAVGPGYPIMAGVGAHSTKQVLELANDASEAGANYLLVLPPAYFGKATTPAVVKRFFADIAAKALHPVVVYNFPGATNGVDIDSETIADIVRTSKEASGGKSNVVGVKLTCAQVEKITQLTAAFGPDEFAVFEGQSDFFIGVLSVGSVRCIAAFVNVVPKTIIQIDRLYKAGRWRRRWLCIARRLWQSL

SEQ ID NO: 13128 - protein, 494 aa, Aspergillus nidulans
RNPAATTTITMPILPHLTVNTYNLTVVILVAIGTISTAYGLAVIGSTVGQPNFYTFFDLEADTTDPDYKHTTNMIGALNGVNSAGAFMGCILQAWSSDAYGRKTTIRLGAAVLIVGGALCAGAVHMAMFLVGRFVAGLGAGILACSVPIYQAEVSTAETRGAMVCVTGVMYAVGYSLAGWLGYACWFMEATSPAAQFAWRFPLAFQVLFPLCVLVGAPFIPESPRWLLAKGKGVEALSVLQKLHSTNGHSNGDNTKAREEFSLMEKQLELDQSRIVKSRWPALALFSTPANRKRSLIATILMIGNQFLGTFVLTNYGVLIYASLGLTGSIPLLLNACWTSFTLIGNTWTALYIDRFGRRRFLLAGATGCTLCMVFLCALTASFLNTDNTPGLRAAVFFIFFYSSGGVSSWTRRSLRYIAEIFPNHLRSQGVALGLGWFYLSSEVTLVAAPVGLDRVGWRFYLVLIVPSVLYVGCIYFLFPETKGRTLEEMGRVF

SEQ ID NO: 13129 - protein, 440 aa, Aspergillus nidulans
  unsure (1)..(440): unsure at all Xaa locations
RLDDGLARTPQMGSANSSLSWGSRSFHXCRYRWNTYNQYNCFPNESIVHENAQALVDTGLADLGYRYVTIDCGWGVEDRLPNGTITWNPELFPQGFPAMGQYLHDLGLLFGVYGDSGILLCGSPPNITGSLCMSSFLCLLPLVAGRKYADWVGMTDYEDIDARTFAEWGADSLKCTLYHILILXSXNANKSDDNCYSDAATNYPNVNYAPSTSPHPRFANMSRYIQAQDRDILFQVCEWGIDFPALWAPEIGHSWRIGNDIIPHWRSIFRTLNQAVPQTDFAGPGQWPDLDMLLVGLDGVLTVPEEQTHFSLWSILKSPLTIGAAIPGMRAESLEILSNADVIAFNQDALGVSAALRRRWSDEGYEVWSGPLEGGRTIAAVINWRDEDREITLDLPDIGLQYAETLQNVWADETVNGVKTSYSSVVEAHGVMLVQLAETV

SEQ ID NO: 13130 - protein, 392 aa, Aspergillus nidulans
  unsure (1)..(392): unsure at all Xaa locations
SSEGQDECCIYGVSAMQGWRISMEDAHAAVLDLQAKQSGSNDQPTDPDRRLAFFGVYDGHGGDKVALFAGENVHKIVAKQETFLKGDIEQALKDGFLATDRAILEGLXTVILGGSCARLVLPGSCLTQLDPKYEEEVSGCTAAVSIISKKKIWVVVCSRGXGELGRXHTPQANAGDSRSVLGVKGRAKPLSFDHKPQNEGLXLVSIDMSHILMNGCIGEKARISAAGGFVDFGRVNGNLALSRAIGDFEFKKSPELSPEQQIVTAYPDVTVHELTEDDEFLVIACDGGFPLNFAALFHNLIYYRNWDCQSSQAVVEFVHGGIAAKQDLYRICENMMDNCLASNSETGGVGCDNMTMVIIGLLNGKTKEEWYNQIAERVANGDGPCAPPEYGK

SEQ ID NO: 13131 - protein, 448 aa, Aspergillus nidulans
IMILIIVFYHYFAIALVPLFLLFLTASNYYRSSAREMKRHESILRSAVYARFSEAITGTASIRAYGVQNQFRSSLRDSVDTMNGAYFLTFSNQRWLSVRLDAVAVLLVFVTGVLVVTSRFDVSPSISGLVLSYILAIAQMLQFTVRQLAEVENNMNATERVHYYGTQLEEEAPAHIPSNPVPESWPPHGEITFDNVAMRYRPGLPLVLKNLSMNISGGERIGIVGRTGAGKSSIMSALFRLTELSSGRITIDGVDISTIGLHDLRSRLAIIPQDPTLFRGSIRSNLDPFNEHSDLELWDALRKAHLIDSDTKDSAVDASNPNGNANAQRLTLDTAVDEEGLTFSLGQRQLMALARALVRNARIIICDEATSSVDFATDQRIQETMAQGFEGKTLLCIAHRLKTIIHYDRICVMDQGSIAEIDTPLNLWEKEDGIFRAMCERSGISRED

SEQ ID NO: 13132 - protein, 471 aa, Aspergillus nidulans
  unsure (1)..(471): unsure at all Xaa locations
ETKLLVKIDWFILSFCCVTYFFNYLDRSNLTNAYVSGMEEELSFRGNQLNQINTVFTVGYILGQIPSNLALTYLRPRIFFPAMILCWGCMYAFDTGSYCAYHRSRSTMVTAAVHNPQGIMAIRFFLGVAEASTFSGTHFILGSWYTERELGKRSGIFTASGLAGQMFGGFIQTGIHSSLDGAAGLSGWRWLFIVSIFHSYPGRFLPHPSXPFQIDGLITLPVALYGAFLFPDTPATTQAPYLTSSERALAVSRLPVAKHAPIFNRTFLKNLFKTWYWWAFVILWVIAGETESFSSNSLLALYMKSHPTNHYSIAQLNNYPTGVPAVGIVSTLFWATLTDFWGGKRYIVGYFIGITGIITPILILTRFDSTATVFGAYYWAGAVYACQATFFAWCNDAMRMQEERHRSVVIASMNLGNNAVNAWWSILFYSADLAPRFTRGMYAMIGCSVALIIWVTAILLKTLQEDKASSR

SEQ ID NO: 13133 - protein, 600 aa, Aspergillus nidulans
VRICVCGDEGTGKSSLITSLVKGVFVTNKIQPILPQITIPPTIGTPENVTTTTVVDTSAVPQERSNLAREIRKSNVILLVYSDHYSYERVALFWLPYFRSLGVNVPVVLCANKSDLAADHTETQVIEDEMLPLMSEFKEIDSCIRTSAREHRNVNEAFFLCQKAVTHPIAPLFDAKESALKPAAVAALQRIFYLSDKDRDGYLSDKEIKDFQMRCFEKPLSEEDLVHIKETIQKTHPDSVTPSGIDCRGFIHLNKMYAEKGRHETVWIILRAFQYTDSLSLQESYLHPKFEVPPFASAELSPEGYRFFVNLFLLSDKDNDGGLNDAELASLFAPTPGLPPSWADGSFPSCTVRNEAGHVTLQGWLAQWSMTTFTSPKTTLEYLAYLGFESSDRSNPSTTAALKVTRPRKRRKRPGRVGRNVVLGHIVGAPGSGKSALLDAFLSRGFSTTYHPTIQPRTAVNTVELPGGKQCYLIMDELGELEPAILENQAKLLDQCDVIVYTYDSSDPDSFAYIPALRAKYPHLEELPSVYIALKADLDRTTQRAEHQPHEYTALLNMPGPPLHVSVTWSSIQEVFVHIAEAAMEPSTAFPRSEEDVEGK

SEQ ID NO: 13134 - protein, 475 aa, Aspergillus nidulans
  unsure (1)..(475): unsure at all Xaa locations
MAEQLVLRGTLEGHNGWVTSLATSLESKGTDLHGXNTYMELHANPCVYPYTYRIDFFVLVENGQWFXLEIFIDSPNMLLSGSRDKTKIIWNLTRDEQAYGYPKRRHEGHSHIRSDCVCLRSAIPRNSWPKECAKSGVQTEGIYDNQNQFDXXVCLDVXVISSDGAYALSASWDKSLRLWELSSGQTTRTFVGHTNDVLSVSFSADNRQIVSGSRDRTIKLWNTLGDCKYTITDKGHTEWVSCVRFSPNPQNPVIVSAGWDKLVKVRPLYMFSRLLHALGPMMFAFYTYLLLQSLTAMRQKITICLMDTPTPFAYFFYCYNPDYKSXGLQLTKQKGLELASCRLQTDHIGHTGYINTVTISPDGSLCASGGKDGVTMLWDLNESKHLYSLHAGDEIHALVFSPNRYWLCAATSSSITIFDLEKKSKVDELKPEYIEKGKKSREPECVSLAWSADGQTLFAGYTDNKIRAWGVMSRA

SEQ ID NO: 13135 - protein, 343 aa, Aspergillus nidulans
LKPNEVLVKMYAASLNYRELVIAGPMVFATLNRMPRMFPTDNLQGINGPITPPIVPGCDGAGLVEAVGPSVREFSPGDRVVTYIAPKLVEAHGDDAHAGVAEAVASMGQGSDGTLRSWAVFPEAGLVHSPRTLDWLSAATLPCTWLTAWNALFGLNGKQAGPDSWVLVQGTGGVSIAALQLAVAAGATVVATTSTVEKADRLKALGAAHVVNYRNNPESWGKEARLLTPAERGFDFVVDVGGNETFPHSLAAIRVDGVVLAVGQVGDSTAEPVPIFAALIHNCIIRGILAGSCNQFKELVRFIDEKKLVPAMDDVIFELAQAKDAYRRLKERKHFAKVMIRID

SEQ ID NO: 13136 - protein, 234 aa, Aspergillus nidulans
  unsure (1)..(234): unsure at all Xaa locations
RRQSKLSPTQLEELQKATHFDKKELQQWYKGTFGSGAWKYCSKSILCARXETAADIRHIRFLKDCPSGQLTKEEFQDIYRKFFPFGDPSSFANYVFRVFDSDNSGMIDFKEFICALSVTSRGRMEDKLDWAFQLYDIDGDGKITYDEMLAIVEAIYKMVRSPLNPAGRLLTCDSRSGSMVKLPEDEDTPEKRVRKIFRMMDKDENGSLDMEEFKEGSKRDETIVSALSLYAGLV

SEQ ID NO: 13137 - protein, 484 aa, Aspergillus nidulans
IVKKPLEFTPLGTRVLSPAHFASPYRQARNLLHVSAVPDSLPCRKKEFDTVYSHLSAAIMEGTGTCIYISGTPGTGKTATVREVVAQLNAAVLAEEMDDFIFVEINGMKVTDPHQSYSLLWEALKGDRVSPSHALDLLDREFSNPSPRRVSCVVLMDELDQLVTKNQSVMYNFFNWPALRHSRLIVLAVANTMDLPERTLSNKISSRLGLTRITFPGYKHTDLMEIITTRLASVPGKIVDSDAIQFASRKVAAVSGDARRALDICRRAVEIAEQSNEAAGVEALDADDTESLPPTPSKTAARKERANAKQTLSISPQKSTATPRKQTPGRVTIATIKQAIQEATSTPLQQSLRCLPLSAKLFLAALLARVRRTGITESTFGDVTDEAKRIADAAVAVAGAAGAGIKEFLLAGGTGTRVQALGFAAMELMNSGVLALEATSGSRGLGGAAIPTRGDRSGKVRLRVAAEDVRAAFRDDVEAKGLGL

SEQ ID NO: 13138 - protein, 852 aa, Aspergillus nidulans
  unsure (1)..(852): unsure at all Xaa locations
VRIPLNDDVEEKAARMGARQALHDRQMDQIKAAVKTPMPPRRYTIHDRSSMSPSTPQGSGHRHRDSDAHGRRGVTPMKRVPILANFEEWMKMATDNKINATNSWNFALIDYFHDMSLLKEGDSVNFQKASCTLDGCVKIYTSRVDSVATETGKLLSGLADSRDKKAREAEAEGEGAEDDEEDGEEGTSKRSRRKVRSHXKLSIAXARITNGIRHVQRTHEATLAPSFSSLQLKKFELEFSVDPLFKKASADFDEGGAKGLLLNHLSIDGHGRIVFDSSDDAVETAQDRDDTRAQSESLEDPESTSQPPPTEPPRDDSFEGGVEIDIAPLASKFFPDLDRLDAQDICPSLKNFDLGDPSGSLDIPLLKAPEDWRQDKGDDDGHPSNDASGIMLDDDNAVGFDDDGSLAGFDLSDDAGFGGGGEAWAREAALEPMLKVHRVDLEGEEVQDGGSLDNDDAYAISLNHQPSSRDHENILSYFDNALQKNWAGPEHWKIRRIKENAATTAASTAPKQRKEKEPFEIDFSAPLDPTVAELIYLPASSNSAISLPKSQWKTKGRNLLPDDKHFNSRQLLRLFLKPKARMGSRKLNGPRSFTQRRQEQTSGNGEMDEAFWANHKTEDQTGDDEAAPGAYDANFFADDDGLAFPNGIDLDDDDNLPFADAREMLSPPPGGVPGTAAGDAGGATGLAALLNMVGATPGGSQVQSASGGFGSQLVTQGGRRARPDYVAYARVAKKVDVGRLKTDMWKGMGERLISAMDSGPQLSAATSPSKEQHETDDDGPSTPTPIHKRPRLSSDLEPAKEGHLRFTEIMNSLKSVYPPEMLRDISTSYGFICLLHLANEQGLILQNDDDSS

SEQ ID NO: 13139 - protein, 506 aa, Aspergillus nidulans
  unsure (1)..(506): unsure at all Xaa locations
GGLSFGYDQGVISVTLVMEQFLGRFVEVAEGHPGSGFWKGLMTAMLELGAFVGALNQGWLADKISRRYSIVVAVAIFNVGSVLQTAAVDYAMLTVGRTIGGIGIGMLSMVAPLYISEVSPPECRGALLVLEEFCIVLGIVIAYWITYGTRFMAGEWAWRLPFLLQIVPSFVLLGGVIVLPFSPRWLASKGRNDEALQSLSQLRRLPTTDHRIQQELLDIKIDVRFHQELNAEKHPTLQGSGTTKSLLRELAGWADCFKSGCWRRTQVAVLVMFFQQFVGINALIYYSPTLFKTMGLDYDMQLLMSGIINVTQLVGVCTSLWTMDALGRRPLLLWGAAIMGISHVIIAALVGIYSDNWPAHRTRGWTSVAFLFVYMLAFGATWGSVGWALPAGKDPFSDAFNRXSXHVAEVFSSFLRAKGVALATCGTWLFNFIIRESLAIFFFFLTGTMDXWKXGLITPPLIQDTGYGAYVFFAVFCILAFIWTFFCVPETSGRTLEQMDAVFKDN

SEQ ID NO: 13140 - protein, 315 aa, Aspergillus nidulans
  unsure (1)..(315): unsure at all Xaa locations
YIXPLSNSSRRSIFGSGQKFVIILQSNTEGGVMEWKGAREWAIERNSISNKKEYAKRWGYKLEVVNMLAKKRYSHEWREGWEKVDILRETMKKYPTAEWYATQEAYRVVTSNSIXVWWLDLNTYIMENSYSLEDHLFDRLDEVVYRDINEYNPLNITHPPTQPYLDEVSRSAIGDNDPGSIHLLLSQDCGGFNLGSFFVHRSLFSERLLDTWWDPVMYEQRHMQWEHKEQDALEYLYINQPWIRSSVAFAPQRYFNSFPPGACGDSLDPMVHYTPDARDFVVNMAGCDFGRDCWDEMYQYREYSKWLNRPIWERL

SEQ ID NO: 13141 - protein, 320 aa, Aspergillus nidulans
  unsure (1)..(320): unsure at all Xaa locations
YNVTGQIGKGAFAVVYKLATKQHGAVFAAKELDKRHFMKNGVLNQKVDNELKIMKDLKHVSDXDNTVQKDLTNITRQPNIVQYIDHHEHDRWIYIIMEYVPCGELSTYLQNMVNIPEDMVKTIARQILHALKYLHKRKITHRDIKPDNILIASHEPLKVKLSDFGLSKVVQEETFLKTFCGTLLYCAPEVYPEYDMYRRGEVGSDAGSVIRKLLHGVLLDTVLSIRLPKTSPYDQSVDMYSLGAVLYHLLAGIPPYTGRGDDRGAQMLRTIMTTEPDYQILREAGVSEEGIDLVSKLLNRDPQLRPKELECLKHPWLVDI

SEQ ID NO: 13142 - protein, 435 aa, Aspergillus nidulans
  unsure (1)..(435): unsure at all Xaa locations
AARTDAQNEFPAEMWKKLGNAGVDITWNPGYRLSKRVXCLSSFLGVTADEEYGGLGMGYQAHCVVMEEISRASGMRLDLFYVGFGPLXRPHHSIGSIALSYAAHSQLCVNQLSLNGTPEQKARFLPGLLSGEKIGALAMSKHSAGXDVVSIKQRQKSDAAGSYGNKMGFKRKIPCHAEKEQSQESQGPDADNNGGQAKTEPEKGSKGITAFVVEKTFKGFSCARKLDKLGMRGSNTGELIFEDVFVPRENLLGEVNRGVKVLMEGLDLERLVLSAGPLGWVHCISICEDEPRQRPCXQAIXDHQAALDLVLPYTHVRKQFGAPIAHNQLIQGKLADMHTKLAASRAYTYATARHIDSHASLGSAAIRTQDCAGAILYAAERATECALDAIQLMGGNGYINEIPAGRLLRDAKLYEIGAGTSEIRRMVIGRAFNKE

SEQ ID NO: 13143 - protein, 1134 aa, Aspergillus nidulans
  unsure (1)..(1134): unsure at all Xaa locations
ERVGKQITSVQSRVQRGYTAREILLDWQDFNSSRMNTPLFLVEALVNHIYNARTMIDTGCLTYGVISDKFVKIHXIPTIPIHPKPFKGVTGNIEEINKIIQVQLDIRAHTEKGAYFYVIPDNLGYDLILGLPWLEQHNRRLEAKRGRLYLCTTGVCLWSTTKRPLLKLNIAQISAATMGGFIQRKRYHGQDIKIFAVLLADIQKALAPKRHIDPRTKLPRXYWKYLRLFEQDKAEELLLHWGDRIDHKIKLVQEESGKDPEVPWGPLYNITXEELIVLXKILSELLQKGFICVSHSPAAAPVLFVXKPGGGLQFCINYCALNTITKKDCYPLPLIHKTLNXIRQARWFTKLDVSAAFYKIYIAKGQEWMTAFCTRYGLFEWLVTPFGLANVPSTFQKYINWTLREYLDEFCSAYIDDVLVYTNRDLRQHRKYVXIVLKKLEEAGLYLDIKKCKFECKETKYLGFIIQAGKGIKIDLEKVKAIKEXETPTIIKGVXGFLGFANFYQRFIPNFSGIIRPLNNLTKERTPFLXTKEYQDSFDLLKEKFITGPVLATFNPSYYIVVETDSSGYNTGGVLSXYNKKGELHPCAYFSKRNSPAECNYEIYDKELLAIVQCLEAWDAELCLYREFQVITDYKNLEYFFSPRKLTEQHIQXSLFLSWFNFKLVYRKGSANQRADVLSXRDQDMPDNEDDRVKSCIMQLFTEKYLGKMVVATLXPAEEQPWELYEKSDIXKEALKQDERYSKAVLCLKDGARRFLLYLXLKVRISECQLDAQDHILFYRRRWVPDSKQLYISIIQAVHDSILTGHPGXEQIYLLVSCKYFWPNMSQDIRRFIWNCDICGRTKSWRDQRRGLLKPLPVPDRPWQEVLMDFIIDLPESKGCTNIIVITDXLTKGVILEGISETDSESVAWALVQVLISKYRILKAITSDRGSQFTSNTWACIYTLTGINRRLSTAYHPQTNRSTERMNSIVETYLCMYTCYDQKDXNRLLLLAELAINSCTSTATGVSPFYLSYGYNLSLFTPTEEVEHLAEEPTKSPIQKGEAIVQKVKEALDWAQASMAYSQQNTENQANKHRSPGTNYQVGDKVWLSLKNIRTDQPSKKLDWKNTKYEVIGLVGSHAVQLNTPPGIHPVFHV

SEQ ID NO: 13144 - protein, 298 aa, Aspergillus nidulans
  unsure (1)..(298): unsure at all Xaa locations
LNTGAKIPAVGFGTWQAKPLEVENSVEVALKQGYRHIDCAAIYRNETEVGNGIRKSGVPREEIFLTGKLWNTKHAPEDVEPALDKTLKDLGVEYLDLYLMHWPWXYLXSWPKQPCXXQTAAFKASDKWFPLDDNGVFQLADIDYVTTYRAMEKLLNTGKVRAIGVSNFNVRRLEDLLSKVSVVPAANQIEAHPYLQQPDLLRYCQSKGIIIEAYSPLGNNQTGEPRTVDDPVVHTVAGQLSMDPGPLLASWAVQRGTVVLSKSVTPSRIAANLQVKRLPDDAFATLAALERHKRFNFP

SEQ ID NO: 13145 - protein, 158 aa, Aspergillus nidulans
IFLTGACGSGKSTAGLHLSTKFRITTIEGDDMHSRVSRAKMASGIPLSDSDRWEWLSHIRGAVMDRLLQPSTSAGIVVTCSALKRSYRDELRKLMYLLEDPVNVTFIHLFVGKENKTELQERLILRSKVEAHYMASTMVDSQLEALESPEEERDVVVV

SEQ ID NO: 13146 - protein, 975 aa, Aspergillus nidulans
  unsure (1)..(975): unsure at all Xaa locations
PLLXLASRYYEDLGVVEDMLTSTIIEAFNRQVAVDPGRAPGYLQCLKEIGSLRGGEDAEAINRAVETAYSEGNLYTDADITEAYKYFGLSRDDPRLTEDSIIGTFYAYLSSTPQETETRRQLWRIGDSRRSERIKSAAEDSKHMFLFPFYSRXLTLLKGVATPEQAQVFLGVSDDTADDFVMAMFTAKVPYALILTSNAGIANLSQVNDNPSCRDIARRAVELIAEARKSDVLRHFVKTGEMTAGEMDVGDAYLLLQIPDRNADEGAIMAAYTICVDDAPAQAEKYNKALAIIAKEKNSPLLSSMVPGLAGKSDRDLSKWPVGLQNIGNTCYLNSLLQFYFSVRPYRNMVLDFENVKMELDEESCQKKRVGSRGVSKKEIERSQKCKXSSELVVXLNSPVVNHIVIRELRALFSDMISSPNSFVTPGQELARLTLISPSNEAAIRRRSTISAGRFGGLGELNGMPVLGPLGPPPKSSETEAHVPAPELEKTKPASDEDSEATLVSDPVKTEVPLAQSDDKENEPPQDDAVMVDAPNETIRAAESVETQTAQAQADATTKPPPVPPRPTPQVDPQRQIIEEVEIGAQQDVTEVINNVLFQSQCAIRGHAVAPDGEQLDQVKEWVSCAVYHYCLRRXLLAVYFMGQARSYILSNKGKRSKEEWWCDIKIDVATGPRDIYAAIDGAFDIQKVSVEDSVAEQYAAISKLPPILQIQVQRVQFDPVKKRSFKSTHHLDLKEIIYLDRYMDTQQPEIVNRRKQAWEWKDTLRKLEARRAELLRQSVCVNKSAVLSFSRANLVYRNPMVSTLQHYXKAPRTSXLNSAPXSRTPTPLRMQLMLTLNSSQSSVDSSRRHKMKXSVGQPPSIITNSMANPQKGLEQEIKNIQAMISNQFVDYKHLPYRLYAVFVHHGSVEFGHYYIYICDFERNIWRKYNDTYVTEVSDLDEIFKSQDRHNPPTPYFLVYVHDGLKERLVSPVAR

SEQ ID NO: 13147 - protein, 607 aa, Aspergillus nidulans
GVNTGFGGSADSRTDKMTALQSALLQLTQAGVLLESDKSGNQNKLLESHAMPASWVRGTMLARCNSNLRGHSAVKLSILQSIVKLLQHRITPIVPLRGSISASGDLMPLSYIAGAIEGNPDVYVQVDGLDMPRIMKSIEGLQYAGLEAQKLGPKEGLGLINGTSTSAAVASLVLYETNQLSVLVQALSAMGLEALTGTAESYHPFISAVRPHDGQVECANNLLSLLRGSKLVQGLDGQKFQDRPGLIQDRYALRCVPQWVGPQLEDLLLAHRQVTTELNSTCDNPLVDVKSKSIYSGGNFQAVSITSAMEKTRQCLQMFGRLIFSQATEMIDPSINNGLPTNLVADDPSLSFTMKGVDISMASYMAELGYLSNPVSSHVQSAEMRNQAINSMALVSARYSMQAVEVLSLMCACDVYICCQALDLRVLHNTFLEKAIPQLHSVTERVLSPFLPQPALEDLNRSLDQHLTQTWPMTNRLSPADRVHTVIEKAIPVLLENLKSHRGPSLGDLETWKSQARNLLNVVYQEIAESFFVKPHTADYLGEGAKALYVMVRQELGIPFHQGFIEHPTVENEILNGRPKKTTGSWISIIYEAIRDSRLMGPLIQAL

SEQ ID NO: 13148 - protein, 978 aa, Aspergillus nidulans
RPVSKRKRRGSLSPEYDDYSRRRRRDRYRSRSRSRSRSPAYNKRDEDPVDEFGRSTGGRSSNDDEYRDGRSERRRRRRADEDYFRKPPPVELDDSPVLYKIYDGRVTGVKDFGAFVNLVGVRGKVDGLVHVSAMQEGTRVNHPSDLVSRGQPVKVKVISIQGSRIGLSMKEVDQETGQDLVPQKRLASGANMERLDGMPSDDRYGNLSADVPVIEESDGRSMKNRKRLTSPERWEIKQLIASGAVSAADYPDIDEEYHATLTGEGTFEEEEDIDIEVRDEEPPFLAGQTKMSLELSPIRVVKAPDGSMNRSAMAGTNLAKERRELRQQEAQDKAAEQAAGVDLNAQWQDPMASERKFAADLRSTQQTGTDEAVPEWKRVTMGKTPSFGKRTNMSIKQQRESLPVYKFRQQLLEAVAENQLLIVVGDTGSGKTTQVTQYLAEAGWANKGIIGCTQPRRVAAMSVAKRVAEEVGCKLGAEVGYTIRFEDCTSPETKIKYMTDGMLQREVLLDPDLKKYSVIMLDEAHERTIATDVLFGLLKKTLKRRPDLRLIVTSATLDADKFSEYFYGCPIFSIPGRTFPVEIMYSKEPESDYLDAALITVMQIHLTEPPGDMLLFLTGQEEIDTACEILYERMKALGPSVPELVILPVYSALPSEMQSRIFDPAPPGGRKVVIATNIAETSITIDNIFYVIDPGLVKQKAYDPKLGMDSLVVTPISQAQAKQRAGRAGLTGPGKCFRLYTEAAYQSEMLPTTIPDIQRQNLSHTILMLKAMGINDLLHFDFMDPPPTNTMLTALQELEKLSALDDEGLLTRLGRKMADFPMEPALAKVLIASVDMGCSEEMLSIVAMLSIQSVFYRPKEKQQQADQKKAKFHDPHGDHLTLLNVYNAWKRSGFSNAWCYENFIQARQIRRAQDVRQQLLGIMQRYHHKIVSCGRNTTKVRQALCTGFFRNSARKDPQEGYKTLVEGTPVYMHPSSAM

SEQ ID NO: 13149 - protein, 249 aa, Aspergillus nidulans
  unsure (1)..(249): unsure at all Xaa locations
FLREYKLVVVGGGGVGKSCLTIQLIQSHFVDEYDPTIEGXLVTSQSYRTVAHQGSPKXDSYRKQCVIDDEVALLDVLDTAGQEEYSAMREQYMRTGEGFLLVYSITSRQSFEEIMTFQQQILRVKDKDYFPIIVVGNKCDLDKERVVSEQGGFNTSLQVISLSQLANNQPQRGESLARQFGCKFIETSRNSRINVENAFYDLVREIRRYNKEMSNPSGSGAFGARAPDSKMDVSEPGESAGCCGKCIVM

SEQ ID NO: 13150 - protein, 1571 aa, Aspergillus nidulans
  unsure (1)..(1571): unsure at all Xaa locations
LTPCFLDVGVSVVALFGLVLGSGALWFLLNKRIPQPVSKNWHFYAKLVSSLGLSHHCAVLFADVLSPAXVVLSALLFTTALQAALQVEIYASWFADFRFWSTVLVFASLCVIFAVQYYEHWRSRYPNGVVLFYWLFFIIAYTVKLRSHVARKTYDDRLPSFVCLNVSLGLAILEFLLEYLVPKKQSAYDALGDEDECPYEYADVFSVLTFSWMTPMMKFGYKNFLTQDDLWNLRRRDTTRATGATLEENWEYELQKDKPSLWTALFKSYGGPYVRGAIIKCGSDILAFVQPQLLRLLINFIDSYRTTEPQPVIRGVAISLAMFVVSVSQTSFLHQYFQRAFDTGMRVKSGLTAMIYAKSLRLSSEGRASKTTGDIVNHMAVDQQRLSDLTQFGTQLWSAPFQITLCMISLYQLVGVSMFAGIGVMILMIPLNGVIARMMKKLQLVQMKNKDARSRLMTEILNNIKSIKLYAWNTAFMNKLSHIRNDLELNTLRKIGATQSVANFTWQSTPFLVSCSTFTVFVLTEDXPLTTSIVFPALTLFNLLTFPLSILSMVITFVIEASVAVRRLTDYFAAEELSTDAVKNEDPVSHLGVESVRIRVASFSWARYKDDTVLENIDLSCRKGELNCIVGRVGSGKSSLLQALLGDLWKTEGEVVVRGRIAYVAQAAWVMNASVRENIVFGHRWDPQFYELTVEACALLDDFKNLPDGDQTEVGERGISLSGGQKARLTLARAVYARADIYLLDDVLSAVDQHVGRHLINRVLGRNGILNSKTRILATNAIPVLKEADFIGLLRDKTLIEKGTYEQLMAMKGEVANLVRTTLNESGDEDSSAESGGLASLESSETTTIIEGPDSDFSDTDEAEQQIGSLAPIKAAGPRRTSTVTLRRASTVSWQGPRRKLGDEENVLKSKQTQETSQQGKVKWSVYGEYAKNSNLIAVAFYLVTLVGAQTAQVGGSYWLKHWTEVSERQSAPNAGKFIGIYLALGLGSSFLVILQNLILWIFCSIEASRKLHERMAFSIFRSPMRFFETTPSGRVLNRFSRXARYQELIELLXREXDIYRIDEVLARTFNMLFGNSAKAIFTLLVIANSTPPFLIAVIPLGYIYFSYQKYYLRTSRELKRLDSVTRSPIYAHFQESLGGISTIRAYRQEERFSLENEWRMDANLRAYFPSISANRWLAVRLEFIGSVIILVSALLSIVSVATGSKLSAGMVGLAMSYALQITQSLNWIVRQTVEVETNIVSVERVLEYASLPSEAPEVIFKNRPPTGWPAQGAVSFHNYSTRYREGLDLVLKDVNLDIKPREKIGVVGRTGAGKSSLTLALFRIIEPTNGGISIDNLDISTIGLRDLRGRLAIIPQDPAMFEGTVRDNLDPRHVHDDTELWSVLGTWACTXRXISGLMVLTVCRAARLKEHVSQMQGQLDAHIQEGGMYSTCSXYIPSIALNXPPTGSNLSQGQRQLISLARALLTPSNILVLDEATVSGIAHRFLGSGENXQHXAAVDVETDALLQRTLRSSIFQDRTIITIAHRINTIIDSDRIVVLDKGRVAEFDSPAALIKQRGKFYDLVKEAGLL

SEQ ID NO: 13151 - protein, 321 aa, Aspergillus nidulans
  unsure (1)..(321): unsure at all Xaa locations
NITHVLSVIRLRPKDDLFAGYQHHRIEVDDLDDENLLEHFPSAIKFIQSGLDAGGGVLVHWLVYVSSSSVSSXTPRVVPTMPLLHCRPLTASSAMGKSRSATVCIAYLLRRQRNALTPQSALALLRESRPLCEPNPGFMEQFNVYYQMGCPDDVTWHPLYSRWLYRLEVEESVACWRAPEMDSVYFEDEQSHQNVATTGPATEIKCRKCRCGLLISENSRFYSLXIGESWRSHHLLFPHGSHGDVKGAIISECAHIFMSPLTWMRPSLFPDTPGDAPLSGRLTCPNSSCGSNIGKFAWQGMQCSCGDWVVPAIGLARARVD

SEQ ID NO: 13152 - protein, 386 aa, Aspergillus nidulans
  unsure (1)..(386): unsure at all Xaa locations
SNGSYQTXIKNRQMKDYSSEAIAWIYGNYAFLTLFGGVQVGPVFDARGPRLLVLGGSVLVMLQVITMGFCTQYXHLVLSIGIAGELGTSMIFTPAVSAIGHYFNERRGVATGLAATGGSVGGVAFPLILESLFPKIGWAWATRVIALICLISLAGACLLVKSRLPKKPASKENVLPDFRIFRSLKLSFTTAGIFFIEWGLFIPISYISSYALAHGTSESLSYQMLAFLNVGSVLGRAIPGFFADHLGRFNTLIVTVALCLVCNVCIWLPAGDSVAIMIVYCVIFGFASGSNISLTPVCISQLCKIENYGRYYATSYTIVSFGXVKIFSFNLTXYXCLSVSTLTGMPIAGEILARCNGDYWGLITYTICCYASGLICVTTAKLLHVG

SEQ ID NO: 13153 - protein, 839 aa, Aspergillus nidulans
VEGTWKDLTENVNRMANNLTTQVREIADVTTAVAKGDLSKKVTANVQGEILDLKSTINGMVDRLNTFAFEVSKVAREVGTDGTLGGQAKVDNVEGKWKDLTDNVNTMAQNLTSQVRSISDVTQAIAKGDLSKKIEVHAQGEILTLKVTINHMVDRLAKFATELKKVARDVGVDGKMGGQANVEGIAGTWKEITEDVNTMAENLTSQVRAFGEITDAATDGDFTKLITVNASGEMDELKRKINKMVSNLRDSIQRNTAAREAAELANRTKSEFLANMSHEIRTPMNGIIGMTQLTLDTDDLKPYTREMLNVVHNLANSLLTIIDDILDISKIEANRMVIESIPFTVRGTVFNALKTLAVKANEKFLSLTYQVDNTVPDYVIGDPFRLRQIILNLVGNAIKFTEHGEVKLTICKSDREQCAANEYAFEFSVSDTGIGIEEDKLDLIFDTFQQADGSTTRRFGGTGLGLSISKRLVNLMGGDVWVTSEYGHGSTFHFTCVVKLADQSLNVIASQILPYKNHRVLFIDKGENGPEAENVLKMLKKLDLEPLVVRNEDHVPPPEIQDPSGKESGHAYDVIIVDSVNTARMLRTYDDFKYVPIVLVCPLVCVSLKSALDLGISSYMTTPCEPIDLGNGMLPALEGRSTPITTDHSRSFDILLAEDNDVNQKLAVKILEKHNHNVSVVGNGLEAVEAVKQRRYDVILMDVQMPVMGGFEATGKIREYERDSGLSRTPIIALTAHAMLGDREKCIQAQMDEYLSKPLKQNQMMQTILKCATLGGSLLEKSKESRISSSGEMHHVHTGPDGKSQRPGMEGRSITSSSATSRTLASTSAERTEQLSIDR

SEQ ID NO: 13154 - protein, 558 aa, Aspergillus nidulans
  unsure (1)..(558): unsure at all Xaa locations
LAQLALKQTPIDKFLYLSTLRKNNVHLFYRLVTDHLRVRFRDCTIAIVDQEANCRIELTPLIYTPVVGEACQRWSEIYQQPEGXFQANEXGELPRFSXLARTRYYLSWEDRGNLASVIANWPQPNVEITCITDGSRILGLGDLGINGMGIPIGKLALYTTCAGIRPEATLPLTLDLGTSNKALREDPLYLGSRRDKITPDEEREFLDELMAALTERWPGXVRSTQLCPRIRRLTGNFFAVSVIQFEDFKNPFPALERYQDVYTCFNDDIQGTGAVILGGVINAVKRSGVPCKDQRAVFFGAGSAGVGVANRLVAFFMREGMTEDEARSCFWLVDTKGLVTADRGDKLAEHKVYFARTDNAGQQFKTLEEVVDHVKPSILMGLSTQGGVFTPEILRKMAEWNTNPMIFPLSNPSSKSECDFETAVTNTDGRVLFASGSPFPTMSFTNSAGETKMYYPGQGNNMYVFPGIGLGTILSKAVKVTDSMIYASGEALSKALTAEEIERGLLYPDLTRIRKVSVVVARNVIRAAQEAKVDRETTLRTMDDETLDAWIKSRMYDP

SEQ ID NO: 13155 - protein, 489 aa, Aspergillus nidulans
  unsure (1)..(489): unsure at all Xaa locations
INPATGEPNPDVPVAIKEDVDRAVVAAQEAFKTWIDVPFDERRKALLAYADAIEEYVADFAKLLVQEQGKPVSHSFILGSSSKSLTVQLQFAANEVAQSAQVIRSAADVAEGLTDEIIEDSAEKKIVVRHIPIGVGAGIIPWNFPHLLTVVKLAPALITGNVIIIKPSPFTPYCGLKLVELAQRFFPPGVVQALSGDDRLGPWLTAHPGIGKISFTGSSATGKKVMESASRTLKRVTLELXVVLHIRFSWVLTTSRGGKDAAIVCGDVDVQSVAPRVSLAXSANKVTSPTNCIRSSRKGFFNSGQICLAVKRIYVHESIYNEFRDAAVAYAKTIEVGPGTQEGVFMGPLQNSMQYEKVKGFFADLTKEQLSLTHPDGKAFDNKAGYFIKPTIIDRPAEDSHIATEEQFGPIMPLFSWSDESDVIARANNTQMGLGASVWSRDLEQAARIAAKLQAGSVWVNTHFEADLRAPFGGHKESGIGTENGLQGL

SEQ ID NO: 13156 - protein, 698 aa, Aspergillus nidulans
  unsure (1)..(698): unsure at all Xaa locations
CFSSLHDRTVNQSADFSSTSKNYDRLGRRAKEKLLDRVRYPALXSFFGRVSDLFFFSFCNXEFFMSLLNSASTKREAKSYLARLKAQQPAKPQKKLQSTTVQQTIAESLPSGVNLGSFYGASRSVYQSPVFRQDSTPAPAREDIPERLHLALVKIKTPQLLDDSTLDGVARTLSQINRLGLACCVVVDPGSDGDTHTLRKIATEQVGRIATAVDRQPDSKSSHLYSVLSFPAKRPDIPTVSSRKQLLSPLRDGHILIVAPIAYTEDTPKALMVPANDAVLALTKELAGLATMPDPDEDPMITAQKINDLQKEVSLDRVILLDPLGGVPAFRGPQTSHAFINMDQEFEHIERELLQVRNPANNSQGESVVTNPISDSNAVSESASTEPTSTPAKQALLPMSVGEDTIDGHLDNLRLSHQTLAMLPSASSGIITSPVEVAKLRTFRWNRVLLSCQVGTRRQRNPLIHNLLTDKPLLSSSLPLSRRARGSLHLPAPPTTFVKRGMPVSLIPDPRVQVWTAQTRPNMNLDDPHVDLPRLVHLIEDSFNRKLDVKDYLNRVNGRLAGLIIAGEYEGGAILTWELPPGVEDDGSESSTARMVPYLDKFAVLKRSQGAGGVADIVFNAMVRTCFPNGVCWRSRKDNPVNKWYFERSLGSWKLADTNWTMFWTTPDLPEKPQKFRDYEAVCRSIQPSWAEDTGVID

SEQ ID NO: 13157 - protein, 847 aa, Aspergillus nidulans
  unsure (1)..(847): unsure at all Xaa locations
RERVGKRITSVQSRVQRGYTAREILLDWQDFNSSRMNTPPFLVEALVNHTYNARTMIDTGCLTYGVISDKFVKIHQIPTIPIHPKPFKGVTGNIEEINKIVRVQLDIGAHTEKGAYFYVIPDNLGYDLILGLPWLEQHDGRLEAKRGRLYLCTTGVRLWSTTKRPLPKLNIAQISAATMGGFIQRKRCRGQDIEIFAVSLADIQKALAPKRHIDPRTKLPRQYWKYLRLFEQDKAEELPPHRGDGIDHKIELVQEESGKDPEVPWGPLYNMTQEELIVLRKTLSELLQKGFIRVSHSPAAAPVLFVRKPGGGLRFCVDYRALNAITKKDRYPLPLIHETLNQIGQARWFTKLDVSAAFHKIRIAKGQEWMTAFRTRYGLFEWLVTPFGLANAPSTFQKYINWTLREYLDEFCSAYIDDVLVYTNGDLRQHRKHVRMVLKKLEEAGLYLDIKKCEFECKETKYLGFIIQAGKGIKMDPEKVKAIKEWETPTTIKGVRGFLGFANFYRRFIPNFSGIVRPLNNLTKKGTPFLWTKECQDSFDLLKEKFITGPVLATFNPSYCTVVETDSSGYNTGGVLSQYNKKGELHPCAYFSKRNSPAECNYEIYDKELLAIVXCLEAWDAELRSCGEFQVITDHKNLEYFFSPRKLTERHVRWSLFLSRFNFKLVYRKGSANQRADALSRRDQDMPDDEDDRVKSCMMQLFTEKHLGKTVVATLXPAEEQPWEPYKKSDIWKEALKXDERYSEAVLCLKDGARRFPPHLQLKVRISECQLDTQDHILFCGRRWVPDSEQLRTSIIQAAHDSILTGHPGREQTYLLVSREYFWPNMSRDIRRFVRNCDICGRTKSWR

SEQ ID NO: 13158 - protein, 940 aa, Aspergillus nidulans
  unsure (1)..(940): unsure at all Xaa locations
ADLIRDVEFVIFDEVHYVNDFERGVVWEEVIIMLPEHVTLILLSATVPNTQEFASWVGRTKKKDIYVISTAKRPVPLEHYLWAGKDKFKIVDSNKRFLESGWKQADDIISGKDKIKAQKAAEAQAQSQASRGGSQGRGRGQAPARGGPRGGGGGQRGGGQRGRGQPANRGTGNIARTGRGGGRTTAAQDKTVWVQVVQHLRKENLLPACIFVFSKKRCEQNADSLSNQDFCNASEKSLIHITIEKSLTRLKQEDRTLPQILRLRELLSRGIAVHHGGLLPIMKEIVEILFAKTLVKVLFATETFAMGLNLPTRTVVFSGFRKHDGKGFRDLLPGEYTQMAGRAGRRGLDNVGYVIVVNSGKDEAPPAGALRKMILGDPTKLRSQFRLTYNMILNLLRVEALKIEEMIKRSFSENATQALLPEHEKQVQISEASLEKIKREPCEICDVDLAACHDASIEYGKLTSELHLNLLSSPVGKRLLMPKRLVVYRKVINGSPXLAAAXADTLQDGYRTAGVIVREVGGGPNPVIQILEIGKLNSKRHPSEILPFLPAFRGFLNPLPTRAADMTLKVFKIPIADIECVTNTIVKLSGPTWYLNIKERLVSMHLVQGSCXHXFKEAIRFADKELSKLCSSWTTPVWDELDWARIKELQLRDILDKRREQANIAQSCDCLKCPKFLKHVCSYSTLXTIPAILTTFXFEMQRDEWQIKENISQLKQLMSDQNLHLLPDYEQRIQVLKDLGFVDEQSRVQLKGKVACEVRLKIRYSPXMCXDMCXIHSADELVLTELILENVLAEYEPEEIVALLSAFVFQEKTENVPTLNPRLEKGKEAIIRISEKVNDVQIQHQVLQSTEDINDFASQPRFGLAEVVYEWAKGMSFNRITDLTDVMEGTIVRTITRLDETCREVKNAAKLVGDPTLYAKMQEAQEKIKRDVIFAASLYM

SEQ ID NO: 13159 - protein, 462 aa, Aspergillus nidulans
  unsure (1)..(462): unsure at all Xaa locations
MAPTACVPAEVCMPKLYDKPDFYVNNIHQFSNHAPDDLSQSRLAARDLVLNVLKKRAAEVDTDRCAPGEEDAFYVADMGEVYRQHLRWKMNLSRVRPFYGMSSMLSYNRTXCXQNXRVKCNPDPEVLRLMAKLGNGFDCASKAEIDMALSTALIPSRIIYAQPCKTSRTLRHAAKVGVKQMTFDTPMSCYKIKACYLKAELYLRILTDDLNSLGNSXXKFGASLMWLVSFLELAHQLELKIVGVSFHVGSGAEDPKAFLKAVQDARLVFDQAAEIGHELHTLDVGGGFTGETFEKFAAVLDSALETYFPPNIRIIAEPGRYYVGGAFTLAANIIARRGVQDPENPSKDAYMIYLNDGVYGNFSNIIFDHQHPEARILSCASEINGRPVSKNVTYSIWGPHLRWSXSSSPAQRASWLLDVGDWLYFEEMGAYTRCSATRFNGFSDNHEVIYISSEADASALLE

SEQ ID NO: 13160 - protein, 572 aa, Aspergillus nidulans
DSIRRFRYLLGLTDLFRHFIESNPNPRIKEIMAEIDRQDAEEAAKSKRKVSARSGGASGERRRRTEQEEDAELLSDEKRGGGTNTIFRESPPFIQGEMRDYQIAGLNWLVSLHENGISGILADEMGLGKTLQTISFIGYLRHLCDITGPHLVAVPKSTLDNWKREFHKWTPEVNVLVLQGDKEERHKLINERLLDEDFDVCITSYEMILREKSHLKKFAWEYIIIDEAHRIKNEESSLAQIIRVFNSRNRLLITGTPLQNNLHELWALLNFLLPDVFGDSEAFDQWFSNQEADQDTVVQQLHRVLRPFLLRRVKSDVEKSLLPKKEVNLYVPMSSMQVKWYQKILEKDIDAVNGAGGKKESKTRLLNIVMQLRKCCNHPYLFEGAEEGPPYTNDVHIINNSGKMVILDKLLARMQAQGSRVLIFSQMSRVLDILEDYCALRKYQYCRIDGTTAHEDRIAAIDEYNKPDSDKFIFLLTTRAGGLGINLTTADIVVLYDSDWNPQADLQAMDRAHRIGQTKQVVVYRFITESAIEERVLERAAQKLRLDQLVIQQGRAQQQAKNTASKDELLGM

SEQ ID NO: 13161 - protein, 884 aa, Aspergillus nidulans
  unsure (1)..(884): unsure at all Xaa locations
LQDNQVVDDFSDTTQLHYGDLNTKIVGVRYYRGTATIGEHVALKREPRNQYDGNAVRVDNAMGTQIGHIPRNMAAKLATYMVSSIVSRAYPSLSXPTIGNRLLVVEGVLTGVIGAFDCPIVLKLYGPSDLERREALKQRMVQDKLPLNHLKKAERDEKKVQKEREKAVKEAAKRARKGQLLEAATNLGYSNLSQPFGEGIITEESLDELINQSSTFNPREINRVTESFGLKESDLENMPMVESPSSLSTTLLPYQRQGLAWMISKENPGLPTSDNDVVQLWKKEGNKFTNIATNFSTTAPPSLASGGILADDMGLGKTIQIISLILSNSQPKTKESSKATLIISPVGIMSNWRNQIQEHTNPEQAPRVLIYHGPGRKEDANLDHYDVVVTSYGTLATEYKTESKATPQKGLFSVKWRRVVLDEGHTIRNPRSKGFSAACALRADSRWALTGTPIVNTLKDLYSQIRFLGLTGGLEDFAVFNSVLIRPLMSDDPDSRLLLQALMSTICLRRRKDMGFVNLRLPTLTSRVLRIKFHPHEKEKYDMFQYASTQAYPCSTILTPNRSEAKGMLLDFKSNNKTGTTYSHLLEVILRLRQVCNHWALAKNRLDKLAAILDKHQTVPLTPDNIKALQDMLQIRIESQEICPICLDILETPVITACAHAFDHDCIEQVIVRQHKCPICRAEIENKSSLVAPAADLGENTDDVSADPDNPSSKIEALIKILTAHGQVEATKTVIFSQWTSFLTLVEPHLQNAGIQFARIDGKMTSIARDRSMRRFSTDPKCTVLLASLSVCSVGLNLVAANQAILADSWWAPAIEDQAVDRVYRLGQTRETTVWRLVMEDSIEDRVLAIQEQKRKLMLAAFREKASKKVDDRATRVADLEKLL

SEQ ID NO: 13162 - protein, 443 aa, Aspergillus nidulans
  unsure (1)..(443): unsure at all Xaa locations
ASECHXLSAQYANRGEKYDDDDGHYIVNPNTPITDRMXVPSKSQMYGRNCXTSSDSIIKLLGQGTFGKVVEAYDKQRKARCAIKIIRSIQKYRDASRIELRVLSTLASNDKHNRNKCIHLRDCFDFRNHICIVTDLLGQSVFDFLKGNGFVPFPSSQIQSFARQLFTSVACXVVRIMFPLDFSXLGTVLHDLNLIHTDLKPENILLVKNAYQTFTYNRTIPSSSTAISRNARQRRVLLDSEIRLIDFGSATFDDEYHSSVVSTRHYRAPEIILNLGWSFPCDIWSIGCILVEFFTGDALFQTHDNLEHLAMMEAVIGERIDPKLVRQVMQGGRNGNQNQAAKXVFSVLQHDHGXFSRYFVRNRLDYPNEETTRASKKYVQAMRRLTVCLLSNKAFLGQLLIIPVVHANEYQVLPTLPGPIQRIFVYDPKQRITAKDALKHPWF

SEQ ID NO: 13163 - protein, 405 aa, Aspergillus nidulans
  unsure (1)..(405): unsure at all Xaa locations
KSYNILVLPGDGIGPEVMAEATKILSLFNTSTVRFRTQTELIGGCSIDTHGKSVTQAVLDAAVSSDAVLFAAVGGPKWDHIRRGLDGPEGGLLQVRKAMDIYANLRPCSVDSPSREIARDFSPFRQDVIEGVDFVVVRENCGGAYFGKKGEEDHYGSFLPILTVTXVVYILMNTAMDEWGYSAFEKQRITELSAELALRHDPPWPVISLDKANVLASSRLWRRVVEKTMSEEYPQVKLVHQLADSASLIMATNPRALNGVILADNTFGDMVSDQAGSLVGTLGVLPSASLDGLPKPGEQRKVHGLYEPTHGSAPTXVIPNPLLSLHSLLTIMYDRIAGKNIANPTAMILCVALMFRYSFNMEAEARQIEAAVRTVLDKGIRTSDLGGSTGTREFGDAVVAALKGE

SEQ ID NO: 13164 - protein, 383 aa, Aspergillus nidulans
  unsure (1)..(383): unsure at all Xaa locations
AKIDAPAAAPAPQLSGLQLYSRFAFAGAVCCSITHGALTPVDVXVALIALSVTILRTRAFPVDPPPILNCALTCCFFAPYSVKTRIQLDPVTYNRGMIGGFRQVIANEGAGALLTGFGPTAAGYFLQGAFKFGGYEFFKQQWINQLGYESASKNRTAIYLASSATAEFFADIALCPLEATRIRLVSQPEFASGLLSGFSKILKNEGVGAFYSGFGPILFKQXVPEQRSSNFGLCXLKFSRVPYTMAKFVAFEKFSEAIYGVVDKNTLSDGGKTVVNLGSGLLAGFAAAIVSQPADTMLSKINKTQGLPGEGTTTRLIKIAKELGLKGSFSGIGARLFMVRTIPXNARLILLTRFPDGTITAGQFAIYGDIKRLLGATGGVEIA

SEQ ID NO: 13165 - protein, 725 aa, Aspergillus nidulans
  unsure (1)..(725): unsure at all Xaa locations
MDPLDPILDGLNSAQRTAVTSSAPILQVLAPPGSGKTKTLTSRVAYLLAHDGYRPQDVICCTFTIKASREMRERLAKLVGDHVQSRLILGTFHSICRRYLVRYGHLIGLQKGFGIADSGDSLAIIRVSXCLWWGVGDVMLKNLQRIVKRLQLGIQPNTARARISHQKAHGVSPDDVAAKQNKISKLLEHREFVQVYREYESELATSNLLDYDDLLLRCAELLRKHPKCVSNVQVVLVDEFQDTNQIQYDLMNLLASWNRRITVVGDPDQSIYGFRSAEIENLKRMQRLYRNTEVVLLEDNYRSSGSILKSAQDVIEQDLSRPAKKLQPTHTFGTLPVLRKLPSAEDEAQWLVLEIKRCIVLTGKLLKYSDFAILLRSASLSRQIESAMGKHGVPYRMVGGQRFFDRVEVKLLLDYLRVISHPENSEALLRIINVPSRKIGEETVKMLLNGAEKAGKPLWDYIKDVAQGRRSTEKAMSKPTNQGLSSLVGLIEYSREKLRQCVDRSAPRRLLEIVMKRLSFREFITATYGSNDENRWANVEELMSQADDATAADESEQDENLPEIAGLTQQESHPGEEALSRFLANVALSTEVQPKEETEGEDQAQEKVTISTIHAAKGLEWPVVFIPAAYEGIIPHSRAEDSDEERRLLYVAMTRAQALLYLSYPLRQARENAETNVTSFLPQELITSRLRPVGPKLDEKVVYGIADILRRERPSAETMLEGLDS

SEQ ID NO: 13166 - protein, 1120 aa, Aspergillus nidulans
  unsure (1)..(1120): unsure at all Xaa locations
VFSEAASDRLTLRLLRRSNDDIVSQGVVEVSDRKFFNLENDRSIVPNGPLDARMGISNKTSTCQTCGGALQVCNGHFGHVRLVLPAFHVGYFKRVISILQEICKECSHILLPEAERRAFLREMRRPRLDNLRRMQIAKRVNDRCRKTRTCENCGAVNGVVKKTGTSSLKITHDKFRAFNASTSAKKIPPPSKIVFDRSLEEARSSNPEVEKHHKKAQDDLNALRVLNLFKRISDSDCELLGLDPKEARPEMFLWQFIPAPPVCIRPSVGQDASSTEDDLTAKLGDIVQSNINLKNALLKGAPVQTIMECWDYMQLQIAVYINSDVPGLNKADLGKPIRGFVQRLKGKQGRFRGNLSGKRVDFSGRTVISPDPNLRVDEVAVPELVAKNMTYPEVVNRYNKEKLQQCVRNGQKKWPGANYIIKKGNPLKTMLKYGNLKFIADQLQEGDIVERHIEDGDIVLFNRQPSLHKLSILSHFAKVRPHRTFRLNECVCNPYNADFDGDEMNLHVPQTEEARAEAMELMGVKNNLATPKNGEPIIGAIQDFISAAYLLSSKDNFFDRRSFTQICLYMLGPQTRFDLPPPAVFKPQMLWTGKQVFNILMRPNKDDPVLVNLDAACKQFKPPKGNQPRDLDPNDSWLVVRNSEVMCGVMDKSTVGSGKKDNVFYIMLRDFGPAAAAEGMNRLSKLSARWFSNMGFSIGITDVYPSDRLVQSKNDLVEAAYAQCDEVIAKYKAGTLEKYPGCDELQTMENQLSGILSKVRQQAGDECIAQLSKYNSPLIMATSGSKGSSINVSQMVALVGQQIIGGQRVQDGFQDRTLPHFPKNARQPPSKGFVRNSFFSGLLPYEFIFHAMSGREGLVDTAVKTAETGYMSRRLMKSLEDLSTGYDDTVRNSSQGIVQFQYGDDKLDPVDMEGIAKPVHFDRTFIHAETTTYKNEERSLSPAEIMEVCEEMLSKERAKXARYDLMGAELDYMDRSDHGVDQFESARDFLDSIQQYVQTKADKLISRGGDSDPSDERTIKGLNHTGKLTERTLRTFIAECLMKYKKAQVEPGHAVGAVGAQSIGEPGTQMTLKTFHFAGVAGMSITQGVPRIKEIINASKEISTPVISCELVEKRNIVAA

SEQ ID NO: 13167 - protein, 966 aa, Aspergillus nidulans
  unsure (1)..(966): unsure at all Xaa locations
ERLTEGLEKPSLDDRSYRVIQLPNKLEALLVHDPETDKAAAAMDVHVGSFSDPADLQGLAHGLEHMLFMGTEKGMHCFSAGKTSLIRFXYPVENAYNQYLASHSGSSNAYTAGTETNYFFEVSATGATGESSGQVTPNGTTNGTSAESKSNGPSPLYGALDRFAQFFISPLFLENTLDREMQAVDSENKKNLQSDLWRLMQLNKSLSNPDHPYNHFSTGNLQTLKEEPQKRGVEIRNEFMKFYEKHYSANRMKLVVLGRESLDELEKWVSELFAGVSNKDLPQNRWDGIPIWLPNDMCKQIFAKPVMDTRSVDIYFPFLDEEKLYESQPSRYISHLIGHEGPGSILAYIKAKGWANGLSAGVMPVCPGAAFFTVSVRLTQEGLQQYQQVVKVIFEYIAMIKEREPEAWIFEEMKNLAEVEFKFKQKSPASRFTSRLSSVMQKPLPREWLLSGSLLRKFDPEAIKKALSYLREDNFKLIVVAQDYPGDWDTKEKWYGTEYKVEDVPKDFMSGIRAALDTTPETRLKELHMPHKNEFVPTRLSVEKKEVSEPQKTPKLIRHDDHVRLWFKKDDRFWVPKATVFVTLRNPLVWATPANLVKSKLYCELVRDALVEYSYDAELAGLDYHLSASIFGLDISVGGYNDKMAVLLEKVFTSMRDLEINPDRFRIIKERLTRSYKNAEYQQPYYQVGDYTRYLTAERGWLNEQYAAELDHIEAEDIKCFFPQILRQNHIEVLAHGNIYKEDALRMTDTVESILNSRTLPQSQWYVRRNVIIPPGSDYIYERPLKDPANVNHCIEYYLFIGSIADEVLRAKLLLFAQMTDEPAFDQLRSKEQLGYVVWSGARYSATTIGYRVIIQSERTAQYLESRIDSFLSNFAKTLETMTEDEFEGHMRSVINKRLEKLKNLSSETSRFWSHIGSEDYDFQQNETDAARVRALTKSDILDFYKQMIDPASPTRGKLSIHLKAQ

SEQ ID NO: 13168 - protein, 346 aa, Aspergillus nidulans
  unsure (1)..(346): unsure at all Xaa locations
SSIEAGTVDVVAVNDPFIETHYAVCYFEFXGANYVXLTSCDVAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGNVNVLLLLDIFDXLVDLGILGYTEDDIVSTDLNGDTRSSIFDAKAGIALNSNFIKLVSWYDNEWGYSRRVVDLIS

SEQ ID NO: 13169 - protein, 331 aa, Aspergillus nidulans
  unsure (1)..(331): unsure at all Xaa locations
GHETVGVVAAMGPKGKGFEIGDRVVATILSFCRECFYCRRGHXVFCEIFRPTVXPXTGACGVLRLPWYARLTSVVCHFCXQETAGRVFKIQNLSDVDATLLEPASCAAHGLDKIAPKMGSRVLLFGAGPTGLVCSYXNIRHAXTYXQPXILAQLLRLNGGCHVVVCAPEGLKMELAKSLGAGDEYIGLSRQDPSAQFNKLKADNPYGFDIVVEATGNVKILEDSINYVRRGGKLVVYGVYANKDRVSWPPSKICKSFLLYGGWNLQXTVXSATKSKIIGSFSEVYKFPAAIDYLDSGKVKVSGIVNKVYKIEQWEECLQSMRNKSAIKAAI

SEQ ID NO: 13170 - protein, 433 aa, Aspergillus nidulans
  unsure (1)..(433): unsure at all Xaa locations
MSLQTIGIATVAVVYFLIRYFNRTDIPKIKGLPEVPGVPIFGNLIQLGDQHATVAQKWAKKFGPVFQVRMGNKVSSVSAFVTDDNIARIILTXHSRVVFANTFDSVRQLWIKDQSALISRPTFHTFHSVVSSSQGFTIGTSPWDESCKRRRKAAATALNRPATQSYMPIIDLESMSSIRELLRDSANGTMDINPTAYFQRFALNTSLTLNYGIRIEGNVNDELLREIVDVERGVSNFRSTSNQWQDYIPLLRIFPKMNREAEEFRVRRDKYLTYLLDVLKDRIAKGTDKPCITGNILKDPEAKLNDGMPSGPVRAXRKIKINRVXPEIKSICLTMVSAGLDTVPGNLIMGIAYLASEDGQRIQKRAHDEIMKVYPDGDAWEKCLLEEKVPYVTALVKETLRFWTVIPICLPRENTKDIVWNGAVILRGTAFCM

SEQ ID NO: 13171 - protein, 281 aa, Aspergillus nidulans
  unsure (1)..(281): unsure at all Xaa locations
RPSLHDPARDPRDEAALTPPATTGSPTSPYALTPAIILMAXAGHVSISTYLGPSRFADAVCLIGPGTRARLESTPEENEARIKKLSGAVRTILECLGEDPDREGLRETPDRYAKAMLYFTKGYEENVRDLVNGAVFHEDHDELVIVKDIDVFSLCEHHMVPFTGKGKPLPIFTLVLRXGVIQMHIGYIPDRRVLGLSKLARLAEMFSRRLQVQERLTKQVALAISEVLKPRGVGVVMESSHLCMVMRGVQKTSSSTTTSCMLGCMRSSAKTREEFLTLLNL

SEQ ID NO: 13172 - protein, 1327 aa, Aspergillus nidulans
  unsure (1)..(1327): unsure at all Xaa locations
PTKGSRGPPTKGTRTPRKASQAPAEEKQKRLSEGKCYAAVILTTLYKSALQNLPGALGRWPQFRKNKTKWMTTARASRKTNNLCAKSRTEGLYSXRNTTXLARISTARAXITPPFLVEALVNHTYNACTMIDTGCLTYGVISDKFVKIHQIPTIPIHPKPFKGVTGNIEEINKIVRVQLDIGAHTEKGAYFYVIPDNLGYDLILGLPWLEQHDGRLEAKRGRLYLCTTGVRLWSTTKRPLPKLNIAQISAATMGGFIQRKRCRGQDIEIFAVSLADIQKALAPKRHIDPRTKLPRQYWKYLRLFEQDKAEELPPHRGDGIDHKIELVQEESGKDPEVPWGPLYNMTQEELIVLRKTLSELLQKGLNRVSHSPAAAPVLFVRRPRGGLRLYIDEPCSIAITNNDRYPLLLIHETLNQIGQARXFTKLDVSAAFHKIRIAKDQEWMTAFRTRYGLFEWLVTPFWVGXCPSTFQKYINWTLREYLDEFCSAYIDNVLVYTNRDLRQHWKHIXIVLKKLEEAGLYLDIKKYKFECKETKYLGFIIQAGKGIKIDPEKVKAIKEXETPTTIKGVQGFLGFANFYQRFIPNFSGIVRPLNNLTKKGTPFLXTKECQDSFDLLKEKFITRPVLATFNPSYYIVVETDSSGYNTGGVLSXYNKKGELHPCAYFSKRNSPAECNYEIYDKELLTIIXCLEAMMLILRLCKELESMGDHKNLEYFFSPRKLTXQHIQWSLFLSRFNFKLVYRKGSANQRADALSQRDQDMPDDEDDRVKSRTMQLFTEKYLGKMVVATLQPAEEQPWEPYEKSDMWKEALKQDERYSEAVLCLKDGARRFPPHLXLKVGISECQLDAQDHILFCRRRXVPDSKQLCTSIIQAAHDSILTGHPGXEQTYLLVSCEYFWPNMSRDIRRFVRNCDIYRRTKSWRDQRRGLLKPLPVPDRPWQEVSMDFITDLPESEGCTNIMVITDXLTKGVILEGMSETDSESVAWALVRVLISKHGIPKAITSDRGSQFTSDTXARICTLTGINRRLSTAYYPQTDGSTERMNSTVETYLRMYTCYDQKDXNRLLPLAELAINGRTSTATGVSPFYLSHGYNLSPFTPTKEVEHLAEEPTKSPIQKGEAIVQKVKEALDWAQASMAYSQQNTENQANKHRSPATNYQVGNKVWLSLKNICMDRPSKKLDWKNAKYEVIGLVGSHAVRLNTPPGIHPVFHVDLLRLASSDPLPSQKNDDSQPPSIMVNGEEEYMVEKILDERRRRYGRGHRLEYLVKWSGYAQPTWEAATALEEVQALDEWLDCTKQYRLQDGSLNRDAYIKAKATXPTLXPVLPTXRE

SEQ ID NO: 13173 - protein, 285 aa, Aspergillus nidulans
  unsure (1)..(285): unsure at all Xaa locations
VASLFSLSGKTALVTGGTRGIGAAMAIALAEAGADIILIQVRPPISPPHIHYTTTIHXLTCDAQRDTSNTTTRDQITRLGRKATIHAAELSDRSAVKAIIPTLVSQGHNPTILLNCAGIQRRHPSERFPDEDWDEVLNVNLTSVFTLCREFGAYILSLPESSFTPNKKKGSIINVASLLSYQGGITVPAYAASKGGVAQLTKALSNEWVSKGINVNAIAPGYIDTDMNVALINDANRNAGIMARIPAGRWGRPEDFKGPVVFLASEASSYVSGELVTVDGGWMGR

SEQ ID NO: 13174 - protein, 475 aa, Aspergillus nidulans
LSLDDFRAQAKTMQGSRDFGAQLFCALLRSVAVEARLVCSLQPLPFSGAMQPPQKPEPEPIVISSDDPDSLTDGSTKSEAKPAPIRRIGRPGFKPTGVQNTTVLSSRTSLDRLNGFTDNYRTHSSESSYPVFWVEAFNEAFQKWVVIDPMVTKTLAKPHKLEPPATDPYNLLSYVVAFEEDASARDVTRRYTRVFNAKTRKLRVESTKNGEAWWKRVLEHFEKPFLEDRDELEIAELTAKTASEPMPRNVQDFKDHPIYALERHLRRNEVIFPKRVTGHVSLGKSGGKGQTEPIYRRSDVHILRSANKWYRLGRDIKVGEQPLKRIPVRNRGMAVDDEEEGEETALYAFFQTELYKPPPVVQGRIPKNAFGNLDVYVPSMVPAGGIHITHLDAARAARILGIDYADAVTGFSFKGRHGTAIIKGVVVASEYKEAVEEVLKALEEEKLQNEQEERAVEVLRAWKNLLMKLRIAERV

SEQ ID NO: 13175 - protein, 1468 aa, Aspergillus nidulans
  unsure (1)..(1468): unsure at all Xaa locations
KLAELRALRAAGKKRLSTYEVEEQGDIYEEVDDDGYKKIIRNRLDEDDFVVDDNGEGYADDGREVWNEQTGQYSDESDDDDLPARGKAAKRKREEEKQRKEKINNGISKYFSSGAAAPTPKPKVSEGCXTKMVEGRWANLYACSLLLLRKDDAFLADLLGEVDNNVVSNTVPKHNVVKSETRRKVRILSPPLSEKTRTSKPAIKDENSGPVPPVAEEPVLDMDNGDGPLDTNDDIPMSDTMPSSPVTKAVERKSAVLIKEEPEDDDDNMMEVVQATGHDEAKAPSVNISGSRPPPKIKKQPYATPASSSPVKSAADVNASWNDVRNKLNVLNSPASTETRAFGKLRPQDVAEQDGSLRFFWLDYTEVNGSLCLFGKVKNKQNGSYASAFVKVDSILRKLYFLPREYRHKGGRETDEEVDMEDVYHEVDQMMSRLRVGMHKIKACTRKYAFEMPGIPKEAEYLKLLYPYDKPALPMDTKGETFSHVFGTNTSLFEQFVLWKNIMGPCWLKIEEADFSAVNNASWCKFECQTSKPGLISPVPDSENLDPPTLTLISLAFRTQLNVKENKQEILVASARVYENISLTETTPPEKLPCKTFTVMRPAGSSYPVNFEAEIRKQRGTYMLEKSEQMLLSKFLALFERMDPDVLMGHQLQEVDLSILLSRLKEKKTPGWHRLGRLKRGEWPKNFNKGGGFFTERHLVAGRLVCDVANDMGKVRTLTVYLENHXRWXSLMMKCQSWSLTEMCDLYLGSGNGRQDLDIDAALKTWATSKDGLVNFVTHCDTDTYFIAALVLKLQMLSLTKVLTNIAGNSWARTLSGTRAERNEYILLHEFYKNKYICPDKYSSKLQKAEEIAQEGDEDDATDKKKKDKYKGGLVFEPERGLYDRYVLVMDFNSLYPSIIQEYNICFTTVDRTSSVCYFHAHFWSKLTCPGENENDEKVPEVPASDAEQGILPRLIATLVGRRGEVKKLMKDKRATPEQLALWDTKQLAFKLTANSMYGCLGYTQSRFYARPLAMLTTFKGREILRSTKELVESKQLRVIYGDTDSVMINTNMDTISDALKVGEELKTAVNERYKLLEIDIDNVFRRLLLHAKKKYAAINMTEVDGKYVDKLEVKGLDMKRREYCALSKEASQRLLNEILSGDDQELVLNRVHDYLRELAGNMREYTIPVQKYVIYTVCLPLCSFXALADLLXKLSKRPEEYPNKETMPPAQVALRELARGKTVRPNDVISYIVTSGDSETSSLPPAKRSYTLQDVIKPDSRLKPDIEFYLLKQIFPPIERLCAPIPGTDAVRLAECLGLDVRKYQINTTTTNSTQNTEIFPLESQIPDSVRFESAARLTPHLPPLQGTLRLXGARSLNPHVXTHRLVLPNSSCGNPISTLTIIAQLESQIRAQTSKYYEGWLVCDESTCGNRTRQISVYGHRCLGPRGQAEGCLGRMAYEYSEKQMYNQLLYFASPMGRRXGAGRGG

SEQ ID NO: 13176 - protein, 1100 aa, Aspergillus nidulans
NLGYDLILGLPWLEQHDGRLEAKRGRLYLRTTGVRLWSTTKRPLPKLDIAQISAATMGGFIQRKRCHGQDIEIFAVSLADIQKALAPKRHIDPRTKLPRQYWKYLRLFEQDKAEELPPHRGDGIDHKIELVREESGKDPEVPWGPLYNMTQEELIVLRKTLSELLQKGFIRVSHSPAAAPVLFVRKPGGGLRFCVDYRALNAITKKDRYPLPLIHETLNQIGQARWFTKLDVSAAFHKIRIAKGQEWMTAFRTRYGLFEWLVTPFGLANAPSTFQKYINWTLREYLDEFCSAYIDDVLVYTNGDLRQHRKHVRMVLKKLEEAGLYLDIKKCEFECKETKYLGFIIQAGKGIKMDPEKVKAIKEWETPTTIKGVRGFLGFANFYRRFIPNFSGIVRPLNNLTKKGTPFLWTKECQDSFDLLKEKFITGPVLATFNPSYRTVVETDSSGYNTGGVLSQYNEKGELHPCAYFSKRNSPAECNYEIYDKELLAIVRCLEAWDAELRSCGEFQVITDHKNLEYFFSPRKLTERHVRWSLFLSRFNFKLVYRKGSANQRADALSRRDQDMPDDKDDRVKSRTMQLFSKKHLGKMVVATLQPTGEPPREPCEKGDMWKEALKQDKGYNEAIQCLKDGARKFPPHLQLKVGTSECQLDAQGYILFRGRRWVPGSEQLRTNIIQAAHDSMLTGHPGREQTYMLVSREYFWPNMSQDIRRFVRNCDVCGRTKSWRDQRKGLLKPLPVPDRPWQEVSMDFITDLPESEGCTNIMVITDRLTKGVILEGMSEIDSESVAWALVRVLISKHGIPKAITSDRGSQFTSNTWARICTLTGINRRLSTAHHPQTDGSTERMNSTVETYLRIYTCYDQRDWNRLLPLAELAINGRTSTATGVSPFYLSHGYNLSPFSPTEEVEQLAEEPAKSPIQKGEAIVRKVKEALDWAQASMAYSQQNAENQANKHRSPATNYQVGDKVWLSLKNICTDRPSKKLDWKNAKYEVIGLVGSHAVRLNTPPGIHPVFHVDLLRLASSDPLPSQKNDDTQPPGIIVNGEKEYMVEKILDERPRRYGRGHRLEYLVKWSGYARPTWEAATALEEAQALDEWLDRTKQY

SEQ ID NO: 13177 - protein, 1054 aa, Aspergillus nidulans
  unsure (1)..(1054): unsure at all Xaa locations
IXLFRYQLASPVRWVGYHTPPPLYSTDPSRVETQQQLFRGEPCIQRFVEIGPRTILSTMAKRSASIQKDQRSSASCYSPEFLSYHDNQPEILYQYQNDQAIYPLSQPTQPQFEPTSPSHLTKRSPSPSKALPMSAIPSAELTLQAGHVILAMTAQKLRRRFDQVPVEKTIRDLSGGMHYNCPICTYFXLPRKITLQNELTGDLVAEFGRVPEGVEDQPLSSLAESFQPEFSGIPGKAMSTLISRFISGKMPAGFNQSAIQEYLNSRWDLTKSHATIPLCFAPTMEPARRLANADEARAYLDDLVEKHAAFQGISLVPSNQVADGHESLAPVVMNVADVDEMNKRTKLYRAQFDSLASYLGVDYFASEKAMSESESRIAELEETIRLLNTELDEQFIKGIKPSFNIKQVRKYDSWWNWSREELIRLLNEICQDSSSACPPDMENRLQNLLNKWDANCSEIVRAHLIGLQSRSSAPMNKLQLILEEIFTLGNQTLSIDPLFVHNLPPMGPQTIITDAGCLEYHELPRQISHYPEAMAYGPPWPQGHTSAPFIHIKTREDGQDWMYDSKATSIYHAMLDVGVTTGLTFTHKAVLVTGAGPSSIAASVIQGLLSGGARIIVTTSRSISQSADFYQQMYRQYGAKGSSLSLFPFNQASKQDCEQLVQHIYGPDSPTDGDLDYILPFAAIPQVGEPDAFGGRQELALRAMLVNILRLIGFVRQEKERLRIENRPTMIVLPMSCNEGTFGGDGLYSEAKIGLKALFNRFYSENWSKYLTICGAVIGWTRGTAIMQTSNAVAEEVEKLGVITFTQAEMAFNILALMTPALTALAEDTPIYADLTGGLGSMWNIKQEISAARKRISERQILQIAIAEEDAREQAMICSASTDVESGLPTTRHARLGLQFPPLPDVNEGYPNIEGMIDLTRIPVIVGYSELGPWGNARTRWEIEHRGDFSLEGYIEMAWIMGLIKHVDGHAKGRPYVGWVDADTETPIQDYEVPHKYHKHIMAHAGLRLIKPTKLDSYDPSRKDLLHEVAVEEDLAPFISSKSTGEAFPTTHGE

SEQ ID NO: 13178 - protein, 228 aa, Aspergillus nidulans
  unsure (1)..(228): unsure at all Xaa locations
GLGDAMVKKFMAQLIEGIRFCHSHRVLHRDLKPQNLLIDRDGNLKLADFGLARAFGVPLRTYTHEVSSASLSSMAWACRXICSRVVTLWYRSPEILLGGRQYSTGVDMWSCGAIFAEMCTRKPLFPGDSEIDEIFKIFRYAISLLNRXTQASNVXCTRILGTPDETIWPGVTSFPDFKPTFPKWKREDIQNVVPGLEEDGLDLLEALLEYDPARRISAKQACMHPYFQ

SEQ ID NO: 13179 - protein, 159 aa, Aspergillus nidulans
HVSKGSVGGKIHVQGSSSNVTHTINEDERTEFTRHINAVLAGDPDIGHLLPFPTDTFEMFDKCKDGLVLAKLINDSVPDTIDERVLNKPGRKLKELNAFHMTENNNIVINSAKGIGCSVVNIGSGDIIEVREHLILGLIWQIIRRGLLGKIDIKLHPEL

SEQ ID NO: 13180 - protein, 190 aa, Aspergillus nidulans
IAPALPVLAKLIYMLDDEVLIDACWAISYLSDGPNEKIQAVIEAGIPRRLVELLMHASTSVQTPALRSVGNIVTGDDVQTQVIINCGALPALLSLLSSTKDGIRKEACWTIFNITAGNSSQIQSVIDAGIIPPLVHLLANGDFKTRREACWAISNATIRGVEKPDQTRFPCTQGGIKPFCGLLAGPDNKI

SEQ ID NO: 13181 - protein, 341 aa, Aspergillus nidulans
  unsure (1)..(341): unsure at all Xaa locations
ISARSDIDHPICTECTDMLVEGLQQRLAEATKERDAYITFLRNLNSSVPTQEEVETAEKSLKETLEAEEAAYAELVALEKENAALDEEIARLEEESRQLDYEEEKFWRDRNAFSLVLADFQNERDALNMKYDHDSRQLERLQRTNVYNDAFCIGHDGYFGTINGLRLGRLANPSVEWPEINAAWGQTALLLATIAEKLNFQFQGYRLRPMGSMSRIDKIEYPRPLPAQSTVEGASNAHQPAAPKITSLDLFSSGDLPLHMPWLHSRFDARMVVFLECLRQLGEFVEKTRVRSSRRDQAGAGLPGLKLPYSIKRDKIGDARIKLAFNQNDETWTRACXYTLT

SEQ ID NO: 13182 - protein, 241 aa, Aspergillus nidulans
FLFKVVLIGDSGTGKSNLLSRFTRNEFNLDSKSTIGVEFATRSIQVDSKTIKAQIWDTAGQERYRAITSAYYRGAVGALLVYDISKHQTYDNVNRWLKELRDHADSNIVIMLVGNKSDLRHLRAVPTEEAKQFASEFSLHACMDYLLTLTLNRRNNLSFIETSALDASNVELAFQNILTGIAPVGISKRRSLTAILFFVEIYRIVSSKALEGESGGASVGERRQIIDIEKTQDTENKGGCC

SEQ ID NO: 13183 - protein, 225 aa, Aspergillus nidulans
KMTTDDFEPLLCLGKGSFGTVLLVRHALTGKLYAQKQFKKASITVHKKLVEQTKTERAILESVNRHPFVVKLFYAFQDHERLYLVLEYAQGGELFTHLAMERMFDEDAAAFYMAEMVLALEHLHQNVGVIYRDLKPENCLLDREGHLLLTDFGLSKIAVGDDDRCNSSLGTIEYMAPEVIQGKPYGKACDWWSLGALGYDLLTGSPPFKANNHAKLQEKILKQKL

SEQ ID NO: 13184 - protein, 163 aa, Aspergillus nidulans
NGTAKINWPYLFRQRRRLEENWTKGRFTNFQLPHPAHMEEAHQECVYAIQFIGKWLVSGSRDKTVRVWDLNTKRLWHRPLIGHTKSVLCLQFNPSPSEDIIISGSSDKNVIVWRFSTGEKIHEIAPAHDDSVLNLRFDHRYLVTCSKDKLIKIWNRKNLSPAD

SEQ ID NO: 13185 - protein, 110 aa, Aspergillus nidulans
  unsure (1)..(110): unsure at all Xaa locations
MSAKELTFKEVAEHNTKKDLYMVIHDKVYDCSSFVDEHPVRLTYLPAFXCSPHWTCHGLIWYNYSGGEEVLLDVGGQDATEAFEDVGHSDEAREILQGLLVGDLKRLVRS

SEQ ID NO: 13186 - protein, 137 aa, Aspergillus nidulans
  unsure (1)..(137): unsure at all Xaa locations
EAIWAASPSTTRGQPTQLSSDAKGERLAYAVYYSTPAELSXAMLKHLSDPRDVFTNSQNKSIFLRSIDDPAVARQYTEHKVQTTVARFAPSGFYVASGDASGVVRVWDCVGEGITKGEYSIVNGRINDLAWDGDSQR

SEQ ID NO: 13187 - protein, 225 aa, Aspergillus nidulans
  unsure (1)..(225): unsure at all Xaa locations
FKLNTGYEIPAVGLGTWVRTTTSSFRNQAYECLIVYSQSKPSEVEEPVTAALNIGYRHIDAAAVYGNERDVGNGIKASGVPRGEIFVSSTLTLEEVCVFNXRAKLTSKLWNTHHDPENVEAAVDRSLSDLQTDYLDLYLVSHSSSVVTECKRRXYLLVIXIHWPVASRYSTTTIQPVDEKTGLIDVIDVPIKDTWAAMEALVAKGKVRSIGVSNFNRQRIEELLK

SEQ ID NO: 13188 - protein, 193 aa, Aspergillus nidulans
  unsure (1)..(193): unsure at all Xaa locations
VLLGITGRDFVILAASKAAMRGPTILKAEDDKTRQLNEHTLVAFSGEAGDTGSFALIYFXASTPENXSRPPLTVQFAEYVQANVQLYTMRNDTELSPNAVANFVRGELARSLRSRNPYTVNLLLGGVDPISQKPHLYWIDYLASLASVPYAAHGYAQYYCLSTLDKHHHPDITLEQGMKNLEMCTDELNRRQP

SEQ ID NO: 13189 - protein, 139 aa, Aspergillus nidulans
  unsure (1)..(139): unsure at all Xaa locations
IKLLLIGDSGVGKSCCLLRFSEDSFTPSFITTIGIDFKIRTIELDGKRVKLQIWDTAGQERFRTITTAYYRGAMGILLVYDVTDERSFQSKITPSYVLPYTGRXPKSHHDIRTWFSNVEQHASEGVTKTLLGQMDWERE

SEQ ID NO: 13190 - protein, 150 aa, Aspergillus nidulans
RLDGDNVRFGLNKDLGFSDADRNENIRRIAEVAKLFADSSSIAITSFISPFRADRDTARKLHEVPTPNDSTGLPFVEVFVDVPIEVAEKRDPKGLYKKAREGIIKEFTGISSPYEAPENPEVHVKNVDLPIQEAVKQIIDYLDSKKLLDA

SEQ ID NO: 13191 - protein, 189 aa, Aspergillus nidulans
  unsure (1)..(189): unsure at all Xaa locations
AISNELYVMNEETVAAFCLLSVFTAVAKYGGPAYKEWAEAQVQKHKDILNAARADHTNAVKQRMENVKELSGVVDLTKQLFEVSKVFKQQQLSXAVPARGESVGRLQLTFDKETAKLEAQAYELEQRTALAAEAKQVLDSWVRYEGQVKQRQQRELAETVIGKIQKELQNPKTLQQILNQSVADVERML

SEQ ID NO: 13192 - protein, 172 aa, Aspergillus nidulans
  unsure (1)..(172): unsure at all Xaa locations
QRGLVGPIISRFENRGCVYLPTLLSRDTGPLQAFKLAAMKLTSPSRSLLEQHYSDLKEKPFFPGLVTCEFPRLKXLTLVIAILYQNRHLSGPIVAMVWEGKDVVKTGRTILGATNPLAYAPGTIRGDFAIDVGRNVCHGSDSVESAKKEIGLWFTPEEIQNYKLNAFGWIYE

SEQ ID NO: 13193 - protein, 190 aa, Aspergillus nidulans
  unsure (1)..(190): unsure at all Xaa locations
PVAVITTRQQTQPKDDKKGLIETGREVVNSEDGWSGLWRGLKASLILVVNPAITYGAYQRLKDIYFPREEEPQALGSISXVTSXYRLWVLEILIPVTVLGALSKAMATIATQPLIVAKVGLQSRPPPARNGKPFKTFSEVMRFIVENEGPLSLFKGIGPQILKGLLVQGLLMMTKERYTVSPIALLXTYA

SEQ ID NO: 13194 - protein, 483 aa, Aspergillus nidulans
  unsure (1)..(483): unsure at all Xaa locations
AASEALVSPPVAPVKPGILIVTLHEGRSFALPQHYQQVFSSHIQNGYSMRPSSSSSHSTHSQSSSFVPSNRPQSTSSGINAAPTIHGRYSTKYLPYALLDFDKNQVFVDAVSGTPENPLWAGDNTAFKFDVSRKTDLNVQLYLRNPAARPGARRNDEIFLGAVKVHPRFEEEIQPYIGDPKLSKKDNQKTAAAHAEQERALGQVGAEWHDLQFGSGSLKISVSFVESKHRSLKLEDFDLLKVVGKGSFGKVMQVMCVLIKIFLLIDLSSSYTFTGKKDTARIYALKTIRKAHIISRSQVTHTLAERSVLAQISNPFIVPLKFSFQSPEKLYFVLAFVNGGELFHHLQREQRFDVNRARFYTAELLCALECLHGFKVIYRDLKPENILLDYTGHIALCDFGLCKLDMKDEDRTNSRTFSVPFAFXVANEVQHSAGTPEYLAPELLLGQGYTKTVDWWTLGVLLYEMLTGLPPFYDETQMDMYRK

SEQ ID NO: 13195 - protein, 322 aa, Aspergillus nidulans
PEGYPPAAPVPRPPSKGYDPDQRAPVDASKEADALRKAMKGWGTDEAALINVLAKPDPLHMALIRHTYMDRHGRNLEKDLKSELSGDFETIMLSLAAGPLGQDIRYLRDAMSGIGTDETAINDVLIDRSNADLRAIKYGYVQRYNKALVDDIKSDLSGKTEKFFLMLLNAVRPESGTYFDQASVDKDVHELHLATNAKTGTDELGVSAVFLGASDQKLVAISQAFEAKYHISLEKTIKDEFSGHLEKALLAILARAKDPLKFDVETMLAIVPPGGVKADIKRLIYWVVRLHWNPPYLAQIKEALQKRTGSNFGKRIRGALPG

SEQ ID NO: 13196 - protein, 513 aa, Aspergillus nidulans
  unsure (1)..(513): unsure at all Xaa locations
SVRNQDVYIIQSGSEKINDSVMEILIMISACKGGSAKVYHRYDYPTSPLMSRSRNSCGGXHGRLVAVMPYGSXLGXLLLIMLTQTRYFPYSRQSKKKSHRGSITARMLANLLTVAGVDHVITLDLHVSVXNDGLLHXILSLVDRRSSNLVFLLRHSQMQGFFSKPVDNLFAEPFIARWIRNNVPGXKEAVVVSKNAGGTKRVTSLADTLKLNFGIVATDRRRLKPGPTLADSTVFVEALDQETAPLPKEQDPFIARTHIENPDALQSRESQADLNELDSLRPETPSGARRPSELEAVNEYTDVRVRDVITGRLVQGHLVDDDYPPSGPTSMAVSGDATPGQLPSQESEAIPDSMVDSVVSTTSSKPGDHALGGSFDAADSSDEEEGSTKRNVEQEKTITLVGDVRDRTVFLVDDMIDKSGSWIAAAETVVKRGGAKKVYCIATHGLFGDSSLEQLEACESINYIVVTNTFPISPQVARKSRKLIIIDISSLLSESIRRHHYGERSVSIYLYQK

SEQ ID NO: 13197 - protein, 329 aa, Aspergillus nidulans
  unsure (1)..(329): unsure at all Xaa locations
QVKQGTRVALNIPTLPXMGMLPGEVDPWXYNRSLKDPGQINFAGIGGHEDQIRELREVIELPLKNPELFQRVGIKPPKGVLLYGPPGTVKTLLARAVASSMETNFLKGELLPALGLAFRXHGLVVSSAIVDKYIGESARLIIEMFGYAKEHEPCIIFMDEIDAIGGRRFSEGTSADREIQRTLMELLNQLDGFDYLGKTKIIMATNRPDTLDPALLRAGRLDRKIEIPLPNEVGRLEILKIHSSTVQMEGDIDFESVVKMSDGLNGADLRNVVTEAYVMPLFLYLVIANVEKGSICYKDYRDAINQDDFNRAVRKVAEAKKLEGKLEYQ

SEQ ID NO: 13198 - protein, 297 aa, Aspergillus nidulans
  unsure (1)..(297): unsure at all Xaa locations
EVTARLEYLHLMGFIYRDLKPESGYPKLVREXTTDSFVSQDILLHQSGHIMLSDFDLSKQSGPGGAPTMIPARSGNSNTSLPTIDTKSCIADFRTNSFVGTEEYIAPEVIKGCGHTSAVDWWTLGILIYEMLYGTTPFKGKNRNATFGNILRDEVPFPEQGGAQQISKMLSPNSGXSQYXPSYSICKSLIRKLLIKDETKRLGARAGASDVKTHPFFRQTQWALIRHMKPPMIPHQSRGNETVNFRNVKESASVDIGEKNPSKMKGVPLNSGLATPNGEIADPFEEFNSVTLHHDGD

SEQ ID NO: 13199 - protein, 108 aa, Aspergillus nidulans
  unsure (1)..(108): unsure at all Xaa locations
SGSAGVSKLIAVLIAYPHEVRTYSYRPYYPTXMGIHYLHLQVLRTRLRQAPMADGRQKYTGVLQSLRLMVKVEGFVALYGGLTAHMIRTVPSAAITLGTYELVLKLLS

SEQ ID NO: 13200 - protein, 300 aa, Aspergillus nidulans
  unsure (1)..(300): unsure at all Xaa locations
IAAAIDDRTKAVYVETIGNPRYNVPDFEVIAKVAHEKGIPLVVSFPLYGEYRXLTLTQVDNTFGAGGYFVRPIEHGADIVVHSATKWIGGHGTTIGGVVVDSGKFDWGKNAARFPQFTQPSEGYHGLNFWETFGPIAFAIRVRVEILRDLGSALNPFAAQQLILGLETLSLRAERHASNALALANWLKKNDHVSWVSYVGLEEHSSHEVAKKYLKRGFGGVLSFGVKGEAAVGSQVVDNFKLISNLASKSGCRASIRGQTKSXPIYSVGDSKTLAIHPWSTTHEQLTDQERIDSGVTEDA

SEQ ID NO: 13201 - protein, 317 aa, Aspergillus nidulans
  unsure (1)..(317): unsure at all Xaa locations
MSPPTVKLNSGYDMPLVGFGLWKVNNDTCADQVYEAIKAGYRLFDGACGTPPQNSPIQVSEXQQLTRGRYGNEVEAGQGVARAIKEGIVKRSDLFIVSKLWNSFHDGERVEPIARKQLSDWGIDYFDLYIVHFPVSLKYVDPEVRYPPGWENAEGKVELGKATIQETWTAMESLGDRVLARSIGISNFSAQLLLDLLRYARIRPATLQIEHHPYLTQERLVTFAQREGIAVTAYSSFGPLSFLELSVKQAEGAPPLFEHPVIKDIAEKHGKTPAQVLLRWATQRGIAVIPKSNNPARLLQNLDVVGFDHEDGEQKAI

SEQ ID NO: 13202 - protein, 275 aa, Aspergillus nidulans
YSSMAGKLDQKLLQALNVLGFEYMSPVQQRVLTELPHGADCLVQAKTGTGKTVAFLLPALHCLIQGQSQVRRGQVAILIITPTRELAQQIAKSCDELTSQLSRPLECHIAVGGTARASAHSRFMNGDPSILVATPGRLKDYLSESETAEKLKDIQTLVLDEADTMLETGFLADVKQILKLIPSKSTGWQGMCFSATLPPKVKDVVSVVLNPGYTSISTVDKNEPPTHERVPQYYVLMPSVAETFTTLSSLLAHESKKNTKIIVFGVTANMVELSH

SEQ ID NO: 13203 - protein, 589 aa, Aspergillus nidulans
  unsure (1)..(589): unsure at all Xaa locations
YVGMKNQGTTGSLFTLAALYFGMPRXAVYQIHGKRTVKEISACTLQRLCSNLQTSHLPVSTTELTASFGWESRQIFEQQDVQELSRKLMQRLEEKMKGTPAEKALPEXLVGKSKTYISCVNVDYESSRVQDFWDIQLNVRNNKTLDDSFRDYIQVERLEGDNKYDAGAPYGLQDADKGEIFESFPPVLHLHLKRFEYDIQRDAMMKINDRHAFPMEFDAAPYLSKDADRSESWVYQLHGVLVHSGDLNAGHYFAFLKPTKDGFWYRFDDDRVTRATEKEVLEENYGGEYELPNGAVGVRQPYTRGLSTKRSTNAYMLVYVRKSRVDDVLVPITKDDVPSHIGMHKLLCLXYLLLMCLXKNALVEERAEIARRRKEKEEAHLYTTVGVLSEETFRCHHGFDLTSYDPPVVEEALPKQYRILKTTTVGEFAEKIAEEKGLNPLQLRFWVMVNRQNKTMRPDQVIQDPEMTMDEAYSRYATKGHVFRVWLEVAQPSPDGTVSWPDSSTSVLIFLKNFDVPTQTLTGVGATYVRKSQKVGELGSTILDLMNWPARTEFVLYEEIKHTMIDLMKPQQTFQQSEIQDGDIITSKR

SEQ ID NO: 13204 - protein, 515 aa, Aspergillus nidulans
VPTAGLDTALTLRSVHNENVRREIYQATRTASSRQIQRLEQLLAKRTELAQLAGFETFAHMTLNDKMARSPAAVSEFLTTLITSNRPDVQEELAQLQAQKGSELQPWDHAYYVHQRVRQYETSQKTRRSRELAAIPEFFSLGTVMQGLSRLFDRLYGVRLVPREAAPGETWTPDVRRLDVVDEADRPVAVIYCDLFSRPNKHPNPAHFTLRCAREITQEEIAESAAMDASAVVAHPNDGMATAVDSESKTLRQLPTIALVCDFPEPSSCTPSLLSEHSVRTLFHEMGHALHSILGQTQLQSISGTRCVTDFAELPSVLMERFATDPSVLALYARHWQTDQPLSETMIHHMAQDRAAHGAIYGAVENEAQILMALVDQAYHTTKTGNSFLDTTKLYQQVYSRHASLPDPVDEHGRPSTSWQGFFGHLYGYGATYYSYIFDRAIANKLWEDVFGAGAAAVDRSAGERYKNEVLRWGGGRNGWECVAGVLGPQNLSNANGRLVEGGDEAMREVGRWGL

SEQ ID NO: 13205 - protein, 465 aa, Aspergillus nidulans
GAYQLWADRVGDDSYTWDNWLPFFKKSVQFSGPLTNPRPANATASNDVSAFAATAEEEGPVQVAYPYLTNAISSWVDKALEKMGFPEAQGFSNGQLLGRSYITHTIHPKTRRRDTASTSYLQTALRTSNSLNVITHTLVKKIDFDEEKRATGVVVNTGGFEWQIGAKKEVILSAGVMRSPQLLMVSGLGPRETLEKLDIPVLSDLPGVGQNMQDTIILGPTNPVKVESHSQLMGSKETLPRSIYEYNNFRTGLLTNPGQDYFAFEKHQPGNLSEATAADIDKAFPADWPTFSYIALDDTFVPQYDGKNYFSMSAALLATFSRGTVTINTTNTADNPVVDPRWLDDPRDKEMAVAAFRRCREIVASETMQQVIDGPELLPGFEYQTDEEILNYIAETSDAYYAGVGTCAMGKPDDPLAVLDSKARVRGVKGLRVVDASAFPTAIDGQPMATVYALAEKVAADIIAG

SEQ ID NO: 13206 - protein, 454 aa, Aspergillus nidulans
PHNQPEEAVDETEFVDDHHHAHHRDSVHHRLRANSAIMQFQKILVANRGEIPIRIFRTAHELSLQTVAIFSHEDRLSMHRQKADEAYMIGKRGQYTPVGAYLAIDEIVKIALEHGVHLIHPGYGFLSENAEFARKVEQSGMVFVGPTPETIEGLGDKVSARRLAIKANVPVVPGTEGPVERFEEVKAFTDTYGFPIIIKAAFGGGGRGMRVVRNQADLRDSFERATSEARSAFGNGTVFVERFLDKPKHIEVQLLGDNHGNVVHLFERDCSVQRRHQKVVEIAPAKDLPQNVRDSILADAVKLAKSVNYRNAGTAEFLVDQQNRYYFIEINPRIQVEHTITEEITGIDIVAAQIQIAAGATLEQLGLTQDRISTRGFAIQCRITTEDPAKGFSPDTGKIEVYRSAGGNGVRLDGGNGFAGAIITPHYDSMLVKCTCRGSTYEIARNKVVRALVE

SEQ ID NO: 13207 - protein, 451 aa, Aspergillus nidulans
  unsure (1)..(451): unsure at all Xaa locations
MSTEDNHDSQILTARHRSDASEQSFKSLFGGPSSEDGKETEPDTHDHNHSFSNAKAPAKFANQNVAPFLARHIPEQYAPLGAQSILPADLSSANSKYCYRHRPDQKCRRQADEPSMDKLQRVSNPASLNGGCVLISRELESLPQGDQQSISHVWSLFSAAPAKHRKLILQGIMAQCCFPQLSYISATVRDLIRIDFITALPPEIAFKILCYLDTTSLCKASQVSRGWRALADDDVVWHRMCEQHIHRKCKKCGWALPLLDRKRLRESKREIELRATTWDKGVVGPRSPDASAESPPSGKRKLEDDEVAVVKRHCSSLGSDAGVDKDSDFFKTRYRPWKEVYKDRFKVGTNWKYGRCSIKPFMGHTNGLMSLQFEDNTLASGSYDTTTKIWDTETVEGARTLHGHESRVRCLQYDYTKLISGEMDRTIKVWNWRTDRERYTYTGTRGDSXSL

SEQ ID NO: 13208 - protein, 227 aa, Aspergillus nidulans
  unsure (1)..(227): unsure at all Xaa locations
WRSQFISSRGNEYFCEIDEEYLTDRFNLTGLNTEVPYYQYALDLVTDVFDLDADDDLREQIEKSARHLYGLVHARYIVTTRGLAKMVRIECHFLRCYXRIRHXVEKYKKGDFGKCPRVMCEGHPLLPTGQNDVPNMSTVRLYCSKCEDIYNPKSSRHASIDGAYFGTSFTSMLFQVYPALLPEKSIRRYEPRIYGFRVHASAALARWQDRYREETRNRLRDAGVEVR

SEQ ID NO: 13209 - protein, 228 aa, Aspergillus nidulans
  unsure (1)..(228): unsure at all Xaa locations
EEATALKVQGNKAFAQHEWPTAVDFYTQAIEKYDKEPSFFSNRAQVRCDIFSPAGVFMAPXSWLILXLHDCSAHIKLEAYGFAVADATKALELDPNYIKAYWRRALANSAILNYRDAMRDFKAVVKREPGNRDAKLKLAECEKLVRRLEFEKAIEVADPPSAFESLDIDAIAVDDGYDGVRLGSEMTQEFIDDMIERFKNGKKIHRKYAFQIVKAVKEIVYAEPTMVE

SEQ ID NO: 13210 - protein, 190 aa, Aspergillus nidulans
YHCDITDLHELKATASKILDEHGPVHVLINNAAATGSLARQASLDVTPETWDFNVNANLRHIFFLTQCFIPSMKSSGGGSIVNLGSISWRIPEATTPIYGTCKAAINGLTRIHSREFGTHNIRVNCVMPGAIATDRQRAEVLTEEYRTHVFAQQSLKRDLEPEDVAKVIVFLGSEEASGVTGSCYVVDGG

SEQ ID NO: 13211 - protein, 285 aa, Aspergillus nidulans
MMFSRFFKAVPARAPAFSSPLPVYQARTMATVRNQRPVERATFTIRDGPIFHGKSFGARTTISGEAVFTTSLVGYPESLTDPSYRGQILVFTQPLIGNYGVPSTERDRHGLLKYFESPNLQAAGVVVADVAEQYSHWTAVQSLGEWCAREGVPAISGVDTRAIVTYLREQGSSLARITVGEEYDADQDEAFTDPEQIHLVRQVSTKAPFHVSAADPQCHVAVLDCGVKENILRTLVSRGASITVFPFDYPSHKVAHHFDGVFISNGPGDPTHCQDTTYHLRRLME

SEQ ID NO: 13212 - protein, 596 aa, Aspergillus nidulans
  unsure (1)..(596): unsure at all Xaa locations
EYSTIDRSKGITTALMEKGKNLITPQRQFSIRKSSAQPEPQQASIIRTFTGGLNQLEQQLADDPLQKRRIRLAHRAFLRHSFNRLDFVAVLAYWVSFVLNLGGVENTHQLYVFRMLSCLRILRLLRVDXWNICRLSRQRLAPYLLTXIKVILRSLKKAAPLLVHVAFLIGFFWLLFAIVGIQSFKSSFRRTCVWLGEEYGEQNFTMNDPFGTLQFCGGWLDETGTQRPWYSSDGFESDSKPKGFICPQGSICVEGGNPYNTTMSFDDILHSLELVFVIMSSNTFTDILYNTTDSDYLVAALFFACGFVILSLWMVNLLVAVITHSFQVIREESKRSAFCISKDXGVRGGGGVFPQSXHVEAHYDATYWFWIAVIIFDLVMQAQRSSSMGDGRVQLIDNCEIVVTVALLGEILLRFISDWRKFHQSRRNWVDLALAIITCIIQVPAIRNSKRTYDILTVFQILRFYRVVLAFAVTRNLITLVFRNAVGLLNLILFVFLITFLASIFATQLFRSQIPREDDDGGTIEITFSDLYNSFLGMYIILSSENWTETLYNVTSYTYSFNTAWISATFVILWFIVANFIVLNMFIAVIQESLDV

SEQ ID NO: 13213 - protein, 222 aa, Aspergillus nidulans
VRGDEVHWDDIAGLEGAKKALKESVVYPFLRPDLFSGLREPARGMLLFGPPGTGKTMLARAVATESKSTFFSVSASTLTSKWHGESEKLVRALFGLAKSLAPSIIFVDEIDSLLSSRSSGTENEASRRSKTEFLIQWSDLQRAAAGREQPVKSGDASRVLVLAATNMPWDIDEAARRRFVRRQYIPLPEHHVREQQLRRLLSHQVHDLSDEDIEVLVHVTEG

SEQ ID NO: 13214 - protein, 302 aa, Aspergillus nidulans
LADGRRFTARKEVILAAGALRTPQLLMVSGIGPGDTLAKHGISSVVEAPEVGRNLIDHFALYQLYKLREPRTWHCARELQATLTQLLPKAFPLTGPSTKESPGMCLTRPCRRTRNDLVQATDESVLIPGRPLVETLILYAPIGMPTDGSLLMTSVMLLSATSRGTVSISSASPSDPPLVDSNYYDTETDRAVLTYGSRRTAKALLETSALKNYVECEVPPPDMPALTSQSSDEEFDARIRATGMAHHHPAGTAAMGKVVDTELRVIGVRNLRVVDASILPVSIGGHPQATLYAVAEQAADLI

SEQ ID NO: 13215 - protein, 577 aa, Aspergillus nidulans
  unsure (1)..(577): unsure at all Xaa locations
MHPWFSWIFWINPLAYGYEAILSNEFHGQLIPCVNNNLVPNGPGYTNSEFQACTGIRGVPAGASVITGDQYLQGLSYSHAHVWRNFGIMWAWWVLFVILTVYFTSNWSQVSGNSGYLVIPREKAKKTKHLTMDEEAQPGLDLHDSSHRGGTSPIDDEKGSHTNSSSKVDAQLIRNTSIFTWKGLSYTVKTPSGDRVLLDNVQGWVKPGMLCALMGSSGAGKTTLLDVLAQRKTEGTIRGSILVDGRDLPVSFQRSAGYCEQLDVHEPLSTVREALEFSALLRQSRDTPVVQKLKYVDTIIDLLEMHDIENTLIGTTAAGLSVEQRKRLTIGVELVSKPSILIFLDEPSSGLDGQAAFNIVRFLRKLADVGQAVLVTIHQPSASLFAQFDTLLLLAKGGKTVVFLPVRGEICXRVRSGYFGDIGHNGATVKEYFGRNGAPCPQNTNPAEHMIDVVSGSLSVGKDWNEVWLTSPEYTAMTQELDRIIMEAASKPPGTLDDGHEFATPIWTQLKLVTNRNNASLWRNTDYINNKFMLHVISGLLNGFFFWETRQLVADLQMRLFTIXNFIFVAPGVMAQL

SEQ ID NO: 13216 - protein, 335 aa, Aspergillus nidulans
  unsure (1)..(335): unsure at all Xaa locations
NANDNITSFEPPSRVRSPFADALFHNKTRCFVXXVECDPGXSIAXTDGNHSGMQPRAVQGMLDFDFICKRSTPSVAGIIYTFGGQFVSKMXVAYTRIDAGSYSXQYVRRYWGTSETLLPVYQDTAKAMAKHPDVDTVVNFASSRSVYSSTMELMQYPQIKCIAIIAEGVPERVCELCAAQLKRPRRXHENSEAREILVTAKEKGITIIGPATVGGIKPGAFKIGNTGGMMDNIVASKLYRKGSVGYVSKSGGMSNELNNIISQTTDGVYEGVAIGGDRYPGTTFIDHLLRYQAEPECKILVLLGEVGGVEKYRVIEAVKNGVITKPIVAWAIGTC

SEQ ID NO: 13217 - protein, 349 aa, Aspergillus nidulans
  unsure (1)..(349): unsure at all Xaa locations
ASAPTVGGGSPVSGSPKGGLAAKRMKPGLKLSDATGPSNPAAGGQSPPVDRLEVESQLSASIRSTLTRNREPXSSRTKAVLHGGGIEFSSGQSFSISLDEVDRMDELGKGNYGTVYKVRHSRPHMRKPGQGLSGIVSRPQGSDGSDTELKPQDSLTGAVMAMKEIRLELDESKFAQIIMELDILHRCVSPFIIDFYGAFFQEGAVYICVEFMDGGSVDKLYGDGIPENILRKVALSTVMGLKSLKDDHNIIHRDVKPTNILVNTRGQVKICDFGVSGNLVASIAKTNIGCQSYMAPERIAGGGVQQSGASGGTYSVQSDIWSLGLSILECAIGRYPYHPETYKNIFSQL

SEQ ID NO: 13218 - protein, 578 aa, Aspergillus nidulans
LQQEVNQHVFKLEQEEYVREQIDWTFIDFSDNQPCIDLIEAKLGILSLLDEESRLPMGSDEQFVTKLHHNFAADKQKFYKKPRFGKSAFTICHYAVDVTYESDGFIEKNRDTVPDEHMEILRNSSNNFVKEILDTAASVREKDSAAVSSKPVTAPGRKIGVAINRKPTLGGIFKSSLIELMSTINSTDVHYIRCIKPNEAKEAWVFEGPMVLNQLRACGVLETVRISTAGYPTRWTYEEFAIRYYMLCHSSQWTSEIKDMCHAILRKALGDATQQKHDKYQLGLSKIFFRAGMLAFLENLRTSRLNECAIMIQKTLRCKYYRRRYLEARLSVLATQSLVRGFLARQRAAEIRRIKAATTIQRVWRGQKERKRYNQIRDNVILLQSLSKGFLCRRNILNSIHGNAAKTIQRAFRSWRQLRAWRQYRRQVIIVQNLWRGKKARREYKVLREEARDLKQISYKLENKVVELTQYLESLKRENKSLNSQLENYETQLKSWRSRHNALENRSRELQAEANQAGITAARLTALEEEMSILQQNHADGQATIKRLQEEERISRDSIRSANQELEKLKQLNAETKS

SEQ ID NO: 13219 - protein, 320 aa, Aspergillus nidulans
TVASSMSLRLINSCQDAHDIAQAHLDDERAKLTGFDDELRDLEQTMQSKNSQITEEGLEMQKLGHQLEKLQKEQNAAEQAVAHLEAEHEWIADEKDNFGRPNTVYDFKNQNIAECKATLRNVTERFQGMKKKINPKVMNMIDSVEKKEAALKNMMRTVIRDKSKIEETIINLNEYKKEALHKTWTKVNADFGQIFSELLPGSFAKLDPPEGKDITDGLEVKVSLGKVWKQSLTELSGGQRSLIALSLIMALLQFKPAPMYILDEVDAALDLSHTQNIGRLIKTRFKGSQFIVVSLKDGMFQNANRIFRTRFSEGTSVVQA

SEQ ID NO: 13220 - protein, 142 aa, Aspergillus nidulans
NGQIPPNTISRLSALRVLSLRANLISGEFPKDFVELKDLAFLYLQDNNLSGPLPLDFSVWKNLTSVNLSNNGFNGTIPSSLSRLKRIQSLNLANNTLSGDIPDLSVLSSLQHIDLSNNYDLAGPIPDWLRRFPFSSYTGIDI

SEQ ID NO: 13221 - protein, 176 aa, Aspergillus nidulans
  unsure (1)..(176): unsure at all Xaa locations
NKRSLDYVLRSGLAGGLAGCAVSLTSHRQTEQRXLTSELEAKTVVAPLDRVKILFQASNPQFAKYTGSWTGLVFAIRDIKRHEGARGLYRGHSATLLRIFPYASIKFLAYEQFRAIVIPSRDKETPFRRLVSGSLAGITSVFFTYPLELIRVRLAFETKKSSRSSLVDTIRQIYGE

SEQ ID NO: 13222 - protein, 292 aa, Aspergillus nidulans
  unsure (1)..(292): unsure at all Xaa locations
AYRCHGYAMMRGGTIRSIIGELLGRREGIAYGKGGSMHMFAPNFYGGNGIVGAQVPVGAGLAFAQQYNEEKSTSVVLYGDGASNQGQVFEAFNMAKLWNLPVLFGCESKFRMAYSFXFPLANDRDNKYGMGTSAARSSALTDYYKRGQYIPGIKVNGMDVLATKAAVKYGKDYAISGNGPLVYEYVTYRYGGHSMSDPGTTYRSREEIQRMRSTQDPIQGLKQKILDWGVMSEEDLKGLDKSARAHVDEEVAIAEKMPLPENNSRILFEDIYVRGSEPRWMRGRTVDETFYY

SEQ ID NO: 13223 - protein, 257 aa, Aspergillus nidulans
  unsure (1)..(257): unsure at all Xaa locations
GDYVDRGYYFVETVTLHVCLKIRYPQRITILRGNHESRQITQVYGFYDECLRKYGNANVWKYFTDLFDYLPLTALIENQIFCLHGGLSPSIDTLDNIRSLDRIQEVPHEGPMCDLLWSDPDDRCGWGISPRGAGYTFGQDISEAFNHNNGLTLVARAHQLVMEGYNWSQDRNVVTIFFGTFPGFVSDDDXRCEPPNYCYRCGEPSAIMGIRXHPEYTLYVSPIQPXHDSTDSASLQFDPCPRAGEPMVSRRTPDYFL

SEQ ID NO: 13224 - protein, 279 aa, Aspergillus nidulans
  unsure (1)..(279): unsure at all Xaa locations
RKLHLGMFEIGKPLGKGKFGRVYLAKERSSGFVCALKVLHKSELQQGGVQKQVRREIEIQSNLRHPNVLRLFGHFQDSKRIFLILEFAGRGELYKHLRKEHRFPEWKAAHYIAQMASALKYLHKKHVMHRDIKPENILVGIHGEIKISDFGWSVHAPNNRRQTMCGTLDYLPPEMLTSNPQGNFYNEKVDLWSLGVLTYEFLVGEAPFEDTPVMTQRRIQRGDMQVPSFVSPEAKDLIQKGIPLSSLYAFHWVTNLPXLLVLDPEKRISLDEIQRHPWI

SEQ ID NO: 13225 - protein, 187 aa, Aspergillus nidulans
RPPPSSRPPPSAQPLGLPNDDQLFPLVRAANASNSGALTEQELGSALVNGDYTSFHPKTVKMMINMFDRNRSGSISFDEFVALWRYLAAWRDLFDRFDEDRSGRISLREFEKALVTFGYSLSQPFVTVLFTTFENKGRQVGKPRASGMSFDLFVQACISLRRMTESFKRYDDDRDGYITVSFEEFLT

SEQ ID NO: 13226 - protein, 343 aa, Aspergillus nidulans
  unsure (1)..(343): unsure at all Xaa locations
SADFGLIGLAVMGQNLILNAADHGFTVCAYNRTTSKVDRFLENEAKGKFANPGASGDLTELERELIGYRQSIVGAHSVEEFCSKLKRPRRIMLLVMAGNPVDQFIESLLPHLEEGDIIIDGGNSHFPDSNRRTKYLKEKGIRFVGSGVSGGEEGARYGPSLMPGGNEEAWPYIKDIFQSIAAKSDGEACCDWVGDEGAGHYVKMVHNGIEYGDMQLICEVRREIYLKKPGXLLQAYDILKRGVGLSSKEIADVFAKWNNGVLDSFLIEITRDILYFNDDDGTPMVEKILDKAGQKGTAKWTAVNALDLGMPVTLIGESVFARCLSALKDERIRPEPPQRPTPE

SEQ ID NO: 13227 - protein, 323 aa, Aspergillus nidulans
EMVLADGSIVKVSENENRDLFRGAAGAVGSLGVTTLMELQLVEAKKFVKATYLPQRSVRDSITNVHAATLNDANDYVDGIIYGPDHGVVVAGEMTNEMPDSAKIQTFSKAWDPWYYLHVKAKTRGNSPVTDYIPLAEYLFRYDRGGFWVGRAAFHYFHFPFSRVTRWWLDDFLHTRMLYKALHASGESSRFVIQDLALPYANAEKFINYTSNKLGIWPLWLCPLKQSPAPTFHPHSSVQSPGFTEDQMLNIGVWGFGPKDPEAFVTANRELEHRLRELGGMKWFYAHTYYGEDEFWSMYDRKWYDELREKYNATTLPSVYDKI

SEQ ID NO: 13228 - protein, 467 aa, Aspergillus nidulans
RTEYEEKLQVVLKKPFEADDGKKQTEREIRAKELISTLKRIFPGVKGRVSDLCKPKQKKYADAVSTVLGRHFDAIVVDNEKTAKECIQHLRDQRAGQATFIPLETIQVKALNSNLKGMHRAMRPAIETVDYDDSVARAITYACGNAIVCDDLATAKYLCYERHVDAKAVTLDGTVIHKGGLMTGGRGPQQNSKRWEDSEVESLFKLKDKIMADLANLPKGHRRGTEEETLQGELVGLEQRLAYAREELKALERNLKDKYTELDFVKRQLEDLRPKYTEKQEVLDELDEAIATSQDAVSGVEDEIYRKFCKRLGYSNIREYEVQQGSLHEEAAQKKLEFTTQKSRIENQLSFEQQRLQATTDRIASLQAQHQRDANMIGELESEQERVRNKLDELNAELDILREKLEEQKEKYGQSAENLAHHRRELQKRSKEVESTLRFINGLETEIQRNSSSRYALLRRCKLEDLE

SEQ ID NO: 13229 - protein, 451 aa, Aspergillus nidulans
  unsure (1)..(451): unsure at all Xaa locations
PRRDNSPQKAPYGLYAEKLSGTAFTAPRHENKQTWVYRILPAAAHENFVEEDASSYHTLSDAKKLQHIPNQLRWDPFDLDETVDWVHGLHLVAGSGDPTVKQGLGILLYAAGKDMGKEAFYSADGDFLIVAQHGVLDIQTELGRLLVRPNEICVIPRGVRFVLRADKPYLRSXAYGIRYRVTLPDGPVRGYICELYQGHYQLPELGPIGSNGLANARDFQAPVAAFDDEEGPTEYRLYSKFNNHLFSARQDHTPFDIVAWHGNYYPYKYDLGRFNTMGSVSFDHPDPSIYTVLTGPSDHVGTAIADFVIFPPRWLVAEKTFRPPWYHRNTMSEFMGLITGNYDAKTGGGFQPAGASLHNIMSAHGPDMHAFEGASNADLKPTKIGDGSMAFMFERXVNLSFFQVRNTNFASSLMVGVSEWGLKTCQKVQEEYNEHSWQPLKRHFKDPRKAQ

SEQ ID NO: 13230 - protein, 314 aa, Aspergillus nidulans
LDYSYFSTVNIGTPGQPVWMMLDTGGANTWVFGADCTSEPCQMHNTFGDNSSSTVKTTSDTFMVGYGSGKVSGNLVTDRLKIADIDVQMTFGLATNATDDFRDYPIDGILGLGRSNDTSMGGRRAFMDLVTQEGDLDSNIVGFHMSRNSDGERNGTVTFGGVDKTKFEGDISYTNVVESSIHWSIPLDDASVNGESCGFMGKTAIIDTGTSYSLFPPDDAKTIHSLIPGSKQLSDENYLVPCDSTAKVQFTFSGVSYTMSPKDYIGANLESGDGCVSTIIAQAIFGDDVMILGDTFLKNVYSVFDFDNDRIGFA

SEQ ID NO: 13231 - protein, 473 aa, Aspergillus nidulans
  unsure (1)..(473): unsure at all Xaa locations
MRQPSRARAAAAQQLSGSPYGTENGPMSSSDEWQERGAAVTVRQEIDANGKPVARYIKKGVRDFSFGQTLGEGSYSTVVLGTDRQTLKEYAIKILDKRHIIKEKKVKYVNIEKDTLNRLTDHPGVVRLYYTFQDERSLYFVLDLCKGGELLGVLKRMTTFDEECTRFYGAQILDAIDYMHKRGVIHRDLKPENVLLDSQMHIKVTDFGTAKILKGNQASQNSSGIPSLDSDMPEEERASSFVGTAEYVSPELLTDKNACKASDLWAFGCIIYQLLAGRPPFKAANEYLTFQKIVALEYEFPLGFPSVARDLVERLLVLDPTRRLPIEHIKNHEFFEGMTWGPDLWKQKAPRLKAYTPPPREPIKLNGGSDGDSFPPSINTAPSNASSRVMPRLITRIAGSXPIGHXVVSCADKKQRKDSEVREPGCRVICSLSQSRLQKWGVRSAKEVFTILRGSTTKKRQRLVMITSSGRII

SEQ ID NO: 13232 - protein, 426 aa, Aspergillus nidulans
  unsure (1)..(426): unsure at all Xaa locations
CASPHSEFAVLRXLQTTPSTQQYELSHRNSSIYNPLNTFRLPPGQERQYQQQYGDMYFLRLAKLKPAVEAVAVEAWEGFSVQSPSHLVPAAVSCVLTLCGLQIAGEHARRVERVLDVRQGELCWVAGTIYMEMPLKPNILDDLAKDASXPVYPREARTDSWQNFTSAPPPRRTYQDPAHPELTEIMLEDESGRLRLTGSKLQSVQLATGVIIAVLGTENANGDFEAIDIKVPDLARQPRRWERDEAKAPKEAKKGKIAMVSGLGITGTSSDTLALELLTDYLLGYTGSSKGEEGSPPDASRITRLIIAGNSLGASTIEAAPATDGVPAKKIAHQKKYGYDASAYNASPITQLDSFLAELLPSIPITLMPGETDPANFACPQQPIHRAMFLGSRAYCSAPQSEKTKVEPGWFDSVTNPWEGDVEGWR

SEQ ID NO: 13233 - protein, 429 aa, Aspergillus nidulans
  unsure (1)..(429): unsure at all Xaa locations
GIDPDVKQYTGYLDDNENDKHLFYLXVDIIVVIGRVIYXRAEGFFESRNDPKNDPVVLWLNGGPGCSSLTGLFMELGPSSIDENIKPVYNPYAWNSNASVIFLDQPVNVGYSYSGSTVSDTVAAGKDVYALLTLFFKQFPEYAEQDFHIAGESYAGHYIPVFTSEILSHQKRNINLKSVLIGNGLTDGLTQYEYYRPMACGEGGYPAVLDESSCRSMDNALGRCQSMIESCYNSESAWVCVPASIYCNNALLAPYQRTGQNVYDVRGKCEDESNLCYKGMGYVSEYLNKPEVRAAVGAEVDGYDSCNFDINRNFLFHGDWMKPYHRLVPGILEQIPVLIYAGDADFICNWLGNKAWTEALEWPGHKEFAAAPMEDLKIVDNEHTGKKIGQIKTHGNFTFMRLYGGGHMVPMDQPEASLEFFNRWLGGEW

SEQ ID NO: 13234 - protein, 442 aa, Aspergillus nidulans
  unsure (1)..(442): unsure at all Xaa locations
FSXHPGKSIDKSAWEAIKSNWSIAQAVAAQVRDAALIWCMDYHLMLLHEMLPEQIGNTKKIIKIGFFLHTPFPSSEIYRILPVRNELLLGLLHCDLIGFHTYDYTRHFLSACSRLLYVRFYVYSVWHRSXYWFXGTANTPNGIEFQGKIIACGAFPIGIDPEKFKEGLKKEKVQKRIATLEQKFQGVKLMVGVDRLDYIKGVPQKLHALEVFLSDHPEWVGKVVLVQVAVPSRQDVEEYQNLRAVVNELVGRINGKFGXSSSLYAASSFXLXSGTVEFMPIHFLHKSVNFDELIALYAVSDACVVSSTRDGMNLVSYEYIATQEKRHGSLVLSEFAGAAQSLNGSIIVNPWNTEELAAAYHEAVTMSDEQRALNFSKLDKYVNKYTRLVSPFTGPKQNHLANSNXCLLGQSFVTELTRISEQAAGKLPTKETPVNGETSKLE

SEQ ID NO: 13235 - protein, 345 aa, Aspergillus nidulans
  unsure (1)..(345): unsure at all Xaa locations
EDRRQIGVVSASFLIFNRVIGTGIFATPSTILSLSGSVGLSLFMWVAGTLIAVAGTAVYLEWGTAIPKYVCSIQCSKLGLVLTRLGNGGEKNYLEYVYKKPKFLATAMFAAYAVLLGWAASNSVVFGQYILNAAEVEVDRWNQRGIGLACITAAFLIHGFALNWGLRLQNLLGIVKLIIIIFVIVTGWVALAGHTKIETPHNFQNAFEGTTGSGYGVVMALYNVIWSFIGYSNANYVWSHPTLDHCSSXRLQALSETKNPERTLKIAAPVAIGSVGVLYMLCNIDYFAAVPKDQFLALGNIVEAPFFGTCSGSRARRSCLLCGLAGLGTFSLDLFEGRISRTLPK

SEQ ID NO: 13236 - protein, 577 aa, Aspergillus nidulans
HKFLPKGSNMVTRRPIELTLINTPNAQAEYGEFPALGLGKITDFSQIQRTLTDLNLAVPEKDCVSDDPIQLHIYSPNVPDLSLIDLPGYIQVSGHDQPPELKQKIADLCDRYIQPPNVILAISAADVDLANSTALRASRRVDPRGERTIGVITKMDLVDPERGLSILSDKKYPLRLGYVGVVSRIPQTNALFSRGSGNITSAILKNENAYFSAHPAEFGAESGVSVGVSTLQKKLMHVLEQTMASSLAGTRDAISQELEEATYEFKVQYNDRPLSAESYLAESLDGFKHSFKAFAESFGRPQVREMLKAELDQRVMDILAQRYWNRPIDDLTPPMAEPDPLSDLPKADPESLYWHRKLDASTSSLTKLGIGRLATTVVANAIQSHVERLIANSTFAAHPYAQKQIGDACNSILNDRFFSTSDQVENCIKPYKYEIEVEDPEWTKGRENISKTLKEELRACEAALKNVEDSVGKRKLKDVISFIDKVRKGEVILDGDGSGGAGGFSASLIARGYVLLYFNLRPTTNRSPGREGVFLRDRADILKMRLLAIRSKQCATKNNKYYCPEVFLDVVADKLTS

SEQ ID NO: 13237 - protein, 190 aa, Aspergillus nidulans
GKAIASRLARDGYSVCVNDIPSSQAAIEATVSEIKSQSQANVIGIPADVSSASSVSSLVRDTTEKLGPLTLMIANAGVSQVKPLLSVTDEDISSVMSVNFNGVFNCYTAAARQMIAQGDPKAAAGVEVYKILGAASIVAHKPFPTMGIYSASKWAVRGLTQAMAMEMATTKITVNAYAQGIVDTKMWEAI

SEQ ID NO: 13238 - protein, 119 aa, Aspergillus nidulans
  unsure (1)..(119): unsure at all Xaa locations
HRNDPPSSADDDVSRRKTTDIEEWYLQKFMQVDQEMLFEIILVREVMPISLIISIIYXLHXXGRNYLDIKPLLDIGCKTVANMIKGKSPEEIRKTFNIQNDFTPEEEDQIRRENEWAEE

SEQ ID NO: 13239 - protein, 165 aa, Aspergillus nidulans
  unsure (1)..(165): unsure at all Xaa locations
SQTTIFSPEGRLYQVEYALEAISHAGTALGILAKDGIVLAAEKKVTSKLLEQDTSAEKLYTLNEYVLSLGFRIXGVHIGXFACSNMICAVAGMTADANILINYARQAAQRYLITYGEEIPCEQLVRRLCDLKQGYTQHGGLRPFGVSFIYAGYDHLREFQLXQSN

SEQ ID NO: 13240 - protein, 434 aa, Aspergillus nidulans
SKPVESAKPAAPKSWADLVRNKNLARNAASQSAPSGVVNGVSKSQSVADVLLNLGDDVSQYSDKVTFLEPRGLVNTGNMCYMNSVLQILVSCVPFYQFLDHIGKRASHSFHSDFPMVDALIMFMKEFRVIDAARNEEQLRMRLKANELEQYGEAFIPEFVYEVIRQLPRFRDMRRGHQQDAQEFLGFLLEEMHEECARATSANSSTEPASTDSENGDGWLEVGHKQKPAVTRSSGHIASESPITKIFGGKIRSEFRVPGNKASVTLEPYQPLQLDIGAPEIHNIVDALKGLTKPESIQGDFNSSRGPYVTATKQVFIESLPPVLILHLKRFQYDSVTHGTQKIWKKIGYPLDLEIPREVFPPHRRNVMMAQGGLPKYRLTGVIYHHGKNASGGHYTVDVRRQDGREWIRLDDTVIRRIKSEDVAEAGGEEDPKV

SEQ ID NO: 13241 - protein, 343 aa, Aspergillus nidulans
  unsure (1)..(343): unsure at all Xaa locations
MPTVHLLDYVAGNVRSLVNAINKVGYEVEWVRSPSDLKDVEVRKLSSSPLCLVPHYVSVTRKFRLTWGLXKLILPGVGHFGHCLSQLSSGGYLQPIREHIASGKPLMGICVGFQSLFESSEEDPQIPGLGTIPARLRKFDAKTKSVPHIGWNSATDTRIDSTGGQTFYGLSPSSKYYYVHSYAAPYEPGILEKDGWLVATASYGEEKFIGAIARDNIFATQFHPEKSGQAGPTHPSRFLGRSSAPFCHIRRLDLTGEKNGLTRRIIACLDVRTNDVGDLVVTKGDQYDVREKDGADAGGQVRNLGKPVDMAKKYYEQGADEVTFLNITSFRNCPLADLPMLEI

SEQ ID NO: 13242 - protein, 252 aa, Aspergillus nidulans
  unsure (1)..(252): unsure at all Xaa locations
PKTHTQSPAVTGTSVIAVKFNGGVAIAADNLGTVSLLYTFISRPCSDTXSLASYGSLARFTDVKRLRKFGDAAVIGFSGDVSDMQYIDRLLESIDIRENYSVHGNQLNAKNLHTYLSKVFYKRRSDFNPLWNHILVAGFDSEKKPFLSSADLLGTTFSAPHLATGFGAHLAIPILRRLFPEERPIEEISKEDAVSALKDCLKVLWYRDARSMDKYSLALITQEGIEMHEDQQVEAQNWAFAESIKGYGAQAV

SEQ ID NO: 13243 - protein, 277 aa, Aspergillus nidulans
STYRVYLWLILLDIPPLPTDRYLSLIHRGRSPAYTKIRNDTFRTLATDPLFKRRVTEASLIRLLNAVAWKIHDAKNRNNLKTRSSSRRREMELLINTPPSIAEEEPSADDMTPDSMISSNSSTSAVSPGITNETAIYVQGMNVLCAPFLYAARSEVEAFALFHTFITRECPGYIRGAMDGVHRGLNLVDRCLEIVEPKLAAYLFSKGLQAKLYAFPSVLTLCACTPPLPEVLHLWDFLFAYGPHLNILCIVAQLILMRDTLLQKPKVRRVSRYAFPP

SEQ ID NO: 13244 - protein, 231 aa, Aspergillus nidulans
YPTEYLKTRQQLQATAAGVRVSPWRLFTTTIRQHGLSHMYTGSAAFCVSNASKSGVQFFAFETARQLMPTDTSARSTARGIWGAGIIAGAAESILVVTPGETLKTKIIDNEAGAKRYTSARALSGSAVATEGVAGLHRGVVTVTSKQSANAMVRFTSYNFFLRHLQAMSGSDSNNSVIGATVVAGALAGVVTVYATMPFDTLKTRLEALDARQRFNETLDCLKTIRFFEGV

SEQ ID NO: 13245 - protein, 410 aa, Aspergillus nidulans
DFTVLAKAVVKELAGAFGLLIKSVHYPHEVIAARKGSPLVIGVRTSRKMKVDFVDVEYSEDVALPAEQASQNAAIKNSATGLLAPPDKSLLHRSQSRAFLSDDGIPQPAEFFLSSDPSAIIEHTKKVLYLEDDDIAHIHEGQLNIHRLTKDDGTSNVRAIQTIELELQEIMKGKFDHFMQKEIFEQPESVVNTMRGRLDVANKQVTLGGLRQYISTIRRCRRIIFIACGTSYHSCMAVRGVFEELTEIPIAVELASDFLDRQAPVFRDDTCVFVSQSGETADSLMALRYCLERGALTVGIVNVVGSSISLLTHCGVHINAGPEIGVASTKAYTSQFVAMVMFALSLSEDRASKQKRREEIMEGLSKISDQFREILKLNEPIKQMCERFFKNQKSLLLLGRGGQFPTALEG

SEQ ID NO: 13246 - protein, 201 aa, Aspergillus nidulans
SLPSRTIKFEIWDTAGQERFASLAPMYYRNAQAALVVYDVTKPSSLTKAKHWVAELQRQASPGIVIALVGNKLDLTNDGGETPAETEREAGTEGDDADDNQEEQEDNTPGDARKVPTREASTYADEEGLLFFETSAKTGLNVTDVFTAIANAIPESSLKSGRGAGAGTGQTTLGGGGRSTDDSRVNLGDRGAATAKEGCAC

SEQ ID NO: 13247 - protein, 159 aa, Aspergillus nidulans
KQRQFLQAYEYLCHIGEAKEWIEEVIQQQIPPIVQLEEALRDGVTLAEIVQSMYPNRPLRIFRHPRLQYRHSDNIALFFRFLDEVELPELFRFELIDLYEKKNIPKVIHCIHALSWLLFKKGLVDFRMGNLVGQLEFEHHELEQTQKGLDKAGVSMPSF

SEQ ID NO: 13248 - protein, 357 aa, Aspergillus nidulans
YESSLANACGVNLNTRILAFKPPPPESSKPIDLRAQYNRPLKSTKSNSAQFRRRVQTAPERVLDAPGLLDDYYLNLLDWSSGNQVAIGLERNVYVWSADSGSVSCLLETSPDTYISSVKWSGDGAYVGVGLGTGEVQIWDVEEGTKLRSMFGHESRVGVMGWSKHTLSTGARSGLVFNHDVRIAQHKVAELVSHTSEVCGLEWRSDGAQLATGGNDNLVNIWDARSLSAPKFTKTNHRAAVKALSWCPWQLNLLATGGGSYDRHIHFWNTTTGARTNSIDTGSQVTSLRLSNHYREIVSSSGFPDNSLSIWSYPTLVRNIEIPAHETRVLHSCLSPDGQLLATAAADESLKFWKVFE

SEQ ID NO: 13249 - protein, 344 aa, Aspergillus nidulans
LKRKDLFQQHGLIGDKWVSSSGGGTFTVTNPATLETLATLPEMNGADTESAITAAHTAFQSFRKTTARQRATWLRKWHALCVENIDDLALILTVENGKTLAEAKGEVLYAASFLEWFAGEAERVHGEVVPASNANQRILTVKQPLGVAACLAPWNFPIAMITRKVGAALAAGCTTVWKPAGETPLSALAQAVLAREAGFPSGTINVITTLNSVAEVGAALCNSKLVRKLSFTGSTRIGKLLASQCSQNLTKLSLELGGNSPFIVFDDAKVETAVEACILAKFRNSGQTCVTANRIFVQEGIYDRFSAALVEKVKALKVGNGVEEGVIIGPLTHERAVEKAVAHI

SEQ ID NO: 13250 - protein, 241 aa, Aspergillus nidulans
DFKRDAPGPHIVERIEHDPGRSAHIALLRSKETGKLSYILAADGMRAGDVVQSYMAGIPDDLWQSMGGTVDPGVMAARTAWRGNCLPLHMVPVGSLIFNVGLRPGGGGQLCRSAGTFATVISKGVNQVAAADQESKESQAAGEEKKPMTQREKQARERTLQHITIRLSSGEVRLIHKDCCATIGVASNPNKKYAQLGKAGRSRWLNIRPTVRGLAMNAQDHPHGGGRGKSKGNVDPKSPWG

SEQ ID NO: 13251 - protein, 458 aa, Aspergillus nidulans
  unsure (1)..(458): unsure at all Xaa locations
RKSTAFPPHTIISMPALSPTMTAGNIGAWQKKAGDALQPGDVLVEIETDKAQMDFEFQEEGILAKVLKESGEKDVSVGSVGVPFLXPXQDTFANCEISPIAVLVEEGTDVAAFESFSLEDAGGEGAGAAPPKETQETPKEAPKASEPSTPQPAAGAYEPDTSGEKLQPSLDREPAISPAAKALALEKGVPIKALKGTGRGGQITKEDVEKYKPTAAAAAAGPASEDIPLTSMRKTIASRLQQSWNQNPHFFVSTTLSVTKLLKLRQALNASSEGKYKLSVNDFLIKACAAALRKVPQVNSSWTEENGQVVIRQHNSVDISVAVATPVGLITPIVKNAQGLGLSSISNQVKDLGKRARDNKLKPEEYQGGTFTISNMGMNPAVERFTAIINPPQAGILAVGTTRKVARPVETEEGTSVEWDDQIIVTASFDHRVVDGAVGAEWIKELKKVVENPLELLL

SEQ ID NO: 13252 - protein, 340 aa, Aspergillus nidulans
GLSPNVESVTVNKVCASGLKAVVFAAQNIQLGLAEAQIAGGMESMSRVPYYLPRSSQLPPFGEIKLEDGLIKDGLWDVYNQFHMGICAENTAKKYEISREMQDEYAIASYERAQKAWAENKFAEEIAPVTVKSKKGDTVVERDEGYENLRADKLRTLKPAFLRDGTGTVTAGNASTMNDGASALVLANKELAREFGAGKRALARIVSSADAAIDPVDFPVAPAKAVPIALERAGITKDQVAVWEFNEAFAAVIEANKKVSSFRVRLTERLLTGTDLGLEGARVNELGGAISLGHALGSSGSRILTTLLHQLQAGEYGVAAICNGGGAATAVVVQKLDRVD

SEQ ID NO: 13253 - protein, 407 aa, Aspergillus nidulans
RGLRQVLQKSPSDIVILSSLRTPVTRAKKGGFKDAYPEELLAHVLRATLEANPNLDPALIEDVCIGSVLQELGGAKAGRMAQIHAGFPHSVPFHTINRQCSSGLAAISTIGNSIRAGALNIGVGGGMESMTRNYGSRAIPTVLWPELKESPSKDSRDCIMPMGITSENVASRYGISREDQDAFAANSHKKAAAAQNAGLFDSEIVPVKTLSYDAQNPEAPPTEITVTKDDGVRANISVEKMASLKPAFSETGSSTAGNSSQVSDGAAAALLMRRSTATELGLTSSIKARWVGTAVAGCAPDEMGVGPAVAIPKLLQMLDVNISDVGIWELNEAFASQALYCARKLGIDEAKINPKGGAIAIGHPLGATGARQVATLLPELERTGQEIGVVSMCIGTGMGMAGMFVRE

SEQ ID NO: 13254 - protein, 359 aa, Aspergillus nidulans
MASLRSVLKSQSLRHTVRSYSSQTMPPASPFAPRHFLSIADLSPSEFATLVRNASSHKRAIKSGSMPQNLQGSLLGKTVAMIFSKRSTRTRVSTEGAVVQMGGHPMFLGKDDIQLGVNESLYDTSVVISSMVSCIVARVGKHAEVADLAKHSSVPVINALCDSFHPLQAVADFQTIYEAFTPKAHHLSSLGLEGLKIAWVGDANNVLFDMAIAATKMGVDIAVATPKGYEIPPHMLELIKSAGEGVSKPGKLLQTNIPEEAVKDADILVTDTWVSMGQEEEKAQRLKEFDGFQITAELAKRGGAKEGWKFMHCLPRHPEEVSDEVFYSNRSLVFPEAENRLWAAISALEGFVVNKGKIE

SEQ ID NO: 13255 - protein, 319 aa, Aspergillus nidulans
  unsure (1)..(319): unsure at all Xaa locations
NRLPEFSLAGKVVCVSGGARGLGLTQAEALLEAGARVYALDRLEEPVCTPGPLDXNKSXHIAYNSLPISTTIQKRAREELGTELQYRRIDVRDTELLHSTIEAIANAEGRMDGLVAAAGIQQETPALEYTAQDANRMFEVNITGVMMTAHAVAKQMIRFGNGGSIALIASMSGTIANRRKSFISXPPHPHTPGHSPALAPYHCMSLGIVHXHFHVXGLICSAYNASKAAVIQLARNLASEWGQYNIRVNTISPGYIVTAMVEQLFVQYPERRDEWPKHNMLGRLSSPQEYRGATVFLLSDASSFMTGSDLRIDGGHAAW

SEQ ID NO: 13256 - protein, 186 aa, Aspergillus nidulans
  unsure (1)..(186): unsure at all Xaa locations
SVQVQDECITAFNNLRMTGGQKGSKPKFIIFKISDDKKQVVVDETSDDPDYETFLNKLGDAKDANGKPAPRYAVYDVEYDLGGGEGQGIITSTPSWTMCLTDNLCFCRSKIIFISWVPSGTSINVCFCYXTLIIIIXAAHKEQQWSMIYASTREVLKNALNVVTSIHADDKGDLAWKSILAEVSGG

SEQ ID NO: 13257 - protein, 153 aa, Aspergillus nidulans
  unsure (1)..(153): unsure at all Xaa locations
AYSKKFVVVGDGGCGKTCLLISYSQGYFPEVRIVLXANYGILTDAEYVPTVFENYITQTLHRRSGKTVELALWDTAGQEEYDRLRPLSYPETDLLFVCFAIDCPASLENVMDKVRPPTFALGLSNQGQWYPEVLHXCPTTPIILVGLKSDLRN

SEQ ID NO: 13258 - protein, 228 aa, Aspergillus nidulans
HPEVMSHLVHQLGLSPSLGFTDVFSIDEPDLLALVPRPSQALLLVFPVSKSYESSRIAEDSSLPEYTGSGPNEPVMWFKQTIRNACGLIGLLHAVSNGEARKHILPGSDLENLLKEAEKLDPIRRADLLYESKALESAHADAAKLGDTKAPGAEDDVDLHFVAFVKGEDGRLWELDGRRRGPLERGVLGDEEDALSERALELGVRRFLDVEAKGGNPDLRFSLVSLGA

SEQ ID NO: 13259 - protein, 502 aa, Aspergillus nidulans
  unsure (1)..(502): unsure at all Xaa locations
SLVVYGXIMCSGSMDTGIIGPVTTMDSFVEEFGNRSATVHGLLVSSILIPAAISSFFAGYLADKFGRPQGISIGTLIFGLGARLEAGAVHVSMFVLGRCIEGMGEGLYLGTLVVYVEAVMLNARPLSTADRYICEISPPGVRGALTTGPQLLITLGLVVGFFTCYGTARIQSSMSWRTPFLILACLSLLFSAAAFLWLVPSPRWLTIHGRREEANVVWDLLGVSHAEREKSEIEQARGSVIQGPVSQEVAVTNVSSMDLTVATPQVEDKSIRHKLFDIFSKDVRSRTALAVFLMAMQQLSGIDGVLYVSGFSKELDQQLIKSSQYAPLLFEQAGLASADASFFASGVSALVIFAVTIPALIWADKWGRRHSVIYGGVVISLTMFLMGALYAGNAVHSSAGAGRWVVIVSIYIFAVIFSLSWAVGIKIYAAEIQPQRTRASATSLAHGSNWATNFLVALTTPILLDKSSFGAYFLFGGCSLITACGLCYLYAXTKGRSLDEIE

SEQ ID NO: 13260 - protein, 329 aa, Aspergillus nidulans
HQGSVWAVLAYDKNTIITGTPPCTEHGTGANQNPGCADNIIRIFNSSGKLLKRIKDSRDVVRALCKLPPTHPTGANFVSASNDGVIRLFTLQGDLVGELHGHESFIYSLAVLPTGELVSSGEDRTVRIWNETQCVQTITHPAISVWGVAVCPENGDIVTGASDRVTRVFTRAPERQASAEVLQQFETAVRESAIPAQQVGKINKEKLPGPEFLQQKSGTKDGQVQMIREANGSVTAHTWSAALGRWESVGTVVDSAGSSGRKTEYLGQDYDFVFDVDVEDGKPPLKLPYNLSQNPYEAATKFIGDNELPMSYLDQVAQFIVRNTQGATI

SEQ ID NO: 13261 - protein, 62 aa, Aspergillus nidulans
MSSPPFTVKAVFEYVSDHEDDLNFTIGQIITVTGVEDDEWYYGEYLSESGNKVEGIFPKNFV

SEQ ID NO: 13262 - protein, 449 aa, Aspergillus nidulans
  unsure (1)..(449): unsure at all Xaa locations
PTTSAVNSSITGISVSFLQASAAVGALIAGRLGDIVGRKKCVRLGGFIYFFSAFIQMFAPGFATFLAGRTIQGLGVGFLSMTVPIIQTEIASPHSRGLMVGIEYTILIAGYMLSCWVDYGFNFMLPSEMSWKGPFIVQIGLSFILLAMSFFLPETPRWLAKNGFMEESLQTVADLHPMVIRRLSTYNRFHRKSRSRHLRDESRQIYLDGKPTPQLRGXXSXLRQEMFTRYRKRTIVGITVQMFAQLNGINIISFYLPSTLASAGFDNRKSLLFTAANAIPYTAATIATWWLADKWGRKPLLILGGESRAFXRSQAENLTFSLGLGMAVLLGIVCAFTEASLPVQTKADGQYAFVMLYNIVYGFTWGPMPWLLPAEIFPLRGRSKGMALATTSNWVFNFIIGMVSPDAFSGIHGYFYLIIAGFCLFSAGLVYFYYVETANSSLEEIAALF

SEQ ID NO: 13263 - protein, 404 aa, Aspergillus nidulans
  unsure (1)..(404): unsure at all Xaa locations
SVEPLSTGSPVSRYFDATVSADTVSYFAEAGWTVQGTSSLNTPGHLNMTVKQPYGVVACIIPWNVPMAFFAFKVAPALAAGNTVVLKSSEKAPLTVRILKPMPSALIXHTKSALAATLIAEAGFPPGVINILSGFGTPAGSTLASHMDVRCLSFTGSSFTGQRIQAAAAASNMKIVHMELGGKSPALIFEDADLENAAQATQFSIQCLSGQTCMANSRIYVQESVADEFLALFKEKFGSAVLGNPLESGTTHGPQVDGLQYERVKSYITIGEQDGKLSMGGDAGNGYFVKPTVFEGVPEDSRIVKEEVFGPVVVINTFKTEEEAIKKANASEFGLYASVFTKDLDRAVRTSKLLEAGTVGVNTTSPNVAKDMPFGGYKMSGVGREGFMHSLDNFLETKTILIKM

SEQ ID NO: 13264 - protein, 72 aa, Aspergillus nidulans
  unsure (1)..(72): unsure at all Xaa locations
TSALDTYTEQALMQNINSILKEKGXTSVFVAHRLRTIYDCRQILVLKDGQVAELGSHRRLLSLDGIYAKLWS

SEQ ID NO: 13265 - protein, 554 aa, Aspergillus nidulans
  unsure (1)..(554): unsure at all Xaa locations
QGDWGTKLRVGTALSLLVGAKVRLTEWTYYSDSDLPCWTXVLNVEVPFYFKSIVDSMNVDFAAVGGTAYTVAGSMIIACELVDRSQSLRVANPASQMGATRIGATFFQELRNAVFASVAQKAIRKVARNVFEHLLRLDLNFHLSRQTGGLTRAIDRGTKGISFLLTSMVFHVVPTALEISLVCGILVSKPSPXCMSAHLTRATDHQYGIKFAAITATTMLAYSAFTIATTAWRTKFRKQANAADNRGATVAVDSLINYEAVKYFNNEKFEVARYDKALKAYEDASIKVTTSLAFLNSGQNMIFSSALAAMMYLAADGVATGSLTVGDLVMVNQLVFQLSVPLNFLGSVYRELRQSLLDMETLFNLQKVNVNIKEKPDAKPLELKQGGQIRFENVTFGYHPERPILKNASFTIPAGQKFAIVGPSGCGKSTILRLLFRYYDVQEGRILVDGQDIRHVTIESLRKAIGVVPQDTPLFNDTIEHNIRYGRLDASDEEVRKAARRAHIHELVERLPEGYRTAVGERGMMISGGEKQRLAISRLLLKDPQLLFFDEAVS

SEQ ID NO: 13266 - protein, 384 aa, Aspergillus nidulans
  unsure (1)..(384): unsure at all Xaa locations
MPARXRFAPSPTGYLHLGSLRTALYNYLLAKRTNGKFILRIEDTDQVRGAIPHENRTLMDWVHXKRTIPDAEQRLYDDLHWAGLQWDEGTKCCDQPWRGQRXWSCRPIVGGDYGPYRQVSFLGASLLTLLSLPWGLTDCTIQSERTEIHRKYAEKLIQRGHAYRCFCSPERLDAHARHRSQAGLPPGYDRKCASLLPAHSEERAALGESHVIRLRVEDHPYRYPVYDDLVYGETGHKGPPTKLDLIDRVYDDPILIKSDGYPTYHLANVVDDHLMEITHVIRGTVSLKKKKLVGGYXRAXEWMSSTPLHVLLYKCFGWKAPRFAHVPLLVDHSGQKLSKRNADIDLSHFRDQGVFPEPLLNFAALLGWSHKEKNDIFDLKKLEH

SEQ ID NO: 13267 - protein, 267 aa, Aspergillus nidulans
QIDNSLNINKGLRISRQLFVDLTNKGMPIASEMLDTISPQFLADCLSVGAVGARTTESQVHRELASGLSFPVGFKNGTDGSLDVAVDAIGSVKHPHHFLSVTKPGVVAIVGTVGNPDCFVILRGGKKGPNYDAASITEAKEKLIAKGLAPRLMVDCSHGNSQKDHKNQPKVAAVLAEQIAAGETAIMGVMIESNINEGRYLPNLILNLFPLTLNSQRQQKVPPEGKAGLKYGVSITDACINWEDTESTLETLAKAVATRREKLAPSS

SEQ ID NO: 13268 - protein, 209 aa, Aspergillus nidulans
QQPKPQALASKSGPSAILVSTRQKGNPILNHIKFQPWEYADIPADYVIGATTCALFLSLKYHRLHPEYIYSRIKQLAGKYLLRVLLIIVDIPNHEDPLKELSKTSIINNLTLILCWSAPEAAHYLELFKSCEHSQPTAIRTQQAQSYKDSLVEFVTAPRSINKSDAASLISTFGSLQNAINAQPEQISAVPGWGEKKVRAWCNAVREEF

SEQ ID NO: 13269 - protein, 477 aa, Aspergillus nidulans
MIPVINKIVRHHHTHPEERGIFAVVVAPTKELASQIVNEGRKLALGTGVKVTLMKKGMRVVERENEDEDVLDESNSESSESESDERTPNNKNKGPVPITKSDILVSTPLQLVNALSDNKTKPLATLPLVRNLVLDEADVLLDPLFRDQTLDIWRSCTHPELRASLWSATMGSSIEDMAKTTIKERKLSLPQTKSYPLLRLVVGLKDSAIPNIKHKLVYAATEQGKLLGLRQLIHPTAATTSDVRLRPPFLIFTQTIPRAIALHSELLYDIPPEAGGSARIAVLHSDLSDTQRSDIMKGFRKGEIWILVTTDLLARGVDFRGINGVVNYDIPNSPAVYVHRVGRTGRAGREGGVAVTYYTKEDIPYVKSIANIIDVSEKLRGENGERSVQKWLLDALPDLSKKNKKELKKHGVKARQTGLKGATDEKEQRRTRISTKSGFDRRKEYNKKMMIAASQKKTQARKNGADSDSAGDDDDED

SEQ ID NO: 13270 - protein, 695 aa, Aspergillus nidulans
  unsure (1)..(695): unsure at all Xaa locations
KSDRPKTIINFSKSLPAGATRPKSARHLTREDSTSSTASFATPENYKLVKPLPAAFMSTGLISKKNRNADDSHSLLGFSKNMPDTPCKRPVNLFAASQKAQPDGPLGRPAWSNAVDMPPPSPFNPSSARPKQGPFARGMGIFGTNFNRQGASRRGSLASIDGDDGYGLQTQSPSNRQNSQPLSESDFPPTPTKQSFFPSRTYPPTASQIASLERLSEARGTNSSPLHDRFQHESPRTPQEHFCPPDPSGLTISGPNDRQSAQPDFNPLNLPATPTGPRDSFVGKRPSLPLNIHNTPDVDACLTSRFERVELVGTGEFSQVYRVSQPNGVSLPSIFSTTPKSLNSLPDQVWAVKKSKQPYSGLKDRERRIREVDALKALTNYDHIISFADSWEDNGHLYIQTEYCEEGSLDVFLAQVGLKARLDDFRIWKILLELSTVIAHLVYMXLKVYXLXEGPEHIHDSGFIHLDLKPANILVTFEGVLKIADFGMASRWPAEEGIEGEGDREYIGPEILMGRYDKPADIFSLGLIIFEIAGNVELPDNGLSWQKLRNGDMSDVPSLTWSSETTVFRDASGNPISEEPSFEELCASDFGDDDFGTTDLFGSNRERKPVPFTRSSELADPPAFMIDAGHEQSLDKIVRWMISPEPLDRPTADHILESYGVQFVASRRRAGATVYEGNWGPADDVLAEDAEMIDV

SEQ ID NO: 13271 - protein, 300 aa, Aspergillus nidulans
FYAIQRGHKPGVYTNWANAQEQIRGFQKPRYKKFSTREEAEEFCEARRGARSVCDFYRHQTSRGSGLDERYPERSAGQSVRTGRGPFTPRCGGWVRSECDPRSKDPARLSTRHQSRKQLPKHSQKDHPACSVFTTDGSSLRNGRVQAMAGVGVYFGPGDSRFVSFRMSKVYLLTIPSQQKRLEPLKGSRQTNQRAELTAILRALDIAPRHRDVTIVTDSQYAINCVTVWFQKWRSNNWLTADKKPVENKDLVESILSKIDERTELRVKTLFEWVKGHDADPGNEAADRLAVNGAQRGASE

SEQ ID NO: 13272 - protein, 463 aa, Aspergillus nidulans
  unsure (1)..(463): unsure at all Xaa locations
QDVTATKGLEFEDFYIKRELMMGIFEAGFEKPSPIQEETIPVALTGRDILARAKNGTGKTAAFVIPTLERINPKSTKTQALILVPTRELALQTSHVCKTLGKHLGINVMVTTGGTGLMDDIIRLNDAVHILVGTPGRVLDLASKGVADLSECPTFVMDEADKLLSPEFTPVIEQLLSFHPKDRQVMLFSATFPMIVKSFKVSXVSLGTFLFARVLTPSQDRHMRNPYEINLMDELTLRGITQYYAFVEEKQKVHCLNTLFSKLQINQSIIFCNSTNRVELLAKKITELGYSCFYSHARMLQQHRNRVFHDFRNGVCRILVCSDLLTRGIDIQAVNVVINFDFPKNAETYLHRIGRSGRFGHLGLAINLINWDDRFNLYKIEQELGTEIQPIPQNIDKKLYVYDSPDTIPRPISNPPQQSQGATAASNPSDRRHNHHTNGGHYQSKGRGPYRGGRGQGQRRNMQ

SEQ ID NO: 13273 - protein, 275 aa, Aspergillus nidulans
DGTKVVGAGADKAARMLDLAANATAPIQVAAHDAPIRCCHMIPNPAGGTPLLVTGSWDKQVKYWDLRQSTPIASLECQERVYTMDVKDKLLVIGTADRYINIVDLNNPTKFYKTMQSPLKWQTRVVSCFTDANGFAVGSIEGRCAIQYVEDKDSSSNFSFKCHRETPPNQRDINNIYSVNAISFHPVHGTFSTAGADGTFHFWDKDAKHRLKGYPSVGGTISSTAFNRTGNIFAYAVSYDWSKGYSANTPQLPNKVMLHPVAQEEVKPRQNARRR

SEQ ID NO: 13274 - protein, 356 aa, Aspergillus nidulans
  unsure (1)..(356): unsure at all Xaa locations
FESEAVPGTIPHGQNSPRNVRFGLYAEQVTATAFIAPRHCNKKAWLYRARPAVAHEGFVRSNRSIPGRTWCXQCPVQTELPDNKDTECSFLPLNPRIHVSPTQLAWHPFDIEESETDFVAGLKTVAGSGDPTLREGIATHVYTANKSMTKRAFVNSDGEFLIVPQQGALDIQTEFGPLFVQPGEIVVIQRGLRFRVELPDGPSRGYILEIWGSQFELPELGPLGANGLANARDFLYPTAKYEVVKEPWEIIYKLGGKFFKSTQQHSPFDVVAWHGNYVRHALPNLLPSSYGKRNXQLLQVPYKYDLTKFVNVGSISVDHIDPSIFCVLTAKSRDLNAPLADVLIFSPRWDVASRMF

SEQ ID NO: 13275 - protein, 468 aa, Aspergillus nidulans
  unsure (1)..(468): unsure at all Xaa locations
YSPYYKESHRRLQKEARSYIDTHIAPYCDEWEKKGSVPVEVCTQHTLKSLIICIPNVAQVYQRHAALGYTAATPFPLATDYLRGQKLPAGIKAEEWDGFHDLIVIDEIARCGYLGVIWALGCGNSIGGPPVINFGNEEQKNRFLPDMLSGKTRFCLGVTEPDGSYSYLRIVLCCGLIGTAGSDVAGITTTAERRGDKYIVNGAKKWITNGIFADYCTAAVRTGGEGIAGVSALVIPLNASGVTAGRLTTRVSLPAVCMXSTCARTILNXRIHEGSTYIEFDDVEVPVSNLLGEENKGFPIIMNQYALRLPYHQLSCLTWIDFNHERLWLACTSLRMARVCAEDAYRHAITRETFGKKLIENQVIRAKFAAMGRSLDSAYAWMEQLVYMAETAKANHTDAAMGGLFANLKVLAGRTLEMVNREAQQVLGGLGYSKNGRGARIEQISRDVRVMVVGGGSEEILSELAVNQ

SEQ ID NO: 13276 - protein, 339 aa, Aspergillus nidulans
NVLASVKILILFLIIVAGLRALQGDLPQIPDPASSLKSPFTGSSSYVSRYTNALFKILATYQGWSNAAYVLDEVKDPRKVLKIAGVVGVGLVGILYTLTNISYFIVATPDEISKTGVTVVALLIGKVFGDTMLWLTATLAALSSFGNLMTASFTMSRVVREFAREGIVPYSRFFAATTSSGSPSAAILLVFLSSAVMILFIPFGSVFISPWPQRTETEILLIGEVYNFLLDVSQYAIALVNVLVVIALFIIRRKQPHRRTFRAWTPVIYLFLASQVFLLVTPFIPAALDTGRALPPWLYSVVALLVFFGSGVYWFMSWEVLPRRGQFVWTARESVLADG

SEQ ID NO: 13277 - protein, 522 aa, Aspergillus nidulans
  unsure (1)..(522): unsure at all Xaa locations
EHSRGILLYGPKGTGKTTLLGQIRQAGWRRTFDLSSSSIGRNAGDGDQRLRHIFQEAVRYQPSAVIIDQLDFIAPKKQSVDSYSLAPVLCECIESAKSARVLVVGATRHPNDVDDALRTPHRFATEIELQIPTAHDRSEIIAAICGGPSPFLSKALVELIAEKTHGYVGADIFALLQLVCRKARQRQISSNGESHSEVADTISEGVKSLRLDGEPAIGLRIEEGDIILALQETRPTAMREVFLETPKVRWSDIGGQHDIKRRLQKAVERPLKVSAYTRTKCGLWCLLRXFPERMKRLNVKSKKGILLYGPPGCSKTLTVKALATEAGLNFMAVKGAEILSMYVGESERALREVFRKARSARPSIIFFDEIDAIASKRGSSPQSGVNVLTTLLNEMDGIEELKSVLVVAATNKPEVLDPALMRPGRLDNILYIGPPDFEARKEILSIWFCKSIVHPEVKVEELAMMTEGYTGAEIVSICETAGDAALDEEMRVVRNKMFVERHFEYALKQVRRQVTEDVIQDY

SEQ ID NO: 13278 - protein, 606 aa, Aspergillus nidulans
QLIHHLILRSFVVGYALSTADIALWGALRGNRVAIGTIRKETLITLPRWFNFLEELCPWAVAALQALNASAKDKRAAKAKEGASYDIALLNTDKGVVTRFPPEPSGYLHIGHAKAALLNDYFAHEKYKGTLLVRFDDTNPSNEKQEFQDAILEDLALMGIKPDKTSYSSDYFDELQQYAVQIIKDGNAYADDTDKETMASQRMNGEPSKRRDATVEENLARFEEMTKGTEEGARWCIRAKMSVDNPNKAMRDPVIYRCNPAPHHRTGTKYKAYPTYDFCCPIIDSLEGVTHALRTIEYRDRNPQYQWFLDTLKLRNVQIWDFARMNFVRTLLSKRKLTKLVEQGVVDGWSDPRFPTIRGIRRRGMTIPALREFILKQGPSRNIVNLDWTSFWATNKKYIDPVAPRHTAVLKKDAVKATIKGGPDSPYTQDKPKHNKNPDVGTKKVTYSSSILFDQEDAKSFKQDEEITLMNWGNAFVRKIVTDASGVVTELELDLNEKGDFKKTEKKVTWLSTDQDLVPVDLVDFDYLLNKDSMQEEDSLEDVLNPKTEFHEDAVADSNVALLAEGDIIQFERKGYYRLDKVASPGKPAVFFNIPSGKTVNRLTVQ

SEQ ID NO: 13279 - protein, 222 aa, Aspergillus nidulans
FALPKADYILGLPTGQHVALRTTVDGKTVQRSYTPISNNTDRGTIELLIKVYPKGLLTNHLAQMEVGETIEMRGPKGAMKYSAQYAYRIGMIAGGTGSHPMYQLIRAICEDESDNTQVSLLYANNGEADILLREELESFAGRFPHKFKMEYVLSFPDDNWKGYRGFVNGEMIAKHIGSPADDAKVLLCGPPPMVEAMKKTLAGMGWDMPGAIANGTDQVFLF

SEQ ID NO: 13280 - protein, 366 aa, Aspergillus nidulans
MGSLGPYKQKHKVTVVGSGNWYVPAWRLACRISIILVLIAQKGTAIAKIVAENTASNPAVFEKDVQMWVFEEKVEIPKSSKHYDPASSLCQGPQNLTDIINHTHENIKYLPGITLPENLIANPSLVDAVQDSTILVFNLPHQFIINICEQIKGKIVPYARGISCIKGVDVNEEGVHLFSETIGKILGIYCGALSGANIANEVAQEKWSESSIGYDPPHFDSKAPSPPNRSPSASSDNILHFEHKDVSGQLSRVKLQALPSEFPPIGHALLKSLFHRPYFHIGVVSDVAGVSLGGALKNVVAVAAGWVVGKGWGDNAKAAIMRVGLLQMVKFAPQFFGATINTRTFTEESAGVADLIPTCSAHQNFR

SEQ ID NO: 13281 - protein, 251 aa, Aspergillus nidulans
KEEITLQTIKNAIPKHCFNRSLLISSAYVVRDLLYASVLFYFALHIDTLFSSQLLRILAWTAYGFMQGCVGTGIWILAHECGHGAFSPYQTWNDVVGWTLHSLLMVPYFSWKITHARHHRYTNNTERDTAFVPWTEKEYDTRPRYFPAWFEMFEDTPVYNLISLLAHQIAGWQMYLCFYVSAGAKSKPVPQGKQSGWFGGQQSASHFDPGSSLWTENQRHLIAISDLGLLLVTTANWYLAQQVGVLRMVLI

SEQ ID NO: 13282 - protein, 514 aa, Aspergillus nidulans
  unsure (1)..(514): unsure at all Xaa locations
RVLRYARGKCLGGTSARNLMVYHRXVLRKRSTSVSSFNTNHLIVGTQKTYDQWADITGDSSWAWESVLPYFKKSCTLTPPDMTKRNKNSSVTYNADAFDNDLDGPLHVSWPNYGSPFSTYVEVGLEKIGILPGQDTNSGYLNGSAWAAATIDPSAETRSSSKTSFLPQFTLNFNVYAHTLAKKIIFSGTKARSVKVETLGISYTLTAKKEIIVSAGAFQSPQILMVSGIGPKSTLQELGIKVIKDLPGVGQNLWDHALFGVVNRVNVVTASRLVNDAPRRRRSFSQYAFQKGPLTAPGFGVLGWEKLPNDIRKHLTNSTREALSAFPSDWPEVEYLSLDGILDGWHSADDQNLGDGYEYGTIAAALVAPLSRGSVSINSTDTAEPPLIDLGYLTHPADREVAVAALKRARQAFNASGVTIPGVDEHRPGPDIQTDEEILDFIRSTIVPVWHAAGTCAMGNSSNPDAVVDSNGRVIGVQNLRVVDASIFPTLPPGHPQSTCYMVAEKIADNIRNG

SEQ ID NO: 13283 - protein, 289 aa, Aspergillus nidulans
DLTVAVIGCGTYTLNDTRTKLIQLGTLGTAIAAGILDPKDKSGINIKRLIATVGTEPSKQRVRDALSTHESRLTVLTHGGNVRAIQEADVVLLAVKPFKRAEVFCAPGFKEAIRNKLVLSIMAGITTKEFARLAIGDGVVPGILQVVRAMPNMAAKIREAMTLYTPSPGTSPENLSIASWIFGQVGESHQIPEASFDICAVLVGCAGSLLLLAVDGLLDAAVAEGVRRSEVQNLVVNSAIGMLKLVPAGDHPSVLREKIASPGGCSIQALLELERLGARSAFTRAIMAA

SEQ ID NO: 13284 - protein, 338 aa, Aspergillus nidulans
  unsure (1)..(338): unsure at all Xaa locations
STGHSIPAVGLGTWVCGPASYTLNKYCXHSSSQPHGIEKGVEAALRAEYRHIDDATCYLNENRVLEXMEDAPCTLRQEFVGGHLGYLSNSSQELSLPEITRFWNSQHHPDHIGEALDKTLQGLQREYLDXCLVRLTLRTPXPLADGLRDLLGRAFERMXTLKLMESIIKWSCLANISMMTSGXALERVVYSSKVNSIGVTNHTIEEPEKLLSMREIPIAVNKIPSFSXLQQQTYAVVRGQEDFTVAYRPLDITSSMYLGNSLFRWGTSTGLDSYRRYXSYDGEFADPIVQVIAAGLNKDPGIARSRGQCSILQTLLPKGVTSSRIEGNFQCTYRFSVP

SEQ ID NO: 13285 - protein, 484 aa, Aspergillus nidulans
RVNSENNMYVGYRNQKSFRFLGIPYADAPTRFSYATHTLKSSAQSKATEYGSSCAQVAGGSEDCLYLNIQTPYIPKKNSTAGLRPVLFWIHGGNFVAGAGSDPATDGGNLASREDVVVVTFNYRLSTLGFLAVPGTDIQGNQGIADQILALEVVLYRNWNVDSGSADVCSWTIKNIAQFGGDPRRITIAGEGAGARSVKALLGSPLAYGKFQGAIAMSDVRNGAGIKYEHREASYSSYLSVSESYQTAGQKILFEAGCNQDTTEQQISCLRDLPASTLVNLPTIAHHIVQDGKYINTTDLNLSERHAGTAHVPVIFGNVADEGASFIPFSNNIESELEGIQEFLNISTTQALKIIDSNLFPSPNTGNITLDSFAVAQRIATDIKIRCINQAALYAGVSTGVFKPSYYYQVQRTIGGTDPNNLGGPPSSSEYPLGDPDLFYFRLHGSDLPFVFGNLDAARDPLDLFAAQLISSYFAEFVRSGQPN

SEQ ID NO: 13286 - protein, 307 aa, Aspergillus nidulans
LDVPTIRKHAVRLAKAGLVGLVAMGSNGEAVHLTLEEKQTVIRETRSALDEANFTNVPVIAGASENSIRGTIQLTKDLAAAGAEYALIVPPSYYRYATGNDETLYEYFTSVADGSPIPLILYNYPGAVAGIDMDSDLIIRISQHPNIVGTKFTCANTGKLTRVARALHAIKPESPLAPTKSPVPVTKRAANHPYVAFGGIADFTLQTLASGGSAILAGGANVIPKLCVKVFTLWSEGKITKAMEVQSLLSQADWVLTKAAIPGTKSAIQSYYGYGGYPRRPLARLSDAQVEAVAAGIKEAMDVERTL

SEQ ID NO: 13287 - protein, 1234 aa, Aspergillus nidulans
  unsure (1)..(1234): unsure at all Xaa locations
VGIYTDSVLNSYRGKNRLEVPPHVFAVAESAYYNMKSYKDNQCVIISGESGAGKTEAANGIMQYIASVSGGSDSSIQQTKDMVLATNPLLESFGNAKTLRNNNSSRFGKYLELEFNAQGEPVGANITNYLLEKSRVVGQITNERNFHIFYQFAKGAPQKYRGKLQWLXSGIALANLIQDSFGVQQPQSYLYTSRSKCFDVPGVDDVAEFQDTLNAMSVIGMSEAEQDNVFRMLAAILWMGNIQFAEDDSGNAAITDQSVVDFVAYLLEVDAGQVNQALTIRMMETSRGGRRGSVYEVPLNTTQALAVRDALAKAIYFNLFDWIVGRVNQSLTAKGAVANSIGILDIYGFEIFEKNSFEQLCINYVNEKLQQIFIQLTLKAEQDEYEREQITWTPIKYFDNKVVCSLIEDKRPPGVFAALNDACATAHADSGAADNTFVGRLNFLGQNPNFENRQGQFIIKHYAGDVSYAVQGMTDKNKDQLLKDLLNLVQSSSNHFVHTLFPEQVNQDDKRRPPTASDKIKASANDLVATLMKAQPSYIRTIKPNDNKAPKEFNESNVLHQIKYLGLQENVRIRRAGFAYRQTFDKFVERFYLLSPKTSYAGDYTWTGDVETGARQILKDTRIPAEEYQMGITKVFIKTPETLFALEAMRDRYWHNMAIRIQRAWRNYLRYRTECAIRIQRFWRRMNGGLELLKLRDQGHTILGGRKERRRMSILGSRRFLGDYVGISNKGGPGEMIRSGAAISSMYFHEVSGXFFXLFXPLDDVLFSCRGEVLVSKFGRSSKPSPRIFVLVMSLIRCKSSLXHAQTNRHVYIVSQNFVNNQLVISSERTIPIGAIKTVSASSYRDDWFSLVVGGQEPDPLCNCVFKTEFFTHLHNALRGQLNLKIGPEXVPFNLDGGPYXQRXDXINKKPGKLATVKVVKDGSQVDSYKSGTIHTGPGEPPNSVSKPTPRGKQVAARPVTKGKLLRPGGPAVARPNWLPDLYQSVGLYHSPRLKQPRRNRHQRPDPFLNQWQPLQHPIHVLHLLPPQGHHPRLLPHHLQLQGPKKAKALYDFSSDNNGMISISAGQIVEIVSKEGNGQYIFSQIIEHLPNTSQAGGCAXNLETSAQGWTPEAYLEEQVAPTPKPAPPPPPPVAPRASPAPVNGSAAVAAAKAKAAPPPPAKRPNMAGRKTAPAPPPAPRDSAVSMNSQGDSSGASGRGTPSSVSNASLAGGLAEALRARQSAMQGKQDDDDDW

SEQ ID NO: 13288 - protein, 200 aa, Aspergillus nidulans
FTPKPFEETDIEVQITHCGICGSDIHTIRSGWAPADYPCVVGHEIIGTATRIGRAVNNKQNIQPGDRVGIGAQCSSCLRPDCEACADGEESYCPKMVGTYNSRFPDGSKAYGGYANRWRRPGHFVFRIPEQLSSAEAAPLLCGGVTVFAPLRRFGAGPGKRVGIVGIGGLGHMGLLFARALGSDAVVAISRSSSKKSDAI

SEQ ID NO: 13289 - protein, 949 aa, Aspergillus nidulans
FIIRALVDRKLHRSEPRIDRSRSIRELCAAKSTLQNELIGELANEFQTSLPDRAQDVSLADLDAALGEVSLGPTSVSLLQRVFTAKMPARMTVSNVRERLTEIWGLGFHRQTAVLVTALAAEPHSRLTSLEAAYQYWDGLTEAYGQSLGLFLRKAISQQAARSDDQGAQAIAPADSLGSKDLARKQYEALREYLGIRTPTTKQDGLDLADLQQKLDCWTAEFSDDFLSQISRRFDARKTRWYRDWWNSARQELLTICQNSNVQWTDKMREHFVQRAEEGLVEIARAHSLAKPLVPDLIQAISLPPVVRLGRLATMMPRTVVTLKGEIQCEEHEREPSCFVEFFSSWIQANNIRCTIQSNGEDLTSVFINSLVHASQQGVSFANHTYLITGAGPGSIGQHIVRRLLTGGARVIVTTSREPLPAAAFFKELYSKCGNRGSQLHLVPFNQASVVDCERLIGYIYDDLGLDLDAILPFAATSQVGAEIDGLDASNEAAFRLMLVNVLRLVGFVVSQKRRRGISCRPTQVVLPVSPNHGILGGDGLYAESKRGLETLIQRFHSESWKEELSICGVSIGWTRSTGLMAANDLVAETAEKQGRVLTFSVDEMGDLISLLLTPQLATRCEDAPVMADFSGNLSCWRDASAQLAAARASLRERADTARALAQEDEREYRCRRAGSTQEPVDQRVSLHLGFPSLPEYDPLLHPDLVPADAVVVVGFAELGPWGSARIRWEMESRGCLSPAGYVETAWLMNLIRHVDNVNYVGWVDGEDGKPVADADIPKRYGERILSNAGIRSLPSDNREVFQEIVLEQDLPSFETTRENAEALQQRHGDMVQVSTLKNGLCLVQLQHGATIRVPKSIMSPPGVAGQLPTGWSPERYGIPAEIVQQVDPVALVLLCCVAEAFYSAGISDPMEIFEHIHLSELGNFVGSSMGGVVNTRALYHDVCLDKDV

SEQ ID NO: 13290 - protein, 379 aa, Aspergillus nidulans
  unsure (1)..(379): unsure at all Xaa locations
KPKNIAIHTSPVHDLRVVDCEIPRLAPDGCLIHVRATGICGSDVHFWKHGRIGPMVVTGDNGLGHESAGVVLQVGDAVTRFKPGKSHLLLIFWELRRTRAEAHDDRDRVAMECGVPCSKPTCDFCRTGKYHACPDVVFFSTPPHHGTLRRYHAHPEAWLHRLPDHVSFEEGALLEPLTVALAGIDRSGLRLADPLVICGAGPIGLVTLLAANAAGAAPIVITDIDSNRLAKAKELVPRVQPVLVQKQESPQELAGRIVQRLGQEARLVLECTGVESSVHAGIYVGFGTATAFLKKILXRSQCRQTRFGGTVFVIRVGKDFQNIPFMHMSAKEIDLRFQYRYHDIYPKAISLVNAGLVDLKPLVSHRYKLEDGLEAFATA

SEQ ID NO: 13291 - protein, 304 aa, Aspergillus nidulans
GMIRSLYATMLAGGATICCASFDPSLFWDLVETWKPTWYYATPTMHQMILAESEHRPDALRQSLIRFIINAGGGLPATLAVQLREVFQCTVLPSYGMTECAPIVAPPTDYKLEREGTSGRPVGPDVAILDGAGKHAPTGVTGRICVRGFPVFPGYLTEQGVINKDAFDENGWFDTGDLGHLDQDRFLYITGRSKEVINRGGEIISPIEVENGILSAARDPSSILYGRVTEALAFSTPHDVLQEAVGAVIVTPPGKARPDLRQLHEALGERLLQPKWPALLVYMDEGVPKSNNKLQRIRLSQRLG

SEQ ID NO: 13292 - protein, 159 aa, Aspergillus nidulans
TEPKSTLWALDRITFRRILMDSAFQRRRMYEAFLEEVPLLSSLKPYERAKIADALDTIKFPAGEYIIKEGDPGDAFYLLESGEAEAFMEGVEEPVKSYKRGDYFGELALLDDKPRAASVRAKTEVKVAKLGRDGFKRLLGPVENIMRRTEYLLRPFTVT

SEQ ID NO: 13293 - protein, 191 aa, Aspergillus nidulans
  unsure (1)..(191): unsure at all Xaa locations
EMNAKSLRRKIGVVAQEPVLFSGTIAENISYGSPHSTRSEIVAAARKANCQFISDFVSYLISRLYITLILTXPXPDGVDTQVGPRGAQLSGGQKQRIAIARALIKDPDILILDEATSALDAESETLVNSALAALLRGNNTTISIAHRLSTIKRSDSIVVLGNDGTVAEQGTYEELSARPDGAFTKLMEWQL

SEQ ID NO: 13294 - protein, 262 aa, Aspergillus nidulans
  unsure (1)..(262): unsure at all Xaa locations
LTSYLPNXQPPGVGGVGTAFLNQLARLPNAPKLILLARSSQTLLSPTPSYSPTIPAAEWKTAVETPSLTKSGALTPDEIATYLASAPGRSILVDNTSDPALASNYPVFLRKGISVVTPNKKGFSSDLSLWKEIFAAAAEGKALVYHESTVGAGLPVISTLKDLVNTGDEVTRIEGVFSGTLSFLFNTFAPASGSSSAKWSEVVSQAKELGYTEPDPRDDLNGMDVARKLTILARIAGLDVQSPDSFPIESLIPAELTSLPSS

SEQ ID NO: 13295 - protein, 226 aa, Aspergillus nidulans
REARVSLLWVNSLDVQPAVNSLFDDLRVGTILMQAYDKVIPHSVNCRHVNKPPASGQEMMRFKAVENTNYAIELGKHHGFSLVGVQGADITDGQRTLTLGLVWQLMSRDITNTLSSLASRLGKHEITDSEMIKWANDMTRKGGRSSSIRSFKDQSIGSGVFLLDVLNGMKASYVDYDLVTPGQTDEQAYANAKLSISIARKLGATIWLVPEDICQVRSRLVTTFIG

SEQ ID NO: 13296 - protein, 503 aa, Aspergillus nidulans
  unsure (1)..(503): unsure at all Xaa locations
IQERVSRVKKTFLEHKTRDVEFRLVQLRKLYWAXVLXNSPVVSCNCDXPCRXIKDHEQQIVEALRSDLGKPQFETEVSESVWLENDIVFISKNLHKWVKDEKADDIDLTFKFMNPKIRKDPLGTVLVIGCIYPGDRVVLVXQTDSAFNFPFQLTLGPVLGAIAAGNTVVIKPSENAPKSAVVMQQIVEAALDPSCYTIVQGAIPETQALLAERWDKIFFTGGATVGRIIAKAAAPHLTPVVLELGGINPAIISKSANPRLVARRLLWGKLMNAGQVCTSQNYLLVDRSLVPAVVEEFKKAYKEFYPNGAKASPDYARIVNEGAFRRLKGMIDNSQGKILMGGTMDEKDLFIEPTLVQVESPDDSMLVQESFGPLIPILPVDNIDEAINIANSIQSTPLGLYPFGSKADTEKSTSPTIAVKVNYQANYSQFSSQTRSGGVSVNDAALHIPTLPFGGVGETVYGAYRGRASFDVFVHRRPITSSTGWLESILAIRYPPYAGKLAK

SEQ ID NO: 13297 - protein, 207 aa, Aspergillus nidulans
  unsure (1)..(207): unsure at all Xaa locations
REAVFPTRQSLGLMKSKLKGAETGHSLLKRKSEALTKVSLLCLIAKSPILILCRRFRGTPVXFXFPTTSPHQQHXSIPEITRRIDEAKQKMGRVMQVAAFSLAEVSYAVGGDIGYQVQESAKQARFRVRAKQDNVSGVLLPHFESYTEESINDFGLTGLGKGGQQVQRCRETYARAVETLVELASLQTAFVILDEVIKVVTEEVSVI

SEQ ID NO: 13298 - protein, 394 aa, Aspergillus nidulans
  unsure (1)..(394): unsure at all Xaa locations
VEKYRPNTLDDVSGHKDILATINRFVEANVRVXSGIANPIANFISQLPHLLLYGPPGTGKTSTILALARRIYGSKNMRQMVLELNASDDRGIDVVREQIKTFASRSSGSRKWDCRLIKSRRHKQIFSMAPSATGKSSLASFKLIILDEADAMTSTAQMALRRIMEKYTANTRFCIIANYTHKLSPALLSRCTRFRFSPLKEQDIRVLIDQVIEKEDVRIQPEAVDSLVTLSRGDMRRALNVLQACHASSTVSIPSXNSHKALVLTILGKPLPIKNAPQDQAVPEPETITNETIYDCIAAPHPADIQQIVTTLLATSDVTSCLNTLNTLKINKGLALADILSALGEQLYRLEVPAQTRITWLEGLAEIEWRLSAGGSETVQTGGLVGVIRNGCEL

SEQ ID NO: 13299 - protein, 272 aa, Aspergillus nidulans
PSNWDAIYSIVKKMREDNPTAPVDTMGCAELYWRASSPRDRRFQTLIALMLSSQTKDTVTAVAMQRLHTELGEGGAPAIKLETEHAESIVKQEAENGEPAIKQEAKDGVPPANPSHDSTLNLENILAVSPERLNSLIGTVGFHNNKTKYIKKAAEIIRDQYNSDIPSTPAELMKLPGVGPKMAYLCMSAAWGKHEGIGVDVHVHRITNLWGWHKTKTPEETRMSLESWLPKDKWHEINKLLVGLGQTVCLPVGRRCGDCGLAGTKLCKSEIK

SEQ ID NO: 13300 - protein, 167 aa, Aspergillus nidulans
  unsure (1)..(167): unsure at all Xaa locations
SQTTTRLLRELKEYTASPNEALLHLGPTNEDDLFHWEAVLKGVKGTPYEGTLSXISSFRLRPPLLTFMAAHRGLWSLSIQIPSNYPLAPPKIHFTTKISHPNISFTTGEICLTLLTTEHWSPVYTLSSTLTAIHQLLTDPQPDSPLNVDVAALLREGDTPAWESIVR

SEQ ID NO: 13301 - protein, 96 aa, Aspergillus nidulans
  unsure (1)..(96): unsure at all Xaa locations
MSDFARKDFSTSEFTLLXXYRDLDTHEPCRAKEEITPDASKSTQERVKETVTDTTDRISRGVQPDDQKSTTQQAFDKSQRVSDREGHGSTPQSMXV

SEQ ID NO: 13302 - protein, 227 aa, Aspergillus nidulans
NCIHVFDGLHSTIYKSSSESGALVALKITTPHLLEPPHDAHREAQLLREAANEHIIPLLDTLKLDGGRFGLVFPYKKHDLETLFRRDVLTAAQTKSVLRDMFSAIASIHSLGIIHRDIKPSNILLDSPIGPAYLADFGIAWREGSIEAEPADKKITDVGTTCYRPPEVLFGHKGYNTALDLWAAGCVDAEAITVGHKQLFDAGPVGSDLSLIQSIFTTLGTADEQTW

SEQ ID NO: 13303 - protein, 489 aa, Aspergillus nidulans
  unsure (1)..(489): unsure at all Xaa locations
DSCLRGLVVSMFTVGAFCGAAFAGPTGDYLGRRWTIIIGCIVFCLGGGLQTGAQTIEYLYSGRFFAGLGKLCXNFGRRVHLLNXLRVGFLTMIVPLYQAEICHPNIRGRVTALQQFMLGVGALCAAWISYGTYVGFDDTNDAQWQVSLGLQIVPAVFLGLLIMLFPEVRYEPKPVILLLTCMHLVPRWLIDHGRQEEGLKTLARLHAYGDVNDAWVRAEYTQIQEFILREHEEEAKSYLELFQSRSSFRRLFLCCALQASVQMTGVSAIQXVLFGPYLFSVWXVINGLSRTRYYSVTIYAQIGISGDETLRYQAINSIIALIAQFLCMMLIDRFGRRWSLISGNLGNCLTFIIACILLARFPPEVNNTGAHWGFIIMTWLYNFSFSCTCGPLSWIIPAEVFDTRTRSKGVSLATMTSYAFNTMIGQVTPLAMEDVGYRYYYLFIICNFTNAVFFWLLLPETKKLPLEEMNYLFSNAPWIIPGTKKEDYV

SEQ ID NO: 13304 - protein, 634 aa, Aspergillus nidulans
  unsure (1)..(634): unsure at all Xaa locations
IDGRVQLALWLPNSDAIAFVRDNNLYLRKLSSERVVPITKDGGEQLFYGVPDWVYEEEVFSGNSVTWWSEDGSQIAFIRTNESAVPEFPVQYFLSRPSGKKPQPGLENYPEVREIKYPKAGAPNPFVNLQFYDVEQGEVFSVDTPDDFDDDDRLIIEVIWAAKGKVLVRTTNRESDILKVFLVDTESRESKLIRIQDIAELDGGWVEPTQSVRFIPADPDKGRPFDGYLDTVVHEGYDHLAYFTPLDNPEPIMLTSGEWEVVDAPTAVDLTRGLVYFIATKEAPTERHLYRVRLDGSDLTPLTDTSQPGYYSVSFSDGAGYALLSYQGPSIPWQSIISTEGEKTTTLRIIEDNTDLSKLVAQYALPTENYQNITIDGFTLQVVERRPPHFNPARKYPVLFHLYGGPGSQTVDRRFNVDFQSYVAASLGYIVVTVDGRGTGFIGRAARCIIRGNIGHYEAIDQIATAKNWAQKPYVDESRMAIWGWSYGGFMTLKTLEQDAGETFQYGMAVAPVTDWRFYGKALKPTHFLLGPCIVNXPKAQXISVYTERYMHTPQHNPTGYDNTSISDMAALHNNVRFLVIHGASDDNVHIQNTLTLIDKLDLASVQNYDVHFYPDSDHSIFFHNAHTMVYERM

SEQ ID NO: 13305 - protein, 608 aa, Aspergillus nidulans
  unsure (1)..(608): unsure at all Xaa locations
DNRDVLLKDSLYSAIGLAAACLEKNLDFINFLQTTLVPEVQIQEPGYNVLRRRIAILLGQWVPVKSSEMNWESIYQIFQHLLNNQDPLNDLVVRITAGRQLKHILDTFEFTPEGFKPYAPSIFQSLMSLVQEVESSETKMGLLDTVRLAVTRMEDNVRIPFHNIWTSCXCFSKIAPFSDAILALLPPLWESSGEEHLLKQAILTLLGALIYSLKQESVRYHSVILPLIRNSVDPTSVCYIRSFPVMDQLLTINGYHIYLLEDALELWSAILLQTPSPPSPEILSLIPALFPIFESAIDGVGLALQIAESYIILAPQEILSDRIRLPLFTSFESLLQPTLASAAAYVPRLVELAIRGADAVDNGSENTYRVIISSLLDSSLLSSILEGLYSAYESSQTTGPNKKQTSIYGGVETDYFSVLARLALAHPTLFVSGITPAYSNSNISNNSQTPEQAQEHLITWLLTEWFLHYDNIGTATQKKLHALALTQLLTLSGPNTQPPAYILNHLQSYLNVWTDIITELAEGTTEGDPSDPRGGDYLIYWNNAQTGTYEDNEPPENMRRREWESSDIVHKTNIREFVRDGLQSLIVSCGGEQRFQEDWLLNVDRDVV

SEQ ID NO: 13306 - protein, 198 aa, Aspergillus nidulans
GGMATALLTSPLDVLRTRLQSDYYRSQLKSTTTSSHARFSLARSFIQHFSETFEILFSIHRVEGWRSLFRGLGPSLTGVVPATAIKFYAYGNCKRLYPEVFGLDRDATSTHALSAATAGVVTGTATNPIWLVKTRLQLDRTHVNSDGTTRPPQYRNSYDCVKQVIRQEGIKGLYRGLAASYLGVIETTLHLASYERIK

SEQ ID NO: 13307 - protein, 616 aa, Aspergillus nidulans
  unsure (1)..(616): unsure at all Xaa locations
IFGYDTGQISGFLEMDNFKRRFGQRQLDGTYAFNNVRSGLIVSMVSKDILKTTSLNXFEPRXLSIGTLLGALMAGPLADRLGRKWSIAFWCIILHVGLIIQISSPHPKWYQFMMGRFVTGFGVGACSLLGTRSLLLPGLGXWIXIVPLYQGETSPKQIRGAMVWXAVHSRQDILCPRXYLTADSSLLARTNCSLPWVSLLPTAXTMGQRAXATRHPGVFLSEITFLWALLLGIGIIFFPESPRYDFRHGRADKARQTMSKLYGVPQNHRAIIEELTEIREQLEAESSSRGGFHGWIEMFQGPRMFYRITLGIVLQALQQLTGANYFFYYGTSTSVFKAYSHVVPCGYTMXXYFTYMDVAFWSLDQIQIEDASGKRTDPLFXVTTVFNGAGISNVFVTQMILGGVNFGTTFFGLYVVEHFGRRKSLVTGGIWMFVNFMVFASVGHFSLNVEDPSATPGAGKAMVVFACLFITGEIYPILSGWILHCGDTTLICNFRFRDTWGPMIWAIVAELYPSRYRAKAMAMATASNWLWNFLLGMSIIHPCYAVVCXQREIRFFTPFITGDIDFAYGYVFAGCLFAAILIVYFFVLEGKGKTLEEMDMMYVMRVPPWKSSEWVP

SEQ ID NO: 13308 - protein, 353 aa, Aspergillus nidulans
RGEIAVRILQATREACPSIKTYALYTDNDRTHCDIGRPHHALHITPDGYLDIELLVRLVQQHAIDAIHPGYGFLSESAEFARRMQDLGVIVIGPGWEALDRTGDKLRAKQLAVENNVPVLPSLEYDMATPRATGLGKIKSFAHNVGYPVMIKAVDGGGGRGIRLVHRDDDLGHAVRASAAESPSQTVFVEKAAIDGFHHIEIQIVGDGKDVQHLWERDCSVQRRFQKIVEIAPSLIRDRNQELVSRIADAAVRMMKAIRYRSLGTVEFLVNEQLNEFYFLEINPRIQVEHTITEAITGVDLVQTQLLIAQGYFLAQLGLDTCPKARGHCIQLRLCSEDPRANFSLSVGKVMDF

SEQ ID NO: 13309 - protein, 913 aa, Aspergillus nidulans
  unsure (1)..(913): unsure at all Xaa locations
FXPRPNPSRNFDGNWRQPNNQSQGQDQSKGLGQQNSGFQSGHRARASMNQSIGCIGSFQYPGQPQLIQLPQGQVVMAPPQMFGGAQQLNPLQLAQLQALQQSGQLNGQGLGGLQASQHAPQPLSAQQTQQQQQQQRKTLFTPYLPQANLPALLSNGQLVSGVLRVNKKNRSDAYVTTPDLDADIFICGSKDRNRALEGDFVAVELLDVDEVWSQKKEKEEKKKRKDITDARSASNAGTDKMSRSDSTGDRQEVGPDGSIRRRGSLRQRPTQKKNDDVEVEGQSLLLVEEDEISDEQKPLYAGHVVAVIERIAGQMFSGTLGLLRPSSQATKEKQEAERLARDGAHGRHQDRQQDKPKIVWFKPTDKRVPLIAIPTEQAPRDFVEKHQDYANRIFVACIKRWPITSLHSFGTLVEQLGEMGDLKVETEALLRDNNFGSDEFTDAVLKSIGWENWSISSEGDLSSRRDFRQETTFTIEPTGTSELDNAYHFKALPDGKAEIGIHVTDIAHFVKPNSLVDREAKKRDTAVYLVDRLVKMLPPRIATELCALLPGEERLTVSVVFKANPETGAIDDDIWIGKSIIKSSGKLGFDEVESVIKGTSDVPLSGVSVDIIRGLQVKSSHXVQYIRSLWLTLKQRTASKFREARLGNRVSQIPPLRLLHSLDDENVPVESNIFGSSAVRELVEELSCKANFLVARKLVAALPDKAFLRRQQSPNPRRLHSFVDRMNRLGFGFDESSSGSLQSSLCKVKDDDLRKVSHLTQDRPLVIRLYLIDDQGMETIFVKSMQRAKYYVAGTVQDEMRPHYTLNLPVYTHFTNPLRRYADVIVHRQLEAVLSDGAIEFSDDVESLSKTADICNNKKDSAHNAQEQSVHIEACRNMDKLRQEIGGDLISEGIVLCVYESAFDVLIPEYGFE

SEQ ID NO: 13310 - protein, 369 aa, Aspergillus nidulans
  unsure (1)..(369): unsure at all Xaa locations
FPHAVLTSQIVLPMIVTSMILAVQRLRELSNGGHILARWTISYYVLTTLLAIVHSIILLLSSGDGLXRKRVPNRSMWPKKMRRHSLEREETNIPDVVVQMFESLVPLNIVDALATDSLLAVLVTAVVVGYMIDRERSYILKAVEEIETIIMKVIMILIKLAPIGVFFLILPNMFRLDIRDIGQNLGVLIGGALCNLAIHLFIVLPALYFIITRRMPYTFWLRCSPSWTTAWGTASSAATLPLSLRVVRQNGVSNTVSRFTVPLGCLVNMDGTAIYFPLCVVFLAETQGHSLSPTDYVIICLLSTLSSIGTTPIPSSSLVLTVMIAGSVDVEITGMYAVIIAIDWFIDRFRTMTNVSGDLYAAVIIEKLS

SEQ ID NO: 13311 - protein, 408 aa, Aspergillus nidulans
  unsure (1)..(408): unsure at all Xaa locations
DGVWRGKSYIAKAASPLPAGYNDSFADENIXDRSSWFFYQRKVTVPLANDKLFLLFDAANHRARYVDDEFVVEHIGGYTSFEADISHLTTAGNQIHVITIAVSNELNWDTIPPGRIEVFGNGKRKQHYXHDSXLRNYADLSRSTLCSVYDVFIAGVNIVTNVEASNGILKLINNSKHRVVVLDEDSTTVCEQIGGRQEMVIESVRLRQPGMPYLYQLRAEIISEDGESVLNIYEMPLGVRSTKFKGNMFLINTKLFXFTSLEKHKRCPIHGRVFDPAFIHELSLWPGAGANSFHTSHYPYAKGVPEYADRHGTIAINEAAAVGLSLDILPGSLALNLRQGFSPKTCNEAMRRALGEALKELIARDESQTSVVLXALADEPASSEAGTXNHLYSSLTTRSSRPLCFTNM

SEQ ID NO: 13312 - protein, 407 aa, Aspergillus nidulans
  unsure (1)..(407): unsure at all Xaa locations
MTADMETQNEFDDSGLPGPGAPTPLSSLEVRPLPPLLXASISXNYPGMAGLTSRDIKLFVDAGYHTVESIAYTYVPSADXGLLCLRGXXLIYTDRKRLLEQIKGISEQKATKILVEGELYQRSTFFFCNFLXPIPVDSGKLVPMGFTTATEMHARRSELISITTGSKQLDTLLGGGIETGSITEIFAEFRTGKSQICHTLAVTCQLPFDMGGGEGKCLYIDTEGTFRPVRLLAVAQRYGLVGEEVLDNVAYARAYNSDHQLQLLNQASQMMCETRFSLLVVDSATSLYRTDFNGRGELSTRQTHLAKFMRTLQRLADEFGIAVVITNQVVAQVDGGPSAMFNPDPKKPIGGNIIAHASTTRLSLKKGRGETRVCKIYDSPCLPESDCLFAINEDGIGDPSPKDLEND

SEQ ID NO: 13313 - protein, 194 aa, Aspergillus nidulans
YCGVGTGKVYCRDIVEATYRACLYAGVKISGINAEVMPSQWEYQVGPCHGIEMGDHLWISRFLLHRVAEEFGVKISFDPKPIKGDWNGAGLHTNVSTTSTRAEGGIKAIESYMKKLEARHVEHIAVYGEGNEERLTGRHETGNIDKFSYGVADRGGSIRIPRQVAKDGKGYFEDRRPASNADPYQITGIIAETV

SEQ ID NO: 13314 - protein, 614 aa, Aspergillus nidulans
  unsure (1)..(614): unsure at all Xaa locations
PQIAQEFSILKLDLKLGALSQAELVHSLEKSSIASLLDGKIGQSIKHLLSLRDRIEDTSSKVLITGDLNAGKSTFCNALLRRKVLPEDQQPCTSIFCEVLDARENGGLEEVHAVHKDRQYNRNDETTYDVYALSELENIVIDNTKYMQCKVYVKDVRTIDESLLNNGVVDIALIDAPGLNSDSLKTTAVFARQEEIDVVVFVVSAANHFTLSAQDFIWNAAHEKAYMFMVVNGFDQIRDKQRCQRMILDQIKKLSPRTYKEAAELVHFVSSNAVPVAPQIPVAGPGGGGGGGGGGSDPNGNDWPSGDDDEDKPEDKKGKGKEKEKEKIQDFENLESSLRRFVLEKRSRSKLAPARTYLLNLLADINALAAVNRDVADKELQNVMKELADLEPAYENGKKKKIQLQEEVDKCIDDSCEDVYKHTRTTLTSAIANVSEANLGVEYPGIFSAFQYAEDLKFAMLEHISASVAGCEDYARTKTAQGVGFIQNLGLLHIGEDKFTAPTFRADLMFRRGRRHALARQVDTEVELLDFFDITGLWERQEKLAGTGMAMTAVTVLGGRAFGGISWLDSAFSAAKFLGPNHMRRLLLPGIVAAGKFTFCLFVIIVSXLAQLPL

SEQ ID NO: 13315 - protein, 208 aa, Aspergillus nidulans
  unsure (1)..(208): unsure at all Xaa locations
RKQWRKDHPFAFYAKPHRTAQGVLDMKRWECGIPGKKGTIWEGGLFKLDVTFPDGAWQLYKSSKRSCXLTVLFQEYPTKPPKCMFLSSRSYSQISFTRMSQDSXIEYRLLRSXCCCAVLGXLYVIMNRQFVPALFHPNVYPSGTVCLSILNEDEAWKPAITIKQILLGIQDLLDDPNPESPAQAEAYNMYKKDRAAYEKRVKQVVKEN

SEQ ID NO: 13316 - protein, 468 aa, Aspergillus nidulans
  unsure (1)..(468): unsure at all Xaa locations
DVVIVGAGVLGCALAVALGRQGRSVLLLEQSLKEPDRIVGELLQPGGVSALEQLGLRDCLEDIDAIPTNGYYVTYLGKPVKIPYPSQSPGAPPPEGRSFHHGRFVMKLREAAGACPNVTIVETKVTDLITSSHSKQVLGVECVTKESKDCYFGQITVVADGYASKFRKQYHPYTPKVRSKFWGLELIDAELPQPHYGHVLLEPERPPILIYQIGTHETRILCDIPENLPSASVKNGGVKGHLRNVVLPSLPKCVQPSFAAALDKGQLRSMPNSFLPSAPNKTPGLIVLGDALNMRHPLTGGGMTVALNDVVILRDLLSPEKVPRLSDTRLVLKKLSTFHWRRKMGASVINILAQALYSLFAADGKPLPSXSIHYRTKYXPLADDNLKALQRGCFQYFSMGMYETPVSLLGGMLKKPEVLFAHFFTVAFLSLWMIIRDSPLYKLPLALIRCALVFWTACVVIFPYMLIE

SEQ ID NO: 13317 - protein, 620 aa, Aspergillus nidulans
FLLNLDAGKVYWDPSNPAKRFYIDDVKEIRVGADARNYREEHQVSQDAENRWFTIVIADAERSKGRPVKTIHLIAPNERLLKLWTTTLEYISRYRVGLMAGLAASNQNESVLKAHWQREMTRLFPNGMKAGDTETLDFAAVESVCQSLHINCSQNMLRAHFLKADTGKHGKLNFDEFKDFVTRLRERRDVREIFRSHADDHREGLTLEEFLIFLRDVQKEDIDSDRAYWISVFDKLVRKSKSRTQSPTGTSSEDQSSRMSLDAFSSFLASARNGVYASRSPQSRFDRPLNEYFISSSHNTYLLGRQVAGSSSTEAYISALTQGCRCIEIDCWDGADGRPIVSHGRTMTTSVLFADCITVINRYAFFSSEFPLVISLEVHCNPEQQIAMVKIMKETFGEKLILEPLSNSFVLPSPEELKRRILIKVKTCDETENIRQDPITSFHGRSRSSSSPFIRPSMSDGPTLPNLPSLSSPPTIGADCPGPFLVPERRSLTTTSISSATEDSDGGLVSVRKERRRRQKSKITKPLSDLGVYTRGYKWHSFASAESQAFNHVYSFAERSFESICREPSNKALFEKHNSKYLTRVYPSGFRLRSSNFDPLKFWRRGVQMRALNWQTYDIG

SEQ ID NO: 13318 - protein, 249 aa, Aspergillus nidulans
  unsure (1)..(249): unsure at all Xaa locations
DVSDRYNHTARTFDADVELSEKLMRLGAKRRDLVRQARGNVLEVSCGTGRNLEYYELGEKRGIIDEKSQVGVRGCRTVTFVDLSPEMVAIARAKFEKLYPGFIGSEKVQFRAQDARDVPPPSLSASGSVLPSESQGQGQGKGQGYYDTIVQTMGLCSMPDPAGALRHLGTITEPQHGRILLLEHGRSHYDWLNRVLDNLAPAHADRHGCWWNRDIGQIVRDSGLEIVEEERYHFGTTWRFVLRPKRTXK

SEQ ID NO: 13319 - protein, 153 aa, Aspergillus nidulans
  unsure (1)..(153): unsure at all Xaa locations
ATSDAAARLAPAQLREIREAFQVLDRDNDGFVDKDDVADVLSNVGMWSFCSRARRSXNPFLIAVMMAGLDSSSLSQFFPPGSASTINFPTFLNTLSQLLSPLSSRQELLNALAAFDEDDSGQIDVEELRDALLHTAPEDGERPLTEREVNEVL

SEQ ID NO: 13320 - protein, 274 aa, Aspergillus nidulans
  unsure (1)..(274): unsure at all Xaa locations
SLLVAQFVQNVWIESYDPTIEDSYRKHIEVDVSQSCPAPAFVDADIKXGRQCILEMYVRXLSTGPRGLGECXPLMATVLDTAGTEQFSSSARPLAAVSLLANAFLAAMRXPDTLFWLAXXYRRHVDFGLTQFRELYMKQGQGFLLVFSITSMSSLNELAELREQIVRIKDDENVPIVIVGNKSDLEEDRAVPRARAFSLSQSWGSAPYYETSARRRANVNEVFIDLCRQIIRKDAQGRSEDYELAPRKRENTSRQERKRGKRREPKRKGPCVIL

SEQ ID NO: 13321 - protein, 384 aa, Aspergillus nidulans
TMASPSLKRSAGDLANPAVESKRPKTNGSITSFFGAPKPKENGAATTKSAVPSSVSSFNKQKWVATLTPEQKELLRLEIDTMDESWLAHLKEELIKPEFLALKRFLQKEKQMGVKVFPPEEDIYSWFERDSNPVAVYELTLGCLGSRHTPLHKVKVVVIGQVKLQKGICFVASLTWYMLSHRDPYHNYNQAHGLAFSVRPPTAAPPSLVNIYASIKNDYPSFVPPPNKGGLLIPWAERGVLLLNTCLTVRAHQAASHSNKGWERLTQKAIDVVTRVRTRGVVFLAWGTPAGKRITGINRDRHCILQSVHPSPLSAHRGFVSFSFPPGYFALKLVGLTCYTVKQSTFKKCNDWLAERYGPDEIIDWSLVSKQEASPASAVVQSSS

SEQ ID NO: 13322 - protein, 316 aa, Aspergillus nidulans
  unsure (1)..(316): unsure at all Xaa locations
VSGGTSGCVVAGRLAENKDVRILLLEAGQHNRDLENVHMAGGWSNNFDSETDWNLITKPMAGVDNRQVKLSRGRFLGGSSGCNGTLCIRGSKQDYDDWGLEGWSGDEFFEAMKKVPLPFFWLSSSPHSIDETCXRSQSETFHGKPWFKADESAHGYSGPLHTEPHDLAPIADRLIDSFVDQGLPLHHDMFSTGDVPHGCGHVPRTVYKGVRTTSADFITKEYDRTNITIQTDATVDRIIIERKDDGLRAVGALTRSADGTSKAYYARREVIVSGGAYCSPAILMRSGIGARDELAQFGIDCLVDLPGVGKNLMDHL

SEQ ID NO: 13323 - protein, 412 aa, Aspergillus nidulans
  unsure (1)..(412): unsure at all Xaa locations
NVSPVPPDEIFALNRAYIDDDFPQKVNLGVGVYRTNEGQPWPLPVVEEAEKQLAAENSVFRHEYTAIEGDRAFLPLARDLMFGFDGQATSDAKQEAAKARIGTVQTVAGTGANHLGALFLATHMKPRNVWLSNPSWANHLTIWELAGVPRKTYPYYSAATRSFDFDGMISTLESEAQEGDVILLHACAHNPTGLDPNKEQWKAIIDLCERKRIFPFFDSAYQGFASGSVDEDAWAVRYVLNEKPQMEMCVAQSFSKNFGLYGQRVGAFHYVLNEGAEDLRDTVVNNLCHLIRGEYSMGPTAGCNIVKKVLTSPELTAKWHQDLKVMSSRIISMREALYNELVRLKTPGTWKHIVEQVPCPNRNYSIPTVSGCXHSTQNGMFSYTGLTPSQVYALKDKFHIYLLKSGRASISG

SEQ ID NO: 13324 - protein, 293 aa, Aspergillus nidulans
  unsure (1)..(293): unsure at all Xaa locations
SIGIRCKDGVVLAVEKIITSKLLKPGANKRISTVDRHVGIVSRHRLSKIIERPNCLYXHGFLXLIGLSGLAPDGRHFVSRARDEASSWRGIYKSPIPVSALANRLGGYVQAYTLYSSVRPFGVTSIVGGWDSEAELAVDGQVGSGPQSGSGGKVEGAKSGGPGLYMIEPSGLYWVMLSQIALDVLRTLISFQGYYGAATGKGRQAAKAELEKLDLASEKLSLQDAVKEAARIIYVAHEDNKDKEFELEMSWISSLNGPTKGRHEEVPKELLEEAERAAKRALEGDDEEEEDGS

SEQ ID NO: 13325 - protein, 506 aa, Aspergillus nidulans
  unsure (1)..(506): unsure at all Xaa locations
LASYDTGTISGILAMPYWAQTFSTGYRDSTGQLNVTSSQSSAIVSILSAGTFFGALGAAPVGDIIGRRWGLIASNGVFVLGVVLQTIATSIPPFLAGRFFAGLGVGLISALGEPHCLIHYYTCRVLMNSALVPLYQSETAPKWIRGFIVGSYQFSITIGLLLASVLNNATHHRNDSGSYRIPIAVQFAWSIILVGGMLILPETPRYLIKRDDTKAAALSLSKLRRLPQDHESIRQELSEIQANHQFEVSLGKSGYAECFRGSLLKRLLTGCGLQALQQLTGINFIFYYGTQFFKNSGFKNEFVITLITNCVNVGSTIPGLYAIDKWGRRPVLLTGAIGMAVSQLLVAVLGTTTTGQDAQGNIIVHNAAAQKAAIAFICLYIFFFAASWGPIAWYRFSPTPSLIQHTRRTNXQWSXSNRVVTGEIFPLKTRAKSLSMTTATNWLLNWALSFATPYLVNYGDGNANLQSKIFFIWFGCCFLCIGFVYFMIYETKGLTLEEVDELYLEV

SEQ ID NO: 13326 - protein, 299 aa, Aspergillus nidulans
LQSSKLAFIGGGNMASAIIGGLLSQGINKQNITVSEPWEVNRNKIADLGVKTTTSNVVAGGEADLVIIAVKPQVTKAVCEELADAWSKRETLPVVVSIAAGITLGSLQQWLKTSDGRTTHLVRVMPNTPALVGEGASGLFASADVTAEEKELVNALLGSVSKATEWVDKEELIDVVTGLSGMLFLLLPLVWSIVVLTRPGSGPAYFFAMVEHLIASATALGLPAEQATRLAAQTCLGAGKMLTESSDSPTQLRKNVTSPNGTTHAALETFNAQHFDQVVDKAVKAATSRAAELGNTLGK

SEQ ID NO: 13327 - protein, 455 aa, Aspergillus nidulans
  unsure (1)..(455): unsure at all Xaa locations
LLLSKAPPDYGSDVVLRFRVQGLDEAEALTEATNILFLDVWASTTEFVDIRLAEGSCTCEASPXRPRCXPSQIPSLLGLLPDSLQTAYVPLIDNLPEAISATYPARRSLGLNDQFMPSPSTRAPDLFFEDYQPLSVITPWMQLMASMFSSHARMINVGVSYEGRQIPALRLGRSSQPGESRPMILIVGGNHAREWISTSTVAYIAYNLMTRYGSSAAVTSLLQDYDWVLVPTVNPDGYVYTWDSDRLWRKNRQPTSFRFCPGIDLDRSWSFEWDGNQTQTNPCSENYAGEEPFEGVEAQQLAEWALNETEHNNARFVGFLDFHSYAQQILYPYTYSCSSVPPTLESLEELGLGLAKVIRLTTHEIYDVTSACEGVVIPASGDKSAKSLFPVGGSSGGSGLDWFYHQLRTRYAYQIKLRDRGSYGFLLPSEYIVPTGTEAFNAVLKLGQFLTEQDY

SEQ ID NO: 13328 - protein, 500 aa, Aspergillus nidulans
YLVMCGLGEMATWLPRSSGFTGYAVRFCDPALGFALGYTYVANDSIRAQWLLTAILQILFKYIIVTPNQLTAAALVIQYWLPADKVNPGVWITVFLVLIVFINYFGVGFFGEFEFWLSSFKVVVIVGLILLSFILMLGGGPDHDRKGFRYWKDPGAFNSYIDMGPDGNGSAAGRFYAFWATLVSATFAYLGTELVGVTVGEAQNPRKTIPRAIKLTFYRIIFFYVISVLLVGTLVPYDSSELKQANSASTSSAASPFVLAIQLSGIPALPHILNACILAFVFSAANSDLYIATRTIYGLAKEGKAPKILTKTDRRGVPFVALGLCTLIALIAYMNVSSSSKTVFKYFVDLVSQFGLLSWISLLVTHICFVKARKAQEIPKNELAYTAPLGVWGSYFALFWCIVVSLTKSFDVFTGDTFNYKTFITSYLGIPLYLILIFGYKFTTRCKRVLPHEADLYTDKDAIDREEAAYLARQEAKRAAQGANHKQANWFYKTFVSWLF

SEQ ID NO: 13329 - protein, 320 aa, Aspergillus nidulans
  unsure (1)..(320): unsure at all Xaa locations
FRQQYRVLQQLGKGHFATVYLCVERTTGAKFAVKVFEKRADSKSQNDALMQEIGLLMSVSHPNLLCLKDTFDESDGVYLVLELAPEGELFNMIIRKQKFTEKETRHIFRQLFEGLKYLVCPVPYMGCSYYDSNVDSHDRGIVHRDIKPENILVADNKLTVKLGDFGLAKIIGEDSFTTTLYVLPKVXLEVQITDQILRPDVAHQVVSTYEFIVNDAHSPDVAPEILQESRRRKYTKAVDIWSLGVVLYICLCGFPPFSDELYTPENPYTLAQQIKLGRFDYPSPYWDSVGDPALDLIDRMLTVDVDKRITVDECLQHPWL

SEQ ID NO: 13330 - protein, 439 aa, Aspergillus nidulans
  unsure (1)..(439): unsure at all Xaa locations
LIINNESVITDNVVEVHNPATGELLHRCAGASVDDANRAVAAAKAAFPIWSKTHPYERRAILSKAADIMFSRKEEFIKTQMEETGAGRMFVEVTFMASVSFLRDFAGMIPSVEGRAPIVAEEGQSALVIKQPYGVVLGIAPWYVCFFWKEAVSLTNVRLQNAPFILGTRSVALPLAAGNTTILKGSELSPKCFWLIGDVLREAGLPAGCLNVIYHKTSDAPAVTNALIAHPDVRKISFTGSTLVGSIIASTAGKYIKPVLLELGGKASAIVLDDADLEKAAMGCTLGAFLNVSNSFNGHSSRKPGECXHQPLVGQICMSTERIVVQRPVAEKFQKLLVETSEKIFGKNAPAPVLVATAAVKKNQGLVADAIDKGASVVFGDPKESEPCANALRPVIVGGVTKEMDLYATESFGPTVSLIVVDSEEEAIKVANDTEYGLT

SEQ ID NO: 13331 - protein, 175 aa, Aspergillus nidulans
  unsure (1)..(175): unsure at all Xaa locations
QTCLLISYTTNAFPGEYIPTVSVTALLLSLXRNEPLLTGYHRFDNYTASVMVDGRPISLGLWDTAGQEDYDRLRPLSYPQTDVFLICFSIVSPPSFDNVKSKVYPHPLRNALXYIILQTICCXLRCSWFPEIEHHAPNVPIILVGTKLDLRDDPEQLESLRMRKQEPVTYEQALA

SEQ ID NO: 13332 - protein, 430 aa, Aspergillus nidulans
  unsure (1)..(430): unsure at all Xaa locations
STQAWKVLSQTLPSRGPDVDAWWQLTGRHLAVLLDAAAYPIEKQYECLLYHYHYAVCLTTSVYKVTDXLEVVXAPYLGPAPREGASPPTWKSMLQLDGTPFEFSWKWNNPGGEPDVRFGLEPIGPMAGTSLDPLNHLAMREILYKLSSAVPGSDLTWTHHFLATLFDHDYAKYTQKAATMGSSIGTSLVYSLEFQRKSTGLKTYFHPRKLDQQAFLDIPSWEASFRGLHPNSPSRTAVHEFLSTNPEGKLLKPFCLSVDNCSPAKARIKWYFNSPHTNFRAIREIMTLGGRIADTETRTKQFSELFNLLKTVTRGARXFPRDFRVSIRPQQRRQHNPQLRDAPDMLKGCVYFFDIAPGRNLPAIKVYFPVRNHCRNDLAVTQNLNRWLESRGRGQYGAAFGRALETIADYRRLEDSGGLLSFLSCQFMED

SEQ ID NO: 13333 - protein, 261 aa, Aspergillus nidulans
  unsure (1)..(261): unsure at all Xaa locations
KXXXQTFTLPSSPGRTYNIAGMTKGAGMIHPNMATLLGVIATDATIVPSALQSLLKTSVARSFNAISVDGDTSTNDTVAILANGAADGAPINSTQNDDYVVMQNILTSFLQSLSQLVVRDGEGATKFVTVRIQNSPDYPYAQLIASTIARSPLVKTALYDRDANWGRILCAIGYTQGVAPGTVVPERTSVTFKPADGSPVLKLHVNGEPQQVYEERASAILPDGDVQIIVPLGAGNKGELKCXEGVSWFIDFTHSYVTING

SEQ ID NO: 13334 - protein, 159 aa, Aspergillus nidulans
DVPLILQFIRELADSKKALQEVEATEKSLLATLSFPDDTPKRGSVYTALITPPATPENPSPKPVGMALFFYNYSTWRAAPGIYLEDLYVQPAARGKGYGFKLLKWLAAKVLEIRGRRLEWSVLTWNEPSIKFYKQVGAKAMDEWLKMMVEGEALERLAE

SEQ ID NO: 13335 - protein, 197 aa, Aspergillus nidulans
  unsure (1)..(197): unsure at all Xaa locations
DCFRRTTQAEGVVSLWRGNTANVIRYFPTQALNFAFRDTYKSMFAYKKDRDGYAKWMAGNLASGGVCISLFYLXCSRXLLLDAGATSLLFVYSLDYARTRLANDAKSTKGGGERQFNGLIDVYKKTLASDGIVGLYRGFGPSVLGIVVYRGLYFGMYDSLKPVVLTGALEGSFLVSFLLGWGVTTGAGIASYPLDTV

SEQ ID NO: 13336 - protein, 269 aa, Aspergillus nidulans
  unsure (1)..(269): unsure at all Xaa locations
PRKPGMTRDGKEDDCENLRIGTDLLMTDLFNTNASIVRDLAKAAAKASPEANILVISNPCMRHRNSETWNSCXFFQVNSTVPIVSEVFKAAGVYNPKRLFGVTTLDVVRASRFISQVQGTDPSKEAVPVVGGHSGVTIVPLLSQSNHPNIDGKTRDELVHRIQFGGDEVVKAKDGAGSATLSMAMAGARFAESLLRAAQGEKGVVEPTFVESPLYKDQGVNFFASKVELGPNGAEKINPVGEVNEFEQKLLEACLVDLKKNIQKGIDFV

SEQ ID NO: 13337 - protein, 330 aa, Aspergillus nidulans
VQIVDARNLLLFRSEDLETYVKEIDPKKRNLLLVNKADMLTDNKREMWADYFERNQIEFRFFSAQMAKEANEARENEGEDEDTKSLTEGTENLNLQESKEKEADGGVDLPSGTKAPSPKRTNILDVDELEELFLSNAPDATKDDEDEQDGDSKPRKTVIGLVGYPNVGKSSTINALLGAKKVSVSSTPGKTKHFQTLYLSPEIMLCDCPGLVFPNFASTKAELVVNGVLPIDQQREFTGPAALVAKRIPKHFLEDVYGVTIHTRPIEEGGTGEPTAHDLLRAYARARGFATTGQGQPDESRAARYILKDYVNGKLLFCHPPPANEAEGEE

SEQ ID NO: 13338 - protein, 451 aa, Aspergillus nidulans
  unsure (1)..(451): unsure at all Xaa locations
RDSLDVRIYDPFRQGGEAYLGSADMEVKFAGKLRPDTLYDQDELLNSVIKVRVTLSXLSTAXLMVSNFESQIFAPGQPVLMDHHGVPLQLTVKTILRVSLTSEKDTSKVPETEPTARGILTKHTLINFFKDPQSEIQIKPAKNRPAANAIIQPDFNTEKMGIGGLDSEFHTIFRRAFASRIFPPDIVQKLGIQHVKGILLFGPPGTGKTLLARQIGKMLNAREPKIINGPEVLNKFVGQSEENIRKLFADAEQEYKEKGDESGLHIIIFDELDAVCKQRGSGAGGGTGVGDSVVNQLLSKMDGVDQLNNILLIGMTNRKDMIDDALLRPGRLEVHVEISLPDEAGRAQILGIHTQNMRQSDLMDPSVNLSELATLTKNYSGAEIAGLVKAATSFAFNRHIDSGKTVRVKDDAAEMKVNHSDFIHALDEIQPAFGVSEDEIKRCIEHKIINY

SEQ ID NO: 13339 - protein, 324 aa, Aspergillus nidulans
  unsure (1)..(324): unsure at all Xaa locations
NRLLKYLSTNGGIIVHHVDTTNPDKVKEVLTDKTAMVVLKTPTNPLIKIVDIPTIAAASHEANPNCLVIVDNTMMSPLLLSPLELGADVVYESGTKYLSGHHDVMAGVIAVNDPALGERLYFPINASGCGLSPFDSWLLMRGVKTLKVRMDQQQANAQRIAEFLESHGFKVRYPGLRSHPQYDLHHSMARGAGAVLSFETGDVSVSERIVANAKLWGYQRXLWLVNSLISLPCRMSHASIDAKTRKERAMPEDLIRLCVGIEDVDDLIDDLRRAVSVSTRNRVFWVMLIFSSWYKLALSTSLWTALKRTRRSLRSQVMKEYGYG

SEQ ID NO: 13340 - protein, 406 aa, Aspergillus nidulans
  unsure (1)..(406): unsure at all Xaa locations
RTQVLSTVTAIYDIGCFFGAIAAFTCGERLGRKKAILLGTTIMAIGTIIKASSYSLAQMFVGRIVLGYAIYASLEFKTVXYXDSGVQIGNGINTTTAPVWQTETAHHKWRGKLVIFELVMNIAGFSLVNWINYGLSFRGGAVAWRFPIAFQFVFIVILFATVPWLPESPRYACIRVSVSFLEPRLTIFRWLMEQGREKEAVEILAAIEDKPVTDSYILTQRNEIRFSVQYERENAPTWTELFLRKKGTNDTKSLRRLLLGAGTQFMQQFEGINIMSYYMPLILINAVGLSESMARLLSACNSVSYLLFTCLAVPLVERWGRRGLMLFSTAGQGFSFLVITILLRYAETSPDKEKIASASIAFFFLYFISFGMGMLGVPWLYPTEINSLPMRNKGAAVATATNWMTN

SEQ ID NO: 13341 - protein, 440 aa, Aspergillus nidulans
  unsure (1)..(440): unsure at all Xaa locations
FKSGKTKEIAWRKWQLKQIWWLVDDNEALIQEALKKDMNRHPFETTFTECANVKGDVIEHLKNIDKWTADQKPSAGMLGLMLRPTVRPEPLGVALIIGPWNFPFSLLVQPLIAAITAGCAALLKPSEVTSSVQQLFVDLVPKYLDTSAVRVVTGGPAETGCLLQRKFDHIFFTGSVPVARHIAAAAAKHLTPTVLELGGQCPAIVTSSADVDAARKDIAWIKYLNAGQICLSVNHVFAHPSVERELIERMAFWLDRFYKGEKDAMTHIVNDKNYARIKQLAEKTKGKIELDGTADAETRSLPVSIVSNVEMSDPLLSEELFGTVCPVIKGSTDDAIKSINRYLAXPATLHMLTDXPAPTLALYIFSQDQNEVEHSKSPSLPWFTCTHSSVISSTLSGGVCVNGVLVHAMVPNAPFGGVGDSGHGAYHGEYGFKSFTHYRT

SEQ ID NO: 13342 - protein, 315 aa, Aspergillus nidulans
LSAHVICPECKEMPPNLEFPGSHETVCGSCGLVLADREIDMHSEWRTFSNDDQNNDDPSRVGDATNPLLNGDQLETQIASGGSGRVRDLYRAQNKQSSDKANKSLLAAYKEIGALCDGFGIPKNVADTAKYLFKIVDDAKAFKGKSQDVIIAGCIFIACRKCKVPRTFTEIFAVTKVSRKEIGRIYKALEKFFTSQNLERANAVVSNGGVPDPNDTYTATTSTKPSDLCSRFCNLLDLPFQVTSVSSALSDRVTTEGNLAGRSPLSIVAACIYMASYLMGHPKSAKEISQVAHVSDGTIRGAYKQLYTERESWVD

SEQ ID NO: 13343 - protein, 369 aa, Aspergillus nidulans
  unsure (1)..(369): unsure at all Xaa locations
GTSGLVAANRLELSNVTVAVIEAGGSVLNNFNITYVEGHSLAFDTDIDWAYQTEEHIYAGDLKQTIRAGKAIGGTSTINGNCNHTFSIRNICVXFNLPQEYPYTRAEDIQIDNWELVGNKGWNWKSLFSYHRESEGFEVPAQDLIAHGASYDADYQGRNGPVKVGWPTAMTNSIVFPVLKETFEHLGVHYNRDSGGGRMVGFTVHPDTVDREANVRMDATRAYFWPYKSRPNLKIISNTQANRIIKANTTHGEISAIGVEVTGPQGVGMIYASKEVILSAGALRSPALLELSGVGSPDILRKYSIPVKVNLPTVGENLQDQMNNVLTWESKNYLTGLATFSALLSVNQLYGTKFSEVAAFVQANLASYA

SEQ ID NO: 13344 - protein, 268 aa, Aspergillus nidulans
  unsure (1)..(268): unsure at all Xaa locations
RLDQYHTVKVLGEGSFGKVKLAIHQPSGRQVAMKIISRRKLLSRDMIGRVEREIQYLQLLRHPHIIKLYVDVQLGLGRANVLGYTVISTKTDIVMVLEYAERELFDYLGKRGRCNDAEARKFFQQIICAVEYCHRHKIVHRDLKPENLLIDRDKNVKIADFGLSNIMTDGNFLKTSCGSPNYAAPEVISGKLYAGPEVDVWSCGVILYVLLVGRLPFDDDYIPALFKKIAAGNFHMPTYISSGAARLIRXMKQVHPVHRITTEDKRGH

SEQ ID NO: 13345 - protein, 197 aa, Aspergillus nidulans
  unsure (1)..(197): unsure at all Xaa locations
VRDVLLAGGEAVRGVTKAVYDAAVDAARKNFADSIGAPKIPNVSWEDVGGLTNVKDALVETIQLPLERPELFAKGMKKRSGILFYGPPGTGKTLLAKAIATEFSLNFFSVKGPELLNMYIGESEANVRRVFQRARDARPCVVFFDELDSVAPKRGNQGDSGGVMDRIVSQLLAQLDXMNXGXENSCXVFVIGATNRP

SEQ ID NO: 13346 - protein, 668 aa, Aspergillus nidulans
  unsure (1)..(668): unsure at all Xaa locations
RGYVFACGVGVVEMPXARKLLTDYHLYKGNVLLLMRDIKKIMDFLSIDKTRPAYVEDMMGVWLRRKPWFQECSNIQYYSRDASPSGLARASEDFNRFLQVATGQIDSLSIIKEKEHSFFASLTLPDLREAGDILEEVCVGSDAVELRVDLLKDPASNNDIPSVDYVVEQLSFLRSRVTLPIIFTIRTQSQGGRFPDNAHDAALELYRLAFRSGCEFVDLEIAFPEDMLRAVTEMKGFSKIIASHHDPKGELSWANMSWIKFYNKALEYGDIIKLVGVARNIDDNTALRKFKNWAAEAHDVPLIAINMGDQGQLSRILNGFMTPVSHPSLPFKAAPGQLSATEIRKGLSLMGEIKPKKFAIFGSPISQSRSPALHNTLFAQVGLPHNYTRLETTNAQDVQEFIRSPDFGGASVNNSAQADIMPLLDEVAAEAEIIGAVNTIIPVSTGKNTPSRLVGRNTDWQGMILSLRKAGVYGPKRKDQEQSALVVGGGGTARAAIYALHNMGYSPIYIVGRTPSKLENMVSTFPSSYNIRIVESPSSFESVPHVAIGTIPADQPIDPTMRETLCHMFERAQEADAEAVKAIEHAPRILLEMAYKPQVTALMRLASDSGWKTIPGLEVLVGQGWYQVCFLASIILIACELTERSLNTGLGSRRYMRVPGHVAPPSFN

SEQ ID NO: 13347 - protein, 242 aa, Aspergillus nidulans
MGVLSEQMAKDRNISRAAQDAFAASSYQKAVKAQKAGLFSEEILPLDVKWTDPKTNEEKTITVKADDGIRDGITAESLGKIRPAFAKDGSIHAGNASQISDGAAAVLLMKRSTAERLGQKIIGKFVCASVVGVKPLLMGIGPWKAIPVALQKAGITKDDVDIFEINEAFASQCVWCINELGLPEEKINPKGGAIAFGHPLGCTGARQISTLLTELKRTDKKVGVTSMCVGTGMGMAAVWVRE

SEQ ID NO: 13348 - protein, 201 aa, Aspergillus nidulans
  unsure (1)..(201): unsure at all Xaa locations
VMSVFSSLRYCLGDPHDYGAIWAALGFMPFGLFFDFMDGRIARWRKKSSLMGQELDSLADLVRHNTFVGSYHGXSTASRISFGMAPAAAAFALGIRTPLDHLFLTFFVLCGLTRLARFNVTAAVLPKDKTGKSKYFEGTPIPTTLSIVAVMAYWVSQEWILEDIPLGVAAQGTTLEFHPIVLLLVLHGCLMVSKTLHIPKP

SEQ ID NO: 13349 - protein, 485 aa, Aspergillus nidulans
  unsure (1)..(485): unsure at all Xaa locations
KAASSASRHLAILSEADRNEALTALHAALSRNKDAILEANARDIQAATQAVNGGSLNHSVLKRLDLSRPGKYDDMLQGILSVRSLRDPVCLRQHSSLTYLVFFIPGFSDYVEVGNVTLRTLLDDGLTLEKVACPIGVLLIIFEARPEVIANIAALSIKSGNAAILKGLLLKFWYVVLNSCXYSKGGKESTESFVTIANVISEAISHTRVPQSSIQLVKTRAAVSDLLAQDSLIDLVIPRGSNDLVRFVKENTKIPVLGHADGLCSAYIHSDADPEIALKVIVDSKTDYPAACNSLETLLVHQDALKEVLPPLAKALIAKGVTLRCDESSKAALIENLTLKEAGMLRDACESDFRTEFLDLTLAVKTIPSNSPLTDVEAAIAHINSHSSKHTDIIITESENIANIFMKGVDSAGVFWNASTRFADGMRYGFGTEVGISTNKIHSRGPVGLDGLTIYKYLIRGSGHRAGDYFDGEGGRKYKHQNLEL

SEQ ID NO: 13350 - protein, 366 aa, Aspergillus nidulans
  unsure (1)..(366): unsure at all Xaa locations
AFLAGGVAGAVSRTIVSPLERLKILLQIQSVGREEYKLSIWQALKKIGREEGWRGFLRGNGTNCIRIIPYSAVQFGSYNFYKRVFPRYGSNVLQNXHSQFAEPSPDADLTPIRRLICGGAAGITSGLYTNPTKHIILTLTKLTLPTQLAXPVIVTYPLDLVRTRLSIQSASFAALKRDSAGEKLPGMFTTMVLVYKNEGGFLALYRGIIPTVAGVAPYVXFPGVLDNRPXVTSADFAXVGLNFMTYESVRKYLTPEGDSTPSALRKLLAGAISGAVAQTCTYPLXELSXFSALQRVLTSFXDVLRRRFQINTMSNMGYQYASIFDAVKVIVAEEGVRGLFKGIAPNLLKVAPSMASSWLSFELTRD

SEQ ID NO: 13351 - protein, 508 aa, Aspergillus nidulans
  unsure (1)..(508): unsure at all Xaa locations
FGGMLFGVETGIIGGVLTMDTFKRKLFVHSVFPVTDAVDRKYGLNELGDTGRANLSANIVSTLQAGCFFGALAASWVADKYGRRLGLIAASFVALVGVIMQVAASGHLEAMYIGRLRSLSLEKKKXNKNXHLTSNSLLCGIGVGFASMVNPLYVSENAPRAIRGGLTGLYQLFITMGIMLAFWINYGSLLHISGAGQYLVPLAMQGLPAILLLVGMLLCNESPRWLAKQDRWEEARATLSRVRNLPSTHPYVENEFQDIVRQLEFERQLISGSSFVDLLKEMWFIPGNRKRALISIWLMICQQMTGTNAINYYAPQIFENLGITGSANGLFATGVYGIVKVVGCACFLVFVADSLGRRRSLLWTSIAQGLAMLYIGLYVRIAPPKEGEPVIPAGYFALVCIFLFAAFFQFGWGPVCWIYVSEIPTTRLRSLNVSFAAATQWLFNFVVARAVPNMLATVGANGYWVHFPHLYTPYGHXTNNLFRAYIIFACFCFSMFVFVWFFVPETKG

SEQ ID NO: 13352 - protein, 488 aa, Aspergillus nidulans
  unsure (1)..(488): unsure at all Xaa locations
VPADKYWGAQTQRXGIVTXVTRGNRVXEADEWIVSLGNFDINQPQDRMPDAVVKAFGILKGAAATVNMKFGLGKLCLIKFRQECVVXXRLDPKIGEAIKQAAAEVAEGKLLDHFPLVVWQTGSGTQSNMNSNEVISNRAIEILGGKMGSKKPVHPNDHVNMSASSNDSFPTAMHIAAVLELENTLLPALTSLRNALQKKVDSFQNIIKIGRTHLQDATPLTLGQEFSGYVAQLDRNIERVQASLPHLRYLAQGGTAVGTGLNTFKGFDEAIAAEVSKMTGTEFKTAPNKFEVLAAHDAIVEASGSLNTLAGSLFKIAQDIRYLGSGPRCGLGELILPENEPGSSIMPGKVNPTQCESLTMVCSQVMGNHVAATIGGMNGQFELNVFKPLMIRNLLHSVRILADGMKSFEKNLVVGLEANESRISTLLHERXVLRTRLTVSCVLTFSVLMLVTCLNPVIGYDMASKVAKNAHKKGITLKESAMELKALS

SEQ ID NO: 13353 - protein, 405 aa, Aspergillus nidulans
  unsure (1)..(405): unsure at all Xaa locations
PLYNAELASPEMRGFFVSFYQFATILVFTAKSGQIRDLMLTTSXGMMIAFWVGYGSNLHMGGTGSTQSNLAWQLPSIIQGIPAALLLLGIWFLPFSPRWLAKRGRDEEARETLAYIRNLPVDHPMIDLEHKEIKAETLFEQRAFAKAFPGLAEKEKQSVVMRELAQYWHILRKWDAFKRVATAWLVMFFQQWSGIDAILYYASNVFQDLGLTGGTTALLATGVTGVVFLVFTMPGMLLIDKAGRKPMLIAGSVAMWIFMVIVAILVAKFRHDWPGHPVAGWVAVVCVWLYVGAFGATWGPVSWTLVSEIFPLSIRSKGAAFGASSNWVSQAKPLDLLXSVRRXFRITYSSTTSPLHSTPPKMFNMWAFGTYIWFAGFLTVGIFWVWFFLPETKGATLEEMDRVFK

SEQ ID NO: 13354 - protein, 387 aa, Aspergillus nidulans
  unsure (1)..(387): unsure at all Xaa locations
LFGYDSGIITSTISLPTFIDYFSNPSSTVTGGIVSSFQGGAILGTMVNMAGADWAGRKMTVLAGAIVSVLGCALQAGAVNMTMLIIGRFIAGVAVGMLTSTIPMYAAELSEPKWRATLSGLLQWMLSWGFLVAQWLGYGCSFSTNEFSCINPPLCGQQIHXLSLGRFPLAFQNVPGLILIAGIWFLDESPRWLMEKDRHEEAKAVLTRIRKGASADTVELEFREIRDVIAADRAVGNTSWRTILTKPSWRRRLILGCGVQAFGPLSGINVINXXAGSMKSESRTNKRSYGPRIYSILGIDNQTSLMIIGISGALSIVYCSIGLYLVDRVGRVKPLFVSALFLGAALLVNAVQAQYMDQNNENQLRSMVAMNFVFSLFYTPVGIISWV

SEQ ID NO: 13355 - protein, 436 aa, Aspergillus nidulans
  unsure (1)..(436): unsure at all Xaa locations
MSLTSKLSITDVDLKDKRVLIRVRXAYKRPLMTPLTLNCNXVDFNVPLDKNDNTTITNPQRIVGALPTIKYAIDNGAKAVILMSHLGRPDGKKNPKYSLKPVVPKLKELLGRDVIFTEDCVGPEVEETVNKASGGQVILLENLRFHAEEEGSSKDADGNKVKADKDAVAQFRKGLTALGDIYISKXPSNHSLATESVIDCYIDDAFGTAHRAHSSMVGVDLPQKASGFLVKKELEYFAKALEEPQRPFLAILGGSKVSDKIQLIDNLLPKVNSLIITGGMAFTFKKTLENVKIGSSLFDEAGSKIVGNIIEKAKKHNVKVVLPVDYVTADKFAADAKTGYALDEQGIPDGYMGLDVGEKSVESYKQTIAESKTILWNGPPGVFEMEPFAKATKATLDAAVAAVQNGATVIIGGGETATVAAKYGAEDKISHVSTGG

SEQ ID NO: 13356 - protein, 391 aa, Aspergillus nidulans
  unsure (1)..(391): unsure at all Xaa locations
VQQVCIPTAILNVDVLCQAKSGLGKTAVFVLTTLHQLEPVPGECSVLVMCHTRELAYQIKNEYARFSKYLPDVKTAVFYGGTPIQKDIEVLSNKDTFPNIIVGTPGRLNALVRDKKLSLRNVKAFVLDECDKMLDQIGRSFNPNSQSRSPLTPLDMRRDVQEIFRATPTDKQVMMFSATLSQDVRPICKKFMRNPLEVYVDDDTKLTLHGLQQYYIKLSEAEKNRKLNELLDSLEFNQVIIFVKSTIRANELDKLLRECNFPSIAVHSGVSQEERXVSLTAEHEVXYXRPTSIKRYKEFKEFNKRICVATDVFGRGIDIERINLAINYDLPADADSYLHRVGRAGRFGTKGLSISFVSTPEDEQVLKDIEKRFEVALPEYPEEGVDSSTYM

SEQ ID NO: 13357 - protein, 450 aa, Aspergillus nidulans
  unsure (1)..(450): unsure at all Xaa locations
ASGCIVFASNMIVASGKEATEGEERGIAIAVISFITLLHVFLPNWGVRGMNVIGVVKVVLLLFIVVTGWVVLSGRLNSIPDPYASFHCSFVGSATSSNLYATALFKVLNSFAGYAIVRSRRTLYRICITGSTDCNPAGSNAAYVLNEIRNPVRTLKIAAPTGLGICGVLYLLANVAYXAAATPEEIANSGTTVASYFMGKVFGTAAERALRXVTPRTFPLKNKIXRAIASSITISAFGNVMTVTFAQARVNQGLAKEGVIPFPTFWASSWPFGSPSAGLLLHFILSVIVIVAIPFGDAYNFILDLEGYPSPIINLLVVAGLFYLRYSEPRLPRPFKVYWPVAVFFMAGQAFQVVAPFIRLPEGKGDTSLPYWLYPIVGIAVLLAGVVYWGIWQLLLPWLGGYRLVPEHQVLKDGTTVAVYKRENKSEXEDTXLELRXGVIETTXYHIHSS

SEQ ID NO: 13358 - protein, 994 aa, Aspergillus nidulans
  unsure (1)..(994): unsure at all Xaa locations
MEQSYILAPAEVLKHFDVTERSGLSSAQVSHSRQKYGPNGEFFALCVKXEAQLRMLTCLFRRXALAEEPPTPLWELVLEQFKDQLVLILLGSAAVSFVLALFEESDDWTVFVDPAVVRLGPEEIIYSSILLTXFALLQILTILILNAIVGVTQESSAEKAIAALQEYSANEAKVVRDGVVQRIKAEDLVPXDIVHVAVGDRVPADCRLLAIHSNSFRVDQAILTGESESVAKDTRAVSDRQAVKQDQTNILFSGTTVVNGNATAVVVLTGSSTAIGDIHESITSQISEPTPLKQKLNDFGDMLAKVITVICILVWVINIEHFNDPSHGGWAKGAIYYLKIAVSLGVAAIPEGLAVVITTCLALGTRKMAQKNAVVRSLPSVETLGSCSVICSDKTGTLTTNQMSVGKIVYLSQLGTGVEVIDVEGTTFAPEGSLSYNGQVVTNLAASSSTIRQMAEVMARCNAAAIAYDEKTGTFSCIGEPTEGALRVLVEKIGTDDAAMNDKLLSLPASQKLHVSSAYYESRLPLQATYEFSRDRKSMSVLVGTGSNRRLLVKGAPESILERCFYALLGPNGARVSLTKAHLDLLSSEVVEYASRGLRVIALASVDDVGANPLIHKASTSEEYAQLEQNMTLIGLVAMLDPPRVEVADSIKKCAEAGIRVIVITGDNQNTAESICREIGVFGKDEDLKGKSFTGREFDSLSHNEQLEAVKSASLFSRTEPSHKSKLVDLLQSLGHVVAMTGDGVNDAPALKKSDIGSPMGLATDVQSSRADMVLVDDNFATITTAVEEGRSIYSNTQQFIRYLISSNIGEVVSIFLTAALGMPEALVPVQLLWVNLVTDGLPATALSFNPADHDVMRRPPRKRDEPLVGGWLLFRYLVIGTYVGAATVFGYVWWFLYNPEGPQISFWQLVSPNYVFVCGLPLTRXXSHFHKCSTEFPEIGCEMFSNDMSRSASTVSLSILVVIEMLNAKKALSSSESLLTFGLWKNMMLDXAI

SEQ ID NO: 13359 - protein, 220 aa, Aspergillus nidulans
  unsure (1)..(220): unsure at all Xaa locations
ALDGKVALITGGVKNLGAQIARELAASGANLALHYHSSSSQSDAAKVEAELQQSVKVVTYQGNLTSAAAVTKLFEDVNRDFGKIDIVVNTVGKVLKKPITEITEEEYDTMFAYVPSSSISSFTXHWNRINSKTAFFVLKEAAKHVSDDGKIITIVTALLGAFTGYYTSYAGSKAPVEHFTRXASMDSTYDHYXHSVVASAKELQSRRISVNNIAPGPMDT

SEQ ID NO: 13360 - protein, 282 aa, Aspergillus nidulans
  unsure (1)..(282): unsure at all Xaa locations
ACGPTHTSVTPLDLVKCRRQVDPKIYTSNISAWRSIISKEGVRGIFFGWSPTFIGYSFQGAGKYGFYEYFKYLYGERMFPNTNRTVMHLAASASAEFIADIALCPFEAIKVRMQTTLPPYAHSLREGWSKIIAQEGVSGFYKGLYPLWARQIPYTMTKFATFEETVSMIYKTLGGPKESYNSLQQTGISFAGGYIAGIFCAIVSHPADVLVSKLNADRKRYVSHSWQRGAYVLTRLAGESAMKAVSRIYGNIGFSGLWNGLPVRILMLGTLTGFQWLMXVAF

SEQ ID NO: 13361 - protein, 200 aa, Aspergillus nidulans
FKTLAADPRNAVWIISGRVQSFLDEWMGQIPELGLSAEHGCFIRMPRSDNWQNLAETTDMGWQKEVMEIYQHFTERTQGSFIERKKVALTWHYRRADPEYGAFQARECRKQLEEHVSKTWDVEVMAGKANLEVRPRFVNKGFIATRLVQAYEDGKVPEFILCSGDDFTDEGMLFPFLATPKLRHELLLTYLRYVPCLEEI

SEQ ID NO: 13362 - protein, 417 aa, Aspergillus nidulans
  unsure (1)..(417): unsure at all Xaa locations
ETTEPVADKAQLDGAASNQGGSDLAEPEYNVEVKLSDLQADPNNPLYSVKNFEDLGLXVVQRQFIPAMSELIHLTXRPRILQGLSAMNFRKPSKIQERALPLLMGNPPKNLVGQSQSGTGKTAAFVLNILSRLDLSSEQAQKTPQALILAPTRELARQIVGVIQVMGKFLDGLHIGTAVPADTNARPTRMEASVVVGTPGTVMDMIKKRIMVAAKLKVIVLDEADNMLDQQGLGDQCIRVKAXVLAFPCQRRYXTLEQPLPRDIQVVLFSATFPAHVHQYASKFAPAANELTLQHEELTVEGIKQLYLDCASEEDKYRTLVQLYGLLTVGSSIIFVKVCLYALVISPNXQLXTRASAVEIERRMVAEGHTVASLTGGIEGSQRDQIIDQFRAGHAKVLITTNVLARGIDEDTVSMVI

SEQ ID NO: 13363 - protein, 1182 aa, Aspergillus nidulans
  unsure (1)..(1182): unsure at all Xaa locations
KFGKQIQRRQLDLPEYAASFVNYKALKKVNSSGSXDRVYRRCXRRTNQLIKQLSATPTIPAQSSVPISQNASEAQAALRANKEVFFFRLVRRGVKGVCGSGLFXVSYQEREIEKVNTFYLQKEAEVCPTVQDRCTETXHXATVSQRLKTLVDKKRVAQSRTVTKPKAPANLVALLEGFQQFDGDLNKLQVSSYADXMKSFLCIGVTCSNFVEINETAMSKILKKVCRKDMLRSLRVDSANGVIXWDKTSKVYIPRRPTSASNQLTIHLXXSRMKELYLHRAVEVQPCFNRDVLRDLSDRATTARIELEAWAEGENIQFDTTRPTDRTTTFQGFGSEEEDLDLQVLQSANSGNLYALREWADKLQKSGDSRERATRTFLAAISEYSDDVLAVLLETGLVDIFAEDDINERNCLHEAAISGREFVLKAGLEAGVQVSRTDVYGRIPLHYACIHGRVGMVQQLLATDPSTVDIMDHDNFTPLIHSIVKNQLDCAEQLLRNNARIDPVSESDHIPLNLACQHGSLPIVKMLLERQARLLPDAEGLYPQHMVARASQSPDILLLLKRHGADLNQRDKLYQWTPLFHAASEGCVNCLRTLLELGVDADVKDEKGLAAVYYAAWEGHLECMLLLWSHHTESQPSQRPLDILNGLRLHEPSSTIAWQEHTPAEAQDMETVDGIPDLSLPPPIIPLRRYGHNFLDKKVFVQILFDPGSSISFDQAGRYPAARLTISSKLSELIPRTVMLPIQEDARMISFHVDTLQTFTVDFEIFPTFGSKVIAKTVALPTVFGAEESSAGSCCLPLFDPRLRAIGQLRFWFQVIKPYHGDPLEITHFATYWKATSTGESDHSGLVTGSSLSGDHVQLFVQLTRDKVPVVHPQYMVKHYGIDIPICHLTFSEFQAVGGEKNVNRPELLQFLQAHAADDLALTHRVLAASFLSLREVFENLPVDVNVNISVLYPSAAEEQALKMTSMTDVNTFADAILTVVFDHARVARDKNPEFMRSVVFTSYNANICVALNWKQPNCKQPVPVNLSPITNNQTPFSFANDLGQIRDLARNAGTHPDVDSSGRASMSIKESARVAQSNNFMGLICRSSLLVCLHKLPLILDRHRYXWRLLXNVVPALVATMKELGLVLVADTSDEAEQPETQALSAAGSMGVAELAYRMPEGVNGLMKANGILRFNDMIDM

SEQ ID NO: 13364 - protein, 249 aa, Aspergillus nidulans
  unsure (1)..(249): unsure at all Xaa locations
QYXQLSFNVQQEWNNTTLRPVTIKQILDATQPYPEANFTIDGQDVSSIVFIGQVRNISTQATNVTYKLDDGTGEVEAKQWINPSEAMDTTEDFGKEGKDLNGVEINGYAKVFGKLKSLFGDRKVVNTHCVRPLTDINELHVHFLEAAAVHLFHTRGAPGPAAGATGKIDGGDAAMGGLDGAGVGGGGGFPANMSATARRVYNLLRTEPQNNEGLHAQFIAAKLGLPPQDVVRAGDELINAGMVFSTVDD

SEQ ID NO: 13365 - protein, 433 aa, Aspergillus nidulans
  unsure (1)..(433): unsure at all Xaa locations
MALDNYYRNKIESMKLEIIQGQAVLRRLEAQRNDYNSRVRLLREELGLLQQPGSYVGEVVKVMSTKKVLVKVHPEGKYGKPPFCFPPNSLAWWLGANXVQQVVDIADGVDIGKLTVGKRVALLSDSYKLEKMLPSSVDPLVLLMMVEKVPDSTYDMIGGLDQQIKEIKEVIELGLKHPELFESLGIAQPKGVLLYGPPGTGKTLLARAVAHHTDCRFIRVSGSELVQKYIGEGSRMVRELFVMAREHAPSIIFMDEIDSIGSSRIDSAGSGDSEVQRTMLELLNQLDGFEPTKNIKIIMATNRLDILDPALLRPGRIDRKIEFPPPSXRLYLCRMRNAVTNCPLTHNSVEARADILRIHSRSMNLTRGINLTKIAEKMNGCSGAELKGVCTEAGMYALRERRVHVTQEDFDLATAKILNKHDDKEVAVSKLFK

SEQ ID NO: 13366 - protein, 422 aa, Aspergillus nidulans
  unsure (1)..(422): unsure at all Xaa locations
SQILFHFAGLDAPSGRLSQKDFSKVIDASWRIPVAAAEQAITTASGAAHKAADAGKSMLHGVLESVHHFALGSLAGAFGAFMVYPIDLVKTRMQNQRSSRVGERLYNNSIDCARKVIRNEGFTGLYSGVIPQLIGVAPEKAIKLTVNDLVRGYFAGKQNGKLKTWQEVLAGGSAGACQVVRIHSLCFQTXAYXLYPXVFTNPLEIVKIRLQVQGEIAKNAGVEGAAPRRSALWIVRNLGLVGLYKGASACLLRDVPFSAIYFPTYSHLKSDFFGESRTHKLGVVQLLTAGAIAGMPAAYLTTPCDVIKTRLQVEARKGEKAYTGLRHAAVTIFRDEGFKAFFKGGPSRILRSSPQFGFTLAAYEVLQKWLPMPGSEHDVSPTGQVEPGVGVPVAKEPLPYLRSRNALKLILDLDENIGRLPI

SEQ ID NO: 13367 - protein, 1283 aa, Aspergillus nidulans
  unsure (1)..(1283): unsure at all Xaa locations
FVSIHVDPPLRPEIYQDPDEEVQDKILFVLNNVSEQNIDEKLRDLTDVLKDPHHQWFASYLVEERAKLQPNFQQLYLDLLDRIDDKILWVEVLRETYASTSKLLNSEATLGSSTERGHLKNLGSWLGSLTIAKDKPIKHKHIWFKGLLLEAYDSQRLTIVIPFTCKVLVQATKSTVFKPPNPWLMDIIALLMELYHFAELKLNLKFEIEVLCKDLEIDHKAIEPSVIIRDRSTTIEESLSTANIPEGLEAFEDMALTSISQSIRNERLSPAAILSTLPSLDKILVLPPSASSMVDSNVLRQIVHSAVERAIAEIITPVVERSVTIASISTVQLVSKDFAMELDEEKFRHAAANMVRQLAGSLALVTCKEPLKVSMTNYIRMIQQEYSDQPMPEGLILMCVNDNLDAACGIVEKAAEEKSLPEIEKVIESQLEARRRHRAARPSEPFIDPSMTRWGLFIPEPYRQTPGGLNKEQLAIYEEFARQARGPGTTHAQNVSTDSGRQLPDVLQEPYPPIPNLSTPAEQPAVPHRTPQPQQDTRLQQSALVGTSSQLNGFLETQNPRDRVESLVSDLQQAAATLPKSTXKDLGRDSAVLQEXQQALRSIVASPNGEEVARLTALKACTSLYSQTKSTLEIEVLVHLLAKLCDMSALVARYTWTVLAEVDDEHMFNVPVTVALIDAGLLDIRRVDMILSRLILQKNAAALDVLAELMDQILFNEEPSALRSDFSGSLEAMSKWLAEDSGLARAKEIIKKLRDSGIPEVVNPLLSDKARSKRDQMEYIFTEWIGIYKAPGAVDRTYYAFLKDMHQRQVMANQEDSALFFRLSIDISVARFEHESQNPSGSLDEAFLYIDALAKLVVLLVKFQGEGTGPVKTSKSAYFNSILSVLLLVLNHHQVMRGEAFNQRVFFRLFSSILCEYSMSGLQHSDQHQEMMFTLANKLLSLQPKYYPSFVYGWFSLVSHRFFMSSMLNMPDRAGWGPYCEIMQVQLSYIGEQLKSTTMTLVTMDLYRGMLRILLILHHDFPEFVAENHFQFCNVIPAHCAQLRNLVLSAYPSSFQKLPDPFREGLKVERLEEMREAPRIAGDTAGPLLRAGIKNVIDNALQSNNVSDSVIQQIRDAVYDTESKESGLFHAPININLLLVNALALYVGQGAVSVNESKGNTRAAFESSAHSALLEKLVXILRPEARYYLLSAMANQLRYPNSHTYFFSFAILRLFGTDYTEQDESDIRQQIIRVLLERLIVHRPHPWGLIITLQELLQNSSYAFFHLPFIQAAPEVSHXVPTL

SEQ ID NO: 13368 - protein, 454 aa, Aspergillus nidulans
  unsure (1)..(454): unsure at all Xaa locations
GAAWINDVNQSRVYALAKRFGVEILEQNTTGLCVLQDVDGDCSTFEYGELPKVFVLSSSSERYELTWFSSTLPLSKISPGSAIWSKQTATLDPVRPRNTEWDPMTFEAYLWSRSAGKETLATSAVWIRAMLGQDLRDISALWFIAYCKAGGGLLQMRSDRKGGGQHLRIRQGMQMISKVIAETLPQDVVCLARGQRHSRAQSRGXGRAADKKTLQACKAIITVPSPVLKMMDFSPKLPALKQLWAESSNYGYYTKAMMIFRTPFWVEKGYCGLIQSFASPASVIRHTSSLPDKKYILTCFMASDLGRAWAALPTDGRKAALIKQIGKLFDAKTEAAGHLVDLVIYEWVNDPYSGWGCPCIALTPGVMDAVGETIREPAGNLHFAGTEAAVRWRGYMEGAIESGERAAAEVIQKLNAASARLXMSIXYIFKVKPWIDRLEPQSCNPDTYPFSRTF

SEQ ID NO: 13369 - protein, 851 aa, Aspergillus nidulans
KEAAGYQAKLDSISADEGAQAALESNAEDIHSRLDQAKERERSASRDKQIEDINSQIRELEDENSRLNAELIEATKKAGDLARLDHLKKELKDRERSLETMKSAHGERLSKFVNPNWKIDTLEQDFQRTLEDKSNAVIMAERAKDSLSRELEQVEYKLKDVEKSLTQRQKSSRNVLRRYAKPLTMKPGEYPDVVSQRQNQLDMAKSTAEQGAGIEEYMSRCLAAAKEDKICRVCARSFKTDNDLRTFFNRLEGLIKRAKLQAQAEDVEQLEQDLNVARAASTAYDTWKRLKETEIPELQQEDEKYTLERDELLGQLEDRDKAVSEMVEKKRDIEALSKTVSTIVRYDSDIKSTRAQIQDLSSKQQQNTAAPRTLEDIQDEIASIGEKTRALKKTLSKLTNEREHARAEINSLELQLRDVKSNLDNVKFQLERKADLLSRIEEYKTLNNQQREAIAKADRDIEDLNPELLKYQAIYDDISQRAEARERELQQIISQLSDSIHQVELASEEIDAYNERGGPHQLDRSKRELKSIENEISQLETEQAALTRTINKISTQLKDSENTKRQYADNLTYRQSVRAFDKVTSEIRELESKNAEVDRSRFKEESERRSREHNALSAKQSSKMGEMKSKDDQLMQLIKDWDTDYKDAAYKYKEAHIKVETTKAAVEDLARYGTALDKAIMKYHGLKMEEINAIIGELWQKTYRGTDVDTILIRSDNENARGNRSYNYRVCMVKQGAEMDMRGRCSAGQKVLASIIIRLALAECFGVNCGLIALDEPTTNLDRDNIRSLAESLHDIIRARQQQANFQLIVITHDEEFLRYMQCGDFSDYYYRVSRNERQKSIIERQSIAEV

SEQ ID NO: 13370 - protein, 129 aa, Aspergillus nidulans
GIRIKAKSGETGEIKGVTYSGISLESISRVGSPSSPVLNPALTSSSYGILIEQNYDGGDLDGEVTSGIPITDLTIENISGSAPVDSDGYNIVIVCGDDACSNWTWSDVEVTGGEDYGSCENVPSVASCS

SEQ ID NO: 13371 - protein, 221 aa, Aspergillus nidulans
  unsure (1)..(221): unsure at all Xaa locations
KLRLSDSMAINFKDGVILGADSRTTTGAYIANRVTDKLTQVNDTIWCCRSGSAADTQAVADIVSYHLNMYSIVNNEPPSTQVAAALFQELCYENKDMLRYAILVPSQNALFDXLAHQSAGIIIAGYDPRHGGQVYSIPLGGSLHKQAYSIGGSGSTYIYGYCDANWKENMTEEEGVEFVRGALREAIKWDGSSGGVIRMVVLTKNGAQRHLYLPDNGYTAP

SEQ ID NO: 13372 - protein, 348 aa, Aspergillus nidulans
DEVRIQIAYCGICGSDIHEYLGGPVFSPPPGKKNPYTGAELPVTLGHEISGTIVELGSSVPASDPNLKLGMRVAVNPAMNDRHHGVEKCTACQLGLPNICKRYTSYGFSAAGGGLASEIVVKHYACIPLPDSISLKVGALLEPLAVAWHCIRISGFQRDQTVLILGAGPIGLAILMILRVWGVKTVVISEVAASRKRMARELGADLVLDPTELGSSKDGLDPVVVATQKAMKADGADVTFDCTGLQSTLDTAIAATRPGGTVFNVAIHEKPLMVNLNELTLGERRLTGGICYTDVDFQELIAALEAGKIQAERLITSIVDLDDVIDKALMELIHNKAAHVKILVKPNH

SEQ ID NO: 13373 - protein, 234 aa, Aspergillus nidulans
ELYNSVLVETPLAGFFKGSLSHQDLDELNIEIVRNTLYKNYLEDFYKFVTTHPDFKGTPTQEVMAEILEFEADRRAINITLNSFGTELSKPERRKLYPEFGKLYPEGSLMLSRADDIEAVSLAVSISADYKAFFDAVGLTQGGGGLGGMGGSDGKSLEDLFYQKEMEMSKLVFTRQFTPAIVYAWMRLKEQVRDPAILEACLTNKFQEIRNVTWISECIAQNQKERIGNFISVF

SEQ ID NO: 13374 - protein, 308 aa, Aspergillus nidulans
DMSSSDGAPESWISSFCQLMGHEFFAEVSEDFIEDDFNLTGLQSQVPMYKEALEMILDVEPEEDEEEEEEEEEEEDEDEILGDEKPPGYRRERRHTRVASDLSMIETSAELLYGLIHQRYITSRPGIQQMLEKYELQHFGVCPRVHCNGCKVLPVGRSDTPGQETVKLFCPSCQDLYTPPNSRFHSVDGAFFGTTFGCLFFMTFPDLEIGPRFDAPLSNISPPRSASLPSTATTTTTTTTTSAGASNQVTSDTPRPVYPVELNGVRTVNFCPGLGEGRVYESRIYGFRVSERSRAGPRMKWLRMKPAD

SEQ ID NO: 13375 - protein, 313 aa, Aspergillus nidulans
  unsure (1)..(313): unsure at all Xaa locations
QTRMQVLHPTTGGLYTGLTHAVSTIYRIEGWRTLWKGVSSVIVGAGKQTRPRSIRLAHPTGXLLGSTFXGPAHAVYFGTYEVVKEMAGGNVDDGHHPLAPVRLXLTTLRRKCXLFQAMSGAAATIASDALMNPFDGEFXQRVRLLKRELFLTXAVIKQRMQVHGSIHKTIFQCAKSVYKTEGFHAFYVSYPTTLCMTVPFTATQFVAYESISKVMNPSGDYDPFTHCIAGGLAGAVAAGITTPLDVVKTLLQTRGLAQNEEIRAVKGLFGAATVIKRQFGWRGFLRGARPRIISTMPSTAICWTSYEMAKAYF

SEQ ID NO: 13376 - protein, 168 aa, Aspergillus nidulans
  unsure (1)..(168): unsure at all Xaa locations
KELAELTESPPAGITVELANESNLYEWKVFMDGPEGSPYHVSCTSFPQPTLQRFKNGQSDLMFIXKGRFELKLTLPTEYPFKPPSVSFVTKIYHPNVTNDDKGSMCLGMLKADEWKPSSRLSAVLEFARSLLGEPMPDDAVEGRIAEQYREDRSRYEEIAREWTRKYA

SEQ ID NO: 13377 - protein, 214 aa, Aspergillus nidulans
RGHTDWVNAVRVDTSSRTVFSASDDCTVRLWDLDTKTCIRTFHGHVGQVQQVVPLPREFEFEEHDAECENDDLSTTSGDADPPSIQASMGLEPNAAYSQSSAFGTSFDNGRAAPPRYMVTSALDSTIRLWETTTGRCLRTFFGHLEGVWALGADTLRIVSGAEDRMIKIWDPRTGKCERTFTGHSGPVTCIGLGDSRFATGSEDCEVRMYSFQS

SEQ ID NO: 13378 - protein, 375 aa, Aspergillus nidulans
SMSIYSFLIAVRSEGQQLMSDTGETTSHLMGMFYRTLRMVDNGIKPLYVFDGAPPKLKSGELAKRSARKHEATEAHEEAKETGTAEDVEKFSRRTVRVTREHNAECKKLLKLMGIPYIDAPTEAEAQCAVLARAGKVYAAASEDMDTLCFEAPILLRHLTFSEQRKEPIQEIHLNRALEGLGMDRNQVISSHAGWRVECLLLDVLHSFIDLCILLGCDYLEPIPKVGPNTALKLIRDHGTLEKVVESIEKDPKQKYVIPESWPYQDARELFLNPDVRDANDPECDFKWEAPDIEGLVDFLVKDKGFNEDRVRNGAARLQKNLKTAQQSRLEGFFKPVAKTDAEKATLKRNDDEKIQEQKKRKKEEAKAKKEAKAR

SEQ ID NO: 13379 - protein, 235 aa, Aspergillus nidulans
  unsure (1)..(235): unsure at all Xaa locations
KQRKIAIVGSRSVGKCCAQRSPHSXLTLITKGKSSLTVRFVEHHFVESYYPTIENTFSQIIKYNGQDYATEIVDTAGQVRTYRCAHSSQTLTLSTQDEYSILNSKHFIGIHGYIIAYSVASRQSFDMVRVIRDKILNHLVSFPCLQSMLSCTEALLXGADYVPLVVVGNKSDLKPEQRQVSLDEGRQLGEEFRCAFTEASARLDFNVARLFELMIGEIEKSQNPSQPTGGNKCAL

SEQ ID NO: 13380 - protein, 138 aa, Aspergillus nidulans
LGKMQTRVDDSPQLSDVEKSSKGHAASLGASLQTFQSNHEGAIVDRIHAARGNTDAIIINPGAYTHTSVAIRDALLGVEIPFIELHVSNVHAREPFRHHSYFSDKASGIIVGLGVYGYKVAVEHVALNFKPLEKKAAL

SEQ ID NO: 13381 - protein, 469 aa, Aspergillus nidulans
  unsure (1)..(469): unsure at all Xaa locations
FLSLDRLYRLTKLARNRKLLENNVQRFKEFGNTHRAKRITTPMIVTRDPQNIKAILSLKFGDYSMGDRIRIFGPLLGHGIFTSDGEDWARSRHMIRPNFVKEQVAHLEIFEELMDDLFALIPTDGSTVDLQELFFGFTIDSATEFLCGHNVHSLKKRRSGVIDDEPDFAEAFNYSLDNISKNGRFGPLMFLNRDPKAVESHRICHESMDQFVDKAIRMRERYNEEKIVDEAAERRYMFLYGLAQQTGDRRRIRDEVLNILLAGRDTTASLLSNMFFLLAKHPSTWAKLQEEVATLEGRAPTYEQLRNMKYLKYCLNEVSEAVXXLDPRKLTSAALRLFPVVPVNSRTAIRDTVLPVGGGPDGQSPAFVPKGTMVAYSVYAMHRREDYYGLMAEEFRPERWADLRPGWEYLPFNGGPRICVGQQYALTEAAYVTTRLAQRYSILESRDPGPWEEKLTLTLCSYNGTQVSL

SEQ ID NO: 13382 - protein, 420 aa, Aspergillus nidulans
  unsure (1)..(420): unsure at all Xaa locations
MSLKGFQKSIVRAPQTFKARFNIGDNTKDPVYTDAERRFQELEKETKKLHDESKKYFDAVNGRFRPDTFRLHSGXYPAXGMLDHQIEFSKAMTELYKPISGRASDPSTYTIEGNPEGIRACEEYEVIVQDLKEALAPELEMIDSRVVSPAQQLLEVIKAIRKVAVKRDHKKLDYDRHRNTLKKLQDKKDKSLKDEKALYKAEGDVEQATQEYNLYNDLLKDELPKLFALEAEFIRPLFQSFYYMQLNVFYTLHEKMQGINIGYFDLTRDIEEAYEEKRGDVKERAEELTIVHFKTTGGRRPGSKLTGKDKLAAEHKGRFGSRPSDPDVVENPPPPYSPGASGSALAAAAAKKPAPPPPKPKPSQFRAPVETVTALYDYEAQAHGDLSFSAGDVIEIVQRTDNQNEWWTGRVDGREGQFPG

SEQ ID NO: 13383 - protein, 610 aa, Aspergillus nidulans
  unsure (1)..(610): unsure at all Xaa locations
RRAEALKVNINAGEGLQDVLKSNLGPSGTLKMYVSSSYFWVCKAXANXXSGWXTVLVVYELSMPLKRPQCLMVHKQIKLTKDGNVLLREMVSXSSAARCGRTSXQSQQIQNPTAVRLTFHSLETISCIDFQRSXIARAATAQDDITGDGTTSVVLLVGELLRQADRHISEGLHPRVITDGYEIAKNEALKVRKAKHRSDXRXVVXYSSLDKFKIERAIDRELLLSVARTSLSTKLNSALAEKLTPDIVDAVLAIHRAPEKPDLHMVEIMTMQHRTSSDTQLIRGLALDHGARHPDMPKRVENAFILTLNVSLEYEKSEINSGFYYSSAEQRDKLVESERKFVDAKLQKIVELKKQVCGDDPKKGFVVINQKGIDPLSLDVLVKNGIMALRRAKRRNMERLQLICGGTAQNSVEDLSPEVLGWAGLVYEHQLGEEKYTFVEEVKDPKSVTILIKGPNGHTIAQVKDAVRDGLRSVYNTIVDGCVIPGAGAFQVACHAHLTSDSFRKSVKGKARWGVEAFADALLVIPKTLADNSGHDIQDSLALLQEEQADGNVVGLDLTTGEPMDPVQEGVFDSFRVLRNCIASSTGIASNLLLCDELLKARQMGKQGGP

SEQ ID NO: 13384 - protein, 577 aa, Aspergillus nidulans
  unsure (1)..(577): unsure at all Xaa locations
PNTHLASLLLTSPTEPLSKTHRCFSEAARPDTHYFTTHDFRLWSQRFAAGLRKSGLQKGDRVLLFSGNDIFFPVIFMGIIMAGGIFTGANPTFVARELAYQLQDSGAIYLLCAEDSLDTGIEASKIAGLDMDKVFVFNNALYDGKGEGMKGCRYWGELVASVEEGAGFAWEELDTPEKANTTLALNYSSGTTGRPKGVEISHKNYVSNMLQYNHLFYLNPNWREKAKRARWLCFLPMYHAMAQNIFIAAALNRGVPVYVMPKFDFIKMLEYTEKFRISDYILVPPVVVALAKHPAVKSGKYDLSSVEDIGSGRAPLGREVCEEVEALWPPGKINIKQGWGMTEXVTLSFEHCRYGYMPAHXPILLWQGHMLHPRLGVPWRNAVTASVGELNPNCERKIVADDGVTELGKNQRGELLVRGPNVMKGYWRNPQATKETLTEDGWLRTGDIAFVSNEGWFHVVDRKKVCPDPIVPSXTDESCLDXPYALYQELIKVKGNQVAPAELEAILLEHPAVADAAVIGVPKYDEDHVEKICQELTQDXGEDEAPRAYIALKPGKNATAKDITTFMEGKVSRIKRI

SEQ ID NO: 13385 - protein, 330 aa, Aspergillus nidulans
  unsure (1)..(330): unsure at all Xaa locations
DSIPIVDLSTLNSSSYSERQKLAESVRKACIEVGFFYIKVXEPPTMRKPSSHXQNHGIAGELIVRTFEAAHNFFALSKEQKMECYLAKSKVCLELQEIDEVXSLTAIELPRLQPLVRRKASNPELEKPAEGALSEAFDIGYELAGDIRKGPGDPPPQDEYGLYGDNQWPDERLLPGFRKIYLEYFSQTLELSRKLIKMNALALGQEEHLFDSAVEYPGVLSRMLHYPPQPVEGQEIPGQAAHTVRSCPDYVEKSLMGEGLGVFTILAQDHVPALQVRNNQGHWVAAPPIPGTLVVNIGDCLATWSNNRFKSTIHRVVNLTGEERYSIPFF

SEQ ID NO: 13386 - protein, 423 aa, Aspergillus nidulans
  unsure (1)..(423): unsure at all Xaa locations
QTLEQLISAGATLPLIEALDWAEGQGKEQVAYVLPTSWTSGLAGNAXLELRLDESALTVKKLAMITHYNIIANIIQATTFEAGPKKGRTEVALGFLPLSHSYGLILAHLTAWRGDTYILHARFDMQAALASIEKYRIERLYLVPPIISALVNNPFLLDLCDTSSVTSVVTGSGPFGPRLAEALSRVRPSWQVLPGYGKLMIIGNECAISDRCERTTETAVIISITDPNITYPGADGCLVPGVEARLINSNGNEVEAYNEPGELLLKSPSIMKGYLGQETATREVFDEQGWLRTGDIAVFRLTGQDGKVTPHLDIVDRKKDIMKVKGLQVAPVEIESHLAAHPAVAEVAVVGVRDEDAGERPYAFIVRSPRTMADLDEEALKADLNRHVEATLSEPHWLRKNIRFVEEFPKSSNGKPLKYKLKE

SEQ ID NO: 13387 - protein, 148 aa, Aspergillus nidulans
FDRRGPACVALESLGDLLRACGQNPTLAEIADLEKNVGGDFDFESFLKVLNRPGGFREPGEPEEYCRGFQVFDKDMTGVIGVGQLRYSTFFLFPLHGLGARVDSLSWVGCMLLTVYSTVLTNLGEKMTDEEVDELLKAVDTSSGEINY

SEQ ID NO: 13388 - protein, 251 aa, Aspergillus nidulans
  unsure (1)..(251): unsure at all Xaa locations
FQQCGKLELSCQTSYHGQDTCCFNTSGGQMLQTQFWDADPAVGPENSWTIHGLWXARLSGGXHASELAKLIMTKADHCNGGFDQFCDSHRKYSNISLILIDAGRRDLLDEMSTYWKDYRGDDPNLWEHEWNKHGTCVSTLETHCYSEYYPQQEVVDYFDKTVELFHDLPTYMVRSSIIRTEXSQLYXNVRLSANAGIVPSYTQTYTRHEVEDALSKAHGATVTVRCRSQRLQEVWYFFNVEGPLQTGKFVP

SEQ ID NO: 13389 - protein, 573 aa, Aspergillus nidulans
  unsure (1)..(573): unsure at all Xaa locations
DDASGSMKSRWVGQPTDVAILDLLDAFGEDDVRDRISARVAETPFSSERKWMGVVIGSGVPGDSTAPIGGPSMAYIKGALEQVLARCDTYLTKDGQEVILDERRRQVVRQAAEQMASEGLRVLSFASGAVRESRGRALGSRSGTPSSKVSSGDEDDRYSGLVFAGLVGMNDPPRKDVHKAIRRLMAGGVRVIMITGDAETTAVAIAKKLGMPIVETPGVRNVLCGQEIDRMGTSELSQALSSVSIFARTSPDHKMKIVRALQSRGDVVAMTGDGVNDAPALKKADIGIAMGKLGTDVAKEAADMILTDDDFSTILRAIEQGKGIFYNIQNFITFQLSTSVAALSLVLLSTMFGFKNPLNAMQILWISMTALXLRRCSFANIXLDILMDGPPAQSLGVEPVDPSIMGRPPRPKSARVLTKPLIQRVLTSAFMIMMGTLAIYIYEMGDDDDVLTGKRSRVVTAHDTTMTFTCFVLFDMFNALTCRSEGKSVLRGEISLFGNKMFNYAVLGSLAGQACVIYLPFLQRVFQTEPLNAAHLFKLVCIASTVFWVDEGRKYYQSLQRRRAVGVGYSVNV

SEQ ID NO: 13390 - protein, 298 aa, Aspergillus nidulans
  unsure (1)..(298): unsure at all Xaa locations
YDILASLGLLNKHAKLLFLGLDNAGKTTLLHMLKVCXQYLWLGLRVFGWEIEFTPLEESVRSETKADEVNSFRNDRVAILSPTAHPSTLSHRLTASQITIESAEDWINNGDXLRHSIEELVIGNNRFTTFDLGGHQQGESSRIHAFQTLILNNNTNAVNISPRLWKDYFPEVSGIVFLVDAKDHERFPESKAELDALLAMEELSKVPFLVLGNKIDHPDAVSEDELRHQLGLYQTTGKGKVPLEGIRPIEVFMCSVVMRQGEFYLAIICAFLFCGWXKTNFYPLLGYGEGIRWLSQYV

SEQ ID NO: 13391 - protein, 603 aa, Aspergillus nidulans
  unsure (1)..(603): unsure at all Xaa locations
MAYFRLYAVLLAVASSVAAVKVNPLPAPRHISWGHSGPKPLSDVSLRTERDTDDSILTNAWNRAWETIVSLEWVPAGIEAPIPEFDEFPTSTPSASAAATRSKRANVPIQFVDVDVEDWDADLQHGVDESYTLDAKAGSDAIDITAKTVWGALHAFTTLQQLVISDGNGGLILEQPVHIKDAPLYPYRGLMVDTGRNFISVRKLHEQLDGMALSKLNVLHWHLDDTQSWPVHIDAYPEMTKDAYSARETYSHDDLRNVVAYARARGIRVIPEIDMPAHSASGVQQVXPDIVACANSWWSNDNWPLHTAVQPNPGQLDIINPKTYEVVQDVYEELSSIFTDDWFHVGGDEIQPNCYNFSTYVTEWFQEDPSRTYNDLMQHWVDKAVPIFRSVSDSRRLVMWEDVVLNTEHADDVPTDIVMQSWNNGLENINKLTERGYDVIVSSADFMYLDCDREGSVTNDDRYNEQTNPDPDTPSFNYGGIDGSWCGPYKTWQRIYNYDFTLNLTNAQAKHVIGATAPLWSEQVDDVNISNLFWPRAAALAELVWSGNRDAKGNKRTTLFTQRILNFREYLLANGVMAATVVPKYCLQHPHACDLNYDQTVLH

SEQ ID NO: 13392 - protein, 285 aa, Aspergillus nidulans
VDVATVEKHAAYLAKSGVAGIVVQGSNGEAVHLDREERNLITSATRHALDSVGPTSMPVIVGTGAPSTRETINLCKDACGAGGDYVLVLPPSYYKSLVSSAALLDHFRAVADASPIPVLIYNFPGASAGLDLSSDDILALSSHPNIIGTKLTCGNTGKLTRIVAQAGPSFLTFGGSCDFTLQTLIGGGAGVIAGTANIIPRACVRIMELYRAGRVEEAQKVQAIVARADWLAIKGGFVAVKSALQSYRGYGQQPRRPCVAPSSEEAAALKEAFSESIELERQLES

SEQ ID NO: 13393 - protein, 780 aa, Aspergillus nidulans
  unsure (1)..(780): unsure at all Xaa locations
VPDVYPQVMAIPIAKRPLFPGFYKAITIRDPNVATAIQEMMKRGQPYVGAFLFKDENADGDVIESTDDVYDTGVFAQVTAAYPLRGEQSGVTAVLYPHRRIKISSLIPPGDSTKSGNSEDKTTEKRGDVVASFEENAAELVTKDHYEPTSFLRKYPVSLVNVENLTEEPFDKKSAIIRAVTSEIVNVCKEIATLNPLFRDQISAFYTDQFPGNLSDEPAKLADFAAAVSGGELHELQEVLESMNIEERLPKGLVVLKKELMNAQLQTKISKDVEAKIQKRQREYWLMEQMKGIKRELGIESDGKDKLVEKFKEKAEKLAMPEAVKKVFDEELNKLAHLEPAASEFNVTRNYLDWLTQIPWGQKSVENFGISHATDVLNEDHYGLKDVKDRILEFIAVGKLRGTVEGKILCLVGPPGVGKTSIGKSIARALNRQYYRFSVGGLTDVAEIKGHRRTYVGALPGRIIQALKKCQTENPLILIDEVDKIGRGHQGDPSSALLELLDPEQNSSFLDHYMDVPVDLSKVLFVCTANVTDTIPRPLLDRMELIELSGYVADEKMAIAQKYLAPAARELTGLKNVDVTLTEEAIEELIKSYCRESGVRNLKKQIEKVYRKAAFKIVSDLGEDVLAEDKALTAEGKAAQEESEKETGPIESTSEQEKATTEHPRVXLNVPDSVHLSIAKDSLTDYVGPTIFTTDRLYDTFPTGVTMGLAWTSMGGAALYAESILKNASTHKSQPGLDITGNLQNVMKEXTQIAYSFVKSAMAKQFPENRFSEKAKLHMH

SEQ ID NO: 13394 - protein, 681 aa, Aspergillus nidulans
  unsure (1)..(681): unsure at all Xaa locations
QLLSYPLGKAAEQLLPDVGFSFCGVRHSLNPGPFSPKAHLLITIMANVGTSRPYSNVISXVNPVPLRSYLNCSELTXGSLVWTQVIHQYYGQSYASAFSYQVLLSLSSDLMGRLGSFNLIQTISXRSPGYGLAGLVRKFLVYPSFCLFPQCLTTLALTKALHGGEYGPLRYGXARLIFVTMTRXEFASLRAIPEDVQHVPLRFFMYAFVGMFCYAWFPGYLFERLSIFNWLSWISPSNVNLAAITGIQTGLGLNPFPTFDWNMVTAALDPLVVPLLATLNVFAGAIVSGVLIAIFWFTNIYWASYLPINTNRLFNRWGTAYNVSEILDSHALLDQARYEQYSTAFLAPSSLVRYAFFFATYSATISYSIFYHGQAIMAGFRNLVRSFYGVTASATDIHSRLMRTYKEGDHAISKQLADTQVANRLLHPVSEIWYAALNVLALTLAVVIITAWPTSVSCCHNASLDSNYXDXPCILDMQTNVGVIFVAFCVSAAFLVPVGQIYALTGIAINLKYNHPPLFSHXSIWKLTLGAHSVLSEFLGGLWTPGNPLSVNFFKLYGYVPEPCCFRFXSTDVTAPFLTTRYTTLANALPFISDLKLAHYAKLPPWHTFSAQVIATVVSAVVCTAMLNYQINEIPDICQRFDPTPPGVIPLTLYRSYQQTQKDRFTCPGNNTYFSASVIFG

SEQ ID NO: 13395 - protein, 444 aa, Aspergillus nidulans
FAKDYGEQDPDGSYSLGTAFLSLSASIIYVGELVGALAAAPINEAFGRRAVFFSASLCIIAGAIVQACSFGSHPVFYVGRVLIGLGVGQFTATCLIYIGEVAPSAIRGPALMCFQFMQSISQLVGACVNQGTQSIQSAQSYRIPMCLLVVLPGTMLLCLIFTPESPVWYMTKDKRDAAIKALRKINRSNRDYDPTMDIQTIENQVQLEREQAKDATWASLITDPVERRKLFYACGAMFVQQINGIQFWYTYGVVFAQSIGVADPFTINTIIYVLQIVTVAISVLLGNKINRRTNLIVCSIGILVSLITVGGLGTTRSPDGSFSRGVGIGIVVLAYINIIFYNFSIGTLSYSIASEMSVGRNRNKITSCAMGVFFVTVWLMVFTSPYIYYDGNLGPMIGFVYGGTTLFLLAYSWFCVGETAGRSNADIERLFQDRVPARQWATYV

SEQ ID NO: 13396 - protein, 487 aa, Aspergillus nidulans
  unsure (1)..(487): unsure at all Xaa locations
AVVPSAPEDPLFGLAQAYRQDPSDKKVDLVIGAYRDDNAKPWVLPVVKKVRFSHGPLHGSLPCPCHGCLCRQPIERXSSVRXSVRRIGAQFRLFKXXCXQTTGRXAIRNDPNLNHEYLPIKGLAEYTTAAQKLIIGADSPAIAENRVCTFQTISGTGAVHLGALFLARFHPATPKPTLYLSSPTWANHHQIFTNVGFTLANYPYFSPQTKGLDFDGMINALRSAPAGSIILLHACAHNPTGVDLTQEQWKEVAVVMRDRSHFPFFDCAYQGFASGDLARDAWAIRYFVEQGFELCIAQSFAKNFGLYGERTGAFHFVSAPGPEAAQSSAHVASQLAILQRSEISNPPAYGARIASKVLNDPELFAQWEDDLRTMSGRIVEMRKGLRQRLEEKKTPGSWNHITDQIGMFSFTGLSEAQVKVLREKWHVYMVXYLSCVVFGXVLTDXTLDQNGRISMAGLNSHNLDYFAEAVDSVVRETSXSSYPPITN

SEQ ID NO: 13397 - protein, 514 aa, Aspergillus nidulans
  unsure (1)..(514): unsure at all Xaa locations
SLDYGKKELQMGGSMNGGIASGEVFEHGTTKRGLKPRHSQMIALGGCVGRSSCYEYYNKFDXXSRTGLFVGTGASLALGGPAFLLGSFVLMSIVVYMIVTAIVEIAAYLPVAGASMSYYGTRYVSRSLGFAMGWLYVYSLGILVPYEVTAGALVIDYWDRXASLLNFVFLLNIANLEYQSVNVGVWITVFIVVIVALNLLPVEYYGEAEFWFASIKVFTIIGLLILSFILFWGGGPNQSGILGFHYWEDPGATKTWLAEGATGRFIAFVGTLVLCAFPFTFSPELLISTSGEMQNPRKDLKKAANRFLLRLVVFYVGAALAMSVISPSNDEALSNGGNNAKSSPVCVGIRHAGIRGLSSVVNASILTMAWSAGNAYLYMSSRALYALAISGQAPKVFLRCTKGGVPYAAVLACGLFGFLAYLNCGNSSSTVFTWFVTITNTSGFVSWICCCIVYLRFRAACKRQGVHELPYRSWLQPYGAWFGLVFFIVLALINGFNVFFPGQLTASSFLTAYI

SEQ ID NO: 13398 - protein, 220 aa, Aspergillus nidulans
  unsure (1)..(220): unsure at all Xaa locations
MATTPAGRMLARQLQHMQSDKDLPGISCGLVDNNVFEWEVMLMISDDVKLYGGKFNVFHISEPAAFSISRSNITTIYXLWTPYQGGFFRARLSFPPEYPHMPPKMKFEPPLFHPNSRVDLPSVNTSPECTVPYSPVTSVYPNGEVCISILHPPEEDKYGYESAAERWSPVQTPETILLSVISMLSSPNDESAANVEAARLWRDDPKEFKRRVRKCVRESL

SEQ ID NO: 13399 - protein, 260 aa, Aspergillus nidulans
  unsure (1)..(260): unsure at all Xaa locations
QVVDAIKDLVQYCNFDCNDSGIALQAMDNSHVALVSMLLKAEGFSPYRCDRNIPIGIDLVSLTKVLRAAQNEDILTLKADDSPDVVNLMFESAETDRLSEYDIKLMDIDQEHLAIPETEYAATIEMPSAEFQRICRDLNALSESGAWLAVISPITSSFTDXRLVVIEATKEGVKFSCQGDIGSGSVTIRQHTSVDKPEQNVSIVLSEPVALTFSLKYLVNFCKATNLSSTVSLSLSQEVPLLVEYGLGSGHLRFYLAPKV

SEQ ID NO: 13400 - protein, 243 aa, Aspergillus nidulans
  unsure (1)..(243): unsure at all Xaa locations
LKYXQHTXYIYQVLLFGCRLGFYEPIRNGLTTAVYNDSHVQSLGINVFAGASSGIIGAAAGSPFFLVKTRLQSFSPFLPVGTQHQYRNSFDGLRKIFASEGVGGLYRGVGAAMVRTGFGSSVQLPTYFFAKRRLVKHLGMEDGPALHLASSTASGFVVCCVMHPPWXVGTGHLNHRIXSIXLFSDTIMSRMYNQTGNLYKGVFDCLAKTIRTEGLFAIYKGYFAHLARILPHTVSSFSGILQT

SEQ ID NO: 13401 - protein, 344 aa, Aspergillus nidulans
  unsure (1)..(344): unsure at all Xaa locations
LQXPEQAASSLENLKMNDSPVKKLNFEAAGKENAPVSNPMVDVPATKPATEKPVEPSKAALDVKAIEANEPLLQENPHRFVLFPIKYHEVSTMRHLTRHAXIGKFLPPNEPPPLTHVSAIYRIWQMYKKAEASFWTAEEIDLSKDLHDWNNRLNEDERYFISRVLAFFAASDGIVNENLLERFSGEVQIPEARCFYGFQIMIENIHAETYSLLIDTYIKEPKQRTYLFDAIDTSMFLGXFCXSRSNMIXFPCIRKKADWAIKWIQDKESTFAQRLVAFAAVEGIFFSGSFASIFWLKKRGLMPGLTFSNELISRDEGLHTDFACLLFSHLNWRPSKKVVEDIIV

SEQ ID NO: 13402 - protein, 405 aa, Aspergillus nidulans
  unsure (1)..(405): unsure at all Xaa locations
YSGRVLKDNDTLATYKIKDGHTIHLVKSAASNQRPAAAAAATPSRSTPNPTNTGVPTNLAAGSGNNPLAGLTGARYAGFAQLPGAGMFGPDGGXVTIDWNSVGPSIRRASPLTQWHSXMGPPPDAESMLNMLENPQVQSLMNEALQNPAMIDMMIQQNPLLRDNPMARQMLQSEGFRRMMTDPNTMRHMMQMQRAMGGFGGGSAFPAPGVTNTTPEENRTAQTNTNNNNSNAANALPGGLFNPFMPQGLGAGNPFAALFGGNQGSQGGNQTDQTGAAQPESGGASETGTASEQNRPAPGFFNPFNPGANPFDPEQNPLLRNPALLEQLMQSMGSPAGGAANPFASLFGGPSFGSPAPQDNRPPEERYADQLRQLNDMGFFEFERNIEALRRAGGSVQGAVEYLLS

SEQ ID NO: 13403 - protein, 259 aa, Aspergillus nidulans
  unsure (1)..(259): unsure at all Xaa locations
LSIAVAFLALFTGLYRFFDARLEQFYIFDHHHLHDLSQRAIAAHGNDTRAIVQYIVSELDEKVGSTHLNKDEEWVFNNAGGAMGAMYIIHASMCPFLSRTCLHSQRPMLMISFLQVITEYLIIFGTLALSVHSSTHRLPKYAQNMCETNXQNSGTAIGTEGHTGRHTADDYFNILQGTQLAYVPGSYEPEVYPAGSVHHLRRGEVKQYKMDSSCFALEYARGWIPPMLFFGYADTFSSTLDFPTLWATSRITGREMISN

SEQ ID NO: 13404 - protein, 246 aa, Aspergillus nidulans
  unsure (1)..(246): unsure at all Xaa locations
AQVYIKRYYTKNEIRNTNPYLVLTTAFYLACKMEECPQHIRFVVSEARALWPGAXMGTAYGHCXCTTEFIVPDVSKVGECEFSLISEMQAQLIVHHPYRTLSELQPELSLTSDEVALAWSVINDHYLTDLSLLYPPHIIAVMAIIVAVVFKPSSQTAFHGSAAPIAGAMRDGGMNILAALSDKGGAGPPPRIQKLIAWLAESEVDIKAVIESTQELVSLYEVWEQYSEKNCKELLGRMIRSKSLDK

SEQ ID NO: 13405 - protein, 490 aa, Aspergillus nidulans
  unsure (1)..(490): unsure at all Xaa locations
LRNDFFHGYATAAAQVEGAWNKDGKGPSIWDTFGHTPGKVKDNSNADDAVRFYDFYREDVALMKSYGVNAYRFSLSWSRIIPLGGADDPVNEQGIKYYQDLVDELLNNGITPFVTLFHWDVPQALEDRYGGMLNQERFIPDFVRYARVCFERLGPKVRHWITFNEPGVYSLAGYAAGVHAPARSSFRELNEEGDSSTEPFIVGHTKLVTHGHVSKLYREVFQPQQKGTIGITLHGNWSEPWDEDDPRDQEAAERAREFEIAWFPDPLYKTGDYPASMRAQLGDRLPRFTPEESKLVLGSSEFYGMNSYTTFFVQHKDTPPDINDHKGNVIVHDTNSKGVSRGEESDTPWLRTAPTGWRKLLNWIWNRYHVPIYVTENGTTAKGETAPTPEVLIDTFRMRFFEGYVGGLARAVKEDGVDIRSYFAWTFTDNWGMFKFPFPLESDXHRVEWAAGYTDRFGCTFIDFDSPMKTRYPKQSAYYLKALFEHLIAS

SEQ ID NO: 13406 - protein, 206 aa, Aspergillus nidulans
YTSNGGATLGVSGPDFAILAGDTRSTAGYNINTRYEPKVFTIQDARDRSIVISVIGFAADGRALKERLDAIVAMYKYQHGKNIGLRACAQRVSTMLYEKRFFPYQLQTMVAGIDADGQGAIYYYDPAGCIEKRSHCAAGEASSLMLPFLDSQAPRLQPLSLQTAQQLVRDAYTGATERHIEVGDHLQMLVVTREGVSEQLVDLKKD

SEQ ID NO: 13407 - protein, 414 aa, Aspergillus nidulans
  unsure (1)..(414): unsure at all Xaa locations
NPSFVLRAVKDVAFEDRVIPPLKDPWDVRVQVAQTGICGSDVHYWQRGRIGGTPPAGPFSNHQLSCRYLAYTGXCDFILESPIVLGHESSGIVTEIGSAVKNLKVGQKVAIEPGVPCRQYVRFLFVRGFLTXKEKKXNKKRRKEGKNXCTWYSCDYCRSGSYNLCPDTVFAKTPPHDGTLQKYYITQADYCYPLPYHMGLEEGAMVEPVAVAVQITKVGNVRPNQTVVVFGSGPIGLLCQAVSKAYACKKVHRVDISQSRLRLCTGFGADGVFLPPPRPEGVEETAWSEKVAALIKEKFGLGEGPDVVLEATGAQSCIQTGVHLVKKGGTYVQAGMGKENVVFPITTACIRDLTIRGSIRYSTGCYPVAVDLIASGKIDVKKLITNRFRFEQAEEAFELVKQGKDSVIKVVIQG

SEQ ID NO: 13408 - protein, 341 aa, Aspergillus nidulans
  unsure (1)..(341): unsure at all Xaa locations
KGPTAMVFLNMGGPSTTAEVEDFLSRLFVRLSRPHGLLRAYPNKNVHDIGRRDLIPLGRLQNYLGPLIAKRRTPKIQRQYADIGGGSPIRKWSEYQCAEMCKLLDQLSPESAPHKPYVAFRYAAPLTEEMYAQLLADGFGNGKGGRAVAFTQYPQYSCSTTGSSLNELWKWRTRLEGKRANCDVDATGTIQWSVIDRWPTHPGLIEAFARNIEDQLKTYPEEKRNSVVLLFSAHSLPMSVVNRGETMTFYSVRPYIXQIIIRXPYPAEVAATVHAVMQRLNFSNPYRLCWAVQVWTVWLGSAPQTSDTVQEYVKRGQTDLVLVPNAFTSDHIETLYELDLE

SEQ ID NO: 13409 - protein, 673 aa, Aspergillus nidulans
  unsure (1)..(673): unsure at all Xaa locations
QGFKSVRDAVLFAIEVSDSMLQPRPSADPKRQSYESPATAALKCAYHLMQQRIISNPRDMIGVLLYGTKQSKFYDEDENSRGDLTYPNCYLFTDLNIPSAHEVLELRSLVQDEENAKKILEPSNEPVSMANLLFCVNQIFTLKAPNFLSRRLFIVTDNDNPHGDNKSFRSAATVRAKDLYDLGVTIELFPISQIEHEFDTSKFYDVSQFLHVRSTKTHNGXDIIYKASPNDPDAPAYLKPDAKMNDAQDGISLLNGLLSSINSRSVPRRAQFSNMSLELGPNFKISVSGYILFKRQESARSCYVWLGGEKPQIAKGVTTQIADDSARTIEKWEIKKAYKFGGDQVCFTPEEQKSLKDFGEPVIRIIGFKPLSTLPFWANIKHPLFIYPTEEDYVGSTRVFSALYQKLLRDQKVALVWYIARKAASPVLGAMMAGEEKVDENGIQKIPPGMWIIPLPFADDVRQNPETALQVAPEPLIDQMRTVIQQLQLPKGVYDPQKYPNPCTCXIKVRPFATLLITKXHLQWHYRILQALALDEDVPEKPDDKTIPKYRQIDKVSFLTQHIDHIRTNTFFSALGGYVLDWADELEKQYAKITADQPKSTTLAKRPAKADNPDKAAPPAKKVKAEAGSGNIQDEVQKHFEQHTLSKLTVATLRDFLASQGRATAGKKAELLE

SEQ ID NO: 13410 - protein, 526 aa, Aspergillus nidulans
  unsure (1)..(526): unsure at all Xaa locations
SFKRAHCAIRYGVFRPSXAAXGRCQVSFRSLALLTIITKSRTRRPKALLGSRLRFALRNTKVEWYPIPVGLGIGLLGILHYYKSQRNERIRQEREAEAAGESFDFSKPPPRPKIRPSGPWQVQIMSTLPLKAMSRLWGRFNEIELPYYLRVPGFKLYSWIFGVNLDEVAEPDLHVYPNLAAFFYRKLKPGVRPLDPDPHAILSPSDGRILQFGLIERGEVEQVKGVTYSLDALLGSATPSQADHSKKFMDHHNEPSQKDAASIAADEQFATMNGISYTLPSLFSGETGGLRKRSSSKDASTESQITSETLVREDLARGDGTPWYAPKPTSNNALYYVVIYLAPGDYHRFHSPVPWVVESRRHFAGELFSVSPYLQRHLPGLFTLNERVVLLGRWRWGFFSYTPVGATNVGSIKINFDSELRTNSLLTDTAADIAAAEAARRGEQYPGFAEATYLHASRTLGGHPLQRGEEMGGFQLGSSIVLVFEAPMGTRKSFDAGWKEGQRDGGLNWTIEKGQRIKMGQKVAYV

SEQ ID NO: 13411 - protein, 723 aa, Aspergillus nidulans
  unsure (1)..(723): unsure at all Xaa locations
SPRAPNGQRKVGSSQQKSQFEEEVLEKLTQDISGLKENNSEKDQQWERPPLGEFDPTKDNICFQQIDAEEGTTMGKPAIRLFGVTEGMALACSITLSYFSDPQKAGQSVLLHVTGFQHYLYIAAPVGFTKEDCDPYRAFLESKIGQFPPVIQSVQITMRENIYGFQGNKKSYYLKITVTEPRHISKRRSALETKAQTVNYKGLWTNADGGILTFDNIQYLLRFMIDTDIQGMSWVEAPAGKYELIAPQDKVSNCQLEARIDYRSLISHAPVGDWAKMAPLRILSFDIECAGRKGIFPEPNHDPVIQIANVVTRYGESKPFIRNVFVMNTCSLIVNTQILEFQQEEKMLMAWRDFIQKVDPDVIIGYNIANFDFPYLLDRAKHLKCTNFPYWTRLNGMRSEAKDTNFSSKQMGNRDTKATNTNGRLQLDLLQLVQRDHNLRSYTLNSVSYEFLGEQKEDVHHTMITELYNGTPDSRRRLAVYCLKDAYLPQRLMDKLMCLVNYTEMARVTGVPFNFLLSRGQQVKFLSQLYRKALQQQLVIPNMKSTDEQDYEGATVIEPIRDYYDVPIATLDFASLYPSIIQAHNLCYTTLLNKNSVAGMKKDEDYIVTPNGDMFCTPKVRKGLLSQILEELLSARKKAKKELAQETDPFKKAVLNGRQLALKVSANSVYGLTGATVGKLPCLAIASSTTSYGRQMIEKTKQEVEARYXIANGYSHDAKVIYG

SEQ ID NO: 13412 - protein, 453 aa, Aspergillus nidulans
  unsure (1)..(453): unsure at all Xaa locations
MAAKSRFTRLDAFAKTVDEARIRTTSGGIITIASLLIIIWLTWGEWVDYRRVAVLPELVVDKSRGEKMEIHLNITFPRLPCELTTLDVMDVSGEQQVGVAHGVNKVRLAPAAEGGRVLDVQALQLXAEXLPIHQPSHRTPLTGPSHAEEAKHLDPDYCGECGGAPPPPNAIKPGCCSTCDEVREAYAQKQWGFGKGTNIEQCEREHYSERIDAQRREGCRLEGVIRVNKVVGNFHIAPGRSFSSNNVHIHDIANYEERGLSPAEQHTMSHIIHSLRFGPQLPDELSDRWQWTDHHHTNPLDSTSQEAPEPAYSFMYFIKVVSTSYLPLGWDPLYSASLHAAADTNTPLGAQGLSAGSQGSIETHQYSVTSHKRSLRGGDASDEAHKERIHAAGGIPGVFFNYDISPMKVINREARPKTFTGFLTGVCAIVGGTLTVAAAIDRTLYEGVSRVRK

SEQ ID NO: 13413 - protein, 400 aa, Aspergillus nidulans
  unsure (1)..(400): unsure at all Xaa locations
GXKNKKYGPWRKAQEKPPKKSPKGLIEAINPIPQGLPKSPPQKASPKRXKXKVGKQARAVSXRGYKAGAQQKPXKPKIWFRPNPRDRATPKGSXKRGRIFDYLPKLEMKTFPTPYYIDHQPAHEWKMRGILVDWLIKVHTRFGLLPETLFLAVNIIDRFLSAEVVALDRLQLVGVAAMFIASKYEEVLSPHVANFSHVADETFSDKEILDAERHILATLEYNMSYPNPMNFLRRISKADNYDIQTRTLGKYLMEISLLDHRFLGYPQSQIGAAAMYLARLILDRGPWVCSAKYXSSMGFHTLTDAXDATLAHYAGYTEEEIDEVFRLMVDYLHRPVCHEAFFKKYASKKFLKGKVFILNILFVRXRLSSLYMTRQWAKKYHHLYIDSALTEPYNSIKDNE

SEQ ID NO: 13414 - protein, 391 aa, Aspergillus nidulans
  unsure (1)..(391): unsure at all Xaa locations
SVFVKYLDQTNISNAYVSGLKGDFRLXGDELNYSNVCYYTAYVVFQVPGLLLLSRPKLYGLFSTFXVLGLFXPWIVEARWLLPTLEILWGSCTFAQSRVRNVHQLYALRFLVGMFEAPVFAETHFILGKSNSGHYWIQVXQDKSGSWYSGSDLFNRAGTWFICNPLSQIISGYLQAAAYTNLSGVGGMPGWRWLFIIDGIFTIPVALIGFLVFPGVPDSPAPFFLTKRDIEIAKDWLSRAKIRRPGSLGPDVFKRTAKRWHIYIFLFSYAYVFAKDTNKGRXDWTLANKNSCMILSSYPSSYMNLWLKDEGYSVTKINQYPTIIQTITIVSSWLGTTLASIYPSWIIYTIISTFSLFSTLCMCICCIPTGLKYVPFPACHGQQNAXQWNWA

SEQ ID NO: 13415 - protein, 280 aa, Aspergillus nidulans
  unsure (1)..(280): unsure at all Xaa locations
MSNLPVEPEFEQAYKGTTTVNEWPMITANVGAQELASTLENSTLFEQHPEYRRALQVVSVPERVIQFRVVWENDKGEVQINRGYRVQFNSALGPYKGGLRFHPSVNLSILKFLGFEQIFKNALTGRAXPLLHWMFAKSTNWYXXNMGGGKGGSDFDPKGKSDSEIRRFCTAFMTELCKHIGADTDVPAGDIGVTGREVGFLFGQYRRIRNQWEGVLTGKGGSWGGSLIRPEATGYGVVYYVEHMIKHVTGGKESFAGKRVAISGSGNVAQYAALKVIELG

SEQ ID NO: 13416 - protein, 1105 aa, Aspergillus nidulans
  unsure (1)..(1105): unsure at all Xaa locations
APDRFLAIFADVCPTAEGDLLNPEDISFFLMQCKTPGRKPVNFIPALDDDFEFYFKKDSLWQAEDVDAVLDQDAERVCILHGPIAARYSKSDSEPAGYILDSILNGVVARLRETSTAEMLLPKLERGHTTPASWSTLSLTERDTSEETSDTSITSLSELIENHSFSSGGVDSVPRPSHPLWMRALLEDDVVLQGTLRQKNPFRDLIQSSPNTVVNYNQDSSELMVTAQEPYHISSFMRAVCHDGVDIQIDISSPKGSEPLRLLYKFSDTNNIRLSEVMDKRNERIKSFYSLLWFGHDCDTSQSLNGVFYGPDITLTEDLLDEYNATIGPAYSDHRQMVPSTDVLPISMGIIIAWDVISRPLILRQIGGDLLRLVHRSNTFEYYSDTRLRLGDSVSSRSEVQAVYDDDGGRVVIVEAQILRSRVPVMTVTSTFLFRGSKGTTVPAFRRAREQKWTYDVTSEFEESILLSRNWFRPCDPSLTLVGKSMIFDLNSLVKYHDDGNMELHVQGTAMSQTNGQQQKLAIVDFRNTCTGNPVLDFLQRRGKLAEPRTEFKIPGWAGKSTMDIQMPPSNEPYAQLSKDFNPIHTSPIFSSLAGVPGTLCHGMCTSAIAERVLEHLGLGGDRERLRRFEARFTDMVMPLEKLVVEIKHTGMVDGRMCFSILAKRKETDERVLEGDAEVEQPRTAYLFTGQGSQSKGMGMDLYKTSSVAKAVWDEIDQQLYNAYGMFYSRYWSILANQXGWSVLDIVQNNPKSLTVHFGGPNGRRIRQKYLDITTEVVLPNGKRVQKPVFPGLTPTSTSYTFRHPRGLLYSTQFAQPAILLFEAAAFAELRAKGYVSHGAVYAGHSLGEFGALSALSRSVPTGALVELAFYRGSVMQASVASDNDGGTTYGMVAMNPKRVGTCRFQAPFGRDARAKIVSFTQTTLDRLVSQIAAQSQELLEIVNFNIEGEQYVCSGTVSRLTCTRLFXQLKAANLYVLGRLIDQLAEAPGQACLAEEQNELQPIIDSLLTKAKALPRPIQLQRGKATVPLEGIDVPFHSSLLRNTVDRFRQCLLRPGFLVDNIDVEQLVGKYIPNVMARPFSLEREYIQEAYELTGSPILKKMLA

SEQ ID NO: 13417 - protein, 587 aa, Aspergillus nidulans
  unsure (1)..(587): unsure at all Xaa locations
DADDTAKALIAFQLRGRRYSPQALIDQFEREHHFTTYLYETHTSVSTNANVLTALVLLSDDGRYQPQIEKCIRYLCEAWFHCDRMVKDKWVCXALSTERILLTECXNISPYYPTMLLCEGLMSYIHRWSEGHLAALPDELMNFQLPITLFQALIRTLRTQNSNGSWGSSNSAEETAYAILILKNVASFNFTDEISAELESAIRKGIQFILSKSQRSQTDDQLWLDKTLFAIPTVSDSYIVAAVQAEATDFVSGDTLNKLVDTSTPTVQKLTSYFARLPSQTETPKWVIQASVIEGILFSCRLKTLDIFSTGKALGDRYIKYAAIFWTLANNARPEYLLSTSVIYSMVELSVGIFQEDEEMEKSLVNLPDAATDAVADYIDKSCHETAFCNNVASHATPHGSDISGYDVETRTQLMTIQHNIRLWLRFALVDNLPANANSHDIYDLKQEVKMAMIAALQQAKAHKFLNSSQTFYAWLHTCAVHDAKSAVVSKSLICKIGHGSNVFRTAKEKYLAERLWRQVSIEGRLWNDLGSIERDRLTANLNSADFLESGPAGDVWEQLVQLADFEHKYALLCLDNLTQLLEASGR

SEQ ID NO: 13418 - protein, 228 aa, Aspergillus nidulans
SVLLGYAPSAASFFIVYDGVKCSLSTNLESQSRSHTILAQSLASSMGEIAACAIRVPTEVVKQRAQAGLFGGSSLLALKDILALRHPDPTRGARGGYGQVVRELYRGAGITIAREIPFAVLQFSMWETMKETYARRRQLEGPVPASTSAIFGSIAGAISAGLTTPLDVIKTRVMLARRGDGAEGKAGVRLREVVQGISAEGFGAFFRGIQPRVAWIGIGGAVFLGSYQ

SEQ ID NO: 13419 - protein, 311 aa, Aspergillus nidulans
WRLTVENGHERLRWEYLKTGKERTAQPQDPASRFYLNLPTVRSPVHVLDGLLTVTSSIPGCARAKTPSAAVLNGALYHSQVQVKELGCWAADLSCIFFVTPMLIIAWYITQAVIDEAYAVELVNFILGVQNADGGWPTYSGESTTLMGTILTYVALRLMGLPADEDHLVKARLYLLKMGGAVYLSGWAKFWLAMLGLYKWEGTDPYPVEMWLLPEWFPISPWKWYIIPRQVYLAMSYLSAKRFTMPTNPLLDEIRKEIFVQPYERIDFLAYRGVSLQCSRELRKPWPLILLNWILQNIWIPWLPAILLAEE

SEQ ID NO: 13420 - protein, 433 aa, Aspergillus nidulans
  unsure (1)..(433): unsure at all Xaa locations
SFKALNVAPWLVGSLTTMAVRKPTAIQRACIPEILKGRDCIGGSRTGSGKTIAFSVPILQKWAEDPFGIFAVILTPTRYVFLLIPTGTKSXLCSELALQIFEQIKAISAPQSMKPVLITGGTDMRSQAIELAGRPHVVVATPGRLADHINTSGTDTVAGLKRVRMVVLDEADRLLSPGPGSMLPDVETCLSFLPGPSQRQTLLFTATLTPEVRALKSMPQTPGKPPIFVTEISTEAKDTVPPTLRTTYVQVPLTHREAFLHVLLSTESNITKSAIVFTNTTKSADLLERLLRSLGHRVTSLHSLLPQSERNSNLARFRASAARVLVATDVASRGLDIPSVSLVVNFEVPRNPDDYVHRVGRTARAGRTGEAVTLVGQRDVQLVLAIEERIGRKMVEYEEEGVNLEARVAKGSLLKEVGAAKREAMVEIDEGRG

SEQ ID NO: 13421 - protein, 293 aa, Aspergillus nidulans
EAEVVLVSNDDFFTALPKIQPSSKREGFATIPDTTWADIGALSGIRDELATAIVDPIKHPELYASVGITAPTGVLLWGPPGCGKTLLAKAVANESRANFISVKGPELLNKYVGESERAVRQVFVRARSSIPCVIFFDELDALVPRRDDTLSEASARVVNTLLTELDGLGSSRQGIYVIAATNRPDIIDPAMLRPGRLETLLFVNLPSPLERVEILQTLVRRLPIEFNEDLRRLAEECEGFSGADLTSLLRRAGYNAIKRRDTIKFDDFVAAKSFIRPSVTDMKKYDKLRREWS

SEQ ID NO: 13422 - protein, 477 aa, Aspergillus nidulans
  unsure (1)..(477): unsure at all Xaa locations
SLPPVYIVSYARTPVGSFSGVXLCGPRISXEEMLTHDPSRRSLSSQTAPQLGSHAIKGICHIXLGHQRRSXLTFIXLALERADGIKPSDVQEVFFGNVLSAKLARPIPCPXALLTPLIVLGQNPARQCALGAGLETSTVCTTVNKVCASGLKAVILGAQTIMTGNADVVVAGGTESMSNTPHYLPNLRTGAKYGNQTMVDGIVKDGLTDVGKQELMGLQAEECAQDHGFNRQQQDDYAIRSYEKAQAAQAAGLFNDEIAPIDLPGFRGKPGVTVTQDDEPKNVRLQAVTLYVYSCSPTLTLNHDKLRAMKPAFIPGTGTVTAPNSSPVNDGAAAVVLVSEAKLKELNLKPVAKILGWGEAAQQPSKFTTAPALAIPRALKHAGVSQDAVDAFEINEAFSVVALANLKLLGLSEDKVNIHGGAVAIGHPLGASGARILTTLLGVLKARKGKVGCAGICNGGGGASALVVEYIAXXGHL

SEQ ID NO: 13423 - protein, 539 aa, Aspergillus nidulans
  unsure (1)..(539): unsure at all Xaa locations
HYXLGFIMKFPKIYNQYFVAFIATVGGMLFGFDISSMSAIIGTDQYNDYFDNPSGLRQGAIDSSLAAGSVVGSAIAGYVSDKIGRRDSIAFACIWWLVGTAVQTANNGFGSLIAGRVLNGVCVGITSSQIHVYLAEIAKKEKRGQRSSVSSWPLVRLWSTINESALQLTKAATEWGILIMYFVGYGCSFIPGTASFRTAXGIQFVPCVFLIVGLPFLPRSPRWLAKVDRTEEAIATLANIQADGNRDDPLVVAEWEEITMVLQAERNALPGWRKFVYNVWYLGXLSEXSVLTRWQGMWKRTLAGFTVQMWQQNSGANVMTYVRSSLTVLTSKIXPGAVCRYIFMMANLTGNINLISSGIQYALFIIFTTFIFFYIDKTGRRPLLIYGALIMALCHFVVGGILSSGEYVPGGVDGNGNVLIRVTGQSSHTVIAFSYLLIIFYALTLAPVCWVYATEVWSLETRATGMGIAAIGNWLFNFALGLYIPLGFQNITWKMFIVFGAMCVLAAIHFFFTYPETCGKTLEEIEEMFAPGGPKPWHT

SEQ ID NO: 13424 - protein, 438 aa, Aspergillus nidulans
  unsure (1)..(438): unsure at all Xaa locations
MQLKDKSLFIQKAFVNGEWVDAESGKTFEVHGIEPQIAYESGDSAHRCXWVVSRCFDDPATGKLIGTCPEFSASDTEXAIQAASAAFPKFRATFARERARMLRRWYQLMVDNAEDLATLITWENGKPLADAKGEVNYAASFFEWFSEEAPRTYGDTIPASVPGNRVITVKQPVGVCGLITPWNFPAAMITRKIGPALAAGCTVVTKSPGETPFTANALAELANRAGIPKGVVNIVTAMKNTPEVGEMITTHPDIRKVSFTGSTNVGRLLMKQSSSTIKKVSWELGGNAPFIVFDDVEDLDAAVTGAIASKFRSSGQTCVCANRIYVQKGIYDEFVQKFVEKVRNFKVGAGFEDGVTHGPVIHDRAVDKVDQHVQDAISKGAKLIAGGQRRSDLGPNFYDLTVLANMTKDMKIASEETFGPVAGLFPFETEKEVVELAN

SEQ ID NO: 13425 - protein, 205 aa, Aspergillus nidulans
  unsure (1)..(205): unsure at all Xaa locations
QVYLASNVQPPRGVLLHGPPGCGKTMIANAFAAELGVPFISISAPSIVSGMSGESEKALREHFEEAKRLAPCLIFIDEIDAITPKRENSQREMEKRIVAQLLTCMDDLALEKTDGKPVIVLAATNRPDSLDAALRRGGRFDKEINMTVPSEPVREQILRALTRQMRLXGRLDFKTLAXRTXGFVGADLNDLVSTAGLTAFKRYLD

SEQ ID NO: 13426 - protein, 323 aa, Aspergillus nidulans
  unsure (1)..(323): unsure at all Xaa locations
LYNKVAIVTGASSGLGRAIATRYAREGAKVVCADVSPTARSLEESDITTHDLILKHGGEALFIQTDVGDAAQMESLVKATVQHYGRLDMXVSTGQTKLELSELDXTSGSLVNNAGISLEARKPAVLHLTDEETWDTTMRVNAKSVFLGCKYGLAQMLRQEPHPSGDRGWIVNISSIMGMIVGPENVRRARFRVGLPTSEXCXRNVYSASYCASKGAVSQLTRQIALDYAPHRIYANALCPGCKFYIFNTTLXCXRXAEREVDTQTAIFKETTTHLTPWEDLNRRHPLKGPGLPDDVARMAVVLASEDASWVTGVCLPVDGGYT

SEQ ID NO: 13427 - protein, 774 aa, Aspergillus nidulans
  unsure (1)..(774): unsure at all Xaa locations
GKSSGFGKKGGQDLPPRGSGMSTRSPXIFHLXIIPSERHDKPETDEVHVPHTAASVAGQNEWAEFHHQPGRKFDDFALVKQEIEAETARIAGNNKGINRQPINLKIFSPHVLNLTMVDLPGLTKVPIGDQPSDIEKQTRALILEYIAKPNSIILAVSPANVDLVNSESLKLARQVDPMGRRTIGVLTKLDLMDHGTNAMDILSGRVYPLKLGFIGVVNRSQQDIQSGKSLSEALQAELDFFRHHPAYRNMANRCGTEFLAKTLNSTLMSHIRDRLPDIKGSFNTLMGQTHEELASTANKQFSGKEHRGSLILQLMTRFASSFISSIDGTSSEISTKELCGGARIYYIFNSVFGNSLDTIDPTQNLSISDIRTAIRNSTGPRPSLFVPELAFDLLVKPQIKLLEPPSQRCVELVYEELIKICHTCGSQELLRFPRLQAKLIEVVSDLLRERLGPCSSYVESLISIQRAYINTNHPNFLGAAAAMSSIIQSKQDQERKAALAEERRKREKRRIKELGGPNGNAPTHPEDEEEQPETKNLPIRTQSSKGTRSMSPHIGKISDTGITATLNGTHSNPPTGFGGANTTRDSFLNYFFGKDGAQPQLTTSASPNQNQTRQSIHXGQCELKRSTHRDAFSGGXLYHGARIXRSEFCCKYLFPIVYEALYXHTTKLSSXRTILSPAISERELMETELIRRLISSYFTIVRETIADQVPKAIMHLLVNHSKDVVQNRLVSELYKEEFFAELLYEDDGIKAEREKCERLLETYKAAAKIVGEVL

SEQ ID NO: 13428 - protein, 766 aa, Aspergillus nidulans
  unsure (1)..(766): unsure at all Xaa locations
FYEDGGDPKQINQEIKQLLETIRPDADLSAKDREGTPAALKYPLLDHQKLGLAWMRSKEECDQKGGILADDMGLGKTIQAIALMVSRPSSDPERKTTLIIAPVALMQQWKREIEKMLSPGHRLQVYILHGDKGRTSFSDLKKYDVVLTTFGMLASELKRVIKYEQLLKDGAEEPTLTRQYLKTLPCLGPTSKWYRVIIDEAQCIKNRATQSAIACCRLNTTYRWCMSGTPMMNNVEELHSLLKFLRIRPYANLGSFQESEWFSFPGISATYRRLIEANXDFSAPLKTNNKHLQEKAMTQLRILLKAVLLRRTKHSKIDGKPIFDIPPRFSEKVHAVFSEDELELYKALEAKTQLQFNRYLEAGTVGRNYSNILVLLLRLRQACCHPHLITDFSVKLNEASEGVDFIANAEQFSNEVVARLRDNENLECPVCIDAVDNPIIFFPCGHGTCSECFSRISDPSLSLQQGIDGAAQVKCPNCRGVVDPKKITDHVSFRKVHFPDESEDSAGLGGLGIAIKEDGDRDDTDDSDEGATLSDFISNDSDCDLTPPKRPKVRSKGKGKGKPRKTLAELKKEASKNQESKRKYLRRLEKTWITSAKIEKTMEIIRDIERRDNNEKIIIFSQFTSLLDLLEIPIAREGHRYRRYDGSMKPADRNSAVLDFTDDPSCKVMLVSLKAGNSGLNLVAANHVIIFDPFWNPYVEEQAVDRAHRIGQLREVHVHRILVPETVEDRIIELQDKKRAIIDGALDEKESKNIARLSTRELGYLF

SEQ ID NO: 13429 - protein, 471 aa, Aspergillus nidulans
  unsure (1)..(471): unsure at all Xaa locations
DEDDDLLDEEILNSSTADIIKRRRMLENELRIMKSEYQRLTHEQNTMKEKVKDNQEKIENNRXDFXLFXMAWRFGTPPETRNWAQSFLRIGASSPRSFLTFISXALPYLVGNVVELLDLDVEAEAAEEGANIDLDATRVGKSAVIKTSTRQTIYLPLIGLVDHEKLKPGDLIGVNKDSYLILDTLPAEYDNRVKAMEVDEKPTEKYTDIGGLDKQIEEIVEAIVWPMKEAERFKKLGIKAPKGTIKQYLVXTDSQLILLIGALMYGPPGTGKTLLARACAAETNATFLKLAGPQLVQMFIGDGAKLVRDCFALAKEKAPSIIFIDELDAVGTKRFDSEKSGDREVQRTMLELLNQLDGFASDDRIKVLAATNRVDVLDPALLRSGRLDRKIEFPLPNEEARANILQIHSRKMTVEDSVNWAELARSTDEFGGAQLKAVCVEAGMIALRKGHSKIGHENYVDAIAEVQAKKK

SEQ ID NO: 13430 - protein, 513 aa, Aspergillus nidulans
  unsure (1)..(513): unsure at all Xaa locations
PKLYQFFVALFASFGSFLYGYDLGVIASVVASDSFIDKFVRGSSTVSGTVVALFTAGAFFGAFGAGFTDPLGRRMTLVLGSVLFIIGGIIQTASVNLGMLYFSRIFSGFGIGILVEMVPMFQAEIAHARIRGILGSLQQTMLGIGSLAASWIGYGCEHHWSNTGNSVQWRLPXVACRSIPSQCITTGGADETSLALQVVPAIGLASCIFFFPESPRWLIDHDRHEEGLRNLATLHANGNENDAYVLAEFELIKQQVEEEHRHGAKSYKELFSNRSNTRRIILACACQASTQMYDPLCLQDWCYYYALRVAVTRPTPILTFYRTGVSAIQYFSPAIFAQIGISTSQTLLYQGINSIIGELAQFIFFFLIDRVGRRPLQIGGNIACGLAFTIGAALMAVYPPSSTNTSAHWAFIVTSTWFFNFCFCASGTMSWIIPAEVFNTATRAKGISLATMVSFAFNTMIAEVTPVALENIGWRYYILFIVCDFGNALFFYLFLPETKGITLEVMDDLFTNS

SEQ ID NO: 13431 - protein, 235 aa, Aspergillus nidulans
HLPSPFVLITGANQGIGQATAKNLASQYNYHVLIGCRRIEAGEKVASELRAAGHKATSLQLDLDSEESIKAAVDIIEKDYGYLDILMNNAAVLLDHDNTLSPWALYSRTFTPNVIGTATLTHLLLPLIRKAKATPPTIIFVSSGMGSLTYGFDKSVPFHQADNRAYNSSKAAVNLLVANYKRILEPKGGKVNAVSPGLVATNMTAHMNARATAEVGAASIVQLSAAGKDGESGTF

SEQ ID NO: 13432 - protein, 393 aa, Aspergillus nidulans
HTIPLTATLYGSRYNAPVTIGNTEFDLLVDTGSSDTFVIETGYECFGQSVYTGDIVTAEQSQCAYASETYNPSESDTFEPINNETFIAGYGAGVATGSMAYEDITLGGVTVTDQRFGLVNRSSPMGLGASGILGLAYPVITSAYEVNGTLEDYVDDLAEDLDDDDVDTSIEQEPYSPLFVNMARRGLVEPYFSLALERLDGDSETGDGGVLVLGGLPDVKLANNFTTVAAEYYEAAEFRSDNGTRLRSYWATTVQRISYGGDGEYTASYQTIVDSGAPMNYVPTEVADGFNQAFSSSAQWDDTQGAYRVDCDANAPDFAVQLGGTTFKLNPTDLVLRSGVEFGGEEICVSAVTRGLEQQINETDTTELYILGAGFLKGVVAVFDFGNSEMRFA

SEQ ID NO: 13433 - protein, 622 aa, Aspergillus nidulans
  unsure (1)..(622): unsure at all Xaa locations
MQSSMLLRVRALPKTASVLSRTKTATYATYKVPRIDNEPNVSYRHAFVLGCQGLCXFCRKHYAAGSPDRKALQEALARTQRNAPLSVPLVIAGKEVGSVQFPSXSSTDVLRSKSSSSLTQSNPASHGPVATYSNATAKDVQAAIESALEARKSWASTPFADRASVFLKAADLISTKYRYDVMALTMHGQGKNAWQAEIDSAAELCDFFRFGVKYAEDLYAQQPVHHAPGVWKXSPLTARLGLGXQDSRVEYRPLEGFVYAISPFNFTAIGGNLAGAPALMGNVVVWKPSPSAIASNWLVHQILLEAGLPKNVIQFVPGEAEEVTKTVLDHPDFAALHFTGSTNVFRNLYGQISTRVAAGKYRSYPRIVGETGGKNFHLIHKSADIRNAAVQTVRGAFEYQGQKCSATSRVYVASSIADSFLEQVASEAKSLKVGPPSDFTNFCGPVIHEASFTKLAKVIDEAKNDPELELLAGGSYDSSKGWYIQPTVYRTTNPDHPLLTRELFGPILVVYAYPDATEADFARIAQKIDATGEYGLTGSVFAQDREALAVANDVLRNAAGNFYINCKSTGAVVGQQPFGGARASGTNDKAGSGNLLSRFVSLRSIKEEFVPTYKVAYPSNEA

SEQ ID NO: 13434 - protein, 270 aa, Aspergillus nidulans
  unsure (1)..(270): unsure at all Xaa locations
PLTGVPKLEYAFKAITAANITSIGVRGKDCAVVLSQKKVPYVAQVTPIXAVLNEVXDKLIDPSSVTHIFRLSPSVGCVMTGSIADARASVDRARGEAAEFRYKYGYEMPCDVLAKRLANINQVYTQRVRCXSKLQAKPNSIXAYMRPLGVAITLCSVDSEKGPQLYKCDPAGYYAGYKATASGPKQQEALNHLEKKLKNKDYAEGSWEEVVELGITALSSVLSVDFKKHELEIGIAGGPRTDGKEGTDPHFRALTEEEIDERLQAIAEKD

SEQ ID NO: 13435 - protein, 320 aa, Aspergillus nidulans
  unsure (1)..(320): unsure at all Xaa locations
FLRAMTDDHSNPNCPIKLAHGTTTLAFRFQGGIVRRNIPVKRSYIRPRXYSKQIVCTDSRATAGNWIASQTVKKVIPVSRLSRGEDKPGSAPVPGLLGTMAGGAAVRVYLYRAYSHDCAEVYVXDCQYWLRYLSQQCTLHGVLRRFCSLXVMLTWYEIRHKRRITVAAASKILANLTYAYKGYGLSMGTMLAGVCGPAESDPVLKPQLTFCDRXHRKKGPALYYIDSDGTRLPGNLFCVGSGQTFAYGVLDANYRYDLTEEEALELGRRSILAAMHRDAYSGGFINLYHVKEEGWVHHGFDDMNPIFWKTKLEKGEFSNV

SEQ ID NO: 13436 - protein, 164 aa, Aspergillus nidulans
  unsure (1)..(164): unsure at all Xaa locations
LFANSDAIADCSPLTVMLYSVAGRSIAQISRDTAVCLSEIENIVAIKDAERDVSNMTETMEKTADDFAEYSGDDGLTLPGMADGAKGIAPVDCWGIRHPMHEMITAFQIGEFKKAQXLHQVLVRGPDSVFMAPRPTSVKTTFHMGWIDAGTVRLPRFPLTAEER

SEQ ID NO: 13437 - protein, 339 aa, Aspergillus nidulans
  unsure (1)..(339): unsure at all Xaa locations
QQQRNLSIHEYLSANLLKSVRAQSSALXILNXSSFQYGVGVPKGEVARSAEEAEKVAKSLGIYLSFPHLVICTKMRVSQVNDDMVIKAQVLAGGRGKGHFDNGLKGGVRVIYSXVXAPNSSFSAXLTWFVSIQSHEAKMFAGQMIGHKLITKQTGAGGRLCNAVFIVERKFARREFYLAVLMDRKTQGPVIVASSQGGMDIEAVAKENPDAIITTPIDINVGVTDAIATKIANELGFSEQCVDDAKKTIQNLYKAFMETDATQIEINPLSETSDHQVLAMDAKLGFDDNAEFRQKEIFSWRDTTQEDADEVKAAEYVHSICSRNSLTSIARPEFIKLDG

SEQ ID NO: 13438 - protein, 674 aa, Aspergillus nidulans
  unsure (1)..(674): unsure at all Xaa locations
TGDGGLHGNLLINNGFQGDDPGLTGYKAIGSVQIKQSPSMPLSAAIKSSLSVSVRADAKGLVGFANTGYNGITVLKQTYWTSFYMKGEYSGTVLLRLTGTDSGTVYGSRNLSVKSTGGKWTQYETTFEANESYVAENEWQLLFDAATAKGHPLHFGLVQLFPPTYKNRLVHFSRNEECKIGITDMIXTRTNGLRNDIARPIADLKPKFLRFPGGNNMCAASLLRTYGSGXXCSEGLDIDSRWKWNETIGPLINRPGRESQYMTQSLVSCENQTSXPAGDWHYPNTDALGLDEYLWWCEDMDMVPVLSVWDGKSYGGIVSGEELQPYLDDIKDELEVTLPLTLLSHPLRAYLTPNTNEQYLLGPPSTPFGALRARNGHPDPWPIQYIEIGNEDDYSGGCDTYPDRLVQIYDTIHASYPNLTLIANNMDENCLPEIPLPGLWHDYHYYRSADDLVAMFNYWDNHDRGDRVLVGEYGCRNDSNPDGVFWSFMQGSCAEAVHMIGLERNSDVVMMAAYAPLLQHFGYTQWSVCTPSASLAYLGIHPADRGEEQPTLFGFESRPNSLTLSTSYYVNRMFSTNQGSTVHKVHSTAGFGPLYWVATSNETAYQVKLANYGAANQTVNIRVPGVGRGVLEMISGPKDASNLPGDIKIVPVSRNIRAGKEGYTVHMPPWGVAV

SEQ ID NO: 13439 - protein, 290 aa, Aspergillus nidulans
  unsure (1)..(290): unsure at all Xaa locations
QLYNKRICLLIAHPDDEAMFFAPTLLALTKPELGNHIKILCLSSGMLVSFILWPXFRNQLMGCAVGDADGLGHIRRGELQKSAKRLGIRGDNDVLVLDDPRFQDGMGNSWAKNEIAALLTATFAPNASASASKSMSRKQAKSRDEAPTATIDVLLTFDAHGVSNHINHRSLYHGARHFLSMLMKDKSGYSCPVTLYTLRTTNLLRKYIGVLDAPFTMVKGVLDGLFAVSSSKTRKNAKDQMPAKLLFVSSVGEWMTAQSAMVKAHQSQMIWFRWGWIGIGRYMVVNDLKK

SEQ ID NO: 13440 - protein, 451 aa, Aspergillus nidulans
  unsure (1)..(451): unsure at all Xaa locations
ETEPSLRDTLRYYQPAVIWSVLISLTTVMESYDMQIVHSFYAFPHFQREYGVQLKNGEYSIPAKWQLALNCASLLGLMSGTFLNGWASERFGARKVIMISLIALTAFVAITFVSPSVEVLFVGELLSRXTPASPQPVSSEPXPSDASSIPWGFSPLPPRRMRQICPLVRRGYVTAFVNPCWVMGRLISTGVLTGTLNIPSQGPYRLPFALQWIFPLPLFIVAWFCPESPWTNLRRSEISIISWGCQLLPCWAIQNYITYFFSLAGLSPGNLFKITLGIVXTPYKVPASNXPRLRTISLAFIGTCLSWLFQTHIGRRTIYLTGLVVMLPLMLAVALLGVAPQSSGVQWAQCALLMIWFFCYPQAPSSXLLSFSFAFPLTHPGIXRLRMPIGPIPYAIAAEIGASNLRNKTISLGRGTYYILSVANSVVSPYMLNRSESNFKGKAALPAAVFT

SEQ ID NO: 13441 - protein, 315 aa, Aspergillus nidulans
  unsure (1)..(315): unsure at all Xaa locations
HPLRFDTVKVRLQTSKDGHFKGPLDCVLQTVRKESVSGLYKGATPPLVGWMVMDSVXVALRSRFELCGDIXQELCRMLGSLTLYRRLLLENVFSNPSIRAMTPFAKNQSDLHTLPSFGHGIAGIMAGTTVSFIAAPVEHVKARLQIQYAADKSKRLYSGPIDCTRRIVRNLPLPYRRCTNRPAAXRPRHQRPLPWPLCNNPLPLLFLLLVGLLRRSDASDERANFPFSTGNKLLAGGISAQIFWITSYPSDVVKQRLMTDPMGGTLGDGERKFRWWKDAAKAVYRERGWKGYWRGFVPCFLRAFPANAMALVAFE

SEQ ID NO: 13442 - protein, 462 aa, Aspergillus nidulans
  unsure (1)..(462): unsure at all Xaa locations
YYTSTHHALRAWVRNYVDTHIAPYAQEWEEAGEIPPHVYKTHCEHGFAIVHPLTTPEDSANLTLPGGVKREEWDTWCGLIVADELNRLGFVGVIWGLGGGNSIGCPPIARFGTAEQRRRWLPKVAKGEIRFCLGITEPDGMFLLLYXSVIFDMVDTSXQXRPIAGSDVANIRTTAVRQGEYYVVNGSKKWITNGIWADYCTAAVRTGGPGRGGISLLVIPLKAEGVTRRRMHNSGVNASGRXIETSGALRDEXADRRFAATGSTFIEFDDVRVPVDHLIGKENGGFPLIMSSAYPPXPDPSPPRRNPGLQFAKCKELTHSRLQSXRLSLACASLRLARVCAEDAFNYATQRSTFGAPLITRQAIQAKIFKFGLLIEPAYAFMEQLVNILEKTKNEPRDDVRIGGMTALLKVMSTRALEKSVREAQQILGGAGYNRAGKGARIEQISRDARVHVVGGGSEEIM

SEQ ID NO: 13443 - protein, 275 aa, Aspergillus nidulans
  unsure (1)..(275): unsure at all Xaa locations
FDLEGRVYAITGGGRGLGLAMAEALLEAGAKGEHSLYSLSTXEEIILTSRKVYCLDRLQTPHPDFEAARSHAESAYGGSLHYHRIDVRNAAETNSIFAKIASENSRLDGLIAAAGINHLEPALSHSPEKLHEVMDINYNGVFHSATAAARQMFNYQQKGSILLVASMSGLIANKGMTSPVYNSSKAAVVQLARNLAMEWGRHGIRVNSLCPGHIVTPMVEMVFQKEPAARAVWEAENMLGRLATPEEFRGAALFALSDASSFMTGSTMLIDGGHT

SEQ ID NO: 13444 - protein, 334 aa, Aspergillus nidulans
QIRTLDDNDRFCDILRKTLKEHLVVIPRLAMGVLECRGLLPAEAMDQFMNTLLRAVRRFYPLESTRLIHDRRISRRVIAEQHLALTETFNSPWHFPGSQDRTDLNADFVGEVFLKCNAKEVVERCGKLVQDIIRQSSGSDKIPEISVQGHLDATFPYMLSHLEYIIGELLRNSIQAVSERYQGLNQTPPPIEVLICEAPQHVIMRVSDQGGGIPREILPYLWSFTKGPHSKVRLENLGQVPAMAATLQELSVSSDIKHADKETFRESSLDTLTSRPPDLRLGIGLPMSRVYAEYWAGSLELHSLEGYGVDAFLQISKLGNKNEQVTTRAAIDAV

SEQ ID NO: 13445 - protein, 359 aa, Thermoplasma volcanium
MSTIEERIKEIEDEIKRTQYNKATEHHIGLLKAKIARLQMEARAHKGGGHYGFSIPKSGDATVALVGFPNVGKSSLLNVLTNSESEVGSYAFTTLKAIPGVMEYKGAEIQILDLPGIIENASYGAGRGREILSTVRSADLIVIVTDVETGGLDKIVKELYNSGIVVNRRRKNIEIKKTTSGGIRVHKPKNVDIDSEYIRQLMKEFKLVNADVYIREQVNEDDIIEAVQKNYVYIPSIVAVNKIDMNGAFDTSPLTRFGEVFKVSAKNRIGIDELREGIYRSLKLLRVYLRNKAGVVDFDKPLILTDGSTVRDVCRKINRSLIDSFRYAIISGKNRPIGEQRVGIDYPLLDEDIVTIISR

SEQ ID NO: 13446 - protein, 678 aa, Thermoplasma volcanium
NIYNLIYTDSCMTLTVCPYCGTGCQINVEYRNGHFTVHGYNKSIVNQGKLCIKGYQGLSYSSSSQRLNYPMIRKNGILTKVTWNEALDYVSEKLKTIRNKYGADAVAFQSSAKCTNEENYLMQKIARMFGTNNIDHCARSCHSSTVAGLIKTIGTAAATGSIKSLKSTKTYFIIGSNTTEQHPIIGTTVLKGKKSGSYLIVADPRKTKLASNADIFLQFRPGTDVALLNSIMFVILKENLYDEEFIKNRTEDFDKLAAEIEKYPPELTEAITGVDAELVRRAAEIYAKYKPSAILYGMGITQHIHGTENVMSVSNLALMTGNIGKYGAGIFPLRGQNNVQGSSDMGALAEFYPGYIPVDSEGVKRFEDLWKTELPKKVGLTLSEMFDAAAAGKVKAIYLMGENPVITEANVAEVEKGIENLELFIVQDIFLTETASLADVVLPAATALEKDGTFTNTERRVQRIVSVKSPPGEAKQDWWILSEIAHRLVGTERYRSVEDVFNEITQAIPNYSGIRYQDIYPTGKQWPVNEQNPDGTEILHTVKFTRGLGRFYPVSYEPPSEIADAEYPFILTTGRNYYHWHSGTMTRRSDILERESPSPYVEISMMDAKQLNIRDGQAIDVESRHGRITLPAKVTDKIPTGIIFVPFHFKEARVNLLVGDNLDPYSKIPEFKVVAARV

SEQ ID NO: 13447 - protein, 476 aa, Thermoplasma volcanium
MAKGIIEELDNSKINSFHLRTWLIAGMGFFTDAYDLFVIGTVISILPLAGWDKLNTYDISILSSISLLASVIGAVIFGRLLDALGRKRVYGFELMLLILGALGSAFVVPVNGINYLIAWRFILGLGIGGDYAGSSTIMTEFSNTKNRGQLVGMVFSLQGVGLIAGPLITLGLLSFIHNLDLVWRVLFFIGAVPAFIVLYGRRAIGETPRYALRVKGDASSAMQSVEKISGDSKVSVSREDLEMSNIKWTDLFKNRYFMLSLIGTAGTWFLLDWAFYGNSIMSHEMLSALIPSSMSGLNKLKLSTFYTLIIFAVSAFPAYWIATFTVDRIGRKRMQVIGFLIMGITFGILGIFRYLMSPTFVTYFLLVYGISYFFTEFGPNVTTFIYAPEMFPTAIRGLGSGISSAGGKTGAFIGTALNVIIFTLYGEGELFLILAGISMLGMLMTLVLLPETSRRKLEDISGEGRYIVRTASGFKK

SEQ ID NO: 13448 - protein, 164 aa, Thermoplasma volcanium
LSEDLVKSGAIKFGDFILTSGKRSDYYVDIKEAATDPNLLSEIASEFSKMIHARKIAGMELGAVPLIVATSLNMGIPYVIVRKERSHGTLSLIVGRLNRGEEVDVIEDVVTTGNSVLKAINVLRENGVVVKDAYCVVDREEGGAKLLENNGIKLHPIVRISELK

SEQ ID NO: 13449 - protein, 587 aa, Thermoplasma volcanium
GVALEAPTGSGKTMMALLGSLKYAYNGHLKILYLVRTNSQEEQVIRELRTISKNRKIRALPMQGRINLCILYKTADDLKEATAESLSKFCNSRKRQVMEGHQEACPYYTIKVRSKETKDFLFENLPTAEEFYEYAFTNNLCPYESIKASLSDADIVVAPYMYFLNKTVADRFLSHWGVSREQLIIVLDEAHNLPDIGRSLGSFRISIESLNRSEKEAQSFGDPELDRGVHVTDFIEMIRSTLERTIKERVKEDDVRIRFQEFKEYLMIMNKKSEKSIRDLNNYLYLFGEYVENEKEKAGKVPVSYCSSLAQRLEAMMDEDDAMYAAILSKSESGYIQASCLDPSSILSSLKESKTIHMSGTLEPFEFYSDVTGFDIPFRRIENVFPIENRFVSYYEGVSTKYDTLDENEIRKLASIIENIVNGVKRNTIVYFPSYAVMDKVIGSGLDFDFLQEKKNLDQTEFYDVVKKFRNGGKPLLAVSGGRLSEGMNFPGRELELILIAGIPFPRPDATNRALYDYYEMKYKKGWEYAVLAPAIIKIRQEIGRLIRGKDDHGACVILDKRAKQFRRFIPDLVKTDDPVNDINTFF

SEQ ID NO: 13450 - protein, 220 aa, Thermoplasma volcanium
IEIEDLYMYYGEKPALKGVNLTIPSGSIYGILGPNGSGKTTLMKILVSLLSKKSGRVSVCGLDVDKDQMKIKEIAGYIPETPVLYESMTPLELFDFVGSVRHIPVDSYARRLNALIDAFSIKDYLNEFIGSLSFGNKQKVAIISALVHDPKVLIVDEGMNGLDPRSARIFKDILMDMKNRGKIVVFSTHILEIAENLCDSVAILYEGSIVANGTIRDLES

SEQ ID NO: 13451 - protein, 426 aa, Thermoplasma volcanium
AKKIIELNDKYLARSTQSLPVVGKLGKGVYVEDVDGNVYLDFASGISVTNLGHLDPYVTQKVEEQLHKLWHFPGTDFYTEMQVLAAKSLIEVTPGKFNKKVFFTNSGTESVEAAIKIAKSYTHRERFIGFIGAFHGRTQGSLSFTASKPIHHKGFFPSMPGVEHVPFPNPYRNPFNIDGYEEPDELVNRVIDYIETYLLKTYVPPEDVAGILAEPIQGEGGYIVPPMNFFKELRKLADKYHIPLLIDEVQSGFGRTGKFFASEHFGVEPDVITLAKSIASGIPMGAAVMKEEMNFSENGLHSNTFGGNLIASAACVATIDEMKKLNAVENAAKQGAYMKKRLVELQNKYNEIGDVRGLGLMLAIDFVKDRRTKEPNSKLRNDVINNAFKNGLILLSTGSSAIRIIPPLIITQEQVDEGIEVLDKAI

SEQ ID NO: 13452 - protein, 241 aa, Thermoplasma volcanium
VNGLRAVIKSGGLDLIRNGDYFAIAMQETKVDVKSVPEEMYHLGYHVYNNPAKRKGYSGTMTLSREKPIDVSYGFESEEGRILNLEFDNFYFINAYFPNSQHGLTRLDLKLDFDKKFLGYANDLRKKKPLIICGDFNVAHEEIDIARPKDNEHNAGFTIEERTWMSQFLSSGYVDTFRLFTTDGGHYSWWSYRFNAREKNIGWRIDYFVVSDDIKDKVKASRILENVKGSDHAPVELEIDI

SEQ ID NO: 13453 - protein, 771 aa, Thermoplasma volcanium
DVMGKIVRISGPVVVAEDIENAKMYDVVKVGEMGLIGEIIRIEGNRSTIQVYEDTAGIRPDEKVENTMRPLSVELGPGLLKSIYDGIQRPLDVIKETSGDFIARGLNPPPLDRKKEWDFVPAVKKNDIVYPGQVIGTVQETSLITHRIIVPDGVSGKIKSIYEGKRTVEDVVCTISTEHGDVDVNLMTTWPVRKARRVVRKLPPEIPLVTGQRVIDALFPVAKGGTAAVPGPFGSGKCVSGETPVYLADGKTIKIKDLYSSERKKEDNIVEAGSGEEIIHLKDPIQIYSYVDGTIVRSRSRLLYKGKSSYLVRIETIGGRSVSVTPVHKLFVLTEKGIEEVMASNLKVGDMIAAVAESESEARDCGMSEECVMEAEVYTSLEATFDRVKSIAYEKGDFDVYDLSVPEYGRNFIGGEGLLVLHNTVIQHQLAKWSDANIVVYIGCGERGNEMTEILTTFPELKDPVSGQPLMDRTVLIANTSNMPVAAREASIYTGITIAEYYRDMGYDVALMADSTSRWAEALREISGRLEEMPGEEGYPAYLGRRISEFYERSGRARLVSPEDRFGSITVIGAVSPPGGDISEPVSQNTLRVTRVFWALDASLANRRHFPSINWLNSYSLYTEDLRHWYDENVAKDWGSLRSQAMDILQRESELQEVAQLVGYDAMPEKEKSILDVARIIREDFLQQSAFDEIDSYCSLRKQYLMLKAIMELNSYQSMAIDHGVTMDNLSSLPVREKLSRMKIVPEDQVESYYSSIIKEIHKEYTSFIGE

SEQ ID NO: 13454 - protein, 449 aa, Thermoplasma volcanium
YKSVSEISGPLLFVENVPNAAYNEMVDIELDNGETRQGQVLDTRKGLAIVQIFGATTGIGTEGTRVKFRGETARLPISEDMLGRVFNGIGEPIDGGPEILAKERMEITSNAINPYSREEPSEFIETGISAIDGMNTLVRGQKLPIFSGSGLPHNQLAAQIARQAKVLDSSENFAVVFGAMGITSEEANYFTNQFRETGALSRSVMFLNLSSDPSMERIILPRIALTTAEYLAFQKEMHILVILTDMTNYCEALREISSAREEVPGRRGYPGYMYTDLSTIYERAGKLKGNNGSITQIPILTMPGDDITHPVPDLTGYITEGQVVVSRDLNRKGIYPGIDVLLSLSRLMNQGIGKGHTREDHRGLADQLYSAYASGKDLRSLTAIVGEEALSQNDRKYLRFADTFEERYLKQDFFEDRSIEDTLNLGWELLADLPESDMKRVKPDHIKKY

SEQ ID NO: 13455 - protein, 389 aa, Thermoplasma volcanium
MVRVGIIGYGISKFGKRNDASMYDLIWEAGSEALKTSGVDKKDVEYLVVSNMGMWSSEELPAVVAGEVLGTERAGTNRVEAACASGSSAISSAYDAIASGHVRMAMALGVEKMSEVDTGTAIELIGRAGNFLWEYEFFGLTFPGYYALHATAYLDKYGGKEEDLALVSVKNHHYAHFNPKAQFTNDISVEDVMSSRYIASPLKLYDSSPITDGAAAVVLASEDVAKQYTDTPVWIDAIGSNLGTSNLSKRPDFTGIEAAREAARKAYKVAGIDSEKPYNFIDGADVHDCFSIAELMAYEDLGFAGKGEALELIREGQTYIGGRIPVNVDGGLISKGHPIGATGVAMAVEATKQLLRKAENGRQIDVNKGRFLTHNVGGTGHYAFVTVYS

SEQ ID NO: 13456 - protein, 237 aa, Thermoplasma volcanium
KVAIVTGGSSGIGLAVVDALVRYGAKVVSVSLDEKSDVNVSDHFKIDVTNEEEVKEAVEKTTKKYGRIDILVNNAGIEQYSPLHLTPTEIWRRIIDVNVNGSYLMAKYTIPVMLAIGHGSIINIASVQSYAATKNAAAYVTSKHALLGLTRSVAIDYAPKIRCNAVCPGTIMTPMVIKAAKMEVGEDENAVERKIEEWGRQHPMGRIGRPEEVAEVVAFLASDRSSFITGACLTVDG

SEQ ID NO: 13457 - protein, 295 aa, Thermoplasma volcanium
MTDLLQEFEEKRDLLKKAVEEHIKKRDEAAQQSRSYAEQRDQLNAKVHEMREQVKEKISQKNALIEEVQKVRAEKEEHFKKLSDLRKDYKKLSEESNYTNISQREIKAKEKELQKLITKQQTMQLTKAEEDKIVSEIKKLNNEIKKMKEDRTKQLNENEKVKELLAEIDKEKTIARDLKKKAEEISNKISEISNDINKSLQDLDEVRKKADEMHEMAVKYGKESEQEHEAFIQAKNDLRDLEKVIAGLRTKKRATKKKEKDDELQQKAEVLFEKFKNGEELTTDDLLILQKAGFL

SEQ ID NO: 13458 - protein, 359 aa, Thermoplasma volcanium
MTVKGVLMAGGKGTRLRPITYSIPKPLVPVAGKPVISYILDSFYNAGVKDIIITTGYKFEALIKGVLENKFSDQNILFSVEKDPAGTAGGVKLAENFIDDTFVVGSGDILIDFDVSKMIEEHKKRGANITIALTRVDDPSQFGIAEVDDEGYVKRFLEKPKKSETFSNTINAGVYVIEPSVLEYIPKGVQFDFAKDLFPKAMANGIKIYTYEINGVWLDAGRPGDLIKANQIMVDKYGDRNINGSRMILKARIPDGVNVSGPTYIGEGVAIGKGSSIDSSTIYEGVQIGNDVEIKNSVIMSSCRILDGSKISDSVIMQNTVIGEACEIRNSVLSQKLNLQKGSRVFDVALSSEIIQDEN

SEQ ID NO: 13459 - protein, 769 aa, Thermoplasma volcanium
VNMVKEVVKRDGTVVPFEKGKIAMAIYKAMLSVKNGSMRDAETLADKVVERLKNIERPTVEQIQDIVEDVLMTSKIEGKIFTDVAKSYILYREKRRAIREEKESLGVKDDLKLTLNAVKVLEARYLLKDEDGKIIETPRQMFRRVASHIGIIEALYDFMEYKKTGKIPENAEKIGKVSLTQEEVLRRAFNYMKEDGIMEGTFEEFMDFLSTKGTSAHLYINKFEEMMSSLDFVPNSPTLMNAGTKLGQLSACFVLPVGDSIEDIFETLKNTALIHKSGGGTGFSFSRLRPKDDIVGSTKGVASGPVSFMKIFDVTTDVIKQGGKRRGANMGILNYNHPDIMEFVLSKDSENKVLSNFNISVGVTDEFFEKLDNDDYVDLINPRTKKVTKRIKAKELWDAIIDQAWKTADPGLIFLDEINRKNPVKNVGDIESTNPCGEQPLLPYESCNLGSINLSKYVNGKDIDYDRLRETVWLATRFLDDVIDANKFPVEQIKKVTRMTRKIGLGVMGFADLLIKLEVPYNSWEALEIAEKVMSFINEESHKASQHLAEERGVFPAWYGSEWEKEGIKMRNSTTTTIAPTGTISIIAGCSSSIEPIFALAFVRHVLNGQELLEVNPLFEEKTRSLGLYSEELMRKVAETGNLENIEINEEIKKIFVTAHEVDPQWHVLMQATFQRYCDSGVSKTINMKSDATREDIAKAYRMAKDLHCKGITVYRDKSKTVQVLTAGTTETKKTEEKEVIELVTKMPDKYLKIDSTFDPACPTGKCDK

SEQ ID NO: 13460 - protein, 436 aa, Thermoplasma volcanium
MYDAVVLGAGPGGYAAAIRLGQRKKKVAIIEKDKIGGECLNYGCIPSKAIIELANSINYLKEMPGVSINYNVDMKKWQEWKWSMINKLTGGVELLLKAYGVDIFRGTGYIQDKNHVKVNDKVLETDSLVIATGSKPVSINGINDVMYNREVLDLDHIPSSIVIIGGGYIGVEIGIALAKLGSKVTIVEMMPSILPGTDNELVRHVVRRMSQLGINVITGRKVLSTAKNGEVTVKLDDGQELRAEKVLMTVGRIPNTEGFGLENLKLAMDGRFIKTDSRKMTSVKGVYAIGDVSGQPMLAHKAYYEADIAADNICGIDSEVDYRAMPYVIYSDPEIAYTGVKGAKSTRFPVAANGRSLTMNENIGTFNIYYDEKGIVTGAGIAAPHASELISEISLAVESGLMAMDIGLTIHPHPTVSEGVKESAEEVYGKPLHFKL

SEQ ID NO: 13461 - protein, 400 aa, Thermoplasma volcanium
LYEFKLPDIGEGVTEGEIVKWDVAEGDEVKKDQDLVEVMTDKVTVKIPSPVNGKISKILYKEGQVVPVGSTLVQIDTGEETSQQTMAEEHAELKPQTTAAQQIAIETVPAGKVLASPAVRRIARENGIDLAKVKGTGDNGRVTLDDLDAYMRGETKAKAPEKPIEAAKPAEVPPVQRSPGREEILEMHGLRRIIFDKMTKAKQIMPHFTVVEKVDVTGMISIIESAKSSGKKVTITGYIARIVPIVLKQYPYLNAIYDEANRRYLIKKYYNIGIAVDTPDGLNVFVVKDADRKSMYEITAEITDKAERARNNQLKIDEVQDSTFTITNVGTIGGVLSTPIINYPEVAILGVHRVMDENGKKIMYLSLSCDHRLIDGAVATRFIMDLKKIIEDPNSLIYEM

SEQ ID NO: 13462 - protein, 319 aa, Thermoplasma volcanium
TQMNIVQALNNAMDIKMAEDNDVVVLGEDVGKDGGVFRVTDGLLAKYGPERVIDTPLTELGIVGMAIGMAVNGLKPIPEIQFQDFIYTAMDQIINQMAKIRYRSGGDYTVPLVLRTPVGGGIKGGLYHSQSGETYFAHTAGLTVVSPSNPYDAKGLLISSIESPDPVIFLEPKRLYRSQKADVPEDKYTVPLRKANLLREGNSVTLVTYGSMVPTVLSTVDKNGIDADVVDLRTIAPLDKDTIISSVKKTGRVVIVHEAPRTLGVGAEVSAMISERAIEYLYAPILRITGPDTPFPYRLEDYYLPNEQRIMAAIKKVME

SEQ ID NO: 13463 - protein, 334 aa, Thermoplasma volcanium
MTEVLDQDQKSLYVKGFTSMVLGRLFDKKVITAQRQGLVGFYTPMMGQEATQAGAAMALSKQDLVYGYYRDVTLLIYLGYPIEKIFDQIMGNAEDTSKGRQMPSHYSAKAVNFMSVPSPVATNLPLAVGAAYAKKYRKEDGIVITSFGDGGTSTPDFHAAMNFASVYDLPVVFLCENNGWAISFPVERQTKAEIYKKAEAYGMKGVYVDGNDFIKTYNAVKEAVEYARSGNPILVEARSYRMGPHSTSDDPSKYRQNEVKEGDENDPLVIAEKAVISKGILSQSEVNRIKDESRKMIDEKFEERLKIPAPDPSTLFDDVYSETTWVIEEERGDI

SEQ ID NO: 13464 - protein, 528 aa, Thermoplasma volcanium
MEYSIMGYNFVRDVIERNDKRKTAVIMSDENLSSKNETYGTLLKESYKLSNFMRQLRLKAGNRILIMMENSLDLYHVVTASIAAGMVYAPTAPILPDDQIKYRVEQLKAKAIFVDAGTHQKAEQFGDIVVNMSDEGTRVEISKMDDTFNDFETEIDGEHAVFFTSGTEGMPKMVLHTNRYPEGHRTTVKWLDLNRDDVHWNISSPGWAKWGWSSYYSPFIAGSAVFGMSYRRFDPERALDAMSKFQITSVCAPPTVWRMFLQHDVGSRALYLKKAASAGEPLNPEVIERFEKYTGVKIKDGYGQTESTLMVGNLTGMKVKPGSMGKSLEPYDIRIVDENGNELGVNRTGFIAVKAEKRPEGLFSAYINDKKLTHDRFKNGYYYTGDTGYRDEDGYIWFVSRSDDVIKASDYRIGPFEVESALLRHPAVVESAVVGSPDDIRGDIVKAYVVLKKGYEPSYELARELSMLVRNTIGPHARPKRIEFVEDLPKTISGKIIRKQLRQMEIDRYMKMKNGINLNTSNKEFNIE

SEQ ID NO: 13465 - protein, 461 aa, Thermoplasma volcanium
ESINDAKTSGFHYKTWIVSGLGFFTDAYDLFIIGVVTSILVLSGWNKFTTLQSSLLDSTALLSAVIGALIFGRLIDKLGRKTVYGLELIILIVGALGSAFLTPLNGVYVLIIWRFILGIGIGGDYATSSTIMAEYSNTAHRGKLVGMVFSMQSLGLLAGPLITLGLLYSGMSLSLVWKLLLAFGAIPALIVVYFRRKMPETPRYLLRVKGDAEAAVKNWEKYTGIEASADAQAEVIKKSWTQIIKQKEFLITLVGTAGAWFLMDWALYGNSIMSSSMLGVLVPSSVTGLDHLIRTTIYSAMIFGFAAFPGYWLATFTIDRIGRKTIQSIGFAAMALSFGILGVFHQLLSPSYIVQFLLLYGMSYFFINFGPNVTTFIYPPEVFPTKVRGLGAGASAAGGKIGAFVGTFLNAIILRSSIGESGLFMILALLAAFGLIITLVLLPEPKKLDLDESSGEKALLV

SEQ ID NO: 13466 - protein, 351 aa, Thermoplasma volcanium
MSGIVTYGSYIPRYRIKPDEIARVWGENPERIKNGIFILSKSVPAPDEDVATISVEAARNALKRKKINPKEIGAIYVGSESHPYAVKPTATIVGSAIGVDFSLFAADYEFACKAGTAGMQNVKAMVDAGMIKYGLAIGADTSQGAPGDALEYSASAGGSAFIIGKDDVIAEINSTLSVASDTPDFWRREGQPYPSHGERFTGEPAYFRHVVNAAKMMMERMETQPKDYDYVVFHQPNGKFPTRAAKLLGFEEKQYKDGLITPYIGNTYSGSMMTGLSSILDVSKPGDHILAVSFGSGAGSDAFDITVTDRIEEMDRNKAPTIKKMLEKIKWVDYAIYAKYKKKIVLGDGIE

SEQ ID NO: 13467 - protein, 385 aa, Thermoplasma volcanium
NDVYIIGAGETKFGELWDKSLRDLAVEAGLEAIKDANIYSKDLQMLYASNSLAGTINEQSNIAALAADFSGIAENHVPAVRVEASTASGGAAVREAYLAIKSGEYDVVMVGGVEKMTDIYGTEIIDVQSSILDREWESFNGATPAAMAAIAARRYMHDFNVEREAISMVAVNDHANASLNPDAQYRNKITVDQVLNSDPVAEPLNVFDCSPITDGASAIILASEGFVKKNRIDGVRILSSAMAEDYLALHSRKSIYTLESTKIATEEALKKAGIKREDVSFLELNDSYSIYGLLELEDMGFAEKGKAKDLVYDDIKLNGRLPVNPSGGLKAKGNPLGATGVSQFFEAYLQLKGKAGQRQVKDARYALLHNMAGTGATSVVHVVGE

SEQ ID NO: 13468 - protein, 209 aa, Thermoplasma volcanium
EVQCGIDEAGRGPVIGPMVISIVCCKEEYLREIGVKDSKMLSRKRREYLFDKITKNCAYSYVVVSPETLNKDMASESLNKIEENYILELLSKAEGIVYIDCFDVIEERAEKYIREKSGKEVVCKHKADSIYPAVSAASIVSKVIRDREIDKIAEKYGFFGSGYPSDPRTIDFLRKAMQQGLDLRSVARIHWETYKKIKEDVESGQKKLF

SEQ ID NO: 13469 - protein, 372 aa, Thermoplasma volcanium
AVQSGELRDPRFGNVTTPIFETSTFVFPNSEKDAYIDNTRNLPYIYTRWGNPTVQAFEEKYASLEKAEHALSFSSGMGAITSVILALAERGDKILSVSDLYGQTFYFLNKVLPEYGISVEYISTDRLNSGEFKPSDYDIIYLESITNPTLKVPDIKAVSERSTGKKIIVDATFASPYNQNPLDLGADVVIHSATKYISGHSDVVMGVFSTNDKSIFDKVVVRRKTFGSNPDPIQSYLALRGIKTLGLRMEKHNKNGMELAKYLRTEPRISHVYYPDTEIGKKVLRGFGGMISFELRPELDVHVFMRNLKIPMVAASLGGVESLITLPVETSHSSMTKEERERIGITDNLVRFSIGIEDHVDLIDDIKQALDK

SEQ ID NO: 13470 - protein, 469 aa, Thermoplasma volcanium
MQETKNIVIHERSERRTRVRWAIVSLLFIAILFNYADREIWIVSEPAFAYSFGWSYSPTHLDALAIHNISLILFFWSLSYAIFNFPGGWIVDKLGLRKSMTTMFAIWSIFTALTAATFNFITMAIVRIVMGAGEGPVWPINSKVVKGWASRFDESKSFTLAGAGQAVGPVIGLIAGGILVTLFGWPSAFIFFGVLGLIFVAIWFFYVRDRPSEDSKVNENELAYIIEGKTNEEKEEKILPSKVNWKISARMIFGTQAGLGTLLVFLSFGYVLFTFLYWLPPLMFSTFAHTVEKSGLYSAAIDVALIAGFLGSGPFNDGLLKRFPDNKPLARRLGAIIPMVLMIVMVGLSYFTGKAHNLVGTAIFLGVGSGLMNLTVGSWAVNAVDLAPAGTSATVYGIYNGSLNFIGAFNAIIEGILFIRYGPVLAFTSSILFMLMFLGGYLGLIRKNTWERAMKYKEELSREAYSYLK

SEQ ID NO: 13471 - protein, 871 aa, Thermoplasma volcanium
TFEVDGRKYYYYPLNKILDGKRLEKLPRSLRILLESMVRNLDGRSITQDDIDAIVNWNPSNVPDKEIRFKVSRVVMQDFTGVPAVVDLASMRDTVKKLGKDPELINPQVRVDLVIDHSVQVDYYGESFAIEKNEELEFNRNLERYKFLKWAQKSFKNFRVIPPGTGIIHQVNLEYLAEVIFDYEEKGKRYAYFDTLVGTDSHTTMINGIGVLGWGVGGIEAEAALLGQPITISLPEVIGVRLHGELNPGVTATDLVLTITELLRKVNVVDKFVEFFGPSVKYLSVPERATVSNMCPEYGATLALFPIDDQTLDYLRTTGRSDHKIKLIKKYLELQGMFGESEGVEYTKVIDLDLSTVKPSVAGPKLPQQRLDLDQVPSSFLSSVESNSDSHLVSLRKVPLKLKGQDVELSDGDIVIAAITSCTNTSNPYVMLAAGLVAKKAVELGLKVNPKVKTSLAPGSRVVTDYLTESGLIDYLDKLGFYLVGYGCTTCIGNSGPLDKDVDEAIIKNNLNVVSVLSGNRNFEARIHKDVKANYLMSPPLVVAYAIAGNITINLDKDPLGEVNGKKIYLKDIWPSNNEIKDAVNKYVKKEMYEKRYGNITNKRWESIDVPESPVYNWDESSTYIRNPPFFENFKLNELISTFSVKGAYPLLILGDSVTTDHISPAGSIPKDSPAGKYLIEHGVKPEDFNSYGSRRGNHEVMMRGTFANVRIRNLMVNKEGGYTIFIPDNKEMSVYDAAMKYRSMGIPLVVVAGREYGTGSSRDWAAKGTYLLGVRAVLAKSYERIHRSNLVGMGVIPIEYESLNPQDIDFTKKIDIDIDGIDPGSKARMTYTDKNGESHTVPVTLRVDTPAEADYIRNGGILQYSLRKIL

SEQ ID NO: 13472 - protein, 392 aa, Thermoplasma volcanium
DGTLLVPDKVTIGYIEGDGIGPDITKTTINVINAALEVAYGGKRSIEWHKVLAGDEAYDKTGNRLPDSSLEELKKCVVSIKGPLTTPIGEGFRSLNVTLRQYLDLYANIRPVRYFPGVPSPVLHPEYMNMVVFRENTEDLYAGIEWRYDSEDAEKVRAFLSSTFNINLTPDTGIGIKPISKFKSTRLVRKAIQYAIANGRKSVTLVHKGNIMKYTEGAFRDWGYEVARTEFGDYTVTEAEYLKDPEKYANKIVIKDRITDNMFQQVLTRTQEYDVIATPNLNGDYLSDALAAQVGGIGLAPGANIGDHYAVFEAVHGTAPKYAGLDVANPTSLILSAEMMLDHIGWKEASKILDDAIMQTYRDQKLTQDIARLLNLKALKCSEFGEEIINRM

SEQ ID NO: 13473 - protein, 585 aa, Thermoplasma volcanium
LDETEINDGAKRWIVSIAKHLNPSSIYVCDGTKEEFDDLASAMVKDGEMIKLNEKNFKNSYLYRSNATDVARTEERTFISARDKSFVGPLNNFLPLDRVKQVWNQFFKGAYTGKTMFVIPYALSSPESKFADFGIEVTDSKYVVLNLHYITRMGKGVIEKIGDRFIKGVHATGNLDPGNKFIIHMPWEKPEGVDADILSVNTNYGGNALLSKKCHALRIASVRAREEGWLAEHMLLLEVKDPQGKSHFITGAFPSASGKTNLAMISPPKDYRDAGWSTRLISDDISWIKIVDGKFMATNPENGFFAVVPGTNYNTNKNAMATLSKNTIFTNVGLTMSGDPWWEGLDPVYDELYDWKGNKRKIGGEPIAHPNSRYTSPLTNYPYLSDLYEDPEGVPVSAILFGGRRATLIPLVFEAFNWNHGVFLGATMGVERTAASEGKVGDLRRDPMAMRPFCGYNINEYFRHWIEIGERSKNKPKIFYVNWFRRRADGTFIWPGFAENFRVLEWIIYRTSHNDNAVETPIGYIPESLNLAGLNISEEDVKELFRIDKEGWKEEMNEIQKYFSELGNVPEEILKEFELEKKRLG

SEQ ID NO: 13474 - protein, 998 aa, Thermoplasma volcanium
RKIYEIISLSIIEIKEISNIKLNNNNIKIPYSTFQDPNEIKDFSFEVNLDQLDDGYKYLLSVELSGNAELIIDGMLDQSIDAGHTYSIFDGPKHEFVLRVGSRELFGKNSWYLNIKSIKIITINYKLFKLGLNFLQLFKYADTTSRSKLRIYNYMLKYLLTLYESPNIEQIMGIGSIFLNKNKEELVDFLSDVYGYPIINHMIKDYPRKDINLYKYTNVLEHIIKTIAASDNKYKTNKVFAFGHCHIDVAWLWPYSETLRKIERSFLNVLKLYEMGFNFVFAQSTALYYYEIEKRNVYIFNKIRRLVNDGKWFIVGGMWVESDTNLIRGESLARQLLYGQGYFKEVFNRYSRIAWLPDTFGFSGQLPQLFVKSGMEVFVTHKPMWNDTTEFPYHCFKWFGIDGTPIITSIVNLSYNENLDFDSVVNAYKSNKNKNLPITYLYGYGDGGGGPDIEMMLKLEQIKDLQFMPNVNGSFSEQEYIDSFKEFYKEMPSYFGEIYLENHRGVYTTNLEIKKYVANIEDKLIMLDFINSMIYNSKLYISNTKKLWYGLLKAQFHDILPGSAYYYAYEEAFAELDDIILEIDKITEFAIRKFIEDKNIKKGLIAINNSQYEFNHFVEIDNSLASEIPADKVVNVGDKKFVLVNVPPLGFSVINTNTENKFENEIKIRKIKGKYIIENKIIKLIINSVGIISFFYNNKRYIKKGNIVKIYNDIPANFDSWNINAQNIRKDLFMDEIKTEIRVISKNIIGMVEIKKIFEDGSSIIQKIIIRPGSSIVEFENTLLLKNREKLVKVVFQPYFHADYIKREIPFGYIMTKLNSKNEKTRPEFPALRYVDYSDNSHGFSILSRESHGYSFINGELGISIAKVPLYPNPFSDRNEVREKFYVYLHNEYYNIYKDANFVFNPIKLHVNEYDGDNVRESLFNFSGENIILENIKVAEDNSGLVTRFYNCSDKMSTLELNFPGGDIYETDILENKQVKYNKNIIFKPFEIKTLLIE

SEQ ID NO: 13475 - protein, 584 aa, Thermoplasma volcanium
MVEVKIIKSDGFFNEVLISSDKKIHFDTAYAEGDFNCFGEGSIVSETTDDLKFKIANLIPGKYHFKIAIDQYKILREAENRSGSYSFSIWLEKPYHNPDYAQFCAIIDKKLMDVRIAVPKHSISVSIFTKDTLKPVYSRRASFDTFDAVEYVFDGMSDYYFEVDNSRLPKEGYFSPKVHIEHEGGSKIIYHIFPDRFFRVGPHLPTLSRWGDKPTFSSFFGGNLRGITEKIGYIKALNVDTIYLNPVYKSKSNHRYDVDDYFSIDGLLGGEQDFIELVNEAHENGIKIVADMVFNHTSTDFPYFLDALKNGKNSKYWNWYIFHGEGAAVFDGRAKGKTKPLYETFMGVGRMPKLNHKNAEVRKFCIDVMKYYKNKFGVDGFRYDVAHSIYPEFFLEAVKEFGNEMLHIGEAWCLPSMFMLSGYWNSFTNYYLRNAIIKFVREEINITEFYNMIQNMIISYGPLIQQNVMNILDSHDTERILRAFKGNKKKVKLAYSILFMFDGFATIYYGDEVGLDGGRDPDDRRCFPWDNMDEDMLQFLKKLGEIRRMYHTGSAGIITVEETQECKYITRLSGESIIKVAIAK

SEQ ID NO: 13476 - protein, 174 aa, Thermoplasma volcanium
MSLVNKAAPDFEANAFVNGEVKKIRLSSYRGKWVVLFFYPADFTFVCPTEVEGFAEDYEKFKKKNTEVISVSEDTVYVHKAWVQYDERVAKAKYPMVEDRKGIIARAYDVYNEETGNAQRGLFIINPDGIVKYVVITDDNVGRSTDETLRVLEALQSGGLCPVNWHEGEPTLKV

SEQ ID NO: 13477 - protein, 891 aa, Thermoplasma volcanium
LIIERIRLRNFLSHSDSDIYFDTGINMIIGQNGAGKSSIVDAIRFALFSDKRTRRTEDMIKKGERYMEVELYFRSEGHSYRIRRTIERRGKSISTDAEIERDGSIITRGASDVSNYVEKNVLNINKDVFLTSIFVRQGEMDALVSKDPAERKKILDEILNIDRLEAGYLLLKEVIDDLTANVSDYDYLKNELQSKINEIDNNNKQIEELESKLRLIEPEIKALEEEINIKENKKDHLNEELHRLNAQLETIKKYEMELAESQSRKASIEMEVVKLPSIEEELKRLENNAAVVKRNEIIEYINLKKDLGSLSEIIEGLKSDLSKYDEAHRKLEDLQSFRSEFLEKKKRKEDLDKLRSSLKEDEDNYQSAVRNIENIKKWIENEEKEIERMSAFISEILKIQEITPEIINSRRAEINSSLMQIEGKIASLNASIDAMRSHKMEVEENAAMLSGRGVCPVCGTHLGTEKSEDLVKHYGEEASRLEEDINKTENEIKKLDEERKHQKKLLDRINGKDVERLIASYNLLSSKRAELKKFMDDEARLKEAHLKAEAAISQYNSIDLGDLEAKNEEWLKANAVISSIDIENIRSRFEEKNKQLNDIIKRMNEIEVNIPDVESYNENSLKRIDEELNSLRNKKNELYAKKAAMDEIQKTIEHFKEEISKKKGIEDSQAEVNAQLLQINDDLKQLSSRLDKINVDQYEWKSLHKVLLQDNEKLNIAVADIRKRLEKKETIIKAIADLKRVREAFSKDGVPAIIRKSASEFITNQTRQYIQRFELDIDDVDVDQDFNITVFRGGIAEGIDSLSGGERMAVAFALRVAIAQFLNKDVSLLVMDEPTAFLDEDRRSDLANIIEYSLKDSSGIPQVIMISHHRELLSASDLALEVKKRNGSSIV

SEQ ID NO: 13478 - protein, 386 aa, Thermoplasma volcanium
MPETTEEISKGLEDVNIKWTRLTTIDGNKGILRYGGYSVEDIINNGAQAEEIQYLFLYGELPNAQELKIFKENVQKGYNIPDFVINSIRQLPRESDAVAMQMAAVASMAASEIKFKWNKDTDRDVAAQMIGSMSAITANVYRHILGMPAERPKPSDSYAESFLKAAFGRNVTKEEVDAINTALILYTDHEVPASTTAGLVAVSTLSDIYSGITAALAALKGPLHGGAAEAAIAQFDEIKEPSNVEKWFNDNIINGKKRLMGFGHRVYKTYDPRAKIFKGIAENLSKNNAEVKKIYDIATKLEDLGVKQFGSKGIYPNTDYFSGIVYMSVGFPLRNNIYTALFALSRVTGWEAHFIEYVEEQQRLIRPRAVYVGPAERKFVKLPDRK

SEQ ID NO: 13479 - protein, 987 aa, Thermoplasma volcanium
  unsure (1)..(987): unsure at all Xaa locations
VLKLGVDSCGSWXSYRVYAGSKSLKGEKNQTILQALLLNGIDIPHICYHPSLGPINTCDTCLVDMNGKIVRSCSTYLEQGAKIDYNSNRVLELQREAVQRMLHNHDLYCTVCDNNNGDCPLHNAVHDLEIDNQKYPYEPKPYPVDDSNPFYVYDPNQCILCGRCVEACQDVQVNETLSIDWSRERPRVVWDNDVPINESSCVSCGHCVTVCPVNALMEKTMLGKAGFLTGLEKNTKQKMIDVVKSIEPEITMSPIMAISNIESKMRSSRIKKTKTVCTYCGVGCSFEMWTMGREILKVQPQPESPANGISTCIKGKFGWDFVNSKERLTSPLIRDGERFRRATWEEALDLVAKKLREIKDKYGGDAIEFIASSKGTNEEAYLMQKLARQVFGTNNVDNSSRFCQAPATTGLWRTVGYGGDSGSIQDIYMADLVIAIGTNTAESHPVLATRVKRAHKLNGQKLIVSDLRMHEMARRADLFLHPKPGTDIVWLSAVTKYILDKGWEDKSFIRERVSGFEDYVKSLEPFTMEFAEEATGISKETLMKVANMIHEAKNMVILWAMGVTQHQAGSDTSTAISNLLLITGNYGRHGTGAYPLRGHNNVQGASDFGAMNAYLPGYQPVSDPTVRKKFEDAWHCTIPEKPGLDNNTCLEGIMNGKIRAMYVVGEELVETGSDSNFIRDQLEKLDFLVVEDLFLSETAKYADVVLPASASLEKEGTFVNTERRIQRIYEVMAPLPGTRPDWQIIQDIANRLGARWNYGHPSEIMEEAASLSPIFAGVRYELLEGFKSLQWPVRSDGKDSPLLYEKEFNFPDGKARLYPLKYNPPLSSGLEFDLHLNNGRLLEHFHEGNETYKSPGIRSKVPGTFVEVSPDLAKERGLETGDLVRITSEYGSIKVSVLVSDRVSGKELYMPMNASGDSAVNLLTGRLMDPTAHTPAYKEVSVRLEKITGKRGPPPLPSTNPRNAIPHPQIGVQVEKKWARKDYVKLT

SEQ ID NO: 13480 - protein, 470 aa, Thermoplasma volcanium
LSEKYDLVIVGRGAAAFSAAIRASEITSGQARIAMVGNGPLGGTCVNTGCVPSKLLISISNSFQNSLKPRYPGLPSVERPPETEVIMDFIRESVHGERKKKYEDVVESYENIDLYTGTAVFTGEKEILVDSSHSLFGYNVLIATGSRPYVPGIKGLNETSYITTDSVWELKHVPASIAILGGGAVGVEIGQALSRLGSEVHIIEVSNQILPGIPADMASIIERSLREDGMVINTSTSVDEVSGGEGKKYLKLNGTNINDTLEVEEILVATGRAPNIDLALEKTGVKYSKRGIAVDEYLRTSNRKIYAAGDVVDQKYKLETLAAREGFISAENMFNHAMRTIDIFNVPFAVFCSPGYASVGYTQDEATKAGIKTEARRISTKDVASERIHANREGIINIVAEADTKEIVGVQIVAENAPELINEASAILSKRFKTDDLINTVHVFPTENEGLKLATQSFSRDITMMSCCME

SEQ ID NO: 13481 - protein, 354 aa, Thermoplasma volcanium
MQIESQSPTDVVASYKAKIDESISRFFDRKEEETKDVLSKRVIKIIRDYTEGGGKRLRPIFMILGYRLFSPEEKGIFDASISIELAQSYLLIHDDVIDKSDVRRGKPSMHIRLEDAFVAGCPQSRSTAEGLAIVAGDLAESYAHEALLRSGFYSENLVKADLELSKTIEMTGYGQFLDILSTTMDDFNEGDLIRLHLWKTAKYTLEGPLAMGAILSGTEYDITALREYGRVLGIAFQLKDDILGLFGDEKTIGKSVYSDVNEGKKTLLMIKAMEWGDRDDANFIRKMLRKGNVTNEEFERIKKLVMDTGSYDYSINLMGKLVDKSKEYLAKVSGDNYVKKILDWLSDYLISRDH

SEQ ID NO: 13482 - protein, 328 aa, Thermoplasma volcanium
MKAVFVYEPLGNENVKVEEVSEPKKEQGKVIIEVKKAGLNPIDYNVINGKIVYRLNPLPHIPGSEVYGIVKEDSGSFKKGERVIVYNRIFDGTCSQCISGNEHLCENGGIWGVVSNGGYSQLVQIDEKNVFRVPEDASDELAASIGVAALTSFRAIRISGCSPGRSILIYGASGNTGMFAVQLASMMGCDVYAVSRKDWIESFGAIEVFRPDNIPPDMKFDIIINPLGSLFWGDALKHLRTRGILVSFGVLTGREGSIDIADLYTGEKKILGSTGGTREDLRGLLEFMKTHELRVKIAREFKINEIKDALKYYSETHDGRILISMRES

SEQ ID NO: 13483 - protein, 297 aa, Thermoplasma volcanium
VLDMKNDLDEIINLSIELKKNRYRSYESLRNKMLGLIFEKPSTRTRTSLEVAIDQLGGHAVYLNPSEMQLGRGETISDTGHVLSRFLDAIAYRAFDHKNVVELARSTSIPVINALDDVEHPLQIVADFMTVKEKKGKFSGLKFSYIGDGNNMANSLMLGAAILGVDIYVATPHGYEPKSEFVDKAKQVAKERGSKVIITNDAIEAAKDADVIYTDVWISMGEESKRGEKEKAFTKYQINSDLVSNAKKDYIFMHCLPAHRGLEVTDDVADSINSVIFDEAENRLHSEKGVLYKLLSY

SEQ ID NO: 13484 - protein, 285 aa, Thermoplasma volcanium
MVLIDKNTKVIVQGITGHQGSFHTGEMLKFGTNVVAGIAPGKGGTKFADKVPIVNSVAEAMQYEPDATMISVPAPFVKDAAYEAIDNGLKIVYILTEHVPYQDTMEIVKEAQLRNITVLGPNGPGITVPFESKIGIMPNHIFKEGDVAVASRSGTLTYEIVYAITKAGMGESTVIGLGGDRVVGLSFIDVLKMFENDPKTKKIVLVGEIGGNNEELAAEYIKKNVKKKVVAYIAGRSAPPGKRMGHAGAIIERGVGTAESKLKAFNSAGVKVADYPQDIPKLLEE

SEQ ID NO: 13485 - protein, 376 aa, Thermoplasma volcanium
ITSCYNWSGGVLNLYEYMGKDIFREYGIPVPNGYVVSSPQDVKKFTNPVAVKSQILLGGRGKAGGIKFAKTDEELKNAVSTLLSTKVRNMTVTKVLIEDMLNIKHEYYVSIALNRAAKSPMLIASAMGGMEIENVPDDKIFKRIIDPSLGYSDFIGREASQFMGLPPELSKQFLDILKKLYNVYRGEDCELVEINPLVETGDGKLIAADAKVVIDSDAIYRHREFSIQDPEKTPLELKAEGKGYAFVELDGDIGVIANGAGLTMATLDALLLHKGKPRNFLDLGGTDNVDIVINAFDLVLEAKPKAILVNIFGGVTKCDTVAQGIVEAKKKFDIKIPVVVRLSGVHEVEGRKILQDNGIEAFSEMMPAIERVTKVF

SEQ ID NO: 13486 - protein, 450 aa, Thermoplasma volcanium
HCKKPFIWFAYNPRVKMSVNYSEDNNRTAVVVGLQFGDEGKGKITDFLSESYDVVVRFNGGTNAGHTVVVGNETYKFHLLPSGSLRTKVVVLGSGMVIDPQSLISEIEIVKKNNSNLAVVVSSNAHVVTKIHKYLDVEEEKIRSSMVIGTTAQGIGPTYEDKYARSGLRMIDLLDYKTIIEKLDIIYRMHENLLSRSEFSDPSVRENLAKELYSYGQELKKYMYYTDILINKLYNEGRTILFEGAQGVLLDPDFGFYPYVTSSNTISASSYTGTGFSMRKIKKVIGVAKAYVSKVGAGPFPTELNDDLAKKIRDAGGEYGTTTGRPRRVGWLDVPLLKYAVQIDDVDEIALTKVDTLGILHTIKVCYSYELDGKQIDYIPKHISEVSRVKPLYEEFEGWGDLSSSLLHPKMRKWEIPQQLRRYIDFIEEQIGRPVTIISSGKDRSKTVRI

SEQ ID NO: 13487 - protein, 123 aa, Thermoplasma volcanium
LIMTNVPDGLKYTKTHEWYKVDNGIATVGITDYAQSQMTDIVYVDLPEVGDKKKVGDVLLTIESVKSAEDVYSPLTGEITEVNQELTKHPENINKDPYGNWLVKMKVEKEGEYLTAEQYRKLI

SEQ ID NO: 13488 - protein, 233 aa, Thermoplasma volcanium
MQQGQMAYDRAITVFSPDGRLFQVEYAREAVKKGSTALGLKFSNGVLLISDKKIRSKLIEQNSLEKIQLIDDYVAAVTSGLVADARVLIDFARISAQQEKVTYGSLVNIENLVKRVADQMQQYTQYGGVRPYGVSLIFAGIDQIGPRLFDCDPAGTINEYKATAIGSGKDAVVSFLEKEYKEGLSEKEAVTLGIKALKASLEEGEELKAPEIASITVGSKYRIYGAEEVKKFL

SEQ ID NO: 13489 - protein, 179 aa, Thermoplasma volcanium
MRSVITGVAGVGKTTVLDIVARESGIPVVNYGTLMFEVAKRRGLVENRDQIRKLSRETQVDLQKLAGEEIGKMENAIVDTHMSIKTPFGYLPGLPEWVLRSINASVFVIIEADPAIIKRRRDNDPTRARDDEGVDSIREHQEMNRYFAAAYSIFSGATVKIVKNEEGKPEQAADEIVRV

SEQ ID NO: 13490 - protein, 187 aa, Thermoplasma volcanium
RITIAGKIGSGKSTVSQEISKITGYSVYSSGTFFRESAKKMGMSIEDFNRYAETHPEADYATDGMQKDFMETHDNIIVEGRLAGWICKIYSISAFKVFLYATRYTRLVRFSNREGIEIDEAAKLLDEREISEKKRYLDLYGIDIDDLSIYDIVVNTEFMKPEEVAVLVLNRIDEMSRKEVYTPRILK

SEQ ID NO: 13491 - protein, 277 aa, Thermoplasma volcanium
  unsure (1)..(277): unsure at all Xaa locations
EIPKVTFEDVAGLDDVKNEILGKIIYPMKFKELSQEYNIQFGGGMLLYGPPGTGKTFIVKAIANEVKARFINVNPSTLYSEWFGVFEKNISKLFRAASLLSPAIIFFDEIDALVPKRDTSNSDAAKRGVAQLLNEVGGINSQKNKNIFIIAATNNPWEVDEAMLRPGRFDIKIYVPPPDIVARKKIFQLNLAKIKQVGNVDYDLLAEETEGYSGADIEFICKKAAQNVFMEAVKTGKSRPVETRDVIDVIGSIKPSIDYELLEKYSKYGSAFXAIAI

SEQ ID NO: 13492 - protein, 370 aa, Thermoplasma volcanium
LPLWYFRTPRIIFGEDSLSFLDDHSSSKILVVTDNFLSNTPILKEVLSHLSGKDIKVFSEISPEPRLSEILKGRELASRLDPDTIIGLGGGSSMDAAKILFALHEMPDLSPFDISPINSIKLHQKSELIEIPTTSGTGSECSWAAVFSDDTEERKNEIASPEIMADYAILDPKLVLDLPKGITVNTATDAITHAIEAYTSQWRNPYSDAMAEKALDLILNNLPTVLVNPKDINARNSVHIGASMAGISFSNSQIGLAHALGHALGAIFKTPHGESVGLYLPHVTEFNYEAAKDRYDKINSFFPDEYRTDKVWETIRSYLNAIGQVTNVSEAGIERSKYEKELGKIVSLASESTGVITNARDASTKDIENI

SEQ ID NO: 13493 - protein, 476 aa, Thermoplasma volcanium
  unsure (1)..(476): unsure at all Xaa locations
QYGKFWXYNKWDRRNGWRRIYVKSPVDGSPIASVYFADRDAVSKAIDSSYDSYYKVWSKFTLSERKKLLAKLADRIQEKSERYATLESLNTGKTLRQSMLMDIPLGIEHLRYFATETEFKMERQITHPEYPDSHGIVQYVPMGVVGAITPWNVPFLMAVWKAAPALLAGNTVVIKPSSFTPLTTIEMARDAISVGFPPGVLNVVNGRGETVGEELARNKKVRMLSFTGSTYTGKRITEITGIKKVTLELGGKSPNIVFDDADLERAALGVMFGIYLNSGQLCESGSRLLVQSSIKDKFLNLLKSKIEKMRPGNPMSMETDISAITTKNQRDKIEKMVNSGLKDGSVIFYQKSIDGSVPKGGLYFPPTILDKVSEDMEVAKEEIFGPVLSVMEFDDEADAIDKANMTDYGLAAGVWTQDSEKATRVASSIEAGTVWINEYHLLSAAAPRGGFKNSGVGRELGLDGIMEFTQTRHLFV

SEQ ID NO: 13494 - protein, 392 aa, Thermoplasma volcanium
LINMQKYNWVDEEISALKAEGRYVPIRTIESAQGAWVKINGKQVLNMCSNNYLGFANHPETKKAAIEAIEEYGVGAGAVRSIAGTDEIHIKLEEKIASFKHSEAALVYQGGLLANLGTVPALVGKDDIIFSEELNHASIIDGTRLSPAKRIVYKHLSVDDLEKQAKENRSSGKKALVITDGVFSMDGDIAPLPEIVDIAEKYDIMTYVDDAHGEGVLGDHGRGIVNYFHLEDKVDIEMGTFSKALGSMGGFVAGSAEMIDLLKQKARPFLFSSALNPGDAAAVLKAIEILEKDDSLVKKLWENADLLKKSLADLGYNTGHSKTPITPVIIGDEKKTVELSTKLYEEKNVFASPIVYPTVPKGTARIRLMPSAVHTHEDIMTAVNAFGELGKK

SEQ ID NO: 13495 - protein, 254 aa, Thermoplasma volcanium
MNIKLLPEVGDLVVVKITEVKNFGANGILEEYPGVEGYIHISEVATGWVKHIRSYLREGQRVVCKVINVNQERKNVDLSLKRVNQHQSREKIAEWKNEQKADKLFEIVCSKLNKDLEACKKEFGVRLVELYGTLFAAFESAAAAEGEWLPDINGDWKDTFVEVAKENITIPEVSVAGYFEAYSLASDGVEKIKEVLTIPPEIGKAELEYVGAPRYRIVVRDKDYKKAEETLKKIVQSVTDKAKKLQVELEFSRQ

SEQ ID NO: 13496 - protein, 150 aa, Thermoplasma volcanium
MELLKVGDQAPDFETVDQSGSKVRLSDFKGQPVVLYFYPKDNTPGCTTEACNFRDNFNSFKEAGIKVIGVSVDSPESHKRFAEKYQLNFTLASDKEKEICKKYGVLGLATAKRVTYIIDRDGKIVYVYPKVTPKDHAVEVMNKIKELGLI

SEQ ID NO: 13497 - protein, 438 aa, Thermoplasma volcanium
MGFFDDMDRMGIRPFHRKIEILASMGMFLDGYDLSVITMAILLMPTQLHFGKLDYILVNVSAFIGMIIGAPLLGRLSDRIGRKKIFGIDLLLFVVFAITAGLATNFAMLFISRLMLGIGIGGDYPISSTMVSEFSPVSKRGTLLYGMVGMYWLGSFFSAVMNYTFAFTPYFWRYTFIVGGVIAIPIIFLRMRIPESPRWLIGHGMTKSAESVVEDLTGRKPDVEEGKAEAEQEESVKFSSLFSSKFLASTIFVLSVWFLFDVASYGIGFYYPTLIDKLGLASHVLNTAGLRAIAESSMIVAVGAILGYLVAMPLADRIGRRILTISGLFVMFLLLLLGSVVKISTLLPVVAFFFSFVLFEQWVGAATLFYPTELFPTNYRSTIQGIATSVSRVGAIMGIVVFPLYPVFHSIFIFAILMALALIISVIFAPETKKTPLE

SEQ ID NO: 13498 - protein, 211 aa, Thermoplasma volcanium
  unsure (1)..(211): unsure at all Xaa locations
EKXTSLIGEKFSXMDVVAIKGNMKLPGDYSGKWLVLFSHFGDFTPVRATEFFSFARRNDEPERLNAXLIGLSVDSKISHIEXLSLIHYNLKIDVKFRVIADPMENVANALGIIXAESATSMVRTVFIVDGKYVVRAKLYYPIKIGRNLSEILRMIKALQMVDKYKVETPASRPDNELIKDKSIIPPPVTIDDIPESMKIIQGLVWWLTYKE

SEQ ID NO: 13499 - protein, 148 aa, Thermoplasma volcanium
IMDRTLVLLKPDAVKRRLVGKIIERFEEKGLKIVAMKFMQMTKDQAKTHYSVHQNKPFFNDLVNYITSGPIVAMILEGAHAIEIVRLMSGATDGSKAQPGTIRGDYSMGIEKNIIHASDSLEAYNHEMPIFFSDNEIIEWAYGDEVIY

SEQ ID NO: 13500 - protein, 582 aa, Thermoplasma volcanium
SLPAKKLRQPIVCVLGHVDHGKTTLLDIIRGTAVANKEPGGITQRIAATTVDINKILKATEKLNNKGMKIPGLLFIDTPGHVAFSNMRARGGALADIAVLVIDINEGIMPQTVESIDILKKFKTPFIIAANKIDLIPFFTDVKTNLFTEFIRKQRQEYVNELDARIYNIVNKLYEYGLNSDRFDRISDFTKTIAIVPVSAKKNIGVPEILMVLAGLAQRFLESEIEYKDINGHATIIEVRREESAGIALDAVLYQGTISVGDTVAVNTKTGPVTTKVKALFVNTGKSQRSLKEVETVSAAEGIRVLISDKLDVISGSPLIVVKGNMEQVMKEIEEASKVDIPLDENGIYVKAEAIGSLEAISYELNKQGIKIRAAAVGDITKRDVMDVQTLQDPLNRIIIGFNVSILPEAKDAIESSDVGVITGDIIYKIVEDTQKWIEERKKQLSQKRKEAMPVPAKIRILPQYIFRASKPVIVGIRVETGQIKVGDNLIRSDGKYAGTIKSIRNDEVSVRYQDAPAEVAVAIDNVTLNRQIFPDDVLYVDIPESVVKELRKAPMEKEIMDTLEEIIKIKRKENPFWGTKV

SEQ ID NO: 13501 - protein, 324 aa, Thermoplasma volcanium
LMEDNEENKEKKTTLEDLPGVGEATAEKLRENGYDDIMAIAVASPKDLSDVTGIGEGAAAKIIAAARKFADIGNFETGEEILERRKTIQKLTTGSKNLDDLLGGGLETQAITEFFGEFGSGKTQIMHQLAVNCTMPKEKGGFDSDVMMIDTENTFRPERIIQMAKSKGLDPDETLKRIHVARAYNSHHQILLAEKAQETAKEFNIRLLIVDSLTAHFRSEYVGRGSLAERQQLLNKHMHDLLRFGTIYNAVIAVTNQVSARPDVFFGDPMAPIGGNIVGHTATFRVYLRKSKGGKRIARLIDSPYLPEGETVIQISEEGVNDGT

SEQ ID NO: 13502 - protein, 337 aa, Thermoplasma volcanium
MIRVGINGYGTIGRRVANAVSSQDDMIVVGIVKTKPDYISEVASRRFKIFVPDSSYMKAFQDAGIKVEGTLDNLLDDAEIIVDATPEGMGEKNKPLYIKKKAKAIFEGGEEPDVAETSFNAYSNYNDAIGKSYVRVVSCNTTGLARTLYPIQQAFGVKHVEATLIRRATDQNDSSKGPINAVEPSLKIPSHHAPDLKTVMGNIDVNTVAIKVPTTLMHVHVVQVDTEKNASNDGVLEAWNNYRRIIHVKKDDGIKSTAQIMDLAREFGRDRSDLYEIAIWEGSVSAKANRISYIQAVHQESDVIPENVDAIRAMFNLADKEKSIEKTDKSLGIEKRV

SEQ ID NO: 13503 - protein, 365 aa, Thermoplasma volcanium
MAKDYYKILGVDRNASEEDIKKAFRELAKKWHPDLHPDNKAEAEEKFKEISEAYEVLSDPEKRRIYDQTGSVDFGGGGSNFNWDNFTHFSDINDIFNEIFGGNFGSDFFSGFGNRQSTRNIDLDMYTNLDISLEEAYYGTEKRIKFRRNAICPDCKGTGAKNGKLITCPTCHGTGQQRVVRGQGFFRMVTVTTCNTCGGKGRIPEEKCPRCNGTGTIVVDEDITVKIPRGATDNLRLRVSGKGQSYDGRTGDLYVILRIKQDKNLQRINDDLLLDQKINFGQAALGADIPIQIFNEKYNLKIPEGTQPGDVIKIKGAGMPHLNGHGSGDLLVRINVEVPKRLTAKQRELIRELFDIKENHKSWFH

SEQ ID NO: 13504 - protein, 541 aa, Thermoplasma volcanium
MIAGQPIFILKEGTKRESGKDAMKENIEAAIAISNSVRSSLGPRGMDKMLVDSLGDIVITNDGVTILKEMDVEHPAAKMMVEVSKTQDSFVGDGTTTAVIIAGGLLQQAEALINQNVHPTVISEGYRMASEEAKRIIDEISTKIGKDEKELLIKLAQTSLNSKSASVAKDKLAEISYEAVKSVAELRDGKYYVDFDNIQVVKKQGGAIDDTALINGIIVDKEKVHPGMPDVVKNAKIALLDAPLEIKKPEFDTNLRIEDPSMIQKFLAQEENMLREMVEKIKSVGANVVITQKGIDDMAQHYLSKEGIYAVRRVKKSDMDKLAKATGATVVSTIDEISASDLGSADRVEQVKVGDDYMTFVTGCKNPKAVSVLVRGETEHVVDEMERSITDSLHVVASALEDGAYTAGGGATAAEIAVRLRSYAQKIGGRQQLAIEKFADAIEEVPRALAENAGLDPIDIILKLRAEHAKGNKYAGVNVFSGEIEDMVNNGVIEPIRVGKQAIESATEAAIMILRIDDVIATKSSGSSSNPPKSPSSESSS

SEQ ID NO: 13505 - protein, 356 aa, Thermoplasma volcanium
VKIAYFSDTYYPTPDGVSTYLKDVKRGLEKRGHEVYIFSLTGDPHEKNVFIPRTVPFPPYDQYRMPLIPFPFREFKTAVDIMPDVIHLHNAFYMSSVGYLVARRLGKKPISTFHTDIDKMRESIRLPFSDLIFDLGKRYSIYLYRKCKFVLAPSCQVKAYLERCGLKNIVTVPLFVDTDELSPAKASNKQDIILYLGRLTKDKGVYRVLELANEMKGTGYKFIIAGVGPELERMKAYVKENDISNVNILGYVKEDEKKQLMEVSKFFIYPSSADTFGISVFEALSMGLPAIVSKEFPVKEDTNAIVYEDFSNIKHIANKLLNIDQATYSEMSTSARTLAISKYSIDRHIDQLLSLY

SEQ ID NO: 13506 - protein, 272 aa, Thermoplasma volcanium
MIETRSLTKVYKNGNNALKDISLDIGSGITSVIGRNGAGKTTMMRIFSTQLRPTSGSVTINGYDVVKESNKVRKIICSIPQEASPIGVLTPLEQVKMYLVARGLSISSADREARIALSSVGLEESMKAPADTLSGGMKRKVFVAMALSANADIVFLDEPTTGLDPMSRLEVWSLIRNLRSDIVLTTHYMEEAASLSKYIIMVDHGTVIKEGTLKELLSEFDGLIRVESRQPLPDSSPVGGIYIKYVNASEANEYISMGCDVKNITLDDVFIK

SEQ ID NO: 13507 - protein, 384 aa, Thermoplasma volcanium
KILIMGVDGYIGFPLALRLLTRGHDVYGIDNFITRKRVQKVGSDSALPISSFAFRNSVIKKKFGKGIGFFYGDATNPKFIYRVINEVRPDAIVHLAEQRSAPYSMIGLKEANETMVKNIVSTLNLIYAVKDITPEAHILKLGTMGEYGTPNIDIPEGFFEIEYHGRKDVLPFPRNASSWYHWTKVHDSNNLMFANKVWGTKVTDVMQGVVYGTRTEEIEKTGLYTRFDIDEVYGTALNRFTAEAIINEPITPYGKGGQTRGFLSLNDSIECLTLALENPPEFGEYRVFNQFDEKYSVNQLAEMVRDLYKEKFGKEPEIVHVDNPRVEKEEHYYNPEHEKLKALGYKRTKDIKSEIYDAIDDLNKFKERLMNLRNVIMPRTYWKK

SEQ ID NO: 13508 - protein, 233 aa, Thermoplasma volcanium
LQGLITAAGLGTRSGASQFYRKEMFSIYDARDGKVVIRPIIDCVIYRMKISGIDDIIVVLDPKDEVTKKYIELSYPDVQIAYQTEKRGYGDAVHSALQFIHGPFLLNAGDGVLFDDNTEKRIVDSYKSGNRLIAFKVDDPRRYGVVEMDENGNIAGLEEKPNLPKSNLALAAIYILDKSVLNEIDTGKANVELTDAIDRTIKKGVKSDVIEIDRSEWISVGLADRYADVVSET

SEQ ID NO: 13509 - protein, 407 aa, Thermoplasma volcanium
MADFFLMDSFDLAGRTIYLRVDINSPVNPVTGEIMGTDRFRAHVETIRKLRDSKVVIVAHQSRPGKDDFTSLRQHAQVMSRILNKKVMFVDQLFGSLVNKTVESMNEGDIVMLENARFYSEEVDLTTLESMENSNIVKGLSTLFDYYIIDAFAAIHRAQTTLVGFRRIKPNIAGALIEKEVTMIDRFRHLNESPKIAILGGAKIDDSIAVSENFLKSGFVDKILTGGVVANAFLWAKGIDIGKKNRDFIIKNNGDYEKLIAKCKGLLSEFGDRILVPSDFILSPSGERVSANGKIPDDQILADIGLDTVVEYSEIIDKAKAIFMNGPMGIYEIEAYSSGTREIFSSVAKSEAFSIAGGGHTLSALDKLGLTNRIDHASTGGGALISYLSGEAMPVLEALKESKRLFE

SEQ ID NO: 13510 - protein, 303 aa, Thermoplasma volcanium
LGGNGREKDHASELRSIFSLKKIADAVNGYEEAKYVVFGIPFDNTSSYRRGSKYAPDSIRGAYVNLESYEYSYGIDLLASGMADLGDMEESEDVEYVIDTVESVVSAVMSDGKIPIMLGGEHSITVGAVRALPKDVDLVIVDAHSDFRSSYMGNKYNHACVTRRALDLLGEGRITSIGIRSVSREEFEDPDFRKVSFISSFDVKKNGIDKYIEEVDRKSRRVYISVDMDGIDPAYAPAVGTPEPFGLADTDVRRLIERLSYKAVGFDIVEFSPLYDNGNTSMLAAKLLQVFIASREKYYKEHI

SEQ ID NO: 13511 - protein, 239 aa, Thermoplasma volcanium
NKNIPSNYMNIMEEISLQEKIEKLPLGVACIDGLTNGGLEAGIITEIFGEGGSGKSNVCMLAACSALRLGKKVVFIDSEGFSSERFLSICKADNSKLKVIRVFSLDDQEVAITKFSKIIEKDASYGLFILDSFSEFFRLERTGDNQSRVIDFQRQLSLLSSIAAKRKIPVLITNQIYQDIANGDILPFGGYVVDHIMKAIYRLERLPDGRRKMTVMKHRSVKEGNSVEFRIVQDGISCE

SEQ ID NO: 13512 - protein, 335 aa, Thermoplasma volcanium
MGTDISDIVVSHQTSLKDQANQVFAIDTYNILYQLLSNVRQYDGTPLMDSSGNVTSHLYGIFYRTVNLVENGIKPIFVFDGKPSPLKNRTLEIRQLAKEKAKAELEEAISRGEENLKQYYSRINYITPQIVNDTKELLTYMGIPYVDAPSEGEAQASYMTRKDADGVISQDYDCLLFGAKKILRNFAIYGRRKVPRKNVYRTVYPEYVMLDEVLKKNGINQDQLIEIGILVGTDFNEGIKGIGAKKALALIKKEGNIKAVLNKIGKNIENLDEIIDFFKNPPVVDVKYVFGKPDPKKIEEFLCVVHDFSRDRILEHINTYVKYYNKSVQFRLDSF

SEQ ID NO: 13513 - protein, 218 aa, Thermoplasma volcanium
ERNILVDDFLAKLRRYKGAKIPNNVSRNENLNRIALSLKRSGLIDEIPLEVMKNALNIYLDNVSHGISRGRGCTAVLAACILVASRSSPSPVTLRYVSRALKIDPSRIWRTESLVVKNTNGKNMAVRPIDFIERYAESLNVDDDVRDEAIALTNKIASQVSLMRKSPSTIAISALYLASILKDRKLVQRYVTKKTGITEVTLIRTYKEIYSYLTGNQA

SEQ ID NO: 13514 - protein, 407 aa, Thermoplasma volcanium
MNIVTLISWDFKRNNESFQRAIINGYDYWSRILDDHGVEKYVILLTCNRVELYYRGDPFDVQEKGYNIISDDMAINHLFHVAAGLDSMSIGENEVLKQVKQAYEKSSSMGKSDKFLSLIFQRAISVGKLVRSKTGIGKGKVSIPSIVYDIVRKNGGNKILLVGNGMLASEIAPYFSYPQYKVTVAGRNIDHVRAFAEKYEYEYVLINDIDSLIKNNDVIITATSSKTPIVEERSLMPGKLFIDLGNPPNIERGNNVITLDEIYEISKKNEMLREEKINQAEILIENEMKATMNKIKDLMIDDIFSQFYRFASVVQTMEIQKFRKMHPEVNENDLEALAHSIINKILNVPVTTLKAVSRSQGNSDFNRLFESFSSNFNDIVSAALQSYEGLRDTQSLRDRTRQLLQKS

SEQ ID NO: 13515 - protein, 466 aa, Thermoplasma volcanium
  unsure (1)..(466): unsure at all Xaa locations
MGFIEEIKSALGNYVITEKKDLIPYMNDASYFTGEMPEAVVLPGSAEDVQTIMRLAYKYEKPVVVKGGGSSLTGSSILKESGIVMSMLRMNRILDINLNDKCVTVEPGLRLNDLQLYLDKYGHFYPPDPASSMAATVGGSISTNAGGLRGVAYGVTKDWILGLDVVLADGTMVKFGNKTLKRTLGYDLTSLMIGSEGTLGVITKAYLKIWPKPQKVARLVAFYQDIESAGRAVNELKVSTIPEMAEFLDKISLDSVPEAITYPPGTKYALIIDVSGPPELLGKKKTETEELLKRYAISTKSTTDPAEMEKIYRARKGLYASILKLRKSEKEYIVIGDIVVPVSELPTSLKEIEKKRDEDGVRAAIFGHIGDGNIHANIFADLGDNSAMDKVNRFMMDLAMVAVKHGGSVSAEHGIGIEKKQLLIEEMKYNNNLRTLDIMKAIKQVFDPKNILNRGNIFEXDGTTHS

SEQ ID NO: 13516 - protein, 446 aa, Thermoplasma volcanium
MAVERLFGTNGIRGIPNDDMSPDFAMSVGKAIGTYVSGEIAFGTDTRLTGDMIKNAVIAGILSTGISVIDLGVLPTPAIQYYSKKHGIYAVVITASHNPPQYNGIKVIDKDGTELERPGEEKIEEIFYSKAFRVVKWENIGRIRQVSDAIDIYINGVISNVDSDNIKSHAFKVLADAGNGAAYYSTPKLLEKLGCSITTLNANPDGRFTARNAEPVPENLVNLISLMKSGRFDLGIAHDGDADRAVFIDEKGNFIDGDRMLALITKYIAKAGDVVVTPVSSSDTIADICNAIGAKLIRTKVGAPIVARAMIDNGATIGGEENGGVIYGKHQYCRDGAMTVSLVLNLMASTNKKLSELISELPVYYLIKKKVERRVDWPSLARELKKGERVDETDGIKILKDDGWILIRPSGTEKILRIYAHSSDFELANKYCEQYIRKVNDIQDKL

SEQ ID NO: 13517 - protein, 305 aa, Thermoplasma volcanium
MLKNKSVVSIDDVQNDDLFEIFDLSESMLKTIESKGNAPLLTNKIMATLFYEPSTRTRLSFESAMHRLGGSVITVSDTKTSSAAKGETLADTVRMASSYSDIIVIRHPLEGAARLASRFTSKPIINAGDGSGQHPTQTILDLFTIKKELGSIDGKVITMVGDLRYGRTIHSLIIALSRFDVKVNLVSPEILRLPEYVYSMLPDRNYVKEYNDLEEVIGETDVLYVTRIQKERFSDQNEYQSVIGSYSINSETVEKMKKKSVIMHPLPRVDEISPDVDNMPQAAYFRQAYYGVPVRMALIYKILGD

SEQ ID NO: 13518 - protein, 149 aa, Thermoplasma volcanium
EKTLKISKIKDGTVIDHIPSGKALRVLSILGIRDDVDYTVSVGMHVPSSKMEYKDVIKIENRSLDKNELDMISLTAPNATISIIKNYEISEKFKVELPPKLIGIIKCKNQNCITNTREPVKPEFEIVSRHPLVLRCVYCQRTMNERDVF

SEQ ID NO: 13519 - protein, 225 aa, Thermoplasma volcanium
LRKFIISLRPAEKFVKFDSPCFDLINIPVTRLMPLDINIEKILKESAADCIVFTSTFGVDLFFSRVNMKGFTILGIGKATCERVQAYGHKCLYPENMDSEGLANLIISKCKDKKILILRSKKANEVLTEKLKEEGIDFLEFRIYDAVPDTKDFEKHYKDQNCLGVIITSSMEAEIVIPFLKEDKKMVFSIGVTTTNTLMSHGIMPDITGNSDFLELLKKIDYFIC

SEQ ID NO: 13520 - protein, 293 aa, Thermoplasma volcanium
LMKIKIGTRPSNLAVAQANMVASSLEAIGIDTEIVKHRSAGDIDTKNPIYSIGKTGVFVQDLNNMILRGEIDVAVHSAKDIPSEIENRLTIAATLKRGSFNDALVSKYDLRSLPISAKVGTSSIRRIFQLKYARQDLKFENIRGNIETRIAKMSELGLDAIVMAEAAIQRLGLNVEYSKLDENKFVPAPNQGIIAVVSKKEGTVRKILEEINDENTFEEMQIERSVVQQLKLGCSTPVGILSRPSGKGHKIIAQFFSMQGDDVSVFEQYLNDLSDVDSLVSYIRENIPREYGY

SEQ ID NO: 13521 - protein, 418 aa, Thermoplasma volcanium
MSSKELFELAAKLFPMGVNSPVRYFKDYPFYVKEGKGSTILDVDGNKYIDYCLGYGPLILGHSDPDVTRAVIEQAEKGLLFGEPSENEIKLAEMIKETSKNIEMMRFTNSGTEATMHAIRLARAITGRKLIVKMEGGFHGAHDYSLIKSGSGTLTFGSPSSPGIPDEVAQTVIVGKYNDENNIKEIFQKYGDKIAAVITEPIMGNAGVILPKQGFLEFLRDITQKHGSLLIFDEVITGYRFAFSPFQDIMRIDPDITTMGKIIGGGLPIGLFGGSEEIMKNISPSGNVYEAGTFSGNPMSMAAGYAAMEKLSKQDYSILKKRTQKLVSGIDDILDRKHITHTIKYYGTMFQVFFADHVNNYDDALKARKEVYFKLFKALSKNGVYLPPSQYETNFVSFAHSDSDIDATLAAFEKAVAE

SEQ ID NO: 13522 - protein, 388 aa, Thermoplasma volcanium
MNDVYIVSAKRTAIGKFGRSFSKIPAPQLGGAAIKAVIEDSGIDKSAIQEVIMGNVIQAGVGQNPAGQAARAAGLADEITKYTVNVVCASGMLAVESAAREIKLGEREIVIAGGMENMSNAPFLLPSDLRWGPKHLLHKNYKIDDAMLVDGLTDAFYFEHMGVSAERTAKKYGITREMADEYSVQSYERAIRATNTGEFSKEITVFSNLSQDEGIRKTTMEDLAKLPPAFDKNGILTAGNSAQLSDGGSALLLASEKAINEYGLKPIAKITGYESASLAPLDFVEAPIPATRKLLERQGKSIDYYDIVEHNEAFSIASIIVRDQLHIDNERFNVNGGAVAIGHPIGNSGSRIIVTLINALKERHMKTGLATLCHGGGGAHTLTLELVD

SEQ ID NO: 13523 - protein, 515 aa, Thermoplasma volcanium
MPFENENTYLRMSEAGKEAEFHRLYEESLKEIEAYFNKEYPNIIDGDVIESKKIKDISPIDGKEIATFQLASDSSVDKAVDMLYKSYKAWYSLGYMKRALIFLKAADMLSEQKFKFAAILTYENGKNRYEAIGDVDEAIDFMRYYAMNLIENQGFIRFTGKAYRNEESISIMKPYGVFGVISPFNFFSIGVGMSSAPLVTGNAVILKPSSDIPLSLYLWVRLMHEAGVPKNVLAFVSGSGGLVGRHIVENKKVAGIVFTGSRDVGLDIQRKSIDNGPKVVITEMGGKDAIIVSNKADMDKAVEGVVRAAFGFAGQKCSACSLLYVHKDIYDEFMKRLKARTEAIKPDDPRKKDTFLNPIINKEAYDKFIKLKPEFNKGKILTGGHELNKPGFYVEPTIVTDLPKDAYIARNEIFLPVLSVFKCNSIEEAVDDINSMDYGLTGGIFTEDPKEIQYYFDNIEVGVIYANRKSGGSTGSMVGSQPFVGWKLSGVSGKGTGSFYYLQQFLREQSQTIAH

SEQ ID NO: 13524 - protein, 211 aa, Thermoplasma volcanium
MNQTLETGTTTVGITLTDAVIMATERRVTMENFIMHKNGKKLFQIDTYTGMTIAGLVGDAQVLVRYMKAELELYRLQRRVNMPIEAVATLLSNMLNQVKYMPYMVQLLVGGIDTSPHVFSIDAAGGSVEDIYASTGSGSPFVYGVLESQYNEKLSIDEGVDLVIRAISAAKQRDSASGGMIDVAVITKKDGYVQLPTEQIEARIKKLGLIL

SEQ ID NO: 13525 - protein, 315 aa, Thermoplasma volcanium
MKTESLRDTYGKELVELGRKDPDIVVLDADLSSSTKTGYFAKEFPERFFNMGISEQSMVTTAAGLAISGKKPFVSTFAIFLMRTYEQIRQSICYNDVPVRFVVTHGGITVGEDGATHQIVEDVGIMSGLPNMSVIVPSDSVETKSVIDYLENIKHPHYVRLSREKFPVINDLSYEFKIGRGYVVKDGSDATVIANGIMVSKALEAANALKDKGIDLRIINMPSVKPIDKDIIIKAARETGRIITAEEHSIYNGLGSRVSEVVSENYPVIVKRIGMRDTFGKSGKAMELFSYFHMDVKDIIDYVIQSLEEKSYENI

SEQ ID NO: 13526 - protein, 286 aa, Thermoplasma volcanium
MKLKIVPVVTPFKEGKIDGEKFIHHCMSLLSVGVNYVFISGTTGLGPSLSINERMDLIKLSSNFADKAIMQVGSMNLEDSIKLARMAKENGIYGISALPPYYFGGIPEEWLIKYYVEISKIIPTFIYNYPKFTGYDINSSLAIKINKAGGNIIGVKDTIADISHMLSYRDLGNDFIILSGPSNSIYEALRSGVDGSVAAAGNFMPKTFIELADKFEAEASFKLQKYINSVLSIANEYGSWSAYYSLIKILRRYSAGDSRAPFYPLNALDEEKLRHDVFFVLPEEQR

SEQ ID NO: 13527 - protein, 418 aa, Thermoplasma volcanium
DMLLNEEEKQIRDLCRRVVKEVPHELIRKIEREEVTFPREFIDFITKNGVVGLRFPKEYGGKGASWVAEASAVEEMGYLGFTLSCMYSLGTIVGEPMYRYGTNEQKEKYLKGITSGKLYGAEAITEPSGGSDLFGMMKTTAVKKGNKYILNGQKRFIVGGKGADFFVTYAITDPNAKSRTRGISAFIVDRDTPGLKVETLYGLMGNKGGGTARIVYKDAEVPEENLIGELNGGYEVFNRMMIPERLTTAAGSLGVSTAALKVATDYALKREAFGSKLIEHEGINFKLAESLTLLQSASALVYTAAKAADLYEKGQTTQSYARKLVSMAKLHSTEAMWKIVNDAMQIMGGIGYTTVYPIERLLRDSRLGLIWTGSSEVMKMIIQHEYLKEFTNPDYWESRRDIEKDALDFRLEEEKVFK

SEQ ID NO: 13528 - protein, 508 aa, Thermoplasma volcanium
LTLDRLFYQTLLRKPNEFLTEGQRKITYKELFEDSVRLANGLSSCDLSGKRIAVLDWNSIEYAIALYGIPFAGSSIHPINVRLPLEQISRTIKTARDEALIVSKDFLPIAEKLAEAGLLSKKKIFTINVSSDDFSRFEDLIDDGEEVFTPKFDEDTEMSILFTSGTTGMPKAVSYTHRKTVTAIWAILTSLSAYQGLARLNSGDTVFPLIPFYHIWSWGSLFISTMIGTKYILGGKFDPISTLKLIKSEKATWMNMVPTMLYALLANDNESVLSGMKILIGGSPIPNGLVEEARKRKIELTSIYGFTDGLIASIGTINEAYGKIEDERKYEISTKYSTPSPLAELKIVKADGAPPEIFFRSPWLPDGYVSDETETKNAYVEGWFRPGDSGHIDEMGNLCIDDRVKDLIKSGGEFIPSSTLESYISGVPGVEMVAVVPRKDDKWVERPVAFVKSNKDFDNLVRNIKDLFDSLVKSGKISSWWIPDEFYRIDNMPLTGTGKIDKKELRKL

SEQ ID NO: 13529 - protein, 765 aa, Thermoplasma volcanium
KIIDNSKQNLAGVLRREMSHVEELAIASAYFNLEGYRNIQEGLKNKPLKLLLGREPSESIKFEEEAIKNLESYDEDFYSEQKDVFASEVLNNEDDVSYFSALHNAVEFFKRPEVEIRRVKGRFFHGKAYMGARTSFSNMVSGFAIVGSSNFTGGGLSGNRELNMLTTDREGVTELIKWFLELWKEDRSVDFKNEFLQLLENYVTTHSPYEVLAKALYEVYGPQLDEARTNGLMKTLFPHQVLSTIQASRILKTYNGVVIADSTGLGKTRVAINLAVMAINDGRNPLLIAPKSALETTWKDEMDKTHVHIDSKRSEYLSQHPDEAIKEIQGKDFIIVDEAHYFKSPGSNRYSVLRDLMAAGQKQIVLLTATPINNSLMDLYSLLSLYLRDDSISDISPSLKGYFSMQQKLWRNDEPVDIDAILRRFVVRTSRELAKVLSESKLHFPVRKLDTDPANRYATGVDYEKIDAEFDRLSFIYYEYAIDKLGKVLRLPDGTPIASGVQDKKRKFLKDLVKILMRINFFKRLESSIQAFRKTMETLLNYIEKSMDYATREGYFIPPKMRGVLTDMYEDDEEWVPPSPDELFSGKNREVLKRCKLSGEEREDYAKKCEMDINVIKEILGQLPETDTKLSQVIDRIQRIELSGKNGVILFTQYFATAEYVYNHMKERIKDRVMLATGSVCRDRFGVSKRDKTPVIRDFMKNGGILISTDVLSESQNLQNAQYIVNYDFPWNPVVLIQRAGRIDRIGSDYDEIFIINVMPINGDE

SEQ ID NO: 13530 - protein, 476 aa, Thermoplasma volcanium
NFPEDFKFGWSQSGFQSEMGYDNAMDDKSDWYVWVHDKENIQSGLVSGDMPENGPGYWNNYKSFHEAAQNMGLKMARIGVEWSRLFPEPFPEKIMADAKNNSLEINNNILSELDKYVNKDALNHYIEIFNDIKNRNIDLIINMYHWPLPVWLSDPVSVRKGIKTERSGWLNDRIVQLFALFSSYIVYKMEDLAVAFSTMNEPNVVYGNGFINIKSGFPPSYLSSEFASKVKNNILKAHSLAYDSMKKITDKPVGIIYANTYFTPLDPEKDNDAIAKADSDAKWSFFDPLIKGDKSLGINGNKLDWIGINYYTRTMLRKDGDGYISLKGYGHSGSPNTVTNDKRPTSDIGWEFYPEGLEYVIMNYWNRYKLPMYVTENGIADNGDYQRPYYLVSHIASVLRAINKGANVKGYLHWSLVDNYEWALGFSPKFGLIGYDENKKLYWRPSALVYKEIATKNCISPELKHLDSIPPINGLR

SEQ ID NO: 13531 - protein, 264 aa, Thermoplasma volcanium
KLISYLQAMLFMTSSVIVSAASAGIGKGIVAVLLGYGYNITAFSRDESKLRALKEEMKLKFGREINTVVADLSVRSDLENVVSNHREKYGSIDNLVVNYGDPKVSSFIEISDEDWDYAISMMLKSTIYLTREALRDMIRTKHGSIVYVTSMTVREPIEGFSISASLRSAVISLAKTLTHEVSQNGIRVNTIAQGYFNTDRFRDIMKREIDSLSGMKRLAGEIPLRRVGEPEEIGELVEFLLSSRSSYINGANIPIDGGITKFPL

SEQ ID NO: 13532 - protein, 299 aa, Thermoplasma volcanium
MPIDPQVRKYLDAMSKVSVPELNKTPIEDLRKIFDTPASGAPKVKISVVEDMILDTDAAKLPARLYDDSNSDSLVLYFHGGGFVFGSIETHDSLCRRIAKYSGSKVISVGYRLGPENKFPVAQIDAFNSYLYVLKRSEELGVDSDKIALMGDSAGGNLAAVASLMARDKGIKLPRLQVLVYPSTGPDMTSKSYLEYSSIYLTKELLNWFSSQYLNSIEDALNPYFSPILADLSGLPEAIVVTDEYDPLLEQGETYSATLRDSGVPVTSIRVNGMIHGFLSNFHLFRAADVSLMMISGAI

SEQ ID NO: 13533 - protein, 355 aa, Thermoplasma volcanium
MFYLGNVLKLSLFGSSHGESVGSLVDGFPVGYKIPLDYIQKYMEYRRPGNTIITSQRKEEDVVKIISGMHNGFTDGSPITMIIENKNVISSYYEELKENPRPGHSDYTLYVKYGDFRNYEGGGFLSGRMTAPLVAAGALAKSYLDSLGIKITSYMKSIGEVTCDEIRGDPYNFETRIPDPEKNSLATSLLVDIMKSGDSIGGRIDTIVEGLPPGVGEPFFNSVESEISRAMFSIPAVKAIEFGDGFTLSKMKGSEANDPFTVLDGHILTKTNHNGGILGGMTTGMPVKFSIAVKPTPSIHKKQDTINLISKEKSEITVKGRHDPCVAIRAVPVVECLTAFVLMDLMMMGGFIDRY

SEQ ID NO: 13534 - protein, 100 aa, Thermoplasma volcanium
MFCPKCGSLMTPVNGRYVCPSCGYEVSKKKEDLKIVNKSNDKETIMIREEVSAEPLDSDAICPRCHHKGARYVLKQTRSADEPETKFYTCEECGYRWREY

SEQ ID NO: 13535 - protein, 240 aa, Thermoplasma volcanium
MSDEFEFEIKRKDGSGKTYFQKYNVPKDKVSTVLEGLLYIKENLDQTLSFRYSCRMEICGSCGMEIQGKPRMACSTIIEDLKSDKIRIEPLKHYKVIRDLVVDIDPFFDKYKEVKPYVIRDDDGKYDKELSQTPEQFHEYANYAMCIKCGLCMAACPIEGSDPSYLGPAPLAAAWRYIADNRDKGAKYRVEVVDGENGTARCHFAGECTEVCPKGVNPSFAIQKLRKTALKIELASIFGR

SEQ ID NO: 13536 - protein, 567 aa, Thermoplasma volcanium
VEKIKEDVIVLGGGMAGLRAAVAAAEYNKNISVGVVSKLYPLRSHSVSAEGGTSAVLNPKDSFDLHAYDTIKGSDYLADQDAVEEFVRLVPEQIYTTDHWGCPWSRNPDGTISQRDFGALSFPRATFAADKTGFHVMQTLFSRALRYENIHFYNEYFATSMFLDNGRMNSLTTINLRTGDFVVFQSKAFIFAAGGAGRLYQFSTYAHSVSGDGDAIAYRAGIPLKDMEFIQFHPTGLVPSGILITEGARADGGYLLNGENKRFMQAYAPNKLEKASRDVVSRAIMWEIEAGRGVKGEYGDMEYVWLDLRHMADVLDERLPMITEIAKKFNGIDAHTELIPVHPATHYTMGGIDSNVRTTTDYSGIFAAGENACVSIHGANRLGSNSTNECLALGNVAGVSAAKYAMEHDIPDLVVSNVENEEKRIWDDLLKRNGGENVAKIREDLRINMDKNVGIFRDENGLNTSLKNIKQLKERYNNISIQDKSSTFNMELEWALEVGFMLDIAEVITTGALLRKESRGAHYRKDYPNRDDENYLKHTIATYTKDGPRITYKPVVITKWQPTVRTY

SEQ ID NO: 13537 - protein, 421 aa, Thermoplasma volcanium
VLSNLDYLYNLKRAGIKYDLTVMREFADMLGHPERDFRSIHITGSNGKGSTSAFIYSILRQKFSVGVYTSPHLERFNERIIVDNEEVPDEYIDGFIEKYRPKFDELSKVNRNPTFFEVTTMMAFQYFKDRKVDYASVEVGLGGRLDATNIIMPEVSVIAQVGYEHADKLGCSLTSIAYEKAGIIKEGRPIVLQDDKPEVVNEVRRIAQVKHSPLITLDRNKIKNLHVDENGTDFDFDGTNDTYHIHTSLIGDYQALNAATAILAVENSKVQVYKKDIETGISRTIWPGRLEIIDRSPLVIIDAAHNPPAANKMVRTVKKVFNREPTIVAGILSDKDAYSFFSVLRQLSGKIIFTTPEEKERAVDPNILMAQYGNLFRSARVIPDPISAFEHAKKVDDFVFVTGSIYLIGVIRGLYDKANEK

SEQ ID NO: 13538 - protein, 435 aa, Thermoplasma volcanium
MSGKADPLEIAKEQVAPVKEEIEEDPFEIALKQLNKAAKVLNLDEQALEILSSPQKILQVSIPVKMDDGKVRVFTGFRVRHNIARGPAKGGIRYHPQETLSTVKALSMWMTWKCAIADIPYGGAKGGIICDPSTLSQGELERLSRGYIRAIADFIGPEVDVPAPDVNTNPQIMAWMMDEYENIVRHSAANVITGKPLEVGGSLGRFDSTGKGGMFVLREGAKKIGLDLSKARVAVQGFGNVGQFAVKFVQEMFGAKVVAVSDIKGGIYSENGFKFDDLLAWSKKIGSVVGFPGSKPITNEELLESDVDVLIPAAIEEQITEKNADKIKAKIILELANGPTTPEADEILYKKGKLVLPDVLSNSGGVIVSYFEWVQNNYGEYWTTEEVYDKLDQKITKAARQVLDTMDKYHVDPRTAAYVIAVKKVADAMKVRGWY

SEQ ID NO: 13539 - protein, 416 aa, Thermoplasma volcanium
MPESIDPFEMALQQLDKAARVLNLDEQALEILRQPEKILQVSIPVRMDNGKIKVFTGFRVRYNTARGPGKGGIRYHPDETLSTVKALASWMTWKCAIADIPYGGAKGGIICDPKSMSQGELERLSRGYIRAIADFIGPEVDVPAPDVYTNPQIMAWMMDEYENIVRHSAPNVITGKPLEIGGSEGRGDATAKGGMYVLREGAKRVGLDLSKATVAVQGFGNAGQFAVKFVQEMFGAKVVAVSDTKGGIFKSDGINYEALLDHKRKTGSVVGFPGSKPITNEELLESDVDVLIPAAIEEQITEKNADKIKAKIILELANGPTTPEADEILYKKGRLDLPDFLSNSGGVTVSYFEWVQNNYGEYWTAEEVYEKLDKKMTKAAHEVFDAMDKYKINPRTAAYVISVKKVADAMKARGMY

SEQ ID NO: 13540 - protein, 777 aa, Thermoplasma volcanium
MDISEYDLTLDLDLQSKTFHGTETISASSGDFVLDAVGFNIEWIKVNGSDAKFEYDGNLLKINGLETAQKVEISYSGKISDSLSGIYFAGRESNGMVTTHFEATDARRMFPCIDHPAYKAVFSITLVIDKDYDAISNMPIKKVETSDRKIVEFEKTPRMSTYLLYIGVGKFKYASERYKDREIILASLKDIKSKYPIDIAKRSIEFYEGYFGIPYALPKMHLISVPEFGAGAMENWGAITFREIYLDIADNSAASTLRLSANVIAHEIAHQWFGDLVTMKWWNDLWLNESFATFMSYKTMDTIHPEWQFWGDFFVSRTSGALRSDSLKNTHPIEVDVKDPDEISQIFDEISYGKGASILRMIEDYVGAEDFRKGISKYLKEHAYGNAEGSDLWNAIETESGKPVNRIMEAWITKAGYPILKVSQDKTGIKVMQSRFFLGGGESTDRWPVPVKMRLNNGISQMLLEEESTVITDKDVIKLNADNLGFYRVNYDDETFSKIIENMDKLTPLDRVGLVDDLFAFLMAGVITPDTYKNRIKSFFNDKDANVISNIVNQFEYLRIITHYFDADAREFLGTAIRYLESADDENLKIAYGKASRLLALLDEAYCETLAPRFSNFEQQTPELKSAIATAYALSTGDVKGMVEKYRSLDRDEDKVKIISGFGKLKSSTDLSVVSGMIEKGEIKKQDMLSFYLSALETMAGREYIYSNLENIVKNVIRYFTGNRTASRTVEQILPVIGLTHPDAASIIERIGSKNTTMGLAKGKELLEVNRSLLERI

SEQ ID NO: 13541 - protein, 345 aa, Thermoplasma volcanium
KKIPMKKYLVMEDGTVLSGQGYGSYKEAYGELVFTTSMTGYLETLTDPSYVGQMLVFASPTIANYALEMGKMESNGVKVSALITKDAHIELKKGGYGREFDEFLKEQGIPGIDGIDTRMLVRKIRANGVLRSYVVNDPSHSLDFPDPMNDDLVSKAVPHHDPVFVKGEEGGTVLFIDLGSKNTLKELMLQNFSLIVVDKQTNLDEIEGYDAIFVSNGPGDPSHPSLSNVIKFLSHNIGVKPLFGICFGLQAISLAYGAKTYKMKFGHRGSNHAVTDGTHSYVTTHNHGYAVDGSTVKDFKVIGWDANDGTVEIIEGDDMFAVQFHPEASPGPHDTRWFFGEMKRR

SEQ ID NO: 13542 - protein, 1043 aa, Thermoplasma volcanium
MPKREDISKILVIGSGPVVIGQAAEFDYSASQACRSLREEGYEVVLLNSNPATIQTDHEIADRVYIEPITVEAVETIIRKEEIDAIEPHMGGQTALNLVVSLKKMGIIDKYGIKIIGTPVESIEISEDRQKFHDFLISIGERDPERYRISRSNYKEEIEKIPFMPVIVRTSFSLGGSGGNIVKTKEELKAYAEELFRGIDEDYIEVNRSLAGLKELEYEMIRDSIGNCITVCNMENLDPMGVHTGESIVVTPSQTLSDIQYHMLRDAAIKIVSGLGIVGACNIQFALDGNDYYVVEVNPRTSRSSALASKATGYPIARIAAKIAVGYNLTEIRNPITKNTFAAFEPSLDYVTVKIPRWPFDKFSVDRTIGVQMKSIGEVMGIGRTFEEALMKAIASLDIDLSYRLRLYVSDEEIWNLVRTPNDRRIFAIFEALFRDFPVDRIMEESMYDRYFIEKMQNIVDYLKTLEFGHIPENLISLKKLGISDEIIGRTCGIDPDEITRYRITNRILPVFKEIDTCSGEFEVIAPYLYSTYEDEDELPGISGFVAIIGSGPNRIAQGLEFDYGAVKAITALRKMGVGSVMINSNPETVSTDFDVSDALFFEPITVEHVSNILAKANLRGLIVQFSGQTGQNIARRIENVLGSSVVMGTSSESIDRIEDRSLFSKRLEAMGIDQPKFEVATNAEEAINKSLALGLPVILRASHVIGGRAMDIIYDYDFLVERSREVFENVNSVLVSKYLENAVEIDVDFVSNGEDFQICGILVHIEEAGVHSGDATMIFGPKIVPQAAEEKIKSIVGKLVREFNLIGISNLQAAIKDDEVYVIELNARSSRSIPFISKATGYNWVELAVSAIMTGKLEKVSVSSKGYFVKVSVFPFSKFNDMDVSLGPEMKSTGEAMYPGFTMEEAIRKSILRDIKSVFISVRDDDKPRIIEAASIMKQNGLKIYATMGTSRYLRERGIECETVYRIKDERKPRIYDMILAGYIDLVINTPEMNAGSVRDGFKIRRLCVRKGIPLVTNINLANAYSKCLSYTNIDYREISSY

SEQ ID NO: 13543 - protein, 386 aa, Thermoplasma volcanium
VEGYSVKAIVETFGTPVIIYSAPRIVKNVSSLFGAMPKVTKCFYSVKANSNPNLVRLIGRQGCGSEVTSLGEIQIAMISSIDPDDILFTPNNVSKEEMDFALDRGIKITFNSPGQFELVSNRVEEATFRINPGIGHGEHPGTTTGGHGSKFGIDPETALKLYTRAKELGIRKFGIHMMVGSNNTDADLMLTFYKKFFDMASEIEKTAHLQFSYIDIGGGFGVPYNDEQRSLDIKKLGSGLKELVDQYGIERLFIEPGRYIVADAGILVGKVYDVYNGFVGTDIGMNINIRHALYGAEHRFYALTGRSDEAEYIVTGQICENTDVTGRLTGKVQIGDLVAMYDAGAYIYSMSSNYNGRFRPTEVIVDHDGVYRIRRRETVNDILATV

SEQ ID NO: 13544 - protein, 1126 aa, Thermoplasma volcanium
MSSYIERIEAYNFKSFRKKKTIYFSRGLNVISGPNGSGKSNIGDMLLFVLGTKSIHSVRADKLSDLISKDSGNTCYVIVTFKNDEGKSLEISRRLVIEDEPKSYYYVNGTKARQSDVEDALSAFGINFGTYSFVLQGDINDFVGMSGVERRKLIERIAGTEQFDVELEKARNDIEEVGKNLDILSSMIDIKGQEVEKLRIEKEKKERYDILSKRLRDIRFTELSKAKEANDRSIQAIDRQVDSIEKEIEKSKVLISDLNLRYHSIEQLLSEETKKLNDLTSGEIRTVQEKLRSLEISIASLDSKISEKKLRMQDMAKQEAIDDARREKYEAEAEEIRKSLESERRERDKLQEEFIAAEDEYNKLVAEAQEKEKENATSRVKTKDYQVKISKLNDEINSLKEKLAEINMAIKGKIDRITELEERMEDIGLKVKADEWKLSQNAEDLSKYRDRYYKLKSEYDEIQEKISKLSSQISAAEATARASVPRQIDRASQVEEIKKNISGVVGQIRDLISYGERYAIAVESAASARLNAVVVDTDVTAKRCIEYLREKKISPMTFLPLNKMRAMSNLSEPDILSRDAGFLGFLIDFIDFDDKYRNAVFWVFRDTGLVSDIDAGRRLMGSIRLVSLDGDVFDPSGSITGGFRRQVRQPARSPSEDLDSMKKELAFLQSEKAKIKKELDEALQSMSDASKKTGEIEKERQIINDDLAKNKQILKDIASELSKLKQEIAENKEEKEALEKDISDRQLDLHKYQEALNDIYDDLGQSIIDTIENSMRKLEDYRKKISAITADIEVKEKRVSFLDKESNNIVQQNIELEIQRKAVEDEIHNIEIQKRSMEEELKKHELFLKQLESSHSDIASKIKDMENEMKEIRSKIEEINSDVEIKRSILSELKVKRSVVADRNSAIEAEMQSIPEPTMIEGDIVLEKRKCEADISALGDINNGAIQEYEESVKAYNELKDKKNRLELERRSLQDLTDSLNKKKKEVFVSTFEKINEKMNYVYGTINGGTASLVLKGDDPLESAVEVSVTPKDKATVKIQALSGGEKSIAAMSFITAVQMLMPSSIYFLDEVDMYLDAYNAESMIRLIREKAGEAQTILISLKVSVFEYAANAIGITSRNGESYIF

SEQ ID NO: 13545 - protein, 731 aa, Thermoplasma volcanium
REGKSVSALFFGFKPYFDVVEPDNEYLSSIRNDDEYVKEEDKVLWVHGSMHNVKRIYIRSPWKVPEYRRRCPFEVLAADIPFHHRFIYDFDLGACVRITGEDISGTEGNFTTDLVLKIDKIENIPDFNVNLKVLSFDVENEINRENVEDYGKILVIGYSIMFGDIQKKGEIHGDEKEILYRFIDLIRAEDPDVITGYNIDGYDMLVIQRRMEQYGIHLNLGRDGSVPRRIMDQFWRVHGRLISDTWWNVKKILHPKHESLDYIAMKLLGEGKDSIDRLNIEAEWQKRQDEVISYCIKDADLTLRIFEKLRVLERLMFMSTVTKLPLDDVANAGTSNYVDSILIRAADRENIGVPMNAHNLKEDEIQGGYVHTIGAGLYSNVIVLDFKSMYPSMIIKYNVCFTTLDPKGEIVSPTGIRFLSPEKKKGLIPRILQELMADRDDVKKRMKEAKSEDERLFYDGIQNAIKVLMNTFYGVLASSFYRFTDPKIGSAITAFARETIKHIIDVLESSGHRVIYGDTDSVFVESGDVRQEDAIKTGKELSQKLSEEEGLTLDFQMVLDPFFSHGAKKRYAGKCVYPEDMKGEIIIKGYEVRRTDSFDLQSTALSKVIDFILDRDVQGAINYADDLVKKVRNGDPSIDIESLVISRTVKDFSSYKANTDSLANIRAARKLIERGETFVPGMKVSWIVTNGKKTPQEVEPYIYGSKLESKPDWDYYAKRLSETLNRVIDVF

SEQ ID NO: 13546 - protein, 290 aa, Thermoplasma volcanium
MEISNIGVVGSGVMGQGIAQVFAKAGYKVTIVDVNEQILENALKAISDGKYGLRNLVNKGQISENDLNSIMSRISTSTEYTSLSSCDFIVEAVPEDLRIKREVFAKLESNVSKDTILASNTSGIMIAEITSGLSYKERIIGMHWFNPAPVMKLIEVVKAQLTSEETFNTTMELAKEIGKVPIKVADVPGFYTTRFIEGWLLSAIRSAEQGVATRKDIDAMTKMAFGFPMGPFELMDIIGIDTVYHIATYLYEETGDPQFIPPISLKQMVLNGYIGDKKVKFGSKGGWFDL

SEQ ID NO: 13547 - protein, 412 aa, Thermoplasma volcanium
EKIAVVGAGITGLFTAYYLSASGFDVEVFDKGDIASGTSGKFHGMLHSGARYAVTDKVSASECISENNTISSFARWFINDTGGYFVSSNREESDYGDTLTKACNDAGIPNYDIDVDEFKKIEPNVKNVDRVIHVPDKVIRAYEFSAAVAAEAFMNGTKFRLYSPVASVSEKGGKYVLGIERNGSLHYEHFDLIVNATGPFSGEFLKLAGYGGSPVMPSAGIMVVFSKPIVRSIINRMREPSDADIMVPYDGLSILGTSAVIVDDPENFSIDSEDVEAMIEDMSSLIPLIRNVNYSRTYYSVRPLLEDEGDDARKASRSFRIIKNGEGVFTVVGGKFTTGRLIGEHVAKEISKETGATIRIENPDLNSTYERFIEKYGRDDKYIAKAMSRIGTIDEENAMRSVAYAISTIIEG

SEQ ID NO: 13548 - protein, 374 aa, Thermoplasma volcanium
MKIALFTNTNVSLGAGIEKTLLNYVKYNTDHQLVIVQSQFYKVQRLPNDVLDRIGIKNVVTIKDYEHCISFLRMHRITKPIYALILPLLIRITKVLNIKKLRSIGELDVVYLFKNEYWPLFKGKLIIGSNHAQFAFDNTYNRILALLVRSGLVYRGIDAFHLFPKSKGIGKLMGKRYFTGIIGVETSQFKPKARDNTVNVLFVGRLEYIKGIDLFIEVCKKFEGNTGVKFNVSGGGEYSQILNDNKLPNLTYHGVLSEGELADLYGKCDIFLYPTRWDAQPSVIAEALSAGEYIITSQRIRGTYDDLSEKGFLEYSSLSLDDLSNRLLKAIDRVAELRAISDAEHSYAVEKYDNSVVVRDLYKNIENLYISMQR

SEQ ID NO: 13549 - protein, 220 aa, Thermoplasma volcanium
FKKFAEDYAKSKSHEKGQDLTELLGLINTHRDTCLDVATGTGFTAASISQICAHVTALDETRAMIEQAQSLIESRATKNVKFVLSTFEDFDDGKFDLITCRRALHHFKDKEAFFKKARTMLNPGGILAIADMVSPANDRKDNFNVLERIRDPTHIGALKVEEMIKLFEENNFQDIKYKIITEELTFEEWLYPITKESEVGKKCLEFLNSLSTEELNQIRL

SEQ ID NO: 13550 - protein, 349 aa, Thermoplasma volcanium
MKGIILHGGSGTRLRPLTYTDVKQLLPIAGKPISEYALENLIEIGIKNINIVIGSVGGLEVKKFYGDGSRWNVNISYTYQPEPLGIAHAIGLTKAFVGNDDFVVFLGDNYLQNGISNLYEDFTNAGSDGHLGLVPVDNPSQFGIAEVDNGKISKLVEKPKTPTSNLAIVGVYFLTPKVFESIDRLKPSKRGEYEITEAYQDMIDRGLKISYSIISGWFKDTGTVDDFLACNRLILDKLGDNGRRDNVSGRFDIHPTVKISSDSEVVGPCFIGEGTRIEHSYIGPYTSIGSNCIIKNAEIEDSIIMDGCEIDLLNENRIKKSLLGPNVRVVSGSKYGMRLVLGRDSKLEL

SEQ ID NO: 13551 - protein, 446 aa, Thermoplasma volcanium
SVSDRLERIPFGSPQRNFLLMVTGGEWAETLMLLGNGVILALVASVLHFSHVLATLVVPTAFFLGEFVGSIFFGWLGDQRGRRTVFLYNLLVFSGGMIIAGLMSTAILIAIFVFIGGIGVGGEFPIVDTFTSEMMPGKERGKRLATVYTIAVTAGPVIAFLTYEMKIVAPPYVSWRILFWFMGIVGIAIWAVRTQLRESPRWLEVHGRYKEADAIVKDWEQRVIEEKHLQSLPEPKSETEVSERKSRYKDIFAPDLRRRTIMMLIFQFFQTGIFYGFTSLAPTFLLYKGITLVHSLEFSFIIYSGFFFGSIFNVFIIDKVERKWGIIASAVLAGVFGTLFGIIPNVTATVIFGFITTFVLWNFSNFYHTYQAEIFPTRVRPTAAGTVYSVSRISTSILVPFITAFFLPHGLLASFGLIWVFIAIVVFDLALLGPKTSKLRVEAIAQ

SEQ ID NO: 13552 - protein, 384 aa, Thermoplasma volcanium
  unsure (1)..(384): unsure at all Xaa locations
MKELLLLYSGGLDTSVMIKWMNENLGYDVSTLTLDIGNNDLKSIREKAEAIGAVETFVEDVXQEFSYEYISKSILANGSYEGYPLSTALARPLMAKKAVELAEKHGFEAIAHGSTGRGNDQVRFELGIKALNPSLEMLAPVRDWNMLRSEEIEYAKKNNIIVPSDGKYSVDENLWGRSIEGSEIENMSLPVPEDAYEWLVPPWEAGPGEVIKLEFSNGLPVAINDSDFELQNLIANLNIIGGRNSIGLIDHVEDRITGIKSREVYECPAAEIITYAHGYLESLILNKHEISIKSFLDSKFSQFVYNGLWYDPAMKPLIAGEEILNSEINGSISLKLYKGKIYFNGSKGANFSYNSNVANYSTYEFDQKSSKGFIDIFKNDTVYS

SEQ ID NO: 13553 - protein, 415 aa, Thermoplasma volcanium
LKIWQGGAAKPSEYDPMEYLVKLDVSADTILEKYEIINLMAYHYELIKIGIINEEDGKCLLNALIKAYEGKITIDVKDEDVHTAIENWVKGLCPKNWENLRLFLSRNEQVHADMILYLLDSFYKMNKIFQSCIEKTIGVNGEGYLPGYTHFQQAMPFTFKSFMNSVLLLLERNILNVHDFFQKIRINVYGYGSGYGSPISAKFDKMGELLGLRYDHKNPIFLSSLYPQTLLEASQLIVTIMMPLSRLSSDTINYYSRGIMDIPDEFTTGSSLMPNKRNPDYLEMIQGLAAESVGVSSSIASIALNKQIGYHRDFQIAKDSIVFLIEKLIAHLDHLPDLLGRIEFFKEASERAVENSSYATMNAWNAFFKGTRWKEAYARIGNMVRENNELEKVDFETPTDNLDIANTRRIIYEEK

SEQ ID NO: 13554 - protein, 281 aa, Thermoplasma volcanium
MDMKIIAKKIDQLGEGPTYDSKRNRVYWIDITGKKFHYLDLNDGSIYNFESVGMISSIVPTNIDLMAATIGHGFYSIDDQANHTLLFELKDESNETRFNDGKADPEGRYVAGTMDLKESRPIGSLYVFNGKGVRRLLSNLTISNGIAWDTRRRIFYHIDTPTRKVRAYSFDAEMNIISKDIAVDFKEEQGSPDGMTIDSDGNLFVAHWGGSKLSVWDPERKRKIDEYDLPAKNITSAVFAGKGLNTLYVSSASSGDPEDLGGSLFELETQYKGTPTFVFKI

SEQ ID NO: 13555 - protein, 313 aa, Thermoplasma volcanium
KMPIIKTENLTKIYSGNIKAVSDLNIEIEEAEIYGLLGKNGAGKTTTIKMLTTAIEPTSGNAKVAGYDLLKDREKIRNIIGVVPQDLTTDADLKGIENLRMIAAFYDIPKSVAESRINDLLNIVDLTDWGNKYVSQYSGGMRKRLELICGLVNAPKILFLDEPTLGLDVNTRAKMWKYIRDIQKELGVTIILTSHYLEEVDELANRISIIDHGKILVTGTPDELKSSLKGDIITMQFSGSDEAEAARYYPNALYSSISGEDKVRIKVENSDVELPKILSYLTQKGISPLTINVKKPSLDEVFLEYTGSSIDED

SEQ ID NO: 13556 - protein, 204 aa, Thermoplasma volcanium
MKIKGVIFDFDGTLLDSVDVRITSWQEAFKDFGVNVPRDVIKPMIGYPGVDLARKFVNNPLDVEMLQEDYFLKKIDSVKLFQDVIPTIHRLKDRGIKVSVVTSTRRSVMNRFDLPVDTVVTIDDVSKGKPDPEPYIIALKKMAVEPKECVVVGDIENDLVPGKKIMCTTVLVKHGRDVHSPFADYEIENISDLIKIIEEIESKS

SEQ ID NO: 13557 - protein, 334 aa, Thermoplasma volcanium
VKAAILKKINEPVSIDDVDIPDPAENEVLIKQEYAGVCYRDLLAATGFFPRIALPMIQGHEIGGTVVKVGDKVEAFRPGDKVSSLIYIPCGKCEFCRSGNENLCPYKKSLGEEVQGGFRQYVNIPEISLVKAPNNVDGASLSLAACVTGMLYHALKRMGKAGEGKKVLITGAGGGVGIHAVEMAKAFGATVIAETTSPEKLDLLEKIGADYIVDGNSKFNEDVKKLGGADIVLECVGIYTFERSLRSLNNGGKMVIIGNVKPDPVSLPLGLIILKGNTIRGSISSTKKDVEEALNMVSKGMIKPIVGKEIDISQINEAYKLMKDKKSSGRIMIK

SEQ ID NO: 13558 - protein, 745 aa, Thermoplasma volcanium
MDNSSGIILRVAEANSTDPGMSRVRLDESSRRLLDAEIGDVVEIEKARKTVGRVYRARPEDENKGIVRIDSVMRNNCGASIGDKVRVRKVRTEIAKKVTLAPIIRKDQRLKFGEGIEEYVQRALIRRPMLEQDNISVPGLTLAGQTGLLFKVVKTMPGKVPVEIGEETKIEIREEPASEVLEEVSRVSYEDIGGLSEQLGKIREMIELPLKHPELFERLGITPPKGVILYGPPGTGKTLIARAVANESGANFLSINGPEIMSKYYGQSEQKLREIFSKAEETAPSIIFIDEIDSIAPKREEVQGEVERRVVAQLLTLMDGMKERGHVIVIGATNRIDAVDPALRRPGRFDREIEIGVPDRNGRKEILMIHTRNMPLGMDEEQKNKFLEEMADYTYGFVGADLAALVRESAMNALRRYLPEIDLDKPIPTEILEKMVVTEEDFKNALKNIEPSSLREVMVEVPNVHWDDIGGLEDVKREVKETVELPLLKPDVFKRLGIRPSKGFLLYGPPGVGKTLLAKAVATESNANFISIKGPEVLSKWVGESEKAIREIFKKAKQVAPAIVFLDEIDSIAPRRGTTSDSGVTERIVNQLLTSLDGIEVMNGVVAIGATNRPDIMDPALLRAGRFDKLIYIPPPDKDARLSILKVHTKNMPLAPDVDLDSIAQRTEGYVGADLENLCREAGMNAYRENPDATQVSQKNFIDALKTIRPSIDEEVIKFYKSISETMGKSVSEKRKELQDQGLYL

SEQ ID NO: 13559 - protein, 216 aa, Thermoplasma volcanium
VSVEKISKSYGKFRALDNVSFEVEGNGCLVLLGPNGAGKTTLMKTMTNIIRPTSGNVKINDINVRENPKKALMNVGSLIEQPEFYSYITGYEALMFTCMMRGLDRKTCESEVENLARLTNSKGYLTRKTREYSRGMKQRVGLASAMIGDPNIIILDEPTFGLDPSGMKEVRDLIIKLKKEKLIILSTHLLYEAQQLADWVAIINSGKLQYYGEQEK

SEQ ID NO: 13560 - protein, 886 aa, Thermoplasma volcanium
VAQTKKYIYLFEEGGKELVDLLGGKGAGLAEMTKIGLNVPPGFTITTEACIDFLRDGNFPKGMMEQTMDALHMIEEKVSRKFGNPENPLLVSVRSGAPVSMPGMMDTVLNVGLNDETVKGLAFMTDNERFALDAYRRLIQMFGEIVYGLPHEEFRGLIEKVKREKGYDEDKFTTSDITEIIKGENEIYRKHKKSFPQDPQEQLVESIKAVFNSWNSRRAKTYREINHIPENMGTAVSIVTMVFGNMGSDSATGVAFTRDPNTGEKRIFAEYLTNAQGEDVVAGIRTPKYIDDMKMEMPQAYSDLIRMCDILEHHYRDMQDIEFTIERGKLYMLQTRTGKRSAKAAIRIAVEMYEEGIISEEEAIMRVTPEIFDRILHPQVKTNGKETPLGKGLAASPGAAIGSIVFSSERAIELGKSKKMILVRPETTADDVRGMAVCEGFLTQKGGMTSHAAVVARAMGKPAVVGVETMHVDTTNNTLTINGKTLHEGDVVTIDGTSGLFYLGELPVEKPEIDKFSKKLLELADKNRKLGVRANANTPEEAHLARENGAEGIGLARTERMFLGNERIPIMRSMIMSESKEERQKYLEQLLPMQISDFVEFFKTMEGYPVIIRLLDPPLHEFLPDKETILNKIYEIKSGKNGSDELQYYEKLLKTVRDLEEFNPMLGFRGCRVGLVYPEIYDMQVRAIMEAAVRVQKEGRRIMPEIMIPLVGHHNELKILMERLEKTAKSVKDSDQVDYKFGTMIEIPRACVTADKIAKYADFFSFGTNDLTQMTFGYSRDDAEGKFMFFYLENGILEKDPFSSVDEDGVGELMRMAVEKGRKSNEKLEVGICGEQGGDPDTIYFCHKIGLDYVSASPYRIPIARLAAARANISEMKPELASTYRY

SEQ ID NO: 13561 - protein, 401 aa, Thermoplasma volcanium
MELPIEDVRVRKVLDSRGNFTVEADVYIPGGFGRTSAPAGASTGETEVIAFSKKGIDESIKFFETNVRRSIIGFNALDQKGFDALITDLDGSGNFSNLGGNLSTALSMSVAKAVSAHLGIPLYRYVGGINHSMPRPIGNVIGGGKHARNGTSIQEFLVSAQGKTFMESAYVNVLVHRKIGDILSEKMKDISIGVGDERAWSVNISDEEAFEVLNQAVNEVSSETKVKIYTGLDFAADSLYENGKYVYKHTVRSRDEQIDYAISINKDFGVYYIEDPMFDTDFEGFAEITKKIGDKAMIVGDDLYTTNPDRIRKGIELGSTNAVLIKVNQIGTLTKAQEAASLASSAGLKNVVSHRSGETTDDFLAHLSVAFSSTFVKTGTIGGERIAKLNELMRIEECLTS

SEQ ID NO: 13562 - protein, 406 aa, Thermoplasma volcanium
KGFLRLEWARDHMPVIAEIRKRFLDEKPFKGINIAMALHVEAKTGIFSLLLKEGGANVRMASCNPLSSDDSVVESLKTDYGMPVFARKGETQEEYYENLQRTLEKPPDIIIDDGGDLTKLVHTERKDLSKNIMGGNEETTTGVVRLKAMEKAGVLLFPMFDVNDANMKHLFDNRYGTGQSTLDGIMNSTNLLIAGRNVVVAGYGYCGRGIAMRLKGMGANVIVTEIDPIKANEAIMDGFQVRRMNDAIRYADMVITATGMKDVVKYEDALVAKKNIVLANAGHFDNEVAVKEIEKHSLEKREVREFVKRYRLENGNTVDVIADGRLVNLAAGQGHPVEIMDLSFALQALTAEYLVKNHQNLEKKVYPVPPEIDRYVAEIRLKQFGGELDTLTEDQIKYLNSWDEGT

SEQ ID NO: 13563 - protein, 389 aa, Thermoplasma volcanium
VIGGGPGGSTAARYAAKYGLRTLMIEKRPEIGSPVRCGEGLSKGILNEADIKPDKSFIANEVKGARIYGPSEKRPIILQSEKAGNEVGFVLERDKFDKHLAALAAKAGADVWVKSPALGVIKEDGKVAGAKIRHENNVVEVRAKMVIAADGFESEFGRWAGLKSVILARNDIISALQYRMINIDVDPDYTDFYLGSIAPGGYIWVFPKGEGMANVGIGSSINFIHNRLELKNYLDRFIENHPGLKKGQDIQLVTGGVSVSKVKMPITMPGLMLVGDAARLIDPITGGGIANAIVSGMYAAQVSKEAIESNDYSPQMMGKYEKLVKDRFERKHLRNWVAKEKLAQLSDETLDKLVDIVSEQVLTTISVEAILKAIAEKYPEVVKELEDLI

SEQ ID NO: 13564 - protein, 446 aa, Thermoplasma volcanium
MVVSPLEYRYGREQIKRIFDDENRLYYMLKVEAAISKAEAEYGIIPPEAAEDIGKVVADRIVQLQRVREIEAEIKHDVMAMVKALSEKCKVGASYVHYGVTSNDVNDTATALQMHDFFSFLKQDIEDIMETLIELTLRYKSSPMMGRTHGQHASPITIGLKFAVYLSEFSRHYDRMIEMSKRAFAGKVLGPVGTGAALGPKALDIQNRVMEILGIYAEEGPTQIVNRDRYIEYLSVINGISVTLEKIGTEIRNLQRPEIDEMSEYFDVERQVGSSSMPSKVNPINSENVVSLSRLIRSMIIPEYEAGVTWHERDLTNSALERFTIPYSSILVDYILVKMNSILSSLIIKEDKIRKNLEMDDSIFSESLVAALTQAGMPRQDAHEFIRRCSMKARSEGKTLKHVVVEEGITNYIRRDELDRLMDPANFIGSAPEICDIVVNNARRRL

SEQ ID NO: 13565 - protein, 376 aa, Thermoplasma volcanium
LQYVNESATVSASNYVEKLKKQGIKVYNFGIGEPDFTTPQHIIEYAFEMAKEGKTHYTPSNGIHELREKVSEKLKNRNNINASPDEVLITPTKFGINLAMMVILNPGDEVLIPEPYYVSYPDIVRLAGGKPVTVSTLEDYSLDFDLMRKYVTPKTKAIIFNNPTNPTGKVYDEKEIKSLVDFALEYGLYIVSDEIYEDLIYNGKLISPASYSEMWGKSITLNGFSKGYAMTGWRIGYMAAPREIVEAANVIQQQTITCVSSISQYAALRALDDTESPKKMKDEFKRRRDLILSILDSSDKLNVTEPDGAFYVFPEYNSDISSNKVSEDLLEKYQVVVTPGSAFGRQGEHHFRISFATSEDIIKEGAERIIKFFASV

SEQ ID NO: 13566 - protein, 362 aa, Thermoplasma volcanium
IKDRFDDHAHSLSFPVFFTSSYDSRKDRKYRYSRELNPTVEELSRQLSLLENTERSICFSSGMGAITGTILALAKPGDKLVMPTDVFGRTYLFAKNFLTKFGINVKFVEPGTDSLLGAVEEHADIVFFESLSNPLLRLYDVDRICRKASDIGAITIVDNTLATPILLKPSLYGCDIIIESLSKFIGGHNNAIGGSASGSLMMDTIDENRRSLGSSMDPMSAYLFILGLKTIDLRIKRSSETAKAIARFLNENNFVSKVYYPGLSDNSDNISAKTLLNGSPPIVSFLLDEGKDVQKFMESLRIITPANTMGGSNSTISNPYTMSHRNLSEDEKLRLGITKNLMRLSVGLEDLDQIIQDLEQAI

SEQ ID NO: 13567 - protein, 376 aa, Thermoplasma volcanium
IGLIGEPNVGKSTFFSAATENEAEINNFPFTTIKPNLGMTYFVVKCPEVEISGKCNPREGYCENGNRHIPVQIIDVPGLIEGASEGKGMGNEFLDNIRDVDSILLLFDASAGDIATVRKSIEMVKSELLKWISQRIYSDWDHFSRKSEASGERRDIALKRKLSLFGISEHQISEMMEKDFFPAKLSIWTREDADKLALSIIKYAKPLLLVGNKSDLVSPNTLSEMKNALGDSYFVSAEYELALKRARKSGLVSTTLNDFAILGGNEKQKEVLAKIRDWFNTPGIIRIHDLLQKVVRDYLHYIIVYPVYDESKWTDKSGNVLPDAFVMPYGSTSLDLAYKIHTDIGEGFIRAVNARTRMVLGKDYILKDGDVIKIIS

SEQ ID NO: 13568 - protein, 274 aa, Thermoplasma volcanium
VKLLKGEEIAEKKAEELKERIEKMGVSPRLVLLQVGNYSAATIYARAKIKRGKKIGADVVLEKYEDLTKQELVRRIEELSADKDVNGIMVENPLPKTIDYYDIVKSIPYYKDVDALSPYNQGSIAINREFLVPATAMAVVDILKYYGYEKTTATIINRSPVVGRPLSMMMLNRDYTVSICHSKTPDIRSIAKASKIIVVAVGRPGFLDDTYVTESSVVIDVGINYVQDKVIGDIDFDKVSEKVEAVTPVPGGVGPITATNILSNLVKAAEYQSN

SEQ ID NO: 13569 - protein, 343 aa, Thermoplasma volcanium
MSTINAIVTDAPKGGVKYTKIDMPEPEKYEAKLKPVYIGICGTDRGEVAGALSFTYNPEGENFLVLGHEALLQVLDVSDNNYIKRGDFVVPLVRRPGKCVNCRIGRQDNCSIGDPDKHEAGITGLHGFMRDVIYDDIQNLVKVNDPDLGKIAVLTEPLKNVMKAFEVFDVVSKRSIFQNDDSTFIGKKMVVIGSGSEAFLYSFVGKDRGFDVTMVNRHDETENKMKMMDDFGVGFSNYLKDMPDKIDLLVDTSGDPSTIFKFVKKVNNNGVVILFGTNGKAPGYPVNGEDIDYIVERNITIAGSVDAAKIHYVQALDSLSNWYHRHPQTIKDIITYEAKPEET

SEQ ID NO: 13570 - protein, 448 aa, Thermoplasma volcanium
TKIVATVGPASEDPSILKQMVKNGLSLIRINSAHAEISYVAKIVKEMRDINPDVGVMVDLKGPELRTGTFPGGSLRISKGNKYTIGKEITLNNEKAIGNIQTGDKVLMSDGEVEFTVDSTSPIVLIAENDGVLRDRSRVNVPGRYVEIGSITERDKSFVIEGIKQGVDFFALSFVQNAENVNSLRDFIIENGGNQYIIAKIETKSGLDNIESIVQASDGIMVARGDLGVELPLKEVVMAQKKIIKISHEDGDFTIVATQVLESMVNNAFPTRAEISDITNAIIDNADALMLSEESAIGKYPALAVQTLRDVSDYVENLVDFQSSYTFKGNKIAYSVAKAAKVLSDDINSNGIVALTHTGSTVKMISSLRPKALVYAGTVDDSLSRKLNIYFGVVPLHLKRDSESLSFADLTEYILKSAFFKSGDKIVVTSGDPYFTFGGTNDVRVMAI

SEQ ID NO: 13571 - protein, 473 aa, Thermoplasma volcanium
YIDGQWVDSSNGDTLTKYNPVTGEVIGKFAAASRDDVDRAFDAAEDAFQKWMDLGSVERSKIIYKAKELIEENRKELENIIIQENGKPVKEAAEEVDGVLDQMQYYAEWARKLNGEVVEGTTNHRKIFQYKVPYGTVVALTPWNFPAGMVARKLAPALLTGNTVILKPSSDTPGSAEWIVKKFIQAGVPKGALNYITGRGSVIGDYIVEHKKVALITMTGSTSTGQRIMQKASANMAKLMLELGGKAPFMVWKDADINNALKTLLWAKYWNAGQSCIAAERLYVHEDIYDTFINKFVELSKKIVVGDPSRADMGPLINTTALKGTEEVVEEAKESGARILYGGSKPDLSGPYKNGYFFLPTIIDNVDQKSKIFQEEIFAPVIGARKVSDVEEMYSLANDSKYGLASYLFTKDPNLIFEAAERIRFGELYINMPGPEASQGYHTGFRLTGQAGEGSRYGILEYLKIKNIYVDYS

SEQ ID NO: 13572 - protein, 698 aa, Thermoplasma volcanium
MISQEMPVERIKDLWRDFFRTYGYSDKINSIHQDYPEVRTLYVSFKDIEDYDRQFAASILASPEIYLKTGEEIVMEDYLLDKVSRRFRIFHLRIKDLEDRNTSYNIRDIRSANIGTLISVSGIVRKNTEVFPKLKNAAFECSNCHELNYVEQNESRLTEPLYCANCGQSKVKDKISFKLRPNLSEFIDVQKIEIQEDPETLEGGAQPQRLIIIVEDDLAGLLFPGNRVVVDGILQAEQRRQGNVPLTEFYTFLYAVNIRKDVKEIESVKITEEDKQKIIEISKRPNVIDVIAKSIAPTIHGLDMIKKALALQMFGGVRKTMKDGTTMRGDIHILMVGDPGTAKSQLLKYMAEVSPRGIFTFGRGSSAAGLTAAAVRDEFGEGRWTLEAGALVLADNGFVAIDELDKMDEHDTAAMHEAMEQQTVTISKAGIMATLRARASVLAAANPKFGRYDLNRNLAEQINFPLPLLSRFDVIFKMVDQPNKDTDSQLAEHVLKAHRLGEIYKSMEKNDIEIDVPDEAKYEPDIDKDLLRKYVAYAKNNVFPRLSDEAIAILQDQYVRTRTGSRDSIPITVRQLESTIRLAEAAARARLSTIVTVEDAMLAKKIVDYYLTDVSTENGKMDIDIIYTGSSSKQRNEMETVLDIIKEIKEEKGIAEVSDVIGVAESKGITAKKAEEAILKLKNAGQIFERSYGKLDVI

SEQ ID NO: 13573 - protein, 563 aa, Thermoplasma volcanium
MGDLNSASTDANISYSENQDRKLRKALSTWDLLMLSVGGIIGSGWLFAAYAASVLSGPASILAWVLGGIIVIFIALVYAELGAMIPRSGAIVRYGHLSHGSFAGFLFGWAYFLSAVSVPAIEAEAVVTYAASYVTKPALIANGIMTVFGTLIAMLLMIAFFFLNYAGIHLMGKTNQGITWIKVIIPVITVIVLIAVHFNPSEIVPPNGFLPYGWAPVFAAISSTGIVFSYFGFRQAIDYGGEAKNPQRSIPIATIGSVLIGILLYSLLQVVFVGGIDWSKMGLEPGQWTLLNAYATAAHASTEHPLAYQLMNAPFATIALSAGLVWLTYTLYASAYIAPSGTLNVYLGTSTRTLYGMAVNGHLPKIFAKVADRNKIPVIPLITTLLVGFLFFLPFPSWYKMVGFISGATVFTYIVGGAALMNLRKQAPELKRPFKLWSANVLAPIAFILASEAVYWTGWPTTLYLAIAIFLGLVLYGALVGLHKIEQTFDKKNVKAGLWVPVFIVILTILSYLGEYGGINVLHFPLDLIVVAIASAIIYVWAIKSGIKTEEIAAMIANEDQYV

SEQ ID NO: 13574 - protein, 283 aa, Thermoplasma volcanium
EALKSISFKVPASGILSLIGRNGAGKTTLIRILSTELLPSSGYAEIDGIDIIGEPDEIRKRIAIIPQEARAISWLTPIQTITTFLLYRGINYSEAKRRSMEVLKKLELEQIAGKLNRTLSGGQKRKVLVAALIASDADILFMDEPTTGLDPISRAELWDLLAELKREKFIFLTTHYLEEAERLSDRIAILDSGELKGIGTISELRSRLPKKYSINLIQTSNLDGEIEINGTVLKTGRRLFIDEEEAYSIVRDLINKNAKFSINPISLEDIYYSIAKRDIGGDA

SEQ ID NO: 13575 - protein, 453 aa, Thermoplasma volcanium
  unsure (1)..(453): unsure at all Xaa locations
LVKYFSITLIYCXCELDYKTGYVQFDQIRITPIFVAVTVLSSMGVFMDGFALSIFSAALPYLKNYILVKSILVSLAASAIYIGMFVGSFVIGHLSDTIGRKRMYTYDLAITSLFLVLTGISRNFAEFFIFELLAGIGIGADYPLSSSIEAEFSPRVSRGRFLVFNIFMWTIGSIVFYLISIPLVGYFGSSSWRWMYFVGAIIPIAVIISRHALPESPYWLVKAGKVKEAKKVAENIGKEAGTPNVDVPSVESGSSSIKSVFSGSYLPLIMFASIAWFAYDVSSYGVWNYTPSIFVSTGISVVSSIVSTLLEDLPVIAGFIVCLILIDRIGRRVLQAAGFGLAGISLLTFGLYSMHHTLPFILIFIAFAMMHLFHNIGPTNLTYVYPVEIFPTRVRGTAMGIATSASRIGAILGVFAFPLLIGTFSLSAGLLFFAIFEFLGFIVTVILAPETKA

SEQ ID NO: 13576 - protein, 424 aa, Thermoplasma volcanium
MASQKPHLNLITIGHVDHGKSTLVGRLLFEHGEIPAHIIEEYRKEAEQKGKATFEFAWVMDRFKEERERGVTIDLAHRKFETDKYYFTLIDAPGHRDFVKNMITGTSQADAAILVISAREGEGVMEQTREHAFLARTLGVPQIVVAINKMDATEPPFSEKRFNEVKADAEKLLKTIGYKDATFVPISGYKGDNVTKPSPNMPWYKGPSLLQALDAFKVPEKPINKPLRVPVEDVYSITGIGTVPVGRVETGVLKPGDKVIFLPADKQGDVKSIEMHHEPLQQAEPGDNIGFNVRGIAKNDIKRGDVCGHLDSPPTVVRAFTAQIVVLNHPSVIAPGYKPVFHVHTAQVACKIDEIVRTLNPKDGTTLKDKPDFIKTGDIAIVKVIPDKPLVIEKVSEIPQLGRFAVRDMGQTVAAGQCIDLEKR

SEQ ID NO: 13577 - protein, 479 aa, Thermoplasma volcanium
GKMLTVYSPIDGSEIAKISMATREDYDEMVKKAQEEFKKWRMIPAPKRGLIIKDIGDELRKEKRNLGRIVTIEAGKTPSEGEGEIQEMIDISDLALGLSRQLYGLTIASERPYHRMYEQWVPLGPIAVITSFNFPASVWSWNSFIAAVTGDVVIWKPSSKAALTAVAVMKVIERVLKRNNVPNIFYLMVSSGSEGGDWITNDPRIPLVSFTGSVPVGRKISENVAKRLGKSILELGGNNGAIVSDKADIDLALRGVVFGALATAGQRCTTTRRVIVSEKIYDEFVKKLVNAYSKVKVGDPREKGVLVGPLIDEDAVRDYEGAISEAVKQGGKVLYGGKKISLKGYEKGHYVEPTIIEANPNMPIVKEETFAPILYVMKYKTIEEALEIHNSVPQGLSSSIFTTDLREEEAFLSPYGSDCGLANVNTSTAGAEIGGAFGGEKDTGGGRESGSDAWKFYMRRQTVTKNWGQTLPLAQDVVF

SEQ ID NO: 13578 - protein, 320 aa, Thermoplasma volcanium
EWELALHSKIEEVNERLFEVVKSEEPDLDRMAKYTIEAGGKRFRPLLTILAFESSTDDPYFKILDLAAGYELIHTASLIHDDIIDDSPMRRGRPTLSYKEGINNAIVVADYLFAKAYELGSRYGPLVSKVMADASSRLAEGQILEAVNLGNLDITEDTYYKIIENKTAHFFEACALGATIVAEADRPTREILSNFAFNLGMAFQVTDDILDIVGDDRYTGKPTFVDIKHDALTLPIIYALRNSNDNDRRAIIDMINGRREINKSLLKDIFLKSGSIDYSFSVAKQYITKSMDYLKKAKKSPDIDLLMELAFIVIDRIEIF

SEQ ID NO: 13579 - protein, 227 aa, Thermoplasma volcanium
LIAGTGENLGYFTALNLLKSGFKVSIIARNKEKLENMGSELRKYGDIEYFAVDLSKREGLASLKKHFSSLNYQIKGVVVEVGGYASDSLDSITAFDQMIEANLKIPILVLSAISGMLDKGSSIVFITSVFASRKIAESSVSYSLSKAGLNRLVEISAKILRQKGIRVNGISTSIISQKPHDKDKIEWQPGTQNVDPELISNVVVFLMSDLSLGVTGNIIYVDKGSSL

SEQ ID NO: 13580 - protein, 250 aa, Thermoplasma volcanium
WCLDMIRMNISVRNLKEITDLLSTIVSEAKFKVDENGMSVTAVDPAHVAMIRLEVPKEVFSEFRSDGTEEIALDIDRLKSVIRLANSSENVGITKDKEKLKFDLGNISKSVSLLDPSTIVTPKIPNIASEYYAIIKRSDFERGLRAAEDISDSIRFVLSSEGFRATSHSESEESEMVLPKDMLSDLSCSDTIKSSYPLEYLLKFIKAVSSADSLKISFRDDYPLSIEFYLDQNPSAKIKGLFLLAPRMEQ

SEQ ID NO: 13581 - protein, 312 aa, Thermoplasma volcanium
MVENQKKKKIEEIERCPECGSTNLIRDYEHGELVCGECGAVIEDSYIDQGPEWRAFDSEQNESRARAGSPMTFTIHDKGLSTDISWKNKDSYGRSIPTRNRAQLYRLRKWQKRIKVSNAAERNLSQALQELERMAFNLSIPNDVRETAAVIYRKAVKQNMIRGRSIEGVVAGALYAACRITNVPRTLGEIASVTRVKKKEIGRTYRIMSRYLKLNIMPSKAEDYISRFCSKLKLSMDTRNKALEILRDAENVGLTSGKGPTGVAAAAIYIASLITGERRTQRAVAEVAGVTEVTIRNRYKELTEKLKLNVEQ

SEQ ID NO: 13582 - protein, 540 aa, Thermoplasma volcanium
IKKIALLNAYQHNGKAELKSVIGKVMAEIADLRKNPKLVSELAKAAVDSVNSMSKDDIVNIVEKQFPEALKKDKKPEEHRLPDLQGVNGHVVMRLAPSPSGPLHIGHTRMAILNDEYVKRYGGDLILRIEDTNPTNIDPEAYAMIPEDLEWLGVNVTKTVIQSERFDLYYSVAKKLIENGHLYICTCDREEFKRKKLASIPCKDRDNPPETNLYLFEKMLDGEIKAGAAVAVMKTDLNHPNPSVRDWIAFRIIDAKHPRTGDKYRVFPMMSFSVAVDDHYLGLTHVLRGKDQLTNTEKQRYVFEYNGWNKPYYYHYGMIRFPGTRLKTSLMKKGIQAGQYDGWSDVRLGTVRAMARRGYQPETFRRYWINSGLREIDAVFSWEIFNSLNREFVDPKAYRFSFTKDPVEIKMEGSNGLTARLPYHPSHPEYGVRKYEIGDTVYISKGDADKIADGERFRLKDLCYVVRKGDRFLFDGTEMKEKTKIINWCPPNSREFQVLKPDGSIDKGLIEPASKGYRGISQLERYGYVNFYDSDEKAYF

SEQ ID NO: 13583 - protein, 295 aa, Thermoplasma volcanium
CPECHSEHLIRDYEHGELICADCGAVIEDSFIDQGPEWRAFDSDQDERRARTGSPMTYLSHDKGLATEISWSNKDYYGKRIPHKNRAQIYRVRKWHQRIRVSNAAERNLSLALQLLNDIGAKLGIPKDIKETSALIYRKAVEKNLIRGRSIESIVCASIYAACRKVNIPRTLDEIAKASEVNKKKIGKAYRHLAKELDLNLRPTTPFSYIAQFCNKLDLDKQAIVISEDIVRQAMSMGISSGKGPTGIAAAAIYIASVKVGKPRTQKEIARISGVTEVTIRNRYKEISKALNISI

SEQ ID NO: 13584 - protein, 318 aa, Thermoplasma volcanium
  unsure (1)..(318): unsure at all Xaa locations
IKKVGIVGAGTMGSAIAEVFAYNGYNVILKDQTIELAERGRENAKRIIEGYEKISNEKVKKEITKIEGYGIKLTEEQKSSITKSLSVNVPVKEVEERIIVTSKNDEMSDCDLIIEAAFEDQAVKNQIFRELSDFSNNAIIASNTSSLSITEMSKNLKKPENGIIMHFFNPPYLLPLVEVVPSLFTSNETLTAVMDLLHGMKNHRENMVPVLAKEREGFIVNRLLIPFINEASKMLDYGIATEKDIDIAMKKGAGFPMGPFELADMIGIDVVKDVMNVFEKTYGDQYKTSQLIRRMSEAGKLGRKTKEGFYKYXKIILL

SEQ ID NO: 13585 - protein, 319 aa, Thermoplasma volcanium
  unsure (1)..(319): unsure at all Xaa locations
MARKKISVIGAGNVGATVAQFLATKELGDVYLFDVVDGIPEGKALDIQEGAPHWGYDLDVVGFSTSDSSNYKNMEGSDVIVVTAGMARKPGMSREDLFDKNVEIIADVSKNIKKYSPDSIIVVVSNPADIMAYALQKISGVDPQRIMGLGGSLDSSRFRTFLAKELDVSVEDVNAFVIGGHGDDMVPFIRYSSVAGIPIEKLLPKEKIDAIVKRTRFGGGEIVNYLKAGSAYYAPGISITAMVESVIKDKKRVIPCAAYITGKHAEHYGINNKFIGVPIKIGERGVEEIYDIDFLPEELELWKKSVASVXGKLEECXRV

SEQ ID NO: 13586 - protein, 189 aa, Thermoplasma volcanium
KMPVVLGQKAPDFTVNTSKGPITLSNYRGKWVLLFSHPGDFTPVCTTEFIAFTERYEDFQKLGVELIGLSIDSVFSHIAWIRDIKEHFGIDIPFPIIADIDKEVAREYNLIDEKSGATVRGVFIIDPNQIVRWMIYYPAETGRNIEEIIRVIKALQFNWDRKLATPANWQPGQEGIEPAPTTVDSSFKR

SEQ ID NO: 13587 - protein, 312 aa, Thermoplasma volcanium
RMRRYRKDQNLRDFISEIRVSIDKLIMPIFIDENIKEKTQISSMPGIFRYPISQLEDYVKHLEDIGIKSVLLFGIPKYKDSFGSSAYDKNSIIQRSISLIKETTDIVTIADLCLCEYTDTGQCGLISNDYVDNDKTLEVYRKIAVSYAEAGVDIVAPSGMMDGQVKAIREALDSSGYVNTMIMAYSSKFSSNLYGPFREAAESAPKVGDRKSYQLDYRNGKEAIREIELDIDEGADIVMVKPAIFYLDIIRSARDRFNLPLAAYSVSGEYSMIVNAVNQGLIGEDSVNEALTAVFRAGADIVITYFAERLAE

SEQ ID NO: 13588 - protein, 376 aa, Thermoplasma volcanium
NFGVSPEEEMVLTYVKKFAQEELKPRAKEIDAKMEVPREIIDRMKQLGFFATYIPKEYGGLGMSFPFLIRAIEEISKACPSTALVLDGALTLFAEPIIMFGSEDLKKRYLTRVASGSVGGLAITEPGAGSDAAGISTTAEKRGDKYIINGDKIFISNGRISDFFVFDAVTDPGKRHKGITAFVVDANTPGLKISRDIHKMGIRGSSTVELVFEDMEVPAENIVGELNGGFKVIMETLDAGRIGIAAQALGIAEEAFAEAMDYIKQRKQFGTTISSFEGIQFMIADMATEIEAARYLTYVAAEKWQHKEDTIEISAMAKLKASDVAVRVTTDALQLFGGYGYTVDLDAERHMRDSKITQIYEGTNQIQRLVIAKELL

SEQ ID NO: 13589 - protein, 319 aa, Thermoplasma volcanium
LFEKYYRSTDIDPPALITKREVGFMTFEGEIIRHMHLSNKFELNNMLRTTVPRHVYSSAAYYKKPDEKKMPEKIWEGADLIFDLDSDHLPGAEKMTYEEMLNSIKEQTKRLVNKFLVSDLGISEKDIRIYFSGSRGYHVHVSSEDVYPLGSDARREITDYVSGNSLSISVIDKALKTGEKRPGGWIKDVISKLYELGINAEKISQKQIERAIDQVKSHNATMVDAPVTYDIHRLIRMPQSLHGKSGMMVKEVDLDKFDDFDPLSDAIPKIFLEGDYDINVHEKTRKLRLLDYKIDLPPGRNRVPQYVAIFLVSSGRADF

SEQ ID NO: 13590 - protein, 549 aa, Thermoplasma volcanium
VIRNMMTGQVPILVLKEGTQREQGKNAQRNNIEAAKAIADAVRTTLGPKGMDKMLVDSIGDIIISNDGATILKEMDVEHPTAKMIVEVSKAQDTAVGDGTTTAVVLSGELLKQAETLLDQGVHPTVISNGYRLAVNEARKIIDEISVKSTDDETLRKIALTALSGKNTGLSNTFLADLVVKAVNAVAEERDGKIIVDTANIKVDKKSGGSINDTQFISGIVVDKEKVHSKMPDVVKDAKIALIDSALEIKKTEIEAKVQISDPSKIQDFLNQETSTFKEMVEKIKKSGANVVLCQKGIDDVAQHYLAKEGIYAVRRVKKSDMEKLAKATGAKIVTDLDDLTPSVLGEAEKVEERKIGDDRMTFVTGCKNPKAVSILIRGGTEHVVSEVERALNDAIRVVAITKEDGKFLWGGGAVEAELAMRLAKYANSVGGREQLAIEAFAKALEIIPRTLAENAGIDPINTLIKLKSEHEKGKISMGVDLDSNGAGDMSKKGVIDPVRVKTHALESAVEVATMILRIDDVIASKKSTPPSNQPGQGAGAPGGGMPEY

SEQ ID NO: 13591 - protein, 261 aa, Thermoplasma volcanium
LTVISIIGGGTIGSSIAIPLKRSGFEVIVTRRNTAVLKHLESYGISVMSDNKTASKEADVVFLTLKPVDIIPEVRKIEENIRGKLLISMAAAIPLKLIKDAAPHSIVVRAMTNIAAKVGAGFTPFCVDDGDQEVAKRASSILSALGEVYLVEEKYMDALTALSGSGPAYILTIIEAMMYGGLKLGLPRDLALKASYQTVMGSAKLLAESGEHPSELKEKVITPGGTTIDGIYELEDARVRTAIMKAIEVSTMKANKISESI

SEQ ID NO: 13592 - protein, 474 aa, Thermoplasma volcanium
LALDAGTTDVKAGAYDRSMNLIASCKRRIGVYYGQGGVVEQDPHEILEAAKYCLNSILRRIPKRYGEPKAIGITNQRESVLAWEPIDGRPITKLISWKDKRGAQLSLDLKERYGQVIKDKTGLISDPYFSATKIKWLVENIKRSSNHKNYVITTLDSWLVKNLNSSSIKPLTDHSNASRTMLFNIDSLEWDSDLLEIVGISEEILPEVKRTIESDSYGKVKLTYGSTTREVPILSVAGDQQASLFGNGCLYPGQAKASYGTGAFILENTGVRVKSDRLLETLFYTYKGKRTYALEGTILSSGSSIDWLVSLAGLKSVPRSILRAEQIERSHVLSVPALSGLGSPFYSSDIRGYISGLSESTDIYEVIRSFLEAQAFLSTVIIEEMRKHIKLLEPLHIDGGLSKSDLIAEMLANLLDMKIIRERNVDATMKGIAMMSMIGYYGIDERKLTVSAGGKEFNPNDKRDEIAEKFNSWR

SEQ ID NO: 13593 - protein, 636 aa, Thermoplasma volcanium
LPTEEVYHPDMNLYKRAYDDSFKNMEAFWSFNAEILTWYKKWDRVLDDTKKPFYRWFVGGKLNMSYNCVDRHIEQHRRNKAAYIWVGEKGDEKIVTYDGLFRRINNLAKALINLGIKKGDRIVLYMPMIIEAPVAMLAAARIGAVFSFVFAGFGAGALAERINDSKAVLLITADGSFRNGKVVELKKIADEALEMTSTIRNVIVVKHAGNNVDMNEDRDIWYHEVVGDSYTYVEPVQMDANDPLFILYTSGTTGKPKGAVHSTGGYGVWVANTLKWAFNPDEDDRWWCAADIGWITGHSYIVFAPLILGLTSIMYEGSITYPEPDRVWEIIEKYRINILYTSPTAIRMLMKFGDKYPKRHDLSTLKVLGTVGEPINPSAWRWYYETIGNSKCPIIDTYWQTETGGFMIAPQRALGLPPLKPGSATFPLPGVDPAILNDRGEEVKDNEKGYIVFRRPWPGMLMTVNNDDERYVKTYFSKFYGYYFCGDYAIKDSDGYYWLLGRADEVLNVAGHRLGTIEVEDALVSTGLAVEAAAFGKPDPIKGEVIVAFIVPKQIQADRRELISEIRKRIRSDLGPIYVPDEIHIVKLLPKTRSGKIMRRVVKAVALDQIPGDLTTLEDSSSVDEIRSAIEAFRKE

SEQ ID NO: 13594 - protein, 280 aa, Thermoplasma volcanium
MEYKEFGNTGVKVSSVGIGTYYDPGWMALSRFNVKRDAEKKIQAIRTAIDAGVTLIDTAEIYGSEDLVAKAIEGHNREELFIATKVWINHLRYDKVIKACKASLSRLNTKYVDLYQIHFPSPTANLQETFKAMEKLVDDGLVKFIGVSNFSRGKLEKSMEYVKKYEIVSNQIHYSLKKRDAEEDIVKFCENNGMAVLAWYPLEHGSLVRESDYPSEILARIKAKHPSITPAQIALSYLIYGNKLVFPIPRASNPEHVKENIASVEQKLDQEEIEELRKYF

SEQ ID NO: 13595 - protein, 425 aa, Thermoplasma volcanium
YYNLPLYSNMVSSEVSGFYKMTVDERLNFVKEFSRLSDDDIRILRTNGSLAIDKADKIIENVITTIEMPLGIAVNFLINGKDYLIPMAIEEPSVVAAASNAAKVARKSGGFNAYATEPVMIGEIQVLGIDSLYLAKMNILRDKSRILELANTRSKTLSSLGAGAKDIEVNVYERPHRMLIVHLIVDVRDAMGANVVNSMCEYVAPEIEKITGGRVNLRILSNLTKYRVAYASAVFSKDIIGKEAVDNIVEAYRMAVVDIYRASTNNKGIMNGIDAVLVATMNDWRAAEANAHSYAALEGYGPLAKYEKNSNGDLVGTIEIPIAVGTVGGTTGSIDKARIARKILGVSNATEFAGVLAAVGLAQNFSAVRALATEGIQRGHMELHARNLALSAGASPEEVDSVVNEMISSKEITMSNAIKILEKMR

SEQ ID NO: 13596 - protein, 300 aa, Thermoplasma volcanium
MSDISTTLAGIKLVNPFMVASGILDENGYTMKELLERGAAAVVTKSIGISERDGYPTPVIVEYGDSLINAVGLSNPGIENFGEEINIAKEAKRPIIGSVFAYNAEEFTKLSVKMEEYGVDAIELNLSCPHVKGFGLEVGSDPDLVEDIVNEIKSKVKVPVFAKLSPNVSNIIEIAKAAEKADAYVLINTVKAMAIDIYSRSPVLSNLYGGLSGPAIKPVGIRYVYEVKKETGKEIIGVGGISNYKDAIEYIMAGASAVQIGTALYKYGKGIFREMEWQLRTFMDEERFEKIEEMVGVAIK

SEQ ID NO: 13597 - protein, 395 aa, Thermoplasma volcanium
MDFDFTEDQKLLQSTAKDFAEKVIAPNIERMRKDRRIPKEVFDGLAKMGFLGMAIPEKYGGMGMDAVSTGIVAEQIARADPTASIPVLFLVDNAWSYLISKYGNPEVFSGILQKVARGSLITGIGSTESGHGSDVAGIDTVAVKKGDEYIVNGEKSFISLVRDIKEIGGGYVTVVKTDPKAGARGISLLYIPYSEEIEIGYLEEMGREGSSWGTLRFNDLHVPAKYLIGQENRGFNIVHEGFEFARGLISVISASMALKSIENGAAYMKQRKAFGNSIATFEGLQFQLADDVAKMEAALNFAYKALWIYDQEQRYGKYSRFQVSKMIAMAKLISTTWGFDAVNDAMQWQGAYGYSKDCPEEWALRGIRSFQLAEGSREIMKIIIARETLGKEFIK

SEQ ID NO: 13598 - protein, 1188 aa, Thermoplasma volcanium
IVDAYFKKYGIVNHQLDSMNSFYASSDNPNSVMQQIVDETKVSDDADPGFFVLDPAKTGGHDIRIYYGRVRENGHYVGEQTIFVGKPEIKEASGASNQITPNEARLRDLNYMAPVTLKLRIVEDGIEKGSETIKVGDIPVMVRSKICTLAEGNLDQYIEKNNGPIGLSRREKLQYVGEDPDDPGGYFIIGGSERVIVSLEDLAPNKIMVEWEDRYESKVEVAKVFSQRGGFRALTSMEKGSDGTINVSIPSVAGTVPLVILMKALGLERDVDVHDAIASVPEMEPIIYANIEDSKNPKILPPNGVNTTEDAISYLEKRFAAGQAKEFRDKKISQMLDHSLLPHLGDSASDRIRKAIYLGRMARSLLELSLGIRKEDDKDHLANKRIKLAGDLMDELFRSAFQSVMKDLKYQLEKTYNRKRGIKIRPAVRQDLLTQRILHAMSTGNWIGGRTGVSQLLDRVSNLSTISHLRRIISPLTRTQPHFEARDLHPTQWGRICPNETPEGQNCGLVKNAALLINVTQGIDSETVMEILKGMDVKEVLEESPNKGRVYLNGDFVGYHDDPRYLVRRLREERRAGRISDEINVRYDDNTNEVIVNCDRGRLRRPLLVLKDGRTVITEDMIEKLRKDEYSFEDLVKVGALEWLDAEEEEDAYVAVYAYNIPEKCPHCSSYLYRSMVDWSNPGSNNIILECGFCYNKFEVPSLITPEHTHLEIDPAMILGVVASIIPYPEHNSSPRITIASAMAKQSLGFAQSNVRIRPDTRGHLLHYPQVPLVRTRVMEYTHYDRRPAGQNFVVAVLSYEGYNIQDALVINKAAIDRGLGRSTFFRTYSAEERRYPGGQEDKFEIPTHDVIGARAEEYYKNLDESGIIYPEAYVEGSDVLIGKTSPPRFLEEGEERLGPQRRRESSVTMRPNESGYVDNVFLTVSESNSRVVKIKVRSERIPELGDKFASRHGQKGVIGLVVPQEDMPFTEEGIIPDLIFNPHSIPSRMTVGHILEMIGGKIASRTGKFIDGTIFSGEPEKSLRDELVKYGFRKSGTEVMYDGITGRKFRADIFVGVIYYQKLHHMVAGKFHARSRGPVQILTRQPTEGRSRQGGLRFGEMERDTLIAHGAAMVIKDRLLDQSDGTVLYVCGNPSCGHIAIYDRRKGTLRCPVCGNTGNIYPIETSYAFKLMRDELISLGVVMRLML

SEQ ID NO: 13599 - protein, 506 aa, Thermoplasma volcanium
MKGYEIFAESLKKLGIEEVFGNPGTTEIPMLRSVNDYVLTLHDSISVGMADGKAQVTGSPTLCNLHTVPGIGNSIAFLHTAFYNRSPVIVTAGQQDYRHIFYEPILSGDLTSLVSGLVKYKYEVKQADDIYRSLKRAYQIAEAPPKGPVFLSFPMNVMDEEYNEKFDDFHKIDYEWIDKKALREIADMINGAKYPAIVFGYEIDLYDAFEEAKDFAHALGCPVYCEPLASRGCYPSDDPQYAGDLPPASALLNMKLMQHDLVLVVGGDITLYPYTPPPPLQGKTVIFVGTDNSGKIGTHYQMNPKMFLREIMGLVQRKCNFSRSPNYTVKTSITLARKKMGTAYVMSKIAKEFRDYVIVDESISASQTFRSFLVYEHNSYFTAKTGQLGWALPAGAGMSLKKGKVLAVVGDGSFMYTPQTLWTIERYNLPLKIIILNNGGYMILRSFSKSYYNEVADKDFLKPNIDAENLVKAFHIPVKVADPNLKDLQWLREGDEARVLIINMDR

SEQ ID NO: 13600 - protein, 352 aa, Thermoplasma volcanium
MEFQKYRTMHFPRDVYIGHDVLNRVLDVVDQNSRTRDVIIVTGNTTYELAGKKIVEILASSPYEVHLSFAGEANYENLKKIEEETNDVNAGIIIGVGGGTKIDLAKKLAYDKNLPFISIPTSPSHDGIASPRASLRRNGISYSEEGAMPIGVIADTSVMIKAPYRYLAAGAADVISNISAVKDWKLAHRLRGEEFSSSAAAMSEYSAQEVISQVGEIRKYDESSVWLVTKNILASGTAMAIAGNSRPGSGSEHLFAHALEAAGVNNMLHGEMCAMGTIVSLYLHDDNWQKIRDVFESLGVSVKARDYGLKEEVVIEALRRAHAIRPERYTILGESDMSYDAAVKALELTGII

SEQ ID NO: 13601 - protein, 287 aa, Thermoplasma volcanium
MYNGIVTPMLTPFNRAGEIDYDATRLLIQDLKGYGVSGLFPMGSTGLFPMFSLEERKKFLQFVSENRNNLTVYAGVGSSSTQESIELSKFTEDVGIEVRVLMPTYYIKPDEEWMYKHFSEVISASSNDLFIYNIPQLAGSWVPENVIKKLKSEFSQVKGIKDSSGDMRFFSRIVTLVSKDFSVFQGQDDLLLTSMALGANGGVCGLSNISGSIVDLYKAFQSGDLKKSREIQLNKVNPLMYAVNAPTFPSGYYYAFYKKHNINGGYRSPMVQPSKEHSRVIDEATSQ

SEQ ID NO: 13602 - protein, 588 aa, Thermoplasma volcanium
MKFSLVTDAFEKMSKTTKRTELTEILVELLKSADEDLQSLVYLIEGKLAPDYQGIETQMSDKLIIKALSIVSNIPEEAVSETYSKLGDIGSVAREIAAKKNMRSLVNEDLTVKYVHDTLMRMAKTSGSGSTKARIDAYVDLALSGTPADLMYITRIITGKLRIGVSDATILDAIILAFSDEKYSEEIENAYNFHPDLGYIAVQLRLGNLESVINMGPTPMVPFKVMLAERLRSVDEIVQKMNGKCAFEYKYDGMRTEIHIVDEKVRLFSRGNEETTGQFPDIVKSAKETFHVSSVILDGEAVPYNPETGELYPFQVISQRRGRKYDLDKVSNEIPITVFLFDIVYINGKDLSKTPYAERRRILEGLFKENDNFKLAKRIVSSDTGTITKFFNQAIEDGCEGLVAKSMADDSYYKAGARGWLWIKLKRDYQAQLWDTIDLTVVGAFMGHGRRSGTYGALLLATYNEKNDTFETVCKLGSGFTDDVLFSLPKRFAEFVSKEKPARVVSTIEPDVWIYPSIVMEIIGAEITISPVHTCAFGIIEKDAGLSIRFPRFTGKWRDDKKPEDSTTTQEIIEMYKEQKKTLTEEKS

SEQ ID NO: 13603 - protein, 441 aa, Thermoplasma volcanium
MRYVIASSRCPFSHDVVMGRELVKENVGGVATALKRAISKHGGTWICWGDGKADNRYVNEDVGTYKIKRIILTPQEKRGYYDMYSNRTLWPLFHYFRERVQYTDNGYETYRKVNEKFAEEILNNTSQEDIVWVHDYQLSLVPGILRQKGLKNRIIFTWHIPWVSREMFETLTESDEIKESVGSADFITFHTDLYRKNFESLFENRKHGKSIAVPLGIDYRYFEKAKSSQIKSYALKDKIMLFSIDRLDYTKGLTNRVLSIERLIRNHPETSGKFVYVMIVTPSRTSVSDYVSMKRELEMNIGRVNGEFGTISWMPILYMYRKISDHSLVSYYKSADIALITPLIDGLNLVSKEFIASTEKGILVLSKFAGASNCLRGALIVNPNSPDEVADAIYKAMNMERKEADERLLKMKAIVKARDTDWWIKRIYRLAIAKEHDRRVT

SEQ ID NO: 13604 - protein, 219 aa, Thermoplasma volcanium
IFLDYDGTLVPIIMNPEQSLADPELIEMLTELRSKYKLFIVSGRSPEEIKRFIPLDLNLICYHGACSIVNGKTYYYNNAQSFLGIFNEIYQSSLNLVNEFPGLRIYKKNLAVLYHFGLMKPQDVPALERVIVEISQKEHVDVYKGKMIFELRVPGVNKGIAIKNVRDEETALIAGDDATDECSFKYNEDAITIKVGPGKTSAHFRVNDYSEMREVLKLL

SEQ ID NO: 13605 - protein, 432 aa, Thermoplasma volcanium
  unsure (1)..(432): unsure at all Xaa locations
AKYLLIVISXRYMKSKGRDVYMVAGGVTKFSKASPDMDFRLRVKKAFDYAMNDAGLTLADIDGSVASYFSDHFQRQLMAGIMVQDYLGLVPKPSKRIEGGGATGGLAFQAGYEEIASGRMDAVVVYGFETMSHVNTWKGNEFIALASDTNFDYPIGGFYTGYYAMMAVRHMHEFGTTVEQMAKVSVKNHGNAIHNPYAQSPMKITVEDVRKAPMVSYPLTRLDVCAMSDGAAVAILASEDKAFEITDHPVLVKAIGTGTDTMRLSDRPFGEVPLLPNESPSDYKGLKYPGVHSFRAGRMAAKEAYEKAEITDPINDLDLIELHDAYTSSEIQTYEDLGLCKYGEGGQFIDEGKPELKGKIPVNPSGGLLAAGHPVGATGIMQAVFMFWQLQHTIKKHFHDDYLQVPNAKRGLIHSHAGTGTYVTVTIMEAVK

SEQ ID NO: 13606 - protein, 585 aa, Thermoplasma volcanium
IASDLVWRKKWDTVMEGRLPEFSFFKGGYLNVAENLIDRHIEAGEANRAALIFESETGRSAVYTYAMLQSIVNKLSNALRSLGVKKGDRVSIFLPNIPETLFSVLACYRVGAVFNTIFSGFSTQALENRLKHFNPMIIITADGTYRRGKLVELKKKVDEIRDSNFEKIIVVKNVGLNLNFTERDLDFYSLIAKFNDKDKGGDVEANEPGIVFYTSGTTGKPKGVVLSGAGFLVNNYVYAKHHLDLSKSDVLWCTADIGWLTMHIWGIIGALANGSTTLFYEGAIDYPSQDRFYEIVQKYKVTKIFTAPTLIRMLMKYGFPEGKYDVSSVRVIGLVGEPLNPEAWHWMNKHFRSAYINNTWGQTETAGTPLAGSAFATGMKPGSSGIEFLGASLDVVDDEGNPVLERPGNLVIKKPFPMMIRDLWNEHERFLKEYYGKLEGLYFTYDVAVKDKDGHFWVLGRNDDVINVSGHRLSTMEMESLVASVNGIAECAVVGIPDEIRGLTPVVFVSLKNDISATGIEETISKMIEEGIGKFAAPSDVIVVEEMPKTPSGKILRRFLREIYVYGDIVGDRTGLENPASIEKL

SEQ ID NO: 13607 - protein, 610 aa, Thermoplasma volcanium
FVYKPDEAEIASTNLGMFASSVGITVKELYDKADSDPEWFWPQVIKDTGIEFFSPYKKVFDNSGGPQHTKWFTEGLINIEYNAVSRYKDSSKPAVIYQNEYLERETLSYSGLNIYVSSVASTLLDMGIRKGDRVGIYMPFNLKSAIAFYSILRIGAVAVPMFSGYGYEAVKTRVEDAGVKLLFTSKGYSRKGKFVDMMSVAEKVGLPIIAEGGSKKGYSFEDAMHGQKRIETEKTGSEDTAIMLYTSGTTGKPKGTVHVHGGALINIAKEVKYYMDLKDGDVLHWITDLGWMMGPWALIGTNVLHGTIYLYDGAVDYPDASRLFTILEDNNVTLLGLSPTLVRMLRYKNIERRFNTVRLFGSTGEPWDDESWSYLFNVLGGGKTPISNISGGTDIIGCFLASNPAIPIKPKCLYRGLGMNASIFDENGKEVYGKVGYLVAKKPSPSMTRGLWMAEDRYLESYWSRFQGVWFHGDFGEMDEDGYFYLYGRADDVIKVAGKRVGPNELEDIVMAVNGVIEAAVISIPDKIKGEALAVFYVGEPDLSGRIKDAIESKMGKPFSPSYVLRLRKLPKTRNGKTMRRVIRSSFLGQDPGDLSNTEDLDSIKEIEEL

SEQ ID NO: 13608 - protein, 381 aa, Thermoplasma volcanium
MHSYVDADDLLRNSIKEFVKKEVEPIRMKIDREDYFPVDVFKEMGKLGYLGVTIPQEYGGSDAGYITQAVIEEELGYSSPSLALSYGAHSNLCLDNVYRNGSQAIREKFVPKLASGEWIGSLCLTEPGSGSDALAMHTTLHDHGGRIFLTGSKTFITNGPYADLFLVHAKDGDSYTSVIVLSSDKGFERGKKFEKMGMRGSPTGELFFNDIDIGNERIVGKRGDGKRIIMSGLNSERVILAFIFVGLARRALDEAVKYSSERKQFSLPISEFELIQEKLAYMYTKYETSRILAYRALEKLESSRDDPLYAAAAIMHASESAEYIAREAIQIFGGYGYIKDTGIEMFLRDAILGQIGAGTTEIRKRIIAKSLIRKYKLGEDI

SEQ ID NO: 13609 - protein, 408 aa, Thermoplasma volcanium
MISKLKMPQPTVNIGMVGHVDHGKSTLTLALTGVKTDTHSEEIKRGISIKLGYADTPVYKCYDASGNPYYTRQPSENCELERVISIVDAPGHETLMATMLSGSALMNGALLVIAANEHCPQPQTREHLTALEIMGIKNIVIVQNKIDLVTRERALESYKEIKAFVKGSIAENAPIIPVSAYHNTNIDILFEAIEKYIPTPEYNEGSDPIMYIARSFDVNKPGTPIDQIKGGIIGGSLTQGSLKIGDEIEIVPGIQNTRGNKTVWTNVTTEVVSLMAGKYSYDMIKPGGLAAVGTKLDPFLTKGDAFTGRIAGYIGKVPPISFSMRLEAHLLKRVVGSDQELNVEPIRAKETLMFTVATANTVGVVSNVKGTDIEVSLKYPVAAFNGMRVAIGRRVLNRWRLIGYGVIE

SEQ ID NO: 13610 - protein, 434 aa, Thermoplasma volcanium
IKTLNPYTGEVIASYNEEDKEQVIRKIKDLREYQAKWRKNIGERIEVIKAAKKNFETQIDDLSKLMSLEMGKPISQSISEVKKSIWLMDYVIENAEKFLAIEDVKTEARKSYVRFDPIGVILIIMPWNFPVWQVMRAAIPALAAGNTVILKHASIVSGTSLKIQDLLNTDAFRSVITSGETASSVIPEVDGVSFTGSTSTGSRIAEIAGKNIKKFVMELGGSDPFIVLDDYNLEDTVKNAVFGRLQNNGQSCIASKRFIVNRKIGEKFVEMLKDEFSRVKIGDPLNSDTFLGPLSSQDQKETVLRQVSDLKGKSELVIGGDYQGNIVMPTIIKTDVRYNEEIFGPVAVVKYFDKPEEAVEISNETPFGLGASIWGNPDEAEKLIPEIQAGMVFVNKIVASDPRLPFGGVKKSGVGRELSRYGMLEFTNIKTVWI

SEQ ID NO: 13611 - protein, 417 aa, Thermoplasma volcanium
AFVINVPKIKFGMNTTKEVGKDAVGLKIKNALVVVGPRLKDSKQFHDVLSSLSESGINYAVFDEVKTEPDDENLTKGYEAIKGKKIDGLISFGGGSTIDTAKILNLLYKYPRDINDYINKPIGKGMIPEGDLLPHIAIPTTAGTGSETTNVTIFDVERLHVKTGISNPFIRPSLAIIDPVNTLTMPPKVTASTGLDVLNHAIESYTSHPYTARPPVASPDERPVYSGSTPIGDLFGLQAIEWVHKYLRRAFADPLDLEARYYMTMGASIAGMGFGHVGVHIPHAMAYPIAGMIKKWHPDDYDFGYPISPHGISTAIPAAYVFRYLSKFVPERFADVLTALGYDTEGMSAEDIGDTLYGYYIDLLHALKIPDNLSDLDFTSSDIEKLVDGTMAQQRLIGLSPKKIDKSDIEFLFKEAM

SEQ ID NO: 13612 - protein, 332 aa, Thermoplasma volcanium
MNAFLKALHGLDHDYIPVWFMRQAGRYLNVYKDYRKKLGLEGMMTDADVIVKITHSPVDMIGVDAAIIFADITTPLPGLGFKVRFEDNVGPIVLNNLSDNGFSGINEFDEASFNHPVLKAISMYREMYREPLIGFCGSPVTLLSYLIAGSFDKDLAKTKRLMLTDPSKYKEISTLLTDASVKYAKLQIKKGVDAFQLFDSWAGYLSPRQYKEFAVPYINDILSEIAGKVPTIYFSTMTSSFVFQSGIISDFISVDWRVEMDKVVKESGDYGLQGNLDPFIVNYDYAFAESEHIINAVKGNNRYIFNTGHGILPDTDPKRLIEIVKYVHSVNL

SEQ ID NO: 13613 - protein, 292 aa, Thermoplasma volcanium
KTAVLLLSYGSPEKMSDIDEYLSKIFGGKPVPKGVAEENYRKYEMFGGLSPSNRIIQSIRDRLQKRFDQSGDVDVFTAFKHWYPSIGEVVPDLKGYDNIVSIPLFSFFSENVKASYYKPLAEALEKNDIRTKMEFVNGISNYDLFIPMWIHLIEEKEKGDSFYLFDAHSLPHPENEEDYLFWLRYSTYKITQIMGLRSSDFGFQGGHEGWLGPSIYNVYRKAKEKKIIAVPISFLYDHLEILYDLDYEFRKKIEEDGYSYERVPMPNDSAIFITLLERIVSSSITHLSGELI

SEQ ID NO: 13614 - protein, 783 aa, Thermoplasma volcanium
MDFSIEEYDLTFDFDLSEFTYRGKEKIKLSGEANELVLDSVRLSIDSVKLNGSAVDFDVNDKALRIESRIKSGDVVDIDFHAKVSDTLMGLYLSKTREGTMITTQFESTGARMAFPCIDHPAYKAVFSITLVIDKDYDAISNMPVKKVETSDRKIVEFEKTPRMSTYLLYIGVGKFKYASERYKDREIILASLKDIKSKYPIDIAKRSIEFYEGYFGIPYALPKMHLISVPEFGAGAMENWGAITFREIALMATEDSGSLMKQNAAITIAHEIAHQWFGDLVTMKWWNDLWLNESFATFMSYKTVDSFSKQWDVFSDFIKSETGGALRSDSLKNTHPIEVDVKDPDEISQIFDEISYGKGASILRMIEDYVGAEDFRKGISKYLKEHAYGNAEGSDLWNAIETESGKPVNRIMEAWITKAGYPVLKVNKDGNRIRLTQEQFYLDGTSGNTEWPIPLTIITKKGKVSMLMEDEVYIDEMLKLNANNSGFYRVMYDNDTFNTVISSLDKFSNLDKWGLLNDMYAFLVSGRLSVNEYVERIKNFLNDEDHLVVEEIASQLTSLYLIKPSSQVVYQLAKDYLRNQVQRLGTKKKGEDDKISKLRGIVYQDLVTVDEDFAKELSPQFASLSEDPDLALAKAVAKARTDGLNELIDAANKYTDDEIRVRVIAAMGWCSKDQLSTIFSLIDNGTIKKQDMLYVFSFVVTNPSGRDFFFQNIDKIVSLMEHAFEGTGYTSRILEGSIPYIGLEKYEEIKAKASQIRSPSYNVGIDKGLETLEIIRKLYNKL

SEQ ID NO: 13615 - protein, 750 aa, Thermoplasma volcanium
LLEEIDGFLKTFGDGMLKDRISYSLTRDRYDSIYYKKLNMKKIGRFLSAEKSNKYVYFHFENYDLKVEARGDGVFKFSWTDGPKLPVENIEFDDLQLHDNTVSVGNYSISLDENGLYLKDQDGKLIYQGYIPDFNEVLSQSLRIFGDDLFSGLGEKAGPINLRGHVYRLWNHDAKGSYGPDSDPLYLNIPVLLHLHDDVSYLIFFENAGDATVDIGFSREDKVTFYFKSKPMVYYVITGDIKSIYSKFSEITGKPYRPPYWAFGFQQSRYSYMSSAEVRSIVDRFNELGIPLSAIYLDIDYMDEFKVFTFNSDRFWDVKDLTKYLGERGVRLITIMEPNVKMEPGYTIYDEAVKNGYFIKYPDGNIFYAPVWPLMAAFPDFSRNDVREWWGKKYDFMKKNGVSGFWHDMNEPAIFVAWGDNSMALSAAQSNGSHSEVHNLFGYYMDKAAYDHLSKTERPFILSRSGWAGISRYAWIWTGDTETSWKEMKQNLLTILHMSASGISLTGCDIGGFVGSPDAELFIRWLQSAIFYPLFRVHSNKKSKRREPWEFGEKYLGIIRDIIKLRHSFLPQIYSEAISSSITGIPMIRPVYWYSSNPDMLLVDDEYLFGDSILVAPIFSEHSTSRIVKLPPGLWYNLYSDEKVFGEIKVEAPLNMIPIYIRSGSIIARDEGKLILHVFHSEEGESAKIYIDAGGEDSELDISVSKDGKINIHRGSSIKAVTIKFHGVYVKGITINGNTKYIEDNLFEIE

SEQ ID NO: 13616 - protein, 370 aa, Thermoplasma volcanium
FEEFNLRNELIESIRGTGYSEPTEVQSMAIPIALAGSDLVVRSKTGSGKTAAYLIPIINNTAKEKGIRALILLPTRELAVQVAKVSEALGKRSGIRTVVVYGGVSINKQIELILRGANIIVGTPGRTLDLIDRGILNFDKVSYFVLDEADEMLDMGFIEDIKKIINVLPVERQSFLFSATIPSEIIELAKGFMHNEEILFLSKDEVTVNGIDHNYAVSRRERKLRTLFSYIDKYKPEKSIIFSRTKAGANMIYEALINHGQDAVIMHGDLTQAQREKALYRFKNFGRFLVATNVAARGLDIGGISDIINYDVPDDPRVYVHRVGRTARMGAAGRAFTIVEDREIGSIDMIRHEARVKMKEIHLETTRKNF

SEQ ID NO: 13617 - protein, 357 aa, Thermoplasma volcanium
AKLINIVIDETGIRPEEINDVITGCALQQDENWTYGGRHPILLANLPDNVPGMALDRACSSSLNAITIGAMEIMTGNADIVMAGGYEHMTHVPMSNSPFLKPNVKLLVRPEYMHYDMNTGYSMGLTAEKLASLHHIGREEMDQYALRSHQLASKALDDGYFKGEIVPMEVEIGGETKIIDSDQSIRKNTSLEEMQKLRPAFKDDGVITAGNSSPLNAGASLTLLMSEKKVKEYGLKPLSRIVSFGWAGVDPSIMGEGPVPATQKALAKAGMKVEDIDYWEINEAFAVVVLNAMKELGIEENKVNIHGGGISIGHPLGATGARIAGTLSRILNEKQAEYGVATLCVGGGQGYSVIFER

SEQ ID NO: 13618 - protein, 371 aa, Thermoplasma volcanium
INMNFELDENLLNFRKKIEEFAKREFTEDLASKYDEQEHYPEDVFTKMMSEGIFDYTNPWNILMATEALCKYDAGMGISMLVPFFGNEVIALFGNDEQKKKYLSRVFAGKAKMGLAVTEPGGGSDVANIKTTAVKEGDHYVLNGSKMFITNGDIADFFVLLARTSQEKKKHHGMSVFIVERDFEGFRSNKIKGKLGVRATDTAELTLENVKVPEENLVGEPGRGFYYIMTFFDISRAYVAAQALGIAEGILERTLSILQKDGPLTSQPERVQFTIADMATRIEATKLLTYEAASYIFNFNPNPAVTSMAKAYAAETAVYVSRKAMEVTGIDGLTSSIERSFRDAKIMEIWEGTSEIEKLVIARMLKTGDVQ

SEQ ID NO: 13619 - protein, 325 aa, Thermoplasma volcanium
VREFANKEIENISKDIEIKGIPDTLVLKLGAQGFLAATAPQEKGGSGLDELGYIIVLEELSRVSPSVAMKVFLTNFYLQLNPDDDVNYIASGKKRVSVAFPDYYARGKSGKVEVSAGKINATKENVINANVEAIALTDGKDVYAVSQGISTKEKRHMGIRGLDLSDLFVSGASYKRLGSEEMMRSTFQKLDREIAAIFLGLSDGTISKAIEYSKVRTAFDHPLKDYSPIFDDLVSLKMEIDVLRFYLYGSGDEYSRALIKIKAKDLSLRATRVSLQTHGGYGYIHDFGIEKYYRDAMALSVYFGQDKYENMVLSDHIFGEAGGII

SEQ ID NO: 13620 - protein, 525 aa, Thermoplasma volcanium
DYQLTIDKMLESGVSSNPNQIINYSGKKTFTYKEFRERVYRLAKALISIGVKKGDTVAVIDWDTYVYLEAYFAVPMIGAVLHTVNVRYPQDLIYYTMDHAEDKYVIVRDEFVPILSKNKEAFYFIKGWIIYSEYGNVPDELSPKYIYDELMSKNYDIELPEISENDLATTFYTSGTTGIPKGVQFTHRQIVLHAISSGLALSDRPISLTADDVIMPLVPMFHVHAWGVPYMTIMSGRQYVLPGRYDFDHIIDLIAQENITVIAMVPSILYMIVTNPNVGKIAGRKIRAIIGGGALPEGLQKAAEKLGIMAISGYGLSETAPILTLATYNSDVKKLPLEEQKKYHLKTGIPIPLVQLRVIDDKWNDVPRDEKTIGEIVVRAPWLTSVYVKNKEGTEALWKGGWMHTGDLAVMDKFGYIKIVDREKDAVKSGGEFIPSLILEDAISACPGVVENAVVGKPHEKWGERPVAFYTGTAKPEEIRKCLEDIVRQGRIAKFWIPDDFINVKEFVKTSTGKIDKKVLREMLK

SEQ ID NO: 13621 - protein, 659 aa, Thermoplasma volcanium
LEISKVTVIGSGIMGHGIAETIALAGYDVNLEDISDDVLAKAKAEIDASLDRLVKSGKLSDKTKVLGRIHYFTSIPESVKDADLVIEAVPEILDIKRQVFAQLDQSTKEDAILATNTSNIRLTEIAEGVKKKGKVVGMHFFNPPVVLKLVEVIRSDYTEDEVFEAVYDFSKKIGKIPIKVYKDTPGFVVNRINAPESLYFCLVLDKGIAKPEEVDRFARSQGLPMGPYELMDYVGIDTVYHSLEYYAKELSPDYAKCQVYNKLYNEKKLGLKTGEGFYKWVNGKAQIPDAQPTKNVELMDIFALEINEAVKIIEEKIVSPEDIEIGVKLGMNRPFGPITVAKGLTNAEIKSKLESLYNKFGVSVFQPAKSISEGRLKSLISEKFEPPVRGQQTEQEKPSIVESSDPVILERNGKIAVLRLNNTKNNLINSAVLDALEQQINDLWHDREINVVVITGNGSVFSAGAQLDSFFSSTFDFLEFSRKGERIFKLLSEMPKITIAEMKGYVLGGGLELSLACDIRVATEDVQIGFPEVTLGLIPGWGGSQKLSKLIGESRASYYVLTAERFDGKRAYEIGLVSRLYKPQEIDAETLKFAKDISERVAPISAALAKRLLLRSANTSLDDGLEMESMAMGTLYGTEDLKEGISAFLSKRKPNYQGK

SEQ ID NO: 13622 - protein, 299 aa, Thermoplasma volcanium
VEKVDESEFQRIFKKAYDAGINFFDTANIYHGRVEKNEDHIDHIGNSERILGKAIKGYERESLVIATKVRGPVSKFINGEGLSRKHIMWQIKESLQRLGLEYVDLYQIHWSDSLTPHEETARVLSHIVDLDMARYIGESNHSAEDIVDFMNISEKLNLHHFVTMQEPYNILQRGIEKDKIPVAKKYGMGILAYVPLAQGVLTGKYVSGPEKGSRSSYYPEIIDFHQKNQKKIDALINFAKEKDITGGQLAIAWLIKKSQIEGIPIIPLLGITKEKYLEENLKALEVNLTDSDMREIDRM

SEQ ID NO: 13623 - protein, 358 aa, Thermoplasma volcanium
VDTQRFVITMNGDNISFIVGDNAINHLSEEAGKYDSIVIMISKTVEEMYANHIPDVGSFGNSVVKISLNDGESLKSLRNYQKIVKVLLERKVDRRSLLVYIGGGTVGDLAGFVASTYKRGVMMIAVPTTLLAQVDSSIGGKNGLDFSDVKNVIGTFYNPYMVIDDTVFLKNNSFIIREGMSEVIKYAIISGGDMYDTLNRCSIDNFDACATNIIKLSVKIKSEIVNRDFYDRTGIRSVLNLGHTIAHGIEGATKGSISHGKAVATGMLVEAHIGEKYGNTNHEVIEAIRDLMKRYGIEELNLKEIGPGNILRYISNDKKIMEGYINMPVPSEIGKVITMKATERMISDGINTFIKEND

SEQ ID NO: 13624 - protein, 240 aa, Thermoplasma volcanium
VFGLIGHPVSHSIGQIVYNRYFQKKGLNAIYLSIDIFPETLKYFMSYASKMDGFNVTIPHKISIMDYLDQIDWEARSIGSVNLVKTEDGLLKGFNTDYYGIEYMFKKGGVDVSGKSIVVAGSGGIARTVIHYLIKNNAKSVTVKARDVKLAKNKLNAYDVDIKEYANNDYDIYINCTPLGTEAVGDPFPEVQFGKGKIAVDVVYNPPVTPFLKRAGISGSKTLSGLDLYIGQAIKTLDIL

SEQ ID NO: 13625 - protein, 408 aa, Thermoplasma volcanium
MIVKVSNLGGSGIAEMPSSKSFTQRYVLASAFLNKSVVLNGITITNDDDVAMRIAESVGSTITINNRSIKISSNFKCPEEIYVGESGTSYRLSIGLLAASGCVTRIKGEDSLAKRPIEPLLMALGENGVKFERNEAGFYNVDGRNSQKKHVEIEGSSSQFVSSLMLYYAKKGGGEFTARNIKSIGYVYITKRVLYDLGYFANIERTITINPTGVWKTAIDVEPDYSSMAFFMVLGLLSDSVDVRFRIKRISRIQPDSVILDLFKNNILINGEEIRVISGINEPVSVDADMNPDLCPPLSVIGIFSKYGVQIRNYERLKTKESNRYEGIIDLAERFGANVEDNGQDLFIKPGSVRFPDVISYKDHRMIMAASIASLIGGFPTVIENAEKTAKSFPGFFAELSKFANVEE

SEQ ID NO: 13626 - protein, 450 aa, Thermoplasma volcanium
MRTERDVIGEIQLEDTVFYGINTARAKENFRITGLTSDSDHIVSIAQIKKAAAMANAEAGALDKEKAEFIEKACDEIISGRYHDQFVIDVYQAGAGTSFNMNANEVIANVALTLMGKNKGDYSVIHPNDHVNMSQSTNDVYPTMMRLTVTKKVKKLKEAISDLIESLEKKSKELRGIPKPGRTHLQDAAPVTVGLEFSAYAYAIKKDRDEITDALDYIMELNIGGTAVGTGINTSKNYQENVVKHIAEITRENFRKSSNLMGIMQFMTDFSRVMNAVTNLALDIEKIANDIRLLYSGPGTGIHEIIIPAVQQGSSIMPGKINPSIAEAMNMICHSVIGAQQAVNMSVQAGQLELNVMMPNIDYELTRSIDIMRNGLIMFKEKLIDGIKANVNTCREHLANSFGSAALLNPYLGYDNVAKIVREAVETGKSIKSLVLATGKITEEQYMKIM

SEQ ID NO: 13627 - protein, 437 aa, Thermoplasma volcanium
KVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQI

SEQ ID NO: 13628 - protein, 365 aa, Thermoplasma volcanium
MLCLSEEQSIIKGSIAEFTKRRIEPIEKRIEDDDYFPMDILREIGKNGFFSVMLPGIGVQDTYSFSLIAEEISKVSPEVAWLYVTHVAASYALDKLGTEEQKDSYLRKMADGEIIGTIAITESSSGATASAIASSARKYEENWILEGSKTFITMGGDADLYAVLAKTHEDPAAFTTFIVLKSDVGLELGTHLIGSAMKGIGWGEISFNNLILEKHRILGKENEGIKIIPTIARIFSIGAASISLGIMERALELVSSHVKERKIACKSLLSNQTVQDKLFHLYADTEAARSLVYRASINDDIRLAYSAKLFSTERSIAVTESAVSLFGATGYEESLAIPKLLNKAIAVPLHFINNAILTGLFITAI

SEQ ID NO: 13629 - protein, 244 aa, Thermoplasma volcanium
LEGKTALITGASKGLGRAIAEEFAKEGARVAINYAHDEKSALEVKKITGGEIFKADVSNRDQVKEMARQIHEKLGKIDILVNNSGIWYLMPFENYDEEKVRRMLDVNLMGAIYTTLEFLPDLKEKKGTIINIGSNAGIGTAAKNTTFYSLTKAAIIMLTKRLAFDLSEYSIRVNAIAPGWIETDLTIGGKTDEEIRKLEEDFKSRTTLKMFGKPEYIGKAALFLASSDSVYMNGQVIVIDGGRI

SEQ ID NO: 13630 - protein, 282 aa, Thermoplasma volcanium
VVPFYEKYVIIEGNKDAGERLYSKKYRDKTVVDVGDIKIGEGLVFAAGPCSVEDEDQIIEIARSVKKAGANMLRGGAFKPRTSPYSFQGLGEEGLELLKKAKEDTGLPIVTEIMNPEYYKFFDDIDMLQVGSRNAQNFDLLRFLGRQKKPVLLKNGMGNTLKEWLEASEYIMSGGNGNVVLCYRGVRGIEEATRFSMNVGTVIAARSMTHLPMCVDPSHASGKREYVEAMTLAAVAAGADMIEIEVHNNPDCALSDSEQQVTPEVFGRIVKKAKQIKNIVSN

SEQ ID NO: 13631 - protein, 494 aa, Thermoplasma volcanium
MIEIDGDNLTLEDVYSVSVLHEPVELSTKARNKVAEIHRKFLDLISSGQTIYGVNTGFGGLLNIKISREEEIELQRNLIRSHSAGVGKYLPTDVVRSIMVIRANTLAKGYSAVSTELIDALLAMINKDVVPAVPEFGSVGASGDLAPLAHIGLAMMGEGQAFLNGELMRSDIALSKVGLKPYEFKEKEGVALINGTSMMAGIMALVTSRAYRTIENAVRSSLLSFEALRGTSKAFSDWIVSARPHLGQIAIAEKMRKYLAGSKNVEKSDKEKVQDAYTLRCIPQVYGAVLDTLEYVSSVLVTEINSATDNPLFNGKEVVSGGNFHGEPIALAADFLSIALTDMGNMIERRIARLVDTNLSGLPPFLVKNSGLNSGYMIPQYTAAALCNRNKVLSYPSSADSIPTSANQEDHVSMGSTSTLKLLEIEENLEYIVAIEFLLGAQALEFSQDPISPVTKAIYTKIREYVKPLDKDRPSYLDIEKIREIMNKNELINA

SEQ ID NO: 13632 - protein, 304 aa, Thermoplasma volcanium
NVAEDIIEVEHFKQTYDGKKFVVDDVSFHVKRGEIYGLLGKNGAGKTTTIRTLTTIMPVHYGKVKVLGLDVSTHPEKIRQRIGVVLQSESFDFTTVEKNLKIYGMLWDVPGEVLKARIEEVMEVFDLSRLRKIRALELSGGQKKRLQVAREFLHDMDLLFLDEPTVGLDPIMRRTVLNYIKEKAKAGLTVLYTTQIMEEADYLCDRIAIMNNGKIVAEGTSDFLKSKYGDLKTIKIHISGNVNREDLKMMFPEFVQIEGDEVRLISKNVEDVLPDMILYFKRSGIHIERINVEETSLDDVFLRV

SEQ ID NO: 13633 - protein, 482 aa, Thermoplasma volcanium
MYRDKFSNITEGYTFDDVLILPMKTGVEPKNVDVSSRLSRRINVKVPIVSSPMDTVTEEAMAIAMARYGAFGIIHRNQPREKEVEMVRRVKREETIIIRDVYTVSPETPIEVARTIMKTKNIAGLPVLKEEKLVGILTKRDLEFAKQGSTVSDVMVKNVITAPENVDLEDAINILHKNRIEKLPLVDKDNHLVGLITAKDIITRQRFPDATRDDEGQLMVGAAVGPFDLDRAIELERAGADLIVVDTAHADNENVLSSIKRMRKEISVDIVAGNIATAGAAEDLISCEVDGLRVGIGPGSICTTRIVAGVGVPQLTAISEVAEVAKEYGIPVIADGGIRYSGDIVKAIAAGADSVMLGSMLAGTEESPGQEMIINGRKYKAYRGMGSIGALSTGISDRYSKLGNGFIAEGVEGAVPYRGRVDEVLFQLVGGLRTGMGYVGAENIGKLKERARFVRISSNGLRESHPHDIRLISEPPNYQISN

SEQ ID NO: 13634 - protein, 450 aa, Thermoplasma volcanium
METYDVITLGAGGAAYPAAFRLKKSGYSVLMIDKKGIMSGNCLAEGCVPSKAIIETVHNYSKLKKFGKYSIAYEDIVKHKDDVQNIRYKQHDEELHEAGLKILKGTAKLIDENTVEVETDTGKERYRAESIIIGTGSDTYVPKIPGAELAWTSRELYALNPKVRKLPKSIAIIGGGYIGLETASFMSLLGTDVTVIELLDRVLSTMDSGMVSKLVPLLPKMNLILSSPVKEIRRGGDMFEVSYDHEGKTEKIRVEAVLMAVGRMPMFPEGLDDLGIKYDKHGIKVNMAMQTNIKHIYATGDVNGLTPLFHAAKRQSLVAANNIMANHVPVDYFDPLSVPFTVYTVPQVAYVGILPDQAKKLGISYIETDYQMEKDAMAQVNSEMEGEIRLFFDSRMKIIGGYVIGNDAGNLINEIALGISKGLSARDFAEMAHQHPMSFEGLDSAARKLY

SEQ ID NO: 13635 - protein, 184 aa, Thermoplasma volcanium
MSEREKITIENIVASTSLAEHLDLSRIALALDGSEYEPEQFPGLIYRLQDPKTAVLIFRSGKVNCTGAKNIEDVKRTIKIIIDKLKAANIEVYDDPDIIVQNIVAVYDLESELNLTDIAMSLGLENVEYEPEQFPGLVYRVEEPRVVLLLFGSGKVVCTGAKEESEIEQAVIKVKKELQKVGLI

SEQ ID NO: 13636 - protein, 241 aa, Thermoplasma volcanium
LKDKVAVVTGSGRGIGRAISVALAKNRCKVIINVKKRLEEGQETLRMVEEYSQGILVKADVSTREGCASIINEARKNFDSIDILVNNAGLGIAMPFMNSDDSLIQKLIDTNIMSVIRCSQEIGRVMEDGGTIINVSSVAGLKPMPLLPIYGMTKAAIINLTQYMAYDFAQRRIRVNAVAPSVVSTKMGNSLVDISGLKEDKFAKEYTLTGKIIDPDEVADAVIFLAKSDSITGQTLVIDSG

SEQ ID NO: 13637 - protein, 321 aa, Thermoplasma volcanium
GITMIEIWTEKYRPKSLSEIYGEDENIQKLKSFVEKKELPHLLFAGSVGTGKTSTAIALAIELFGESWKENFIEMNASNENGIDVIRNKIKDIARIRPSNPLGFKILFLDEADQLTAEAQAALRRTMEMYSETTRFVFACNYSSKIIPPIQSRTVVMRFRPVQDEFIKKKLNEIAKNEGFTIDDESMEAMVEVSGGDMRKAINVLQAVYTSGEISPKKIYEIIGYASPESVNKLISRAINGLFDEARQIVDKMMIEDGLSGIDIVKSVHSIVRASVVPPKQKIEIIKALADAEFRIVEGSNDRIQLDALIARIADIGSKIN

SEQ ID NO: 13638 - protein, 374 aa, Thermoplasma volcanium
VKDVIVIGAGPSGSYAAYRLSKMGLDVLLLEEHKEVGKPVECTGLVSKRVLDFVKTRSIAGKVYGANIYFPNGKSIHVEKNDETIVLYRDSFDKDVAAMAIGAGADIRINARAISVKENNDSVTVKYRDSGQLKEDNAKVVIGADGINSVVRRDLYRIRQEKVVSTLQYDMAGKIEDERSVNVYLGSKYTHGFFGWAVPGGEIIRVGTGSYRASAYPYMKALSKRFGTNRVLGITGAGIPIKIAKSLFTKRSVLIGDAGGIVKPLSGGGIYTGIFSANLASERVANAIENEDYSQLRHYDKDIRGSIGVELKKDGFIQSIYSKIGDRSFDRIYGLISSEKIIDTINRSGDIDYPSKVIFKVLIRNPALLYSMWK

SEQ ID NO: 13639 - protein, 238 aa, Pseudomonas fluorescens
FGEACARRFAEAGWKLVLTGRREERLNALCAELSKQTEVHGLVLDVRDRKAMEEAIANLPPSFAKLRGLINNAGLALGVDPAPKCDLDDWDTMVDTNVKGLMYSTRLLLPRLIAHGRGAGIINLGSIAGNYPYPGSHVYGATKAFVKQFSLNLRCDLQGTGVRVSNIEPGLCESEFSLVRFAGDQARYDATYAGAEPIQPQDIAETIFWVLNAPAHININSLELMPVSQTWAGFAIER

SEQ ID NO: 13640 - protein, 382 aa, Pseudomonas fluorescens
MTPDKKVKILATLGPAVDGIEDIRELVEAGVNIFRLNFSHGDHADHAKRYQWIREVERQLNYPLGILMDLQGPKLRVGKFADGKVQLHRGQAFRLDLDATPGDERRVNLPHPEIIAALEAGMDLLLDDGKLRLRVVTKYSDAIDTTVLNGGELSDRKGVNVPQAVLDLSPLTTKDRRDLSFGLELGVDWVALSFVQRPQDILEARELIGDKAFLMAKIEKPSAVEQLREIAELSDAIMVARGDLGVEVPAESVPQIQKNIITTCRHLGKPVVVATQMLESMRFSPAPTRAEVTDVANAVAEGADAVMLSAETASGEYPLEAVQMMSKIIRQVENGPDYQTQLDVSRPKAEATVSDAISCAIRRISNVLPVAVLVNYSESGAS

SEQ ID NO: 13641 - protein, 349 aa, Pseudomonas fluorescens
PFNFPAMVPLWMYPLAIVCGNCFILKPSERDPSSTLLIAQLLLEAGLPKGVLSVVHGDKTAVDALIEAPEVKALSFVGSTPIAEYIYAEGTKRGKRVQALGGAKNHAVLMPDADLDNAVSALMGAAYGSCGERCMAISVAVCVGDQVADALVAKLVPQIKALKIGAGTSCGLDMGPLVTGQARDKVSGYVEDGVAAGATLVVDGRGLSVAGHEEGFFLGGCLFDNVTPEMRIYKEEIFGPVLCVVRVNSLEEAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFP

SEQ ID NO: 13642 - protein, 223 aa, Pseudomonas fluorescens
HALIIGASRGLGLGLVKTLLADGWQVTATVRNPSNAEALEALGNVQIEKLDMDDQQAVIALSQKLKGETFDLLFVNAGVKGPEVQTPGGATLAEVGQLFFTNAVAPINLAQRFVGQIRDGSGVLAFMSSVLGSVTMPDAPELALYKASKAALNSMTNSFVTQLGEQKLTVLSLHPGWVKTDMGGEGADIDVETSTRGLVDQVDAFAGKGGHHFVNYKGETIPW

SEQ ID NO: 13643 - protein, 833 aa, Pseudomonas fluorescens
MTRSPFRRLVFGTLRRLLYLWVRSETINQSSFTLNLDRSRPVFYVLQNPSLTDLAVVDTECTKAGLPRPVLPVSVGSLIEPAAFFYLTPDPDWLGRQDKRGAPPTLTRLVSALSQNAAEDAQIIPVSVFWGQSPDSENSPWKLLFADSWAVTGRLRRLLSIMILGRKTRVQFSAPIHLRELIEHNKGHERTVRMAQRILRVHFRNLKAAVIGPDISHRRNLVKGLLNQPLVKQAILDEAERENISPEKAKAQALRYGNEIASDYTYTAIRFLEVVLSWFWNKIYDGIKVNHIEGVQKVAQGHEVIYVPCHRSHIDYLLLSYLLFRNGLTPPHIAAGINLNMPVIGSLLRRGGAFFMRRTFKGNPLYTSVFNEYLHTLFTKGFPVEYFVEGGRSRTGRMLQPKTGMLAITLRSFLRSSRMPIVFVPVYIGYERVLEGRTYLGELRGASKKKESIFDIFKVIGALKQRFGQVAVNFGEPIKLAEFLDSEQPGWRQQELGPQFKPAWLNETTNRLGEKVAQHLNEAAAINPVNLVALALLSTTRLALDDRAMARVLDLYLALLRKVPYSPHTTLPEGDGRALIEHVKDMDLLSEQNDALGKILYLDEQNAVLMTYYRNNVLHIFALPALLASFFQSTSRMSREQILRYTRALYPYLQSELFIRWTLDELDAVIDQWLEAFVEQGLLRFEKDVYLRPAPSSRHFVLLTLLSKSIAQTLQRFYMTVSLLLNSGQNSISAEELEDLCTVMAQRLSILHGLNAPEFFDKSLFRHFIQTLLDLDVLRRDEAGKLSYHELLGELAEGAAKRVLPAEIRLSIRQVALHRSEDAADQVAPPVQN

SEQ ID NO: 13644 - protein, 442 aa, Pseudomonas fluorescens
NAPSPLASQLKLDAHWMPYTANRNFQRDPRLIVGAEGSWLIDDKGRKVYDSLSGLWTCGAGHTRKEIQEAVAKQLGTLDYSPGFQYGHPLSFQLAEKITDLTPGNLNHVFFTDSGSECADTAVKMVRAYWRLKGQSTKTKMIGRARGYHGVNIAGTSLGGVNGNRKLFGQAMMDVDHLPHTLLASNAFSRGMPEQGGIALADELLKLIELHDASNIAAVFVEPMAGSAGVLVPPQGYLKRLREICDQHNILLVFDEVITGFGRTGTMFGATTFGVTPDLMCIAKQVTNGAIPMGAVIASSEIYQTFMNQPTPEYAVEFPHGYTYSAHPVACAAGLAALDLLQKENLVQSVAEVAPHFENALHGLKGAKNVIDIRNFGLAGAIQIAGRDGDAIVRPFEAGMALWKAGFYVRFGGDTLQFGPTFNSKPQDLDRLFDAVGEVLNK

SEQ ID NO: 13645 - protein, 255 aa, Pseudomonas fluorescens
MAIVKCKPTSPGRRFVVKVVNQELHKGAPHAPLLEKKSKSGGRNNNGRITTRHIGGGHKQHYRLVDFRRNDKDGIAATVERIEYDPNRTAHIALLLYADGERRYIIAPKGVSAGDQLIAGALAPIKPGNALQLRNIPVGSTVHGIELKPGKGAQIARSAGASAQLIAREGVYVTLRLRSGEMRKVLAECRATLGEVSNSEHSLRSLGKAGAKRWRGVRPTVRGVAMNPVDHPHGGGEGRTLVVASGSPGAPDRGK

SEQ ID NO: 13646 - protein, 465 aa, Pseudomonas fluorescens
MNILYDEQVDGVLPDVDKTALLQALLHQWPDLEVLHQREELKPYECDGLSAYRTTPLLVVLPRHIDEVQGVLRICHERRVPVVARGAGTGLSGGALPLEKGVLLVMARFNNILHIDPAARTARVQPGVRNLAISQAAAPFGLYYAPDPSSQIACSIGGNVAENAGGVHCLKYGLTVHNLLKVEILSVDGERLTLGSDALDSPGFDLLALFTGSEGLLGVITEVTVKLLPKPQTAKVLLAAFDSVEKAGRAVADIIAAGIIPGGLEMMDNLAIRAAEDFIHAGYPVDAEAILLCELDGVEADVHDDCTRVRQVLEHAGATELRQARDEAERARFWAGRKNAFPAVGRLSPDYYCMDGTIPRRELPGVLHAIAQLSAVHGLRVANVFHAGDGNMHPLILFDANQPGELERAEALGGKILELCVKVGGSITGEHGVGREKINQMCAQFNRDELTLFHAVKAAFDPGGL

SEQ ID NO: 13647 - protein, 859 aa, Pseudomonas fluorescens
PLDDRIAYPMTDESPSIDKLLKNLDHAMLADRHRLRRQLLELRKKPDEAKLAQWVARMQASCDQVLARKASLPVIRYDDSLPIAAKRDEIKKALEKHQVLIIAGETGSGKTTQLPKICLEIGRGQHGLIGHTQPRRIAARSVASRVAEELGTPLGALVGYQVRFEDQSDSNTLIKLMTDGILLAETQNDRYLERYDTIIVDEAHERSLNIDFLLGYLKTLLPRRPDLKVIITSATIDLERFSKHFDDAPIVEVSGRTFPVETWYRPLTLEQDEEGNRVEDDLTVDQAILATLDEIAAYERSERRSPGDVLVFLPGEREIRDAADMLRKAQLKHTEILPLYARLSPAEQQRIFQSHPGRRVVLATNVAETSLTVPGIRYVIDSGTARISRYSYRAKVQRLPIEAISQASANQRKGRCGRVEPGICVRLYSEEDFLGRPEFTDPEILRTNLAAVILQMLHLRLGEITDFPFIEPPDGKAISDGFNLLQELSAVDRNSQLTPLGRQLARLPVDPRMGRMLLEAAKLGSLQEVLIVASAMSIQDPRERPPERQQAADQAHAQWKDADSDFAALVNLWRGFEEQRQALTASPLRNWCRKNFLNYLRLREWRDSHRQLSLICRDLQLSLNKEPADYPKLHKAVMVGLLSQIGQKTEDGDYLGARQRRFWIHPSSGIGKKRPQWVMTAELVETTKLYARMVAKIDADWIEPLAGHLIKKNHFEPHWEKKRGQVVAFEQITLFGLIVVGRRPVHYGPVDPVVSRELFIREGLVRGEIQSRAKCLTANKQLLEQLDELEAKARRRDILADEETLYAFYDARLPAEIHQTATFDSWYRVNSQKDPQLLIMREEDVLAREASEVTAQHYP

SEQ ID NO: 13648 - protein, 453 aa, Pseudomonas fluorescens
DVVILGGGPGGYNAAIRAGQLGLKAACVEGRATLGGTCLNVGCMPSKALLHASELYEAALGAEFANLGIEVKPTLNLAQMMKQKDESVSGLTKGIEFLFRKNKVDWIKGWGHIDGPGKVSVTGDQGSRIELTAKDIVIATGSEPTPLPGVEIDNKRILDSTGALSLSEVPKHLVVIGAGVIGLELGSVWRRLGAQVTVVEYLDRICPGVDGEAGKTLQRSLSKQGISFKLSSKVTSATSSANGVQLSVEPAAGGSAEILEADYVLVAIGRRPYTQGLGLENVGLSTDKRGMLANKQHRTEAPGVWVIGDVTSGPMLAHKAEDEAMACIEQIVGKAGEVNYDLIPNVIYTRPELASVGKTEEQLKAEGRAYKVGKFPFTANSRAKINHETEGFAKVIADERTDEVLGVHLVGPSVSEMIGEFCVAMEFSASAEDIALTCHPHPTRSEALRQAAM

SEQ ID NO: 13649 - protein, 444 aa, Pseudomonas fluorescens
MTFATLGLIEPLLRSLEKLGYQTPTPVQAQAIPVVLAGRDLMAAAQTGTGKTAGFALPLLQLLAMEGPKVTANSVRALILVPTRELAEQVHEAVRQYAENLPLRTYAVYGGVSINPQMMKLRGGVDLLVATPGRLLDLFRQNALKFNQLQTLVLDEADRMLDLGFSEELANIYRALPKKRQTLLFSATFSDDIRLLAGQMLNDPQSIEVSPRNVAANTVKQWVVTVDKKRKPELFVHLMRKNKWKQVLVFAKTRNGVDALVEKLQGLGVNADGIHGDKPQATRQRALDRFKLSEVQILVATDVAARGLDIEDLPLVVNFDLPIVAEDYIHRIGRTGRAGSTGEAISLVCADEVNMLSAIEMLTRSTLKREIEPDFVPEHRVPDTDASGQVIKKPKKPKKPKASGGGGAKRNLGKWVDSGETQAPEPSIKPVRKVPVFNTGPRKR

SEQ ID NO: 13650 - protein, 1399 aa, Pseudomonas fluorescens
LKDLLNLLKNQGQVEEFDAIRIGLASPEMIRSWSFGEVKKPETINYRTFKPERDGLFCAKIFGPVKDYECLCGKYKRLKHRGVICEKCGVEVALAKVRRERMAHIELASPVAHIWFLKSLPSRIGLLMDMTLRDIERVLYFESYVVIDPGMTTLEKGQLLNDEQYFEALEEFGDDFDARMGAEAVRELLHAIDLEHEIGRLREEIPQTNSETKIKKLSKRLKLMEAFQGSGNLPEWMVLTVLPVLPPDLRPLVPLDGGRFATSDLNDLYRRVINRNNRLKRLLDLSAPDIIVRNEKRMLQEAVDALLDNGRRGRAITGSNKRPLKSLADMIKGKQGRFRQNLLGKRVDYSGRSVITVGPTLRLHQCGLPKKMALELFKPFIFGKLEMRGLATTIKAAKKMVERELPEVWDVLAEVIREHPVLLNRAPTLHRLGIQAFEPVLIEGKAIQLHPLVCAAYNADFDGDQMAVHVPLTLEAQLEARALMMSTNNILSPANGEPIIVPSQDVVLGLYYMTREAINAKGEGRVFADLQEVDRVFRAGEAALHAKIKVRINETVNDRDGNSVNNTRIVDTTVGRALLFQVVPKGLSFDVVNLPMKKKAISKLINQCYRVVGLKETVIFADQLMYTGFAYSTISGVSIGVNDFVIPDEKARIIGAATDEVKEIESQYASGLVTQGEKYNKVIDLWSKANDEVSKAMMANLSKEKVIDRHGDEVEQESFNSMYMMADSGARGSAAQIRQLAGMRGLMAKPDGSIIETPITANFREGLSVLQYFISTHGARKGLADTALKTANSGYLTRRLVDVAQDLVVTEIDCGTEHGLLMTPHIEGGDVVEPLGERVLGRVIARDVFKPGTEDVIVPAGTLVDEKWVEFIELNSIDEVIVRSPISCETRYGICAKCYGRDLARGHQVNIGEAVGVIAAQSIGEPGTQLTMRTFHIGGAASRTSAADSVQVKNGGTVRLHNLKHVERVDGNLVAVSRSGELAIADDFGRERERYKLPYGAVISVKEGDKVDAGAIVAKWDPHTHPIVTEMKGTVTYVGMEEGITIKRQTDELTGMTNIEVLDAKDRPAAGKDIRPAVKMVDDNGKDLLLPGTDVIAQYFLPANALVGVADGAKIAIGDVIARIPQETSKTRDITGGLPRVADLFEARRPKEASILAEVSGTIAFGKETKGKRRLVITPNDGSDPYEELIPKWRHLNVFEGEQVNRGEVISDGPSDPHDILRLLGVSALAKYIVNEIQDVYRLQGVKINDKHIETILRQMLRKVEISESGDSSFIKGDQMELTHVLVENERLNAEDKFVSKFTRVLLGITKASLSTESFISAASFQETTRVLTEAAVTGKRDYLRGLKENVVVGRLIPAGTGLAYHSERKRRRDADKPLRVSASEVEAALTEALNSSGN

SEQ ID NO: 13651 - protein, 358 aa, Pseudomonas fluorescens
MADLPINDLNVASNETLITPDQLKRDIPLSDAALRTVTKGREVIRNILDGTDHRLFVVIGPCSIHDIKAAHEYADRLKVLAAEVSDTLYLVMRVYFEKPRTTVGWKGLINDPYLDDSFKIQDGLHIGRQLLLDLAEKGLPTATEALDPISPQYLQDLISWSAIGARTTESQTHREMASGLSSAVGFKNGTDGGLTVAINALQSVSSPHRFLGINQEGGVSIVTTKGNAYGHVVLRGGNGKPNYDSVSVALCEQALNKAKIKPNIMVDCSHANSNKDPALQPLVMENVANQILEGNQSIIGLMVESHLNWGCQAIPKDLADLQYGVSITDACIDWSATENTLRSMHAKLKDVLPKRQRG

SEQ ID NO: 13652 - protein, 276 aa, Pseudomonas fluorescens
MLLRFTKMHGLGNDFMVLDLVSQHAHIQPKHAKMWGDRHTGIGFDQLLIVEAPSNPDVDFRYRIFNSDGSEVEQCGNGARCFARFVLDKRLTAKRQIRVETKGGIIELDVRNDGQIGVNMGAPRLVPADIPFQAPEQALSYQVDVDGTPVDLAAVSMGNPHAVLRVSDINTAPVHELGPKIEHHPRFPARVNVGFLQVIDRHRAQLRVWERGAGETQACGTGACAAAVAAISQGWMDSPLLIDLPGGRLSIEWAGPGQPVLMTGPAVRVYEGQVRL

SEQ ID NO: 13653 - protein, 415 aa, Pseudomonas fluorescens
MDAFNYRGGELFAEGVALSAIADRFGTPTYVYSRAHIEAQYLAYADALAGMPHLVCFAVKANSNLGVLNVLARIGAGFDIVSRGELERVLAAGGSPDKIVFSGVGKTRDDMRRALEVGVHCFNVESTDELERLQVVAAELGVRAPISLRVNPDVDAGTHPYISTGLKENKFGIAIADAEDVYVRAAHLPNLEVVGVDCHIGSQLTTLPPFLDALDRLLDLVDRLGDCGIHLRHIDLGGGLGVRYRDEEPPLAADYIKAVRERLVGRDLALVFEPGRFIVANAGVLLTQVEYLKHTEHKDFAIVDAAMNDLIRPALYQAWMDVTPVKPRETAARTYDVVGPICETGDFLAKERELALEEGDLLAVHSAGAYGFVMSSNYNTRGRAAEVLVDGDQAFEVRRRETVAELFAGESLLPE

SEQ ID NO: 13654 - protein, 880 aa, Pseudomonas fluorescens
GEMLMTDIDARLREDVHLLGELLGNTIRDQYGEAFLDKIEQIRKGAKADRRGSMDAELSASLNQLSEDELLPVARAFNQFLNLANIAEQYQLIHRREETQAAPFESRVLPELLARLRNEGHSAESLARQLARLEIELVLTAHPTEVARRTLIQKYDAIAAQLAAQDHRDLTTAEREQIHNTLQRLIAEAWHTEEIRRTRPTPVDEAKWGFAVIEHSLWQAIPHHMRKADQALFAATGLRLPLEAAPIRFASWMGGDRDGNPNVTAAVTREVLLLARWMAADLYLRDVDHLAAELSMQQASDALKARAGDSAEPYRAVLKQLRERLRATRNWAHASLTATTPAPADVLHNNRDLLDPLELCFNSLHECGMGVIADGPLLDCLRRAVTFGLFLVRLDVRQDSSRHSAAMTEITDYLGLGKYEEWDEEQRISFLTRELQNRRPLLPAHFKPSADTAEVLATCKEIAAAPGASLGSYVISMAGAASDVLAVQLLLKESGVLRPMRVVPLFETLADLDNAGPVIERLLLLPGYRARLQGPQEVMIGYSDSAKDAGTTAAAWAQYRAQERLVEICREQQVELLLFHGRGGTVGRGGGPAHAAILSQPPGSVAGRFRTTEQGEMIRFKFGLPDIAEQNLNLYLAAVLEATLLPPPPPTPEWRHLMDELAADGVAAYRAVVRENPQFVEYFRQSTPEQELGRLPLGSRPAKRRAGGIESLRAIPWIFGWTQTRLMLPAWLGWETALSKALERGEGELLGQMREQWPFFRTRIDMLEMVLAKADADIALSYDERLVEPDLLPLGAHLRDLLSQACSVVLGLTGQSQLLAHSPDTLEFIRLRNTYLDPLHLLQAELLARSRRQNVEQGSPVEQALLVSVAGIAAGLRNTG

SEQ ID NO: 13655 - protein, 336 aa, Pseudomonas fluorescens
  unsure (1)..(336): unsure at all Xaa locations
MTLRIAINGFGRIGRNVLRALYTQGYRQDLQIVAINDLGDSAINAHLLKYDTVHGTFDAEVAHDNESLTVNGDRISVSAIRNPADLPWAAEKIDVVFECTGLFTDRAKAAAHITAGARKVIISAPAKGADATVVYGVNHDILRQSHQIISNASCTTNCLAPVAQVLHRELGIESGLMTTIHAYTNDQNLTDVYHTDPYRARSATQNMIPSKTGAAEAVGLVLPELAGKLTGMAVRVPVINVSLVDLTVQLKREASADEVNALMKAASQHSKILGFNTLPLVSSDFNHNPLSSIFDANHTKASGKLLKVLAWYDNEWGFSNRMLDNCLALCNAEXSP

SEQ ID NO: 13656 - protein, 454 aa, Pseudomonas fluorescens
ERIAKGARFLDSLLDKEGVIYGVTTGYGDSCVVAVPLHHVEALPRHLYTFHGCGLGKLLDAQATRAVLAARLQSLCHGVSGVRIELLERLHAFLEHDILPLIPEEGSVGASGDLTPLSYVAATLSGEREVMFRGERRQAADVHRELGWTPLVLRPKEALALMNGTAVMTGLACLAYARADYLLQLATRITALNVVALQGNPEHFDERLFAAKPHPGQMQVAAWLRKDLAIDAPTAPLHRLQDRYSLRCAPHVLGVLADSLNWLRSFIETELNSANDNPIIDAEAERVLHGGHFYGGHIAFAMDSLKNLVANVADLLDRQLALLVDERYNHGLPSNLSGASADRAMLNHGFKAVQIGASAWTAEALKNTMPASVFSRSTECHNQDKVSMGTIAARDAIRVLELTEQVAAATLLAANQGVWLRGRDEDARPLPPSLAAMHEQLAQDFPPVIEDRAL

SEQ ID NO: 13657 - protein, 600 aa, Pseudomonas fluorescens
IAYANDGEILVGQSAKQSGCDQPSTRPFYAVKRLIGRRFEEEVVQKDIKLVPYKIVKANNGDAWVEASGKQMAPPQISAEVLKKMKKTAEDYLGEDVTEAVITVPAYFNDSQRQATKDAGRIAGLDVKRIINEPTAAALAYGMDKAKGDHTVIVYDLGGGTFDVSVIEIAEVDGEHQFEVLATNGDTFLGGEDFDMRLIDYLVDEFKKESGMDLKNDPLALQRLKEAAEKAKIELSSSQSTDVNLPYITADATGPKHLNVKISRAKLESLVEDLVTRTIEPCRIALKDAGIDASKIDDVILVGGQTRMPMVQKAVSDFFGKEARKDVNPDEAVAMGAAIQGAVLAGDVKDVLLLDVSPLTLGIETMGGVMTALIEKNTTIPTKKSQVFSTADDNQGAVTIHVLQGERKQAAQNKSLGKFDLADIPPAPRGVPQIEVTFDIDANGILHVGAKDKATGKEQKITIKANSGLSDEEIQKMVRDAELNAEEDRKFEELAAARNQGDALVHSTRKMIADAGDKVTAEEKTAIEAAVVALEAAVKGDDKAAIDAKVEELSKVSAPVAQKMYAEQAQPAEGAAPHDEKAEKADDVVDAEFEEVKDHK

SEQ ID NO: 13658 - protein, 374 aa, Pseudomonas fluorescens
MAKRDYYEVLGVERGSSEADLKKAYRRLAMKHHPDRNPGDKASEDLFKEANEAYEVLSDSSKRAAYDQYGHAGVDPSMGGGGAGFGGQNFSDIFGDVFSDFFGGGRGGSRGGAQRGSDLRYTLELNLEEAVRGTTVNIRVPTLVNCKPCDGSGAKKGSSPSTCPTCGGIGQVRMQQGFFSVQQTCPRCHGQGKIISDPCDSCHGDGRVEEYKTLSVKVPAGVDTGDRIRLSGEGEAGTQGGPTGDLYVVINVREHDIFQRDGKHLFCEVPISFVDAALGGELEIPTLDGRVKLKIPEGTQTGKQFRVRGKGVAPVRGGGAGDLMCRVAVETPVNLTRRQRELLEEFRSSLADDNSHSPKTTGWFDGVKRFFGDL

SEQ ID NO: 13659 - protein, 268 aa, Pseudomonas fluorescens
MRRIAVMGAAGRMGKILVEAVQQRAPLTGLTAAIVRPGSTLIGVDAGELASLGRIGVPLSGNLESVAEEFDVLIDFTLPEVMLKNLAFCRKAGKAMVIGTTGLDAAQKQLLAEAGKDIPIVFAANFSVGVNLSLKLLDMAARVLAEDADIEIIEAHHRHKIDAPSGTALRMGEVIANALDRDLQKVAVYGREGHTGARERETIGFATVRGGDVVGDHTVLFACEGERLEITHKASSRMTFAKGAVRAALWLDAREPGLYDMQDVLGLH

SEQ ID NO: 13660 - protein, 378 aa, Pseudomonas fluorescens
LTKPAILALADGSIFRGEAIGADGQTVGEVVFNTAMTGYQEILTDPSYAQQIVTLTYPHIGNTGTTPEDAESDRVWSAGLVIRDLPLVASNWRNTMSLSDYLKANNVVAIAGIDTRRLTRILREKGAQNGCIMAGDNISEEAAIAAAQGFPGLKGMDLAKVVSTKTQYEWRSTVWDLKTDSHATIEASELPYHVVAYDYGVKVNILRMLVERGCRVTVVPAQTPAADVLALKPDGVFLSNGPGDPEPCDYAIQAIKEVLETEIPVFGICLGHQLLALASGAKTLKMGHGHHGANHPVQDLDTGVVMITSQNHGFAVDEETLPANVRAIHKSLFDGTLQGIERTDKSAFSFQGHPEASPGPNDVAPLFDRFINEMAKRR

SEQ ID NO: 13661 - protein, 1072 aa, Pseudomonas fluorescens
MPKRTDIKSILILGAGPIVIGQACEFDYSGAQACKALREEGYRVILVNSNPATIMTDPDMADATYIEPIKWQTVAKIIEKERPDAVLPTMGGQTALNCALDLEREGVLEKFGVEMIGANADTIDKAEDRSRFDKAMKAIGLECPRSGIAHSMEEANAVLERLGFPCIIRPSFTMGGTGGGIAYNREEFEEICARGLDLSPTKELLIDESLIGWKEYEMEVVRDKKDNCIIVCSIENFDPMGVHTGDSITVAPAQTLTDKEYQILRNASLAVLREIGVETGGSNVQFGICPDTGRMVVIEMNPRVSRSSALASKATGFPIAKIAAKLAVGYTLDELQNDITGGRTPASFEPSIDYVVTKLPRFAFEKFANADARLTTQMKSVGEVMAIGRTFQESLQKALRGLEVGVCGLDEKVDLSNPESMSVLKRELTVPGAERIWYVADAFRAGMTVEEIFGMNMIDPWFLVQIEDLVKDEEKVKTLGLSAIDRDLMYKLKRKGFSDQRLAKLLGVTEKNLRTHRHKLEVFPVYKRVDTCAAEFATDTAYLYSTYEEECEAAPSGRDKIIILGGGPNRIGQGIEFDYCCVHAALALRDDGYETIMVNCNPETVSTDYDTSDRLYFEPVTLEDVLEICRVEKPKGVIVQYGGQTPLKLARALEAAGVPIIGTSPDAIDRAEDRERFQQMVERLNLRQPPNATVRSEDEAVRAAAKIGYPLVVRPSYVLGGRAMEIVYKEEELKRYLRDAVQVSNDSPVLLDHFLNCAIEMDVDAVCDGKDVVIGAIMQHIEQAGVHSGDSACSLPPYSLPARIQDEMREQVKKMALELGVVGLMNVQLALQGEDIYVIEVNPRASRTVPFVSKCIGISLAMVAARVMAGKTLKEIGFTKEIIPNFYSVKEAVFPFAKFPGVDPILGPEMKSTGEVMGVGDTFGEAFAKAQMGASEVLPTGGTAFISVRDDDKPLVAGVARDLINLGFEVVATAGTAKLIEAAGLKVRRVNKVTEGRPHVVDMIKNDEVTLIINTTEGRQSIADSYSIRRNALQHKIYCTTTIAAGEAICEALKFGPEKTVRRLQDLHAGLK

SEQ ID NO: 13662 - protein, 607 aa, Pseudomonas fluorescens
MAKNLILWLIIAAVLVTVMNNFSSPNEPQTLNYSDFIQQVKDGKVERVAVDGYVITGKRNDGDSFKTIRPAIQDNGLIGDLVDNHVVVEGKQPEQQSIWTQLLVASFPILVIIAVFMFFMRQMQGGAGGKGGPMSFGKSKARLLSEDQVKTTLADVAGCDEAKEEVGELVEFLRDPGKFQRLGGRIPRGVLMVGPPGTGKTLLAKAIAGEAKVPFFTISGSDFVEMFVGVGASRVRDMFEQAKKHAPCIIFIDEIDAVGRHRGAGMGGGHDEREQTLNQLLVEMDGFEMNDGIIVIAATNRPDVLDPALLRPGRFDRQVVVGLPDIRGREQILKVHMRKVPMGDDVAPAVIARGTPGFSGADLANLVNEASLFAARAGKRIVEMKEFELAKDKIMMGAERKSMVMSEKEKQNTAYHEAGHAIVGRVVPEHDPVYKVSIIPRGRALGVTMFLPEEDRYSLSKRALISQICSLYGGRIAEEMTLGFDGVTTGASNDIMRASQIARNMVTKWGLSEKLGPLMYAEEEGEVFLGRGGGGQNASFSGETAKLIDSEVRSIIDQCYGTAKQILTDNRDKLDAMADALMKYETIDAEQIDDIMAGRTPREPRDW

SEQ ID NO: 13663 - protein, 445 aa, Pseudomonas fluorescens
MSKKYFGTDGIRGRVGEYPITPDFMLKLGWAAGMAFRKMGACKVLVGKDTRISGYMFESALEAGLTSAGADVMLLGPMPTPAIAYLSRTFQAEAGIVISASHNPHDDNGIKFFSGKGTKLPDELELMIEELLDTPMTVVESSKIGKVSRINDASGRYIEFCKSSVPTGTSFSGLRIVIDCAHGATYKVAPSVFRELGAEVVVLSAQPNGLNINDNCGSTHMGQLQAAVLSEHADLGIAFDGDGDRVLMVDHTGAIVDGDELLYIIARDLHERGKLQGGVVGTLMSNLGLELALADLGIPFVRANVGDRYVIAELLERNWLVGGENSGHVVCFNHTTTGDAIIAALQVLMALKTRNEGLAQTRQALRKCPQVLINVRFGGGESPLEHPAVKEASARVTQAMAGRGRVLLRKSGTEPLVRVMVEGEDESQVRGYAEELAKLVTEVSA

SEQ ID NO: 13664 - protein, 251 aa, Pseudomonas fluorescens
MRRPMVAGNWKMHGTRASVAELINGLRHLALPSGVDVAVFPPCLYINQVIDGLKGKSISVGAQNSAVESMQGALTGEIAPSQLVDAGCSLVLVGHSERRQIMGERDGMLNRKFAAAQACGLIPVLCVGETLEQREAGKTLEVVGRQLGSIIEELGVGAFANAVIAYEPVWAIGTGLTATPQQAQDVHKAIREQLAAENSEVARGVRLLYGGSVKAANAVELFGMPDIDGGLIGGASLNADEFGAICRAAGN

SEQ ID NO: 13665 - protein, 240 aa, Pseudomonas fluorescens
MNNKKVVLVVGAGDATGGAIAKRFAREGFIACVTRRSADKLQPLVEAIQAAGGEAHGFACDARKEEDVIALIEDIETRLGPIEAFVFNIGANVPCSILEETARKYFKIWEMACFSGFLNAREVAKRMVTRSRGTILFTGATAGLRGASGFAAFAGAKHGIRALAQSMARELGPMNIHVAHVVVDGAIDTDFIRDNFPDKYATKDQEGILNPEHIAENYWYLHSQPRDAWTFELDLRPWNE

SEQ ID NO: 13666 - protein, 851 aa, Pseudomonas fluorescens
MRIDRLTSKLQLALSDAQSLAVGHDHPAIEPAHLMQAMLEQQGGSIKPLLMQVGFDVNSLRKELTKELDQLPKIQNPTGDVNMSQDLARLLNQADRLAQQKGDQFISSELVLLAAMDENSKLGKLLLGQGVSKKALENAINNLRGGEAVNDANHEESRQALDKYTVDLTKRAEEGKLDPVIGRDDEIRRTIQVLQRRTKNNPVLIGEPGVGKTAIAEGLAQRIINGEVPDGLRGKRLLSLDMGALIAGAKYRGEFEERLKALLNELSKQEGQIILFIDELHTMVGAGKGEGSMDAGNMLKPALARGELHCVGATTLNEYRQYIEKDAALERRFQKVLVDEPSEEDTIAILRGLKERYEVHHKVAITDGAIIAAAKLSHRYITDRQLPDKAIDLIDEAASRIRMEIDSKPEVLDRLERRLIQLKVESQALKKESDDAAKKRLEKLQEEIDRHEREYSDLEEIWNSEKAEVQGSAQIQQKIEQSRQELEAARRKGDLNRMAELQYGVIPDLERSLQMVDQHGKSENQLLRSKVTEEEIAEVVSKWTGIPVSKMLEGERDKLMKMESLLHQRVIGQDEAVVAVANAVRRSRAGLSDPNRPSGSFMFLGPTGVGKTELCKALAEFLFDTEEAMVRIDMSEFMEKHSVARLIGAPPGYVGYEEGGYLTEAVRRKPYSVILLDEVEKAHPDVFNILLQVLEDGRLTDSHGRTVDFRNTVIVMTSNLGSMQIQELVGDREAQRAAVMDAISTHFRPEFINRVDEVVIFEPLARDQIAGITEIQLGRLRNRLAERELKLELSPEAMDKLIAVGYDPVYGARPLKRAIQRWIENPLAQLILSGRFMPGETATGVVENDEI

SEQ ID NO: 13667 - protein, 336 aa, Pseudomonas fluorescens
MSRVTLSRYLIEQTRSNNTPADLRFLIEVVARACKEISHAVSKGALGGVLGSMGTENVQGEVQKKLDVLSNEILLEANEWGGHLAGMASEEMDNAYQIPGKYPKGAYLLVFDPLDGSSNIDINAPVGTIFSVLRCPNEYLSQNEALDEKAFLQPGTQQVAAGYAIYGPQTMLVLTLGHGVKGFTLDREMGSFVLTHEDITIPESTQEFAINMSNQRHWEAPVQRYVSELLAGEEGPLKKNYNMRWVAAMVADVHRILTRGGLFMYPRDSREPSKPGKLRLMYEANPMSFLVEQAGGASTDGHQRILDIKPEGLHQRVAVFLGSKEEVARATAYHKE

SEQ ID NO: 13668 - protein, 302 aa, Pseudomonas fluorescens
MTTRTDAVKAYLLDLQDRICAALETEDGGTRFVEDAWTRPAGGGGRTRVIENGTVIEKGGVNFSHVFGSGLPPSASAHRPELAGRGFEALGVSLVIHPHNPHVPTSHANVRFFIAEKEGEEPVWWFGGGFDLTPYYGNEEDCIHWHRVAEKACAPFGPDVYPRYKAWCDTYFHIKHRHEPRGIGGLFFDDLNEWDFDTSFAFMRAIGDAYIDAYLPIVQRRKNDAFTARQREFQEFRRGRYVEFNLVYDRGTLFGLQSGGRTESILMSLPPQVRWAYDWKAEPGSEEARLTEYFLQDRDWLA

SEQ ID NO: 13669 - protein, 272 aa, Pseudomonas fluorescens
MDRYVVFGNPIGHSKSPMIHKLFAEQTGQSLDYSTLLAPLDDFSGCATAFFQEGRGANVTVPFKEDAYRLANSLTARAERAGAVNTLSKLADGSLLGDNTDGAGLVRDLTVNGGFSLTGKRILLLGAGGAVRGALEPLLAEKPASVIIANRTVDKAELLAELFCDLGPVSASGYDWLREPVDVIINATSASLTGDVPPIAESLIEPGKTLCYDMMYGKEPTAFCRWASEHGAGVVMDGLGMLAEQAAEAFFLWRGVRPDTAPVLAELRRQLT

SEQ ID NO: 13670 - protein, 496 aa, Pseudomonas fluorescens
NILFIMADQMAAPMLPFYGPSPIKLPNLSRLAEQGVVFDAAYCNSPLCAPSRFTLVSGQLPSKIGAYDNAADFPADIPTYAHYLRRLGYRTALSGKMHFCGPDQLHGYEERLTSDIYPADYGWAVNWDEPDVRPSWYHNMSSVLQAGPCVRTNQLDFDEEVVFKAQQYLFDHIREDGDQPFCLTVSMTHPHDPYTIPKAFWDLYDDADIPLPTTPDQHSLDPHSQRLLKVYDLWDKPLPVDKIRDARRAYFGACSYIDANVGKLLQTLEDCGLMDDTVIVFSGDHGDMLGEKGLWYKMHWFEMAARVPLLISAPGQFKSGRVSAAVSTADLLPTFVELAGGSLEPNLPLDGRSLVPHLNGQGGHDEVFGEYMAEGTVSPLMMIRRGAYKFIYSETDPCLLFDVDNDPREQEELSQSPQHRQLFDDFLAEARAKWDIPAIHRKVLESQRRRRFVAEALTIGKLKSWDHQPLVDASQQYMRNHIDLDDLERKARYPQP

SEQ ID NO: 13671 - protein, 425 aa, Pseudomonas fluorescens
RQPLYKSLYFQVIVAICIGIALGHYYPQFGVAVKPLGDGFIKLIKMIIAPIIFCTVVSGIAGMQNMKSVGKTGGYALLYFEIVSTIALLVGLIVVNIVQPGNGMHIDVSTLDASKVATYVAQGADQSVVGFLLNVIPTTIVGAFATGDILQVLMFSVIFGFALHRLGAYGKPILDFIDRFAHVMFNIINMIMKLAPIGAFGAMAFTIGAYGVGSLVQLGQLMICFYITCLAFILIVLGGIARMHGFSVLKMIRYIREELLIVLGTSSSESVLPRMLIKMERLGAKKSVVGLVIPTGYSFNLDGTAIYLTMAAVFIAQATDTHMDITHQITLLVVLLLSSKGAAGVTGSGFIVLAATLSAVGHLPVAGLALILGIDRFMSEARALTNLVGNAVATIVVAKWVKELDTDVLDAELASGGRGIADTRP

SEQ ID NO: 13672 - protein, 214 aa, Pseudomonas fluorescens
MSLQGKVALVTGASRGIGQAIALELGRQGAIVVGTATSASGAERIAATLKENGIQGAGFELNVTSDESVTKVLASIQEQFGAPVAILVNNAGITRDNLMMRMKDDEWYDVIDTNLNSLYRLSKGVLRGMTKARWGRIISIGSVVGAMGNAGQVNYAAAKAGLEGFSRAMAREVGSRSITVNSVTPGFIDTDMTRELPEAQREALQTQIPLGRLG

SEQ ID NO: 13673 - protein, 302 aa, Pseudomonas fluorescens
LAFVFPGQGSQSLGMLAELGAQHPLILETFKEASDALGYDLWALTQQGPEELLNQTDKTQPAILTASVALWRLWLAEGGARPAFVAGHSLGEYSALVAAGSLSLADAVKLVERRGQLMQEAVPAGQGGMAAILGLEDADVLAACAEAAQGEVVSAVNFNSPGQVVIAGAKAAVERAIEGCKARGAKRAMPLPVSVPSHCELMRPAAERFAESIAAIDWQAPQIPVVQNVSAQVPADLETLKRDLLEQLYKPVRWVESVQTLAAKGATNLVECGPGKVLAGLNKRCAEGVSTSNLNTPDAFAA

SEQ ID NO: 13674 - protein, 447 aa, Pseudomonas fluorescens
NQLFDAYFTARDMRDVFCDQGRVQAMLDFEAALARAEARVGLIPADAVAAIENACRAGLFDFAALGEAIATAGNSAIPLVKALGKQIAATDAEAERYVHLGATSQDVMDSGLVLQLRQALELIERELGQLADALATQAQRHAATPLAGRTWLQHATPVTLGMKIAGWLGAITRSRQRLRELKPRLLVLQFGGASGTLAALGEQALPIAQALAEELHLNLPEQPWHTQRDRIVEFGAVLGLIAGSLGKFGRDISLLMQTEAAEVFEPSAPGKGGSSTMPHKRNPVGAAVLIGAATRVPGLVSTLFSAMPQEHERSLGLWHAEWETLPEICCLVSGALQQARLLADGLEVDAARMARNLELTQGLVLAEAVSIVLAQRVGRDTAHHLLEQCCKRAVAEQRHLRAVLGDEPQVTAELSASELDHLLDPAHYLGQAQVWVERAVAEHNALS

SEQ ID NO: 13675 - protein, 400 aa, Pseudomonas fluorescens
MRDVYICDAIRTPIGRFGGGLAAVRADDLAAVPIKALMERNPSVDWSAIDEVFLGCANQAGEDNRNVARMALLLAGLPESVPGVTLNRLCASGMDAIGTAFRAIASGEMELAIAGGVESMSRAPFVMGKADAAFSRNMKLEDTTIGWRFINPLMKAQYGVDAMPQTADNVADDYEISREDQDAFALRSQQRTAAAQAAGYFAEEIVEVRIAHKKGETVVSQDEHPRADTTIEALTKLKPVNGPEKTVTAGNASGVNDGAAALILASAEAVKKHGLTARAKVLGMASAGVAPRVMGIGPVPAVRKLTERLGVAVSDFDVIELNEAFASQGLAVLRELGLADDAAQVNPNGGAIALGHPLGMSGARLVLTALHQLEKSGGKKGLATMCVGVGQGLALAIERV

SEQ ID NO: 13676 - protein, 392 aa, Pseudomonas fluorescens
YLNALGVICALGRDKQTVARNLFAGDCSGMRRESGWVPERELPVAAVHGDLAPIPEALADQRSRNNQLLLEAALQIRDDIEQAIQTYGRDRIGVVLGTSTSGIDEASRGLAHYIRDQQFPADYDYRQQELGAPANFLADWLQLSGPTYVISTACTSSARALMSARRLLDLGLCDAVLCGGVDSLCKLTLNGFSALEAVSDERCNPFSANRNGINIGEAAVLFVMSKERGAGPGIALLGAGASSDAHHISAPEPTGRGALQAMQKALDQAHLQADDISYLNLHGTATQHNDAMESLAVDALFADGVPCSSTKPMTGHTLGAAGALEAAFCWLSLSADNPDHALPPHIWDGQADPDLPALKWVTASERLASIAPRYLMSNSFAFGGNNVSLIIG

SEQ ID NO: 13677 - protein, 241 aa, Pseudomonas fluorescens
MTESILVTGSSRGIGRAIALRLASAGHDIVLHCRSGVTEAQAVKAEVEALGRTARILQFDVADRETCKAILEADVEAHGAYYGVVLNAGLTRDGAFPALSDDDWDVVLRTNLDGFYNVLHPVMMPMIRRRAAGRIVCITSVSGLIGNRGQVNYSASKAGVIGAAKALAIELAKRKITVNCVAPGLIDTAMLDENVPVEELLKMIPAQRMGTPEEVAGAVNFLMSAEASYITRQVLAVNGGL

SEQ ID NO: 13678 - protein, 409 aa, Pseudomonas fluorescens
LMKRVVVTGMAGITSLGSDWDTIAGNFAANRSGIRRMDEWDRFSELNTRLAGPIDDFQVPAHWTRKQLRSMGRVSRLAVGAAEKALADAGLLGDESIKDGRMGVACGSSTGSTDEIKAFGNMLLNSVAEGLNANSYVRMMPHTTAANISIFFGLTGRLIPTSSACTSGSQGIGYAYEAIKFGRLPLMLAGGAEELCPTEAMVFDALYATSLKNDAPHTSPRPYDKDRDGLVIGEGGGMLVLEELEHALARGAHIHAEIVGFGSNADGQHTTRPEQITMRRAMELALEDAGLAPDVIGYVNGHGTATEQGDVAETLATSALFGERMPISSQKSFLGHTLGACGALESWFSIEMLNRDLYVHTLNLDEVDPHCGKLDYLRGEFRQMSHDYVMNNNFAFGGVNTSLIFRRWP

SEQ ID NO: 13679 - protein, 354 aa, Pseudomonas fluorescens
MTALKNDRFLRALLKQPVDVTPVWMMRQAGRYLPEYRASRAQAGDFMSLCMNPEFACEVTLQPLDRYPQLDAAILFSDILTIPDAMGQGLYFETGEGPRFKKVVSTLADIEALPIPDPHKDLGYVMDAVSTIRRELNGRVPLIGFSGSPWTLATYMVEGGSSKDFRKTKAMLYDNPQAMHLLLDKLAQSVTSYLNGQIQAGAQAVQIFDTWGGNLSAAAYQEFSLAYMKKIVSGLIREHDGRKVPVILFTKNGGLWLESIAEAGADALGLDWTCDIGNARARVGDKVALQGNMDPTVLYAKPEAIRTEVGRILASYGKGSGHVFNLGHGITPEVDPEHAGAFLRAVHELSAQYH

SEQ ID NO: 13680 - protein, 429 aa, Pseudomonas fluorescens
MGKNVVVLGTQWGDEGKGKIVDLLTEHAAAVVRYQGGHNAGHTLVIDGEKTVLHLIPSGVLREGVQCLIGNGVVVAPDALLREITKLEEKGVPVRERLRISPSCPLILSFHVALDQAREKARGELKIGTTGRGIGPAYEDKVARRGLRVGDLLNMPRFEDKLRELVDYHNFMLVGYYKEPAIEFEKTLAECKEYAELLKPLMLDVTAELHDLRRAGKDIMFEGAQGSLLDIDHGTYPYVTSSNTTAGGVATGSGVGPMFLDYILGITKAYTTRVGSGPFPTELFDEVGAHLAKQGHEFGATTGRARRCGWFDAVILRRAIDVNSISGICLTKLDVLDGLETINICTGYKDAQGNAVAPTDADSYVGLQPVYEEVPGWSESTVGAKTLEELPANARAYIKRVEELIGAPIDIISTGPDRNETIVLRHPFA

SEQ ID NO: 13681 - protein, 190 aa, Pseudomonas fluorescens
MEALHQKIREQGIVLSDQVLKVDAFLNHQIDPALMKLIGDEFATLFKDSGITKIVTIEASGIAPAIMTGLNLGVPVIFARKQQSLTLTENLLSATVYSFTKKTESTVAISPRHLTSSDRVLIIDDFLANGKASQALISIIKQAGATVAGLGIVIEKSFQGGRAELDSQGYRVESLARVKSLKDGVVTFIE

SEQ ID NO: 13682 - protein, 952 aa, Pseudomonas fluorescens
MLELTVEQISMGQSAVDKPAALQLLASHLVADGLVADGYLSGLQAREAQGSTFLGQGIAIPHGTPETRDQVFTTGVRLMQFPDGVDWGDGQIVYLAIGIAAKSDEHLRLLQLLTRALGETDLGQALRRASSPEALLKLLQGAPQELALDAQMIGLGVSADDFEELVWRGARLLRQADCVSNGFAGVLQQVEALPLGDGLWWLHSEQTVKRPGLAFVTPDKPMRYLGQPLSGLFCLASLGEAHQALLERLCALLIEGRGHELGRATSSRKVLEVLGGELPADWPSARIALANAHGLHARPAKILAQLAKSFDGEIRVRIVDGQDSAVSVKSLSKLLSLGARRGQVLEIIAEPSIAADALPALLAAIEEGLGEEVEPLPAVSQQREVIADIAEVLSAPASGSLLQAIPAAPGIAIGPAHIQVQQAIDYPLRGESAAIERERLKQALADVRQDIQGLIERSKAKAIREIFITHQEMLDDPELTDEVDTRLKQGESAEAAWMAVIEAAAKQQESLHDALLAERAADLRDIGRRVLAQLCGVQTPAEPEQPYILVMDEVGPSDVARLDPARVAGILTARGGATAHSAIVARALGIPALVGAGAAVLLLKPGTPLLLDGQRGRLHVDADAATLQRASEERDTREQRLKAAAEQRHQPAHTTDGHAVEVFANIGESAGVISAVEQGAEGIGLLRTELIFMAHPQAPDEATQEAEYRRVLDGLAGRPLVVRTLDVGGDKPLPYWPIAKEENPFLGVRGIRLTLQRPQIMEAQLRALLRSADNRPLRIMFPMVGSVEEWRQARDMTERLRLEIPVPDLQLGIMIEVPSAALLAPVLAKEVDFFSVGTNDLTQYTLAIDRGHPTLSAQADGLHPAVLQLIDITVRAAHAHGKWVGVCGELAADPLAVPVLVGLGVDELSVSGRSIAEVKARIRELSLTQTQTLAQQALAVGSANEVRALVEA

SEQ ID NO: 13683 - protein, 825 aa, Pseudomonas fluorescens
  unsure (1)..(825): unsure at all Xaa locations
VKHPVERLLQQMREAGLPHTAAEENGTDSEKQSLLTHLKSSHKAKVEEPRKITLQRKTTSTLRVAGSKSISVEVRKKKVFVQRSPEEIEAERKRELDERRAVENAARQKAEEEARVRAEEEARRQPAAPSAPAEAVAAPAPVAEPVREAAPVVAAAPAADTRKRDEQRRPDKPRADDNNRRGGDGERKNAPHRASVKEKAPAPRVAPRTTDEESDGFRRGGRGKAKLKNRXAXCFMSAIGPVVREVKIGECITVGDLDQQMXVXAAEVIEFMFXLGTPATINRVLDQETAQLVAEELGHKVTLVSDTALEDSLAESLKFEGEAVPRAPVVTVMGHVDHGKTSLLDYIRRAKVAAGEAGGITQHIGAYHVETERGMVTFLDTPGHAAFTAMRARGAKATDIVILLVAADDGVMPQTIEAVQHAVAAGVPLVVAVNKIDKPGADLDRIRSELSAHGVTSEDWGGDTPFVPVSAKMGTGVDELLEAVLLQAEVLELTATPSAPGRGVVVESRLDKGRGPVATVLVQDGTLRQGDMVLVGSNYGRVRAMLDENGKPIKEAGPAIPVEILGLDGTPDAGDEMSVVADEKKAREVALFRQGKFREVKLARAHAGKLENIFESMGQEEKKTLNIVLKSDVRGSLEALQGALNGLGNDEVQVRVVGGGVGGITESDANLALASNAVLFGFNVRADAGARKIVEQEGLDMRYYNVIYDIIEDVKKALTGMLGSDVRENILGVAEVRDVFRSPKFGAIAGCMVIEGTVHRNRPIRVLREDIVIFEGELESLRRFKDDASEVRAGMECGIGVKSYNDVKVGDKIEVFEKVQVARSL

SEQ ID NO: 13684 - protein, 305 aa, Pseudomonas fluorescens
MDFKDYYKILGVEPTADDKAIKAAYRKLARKYHPDVSKEKDAEAKFKDASEAYEALKSADKRAEYDELRRYGQHGQPFQGPPGWQSRGGFGGGGGDTGDFSDFFSSIFGNRGPGFGGGAGRQSRSAGRRGQDVELELPIFLEETLSNESKKISFQVPQYNGSGQHVSNTSKSLNVKIPAGVTDGERIRLKGQGAPGIGGGANGDLYLTIRFAPHPKFDVEGENLIITLPLAPWELALGAEVAVPTLTGKINLKVPAGSQNGQRMRAKGHGLQNKAGERGYLFVQLKAVMPKANGDDVKALWQELA

SEQ ID NO: 13685 - protein, 77 aa, Pseudomonas fluorescens
MSTIEERVKKIVAEQLGVKEEEVVNTASFVEDLGADSLDTVELVMALEEEFETEIPDEEAEKITTVQAAIDYVTSHQ

SEQ ID NO: 13686 - protein, 413 aa, Pseudomonas fluorescens
VSRRRVVVTGMGMLSPLGTDVPSSWQGILAGRSGIGLIEHTDLSAYSTRFGGSVKGFNVEEYLSVKEARKLDLFIQYGLAAGFQAVRNAGLEVTDANRERIGVAMGSGIGGLTNIEETSRTLHETGPRRISPFFVPGSIINMISGFLSIHLGAQGPNYAIATACTTGTHCIGMAARNIMYDEADVMIAGGAEMAACGLGMGGFGASRALSTRNDEPTRASRPWDKGRDGFVLSDGAGALVLEELEHAKARGATIYAELIGFGTSGDAFHMTSPPADGAGAARCITNALRDAKINVDQVQYINAHGTSTPAGDLAEANAIKSVFGDHAYKLAVSSTKSMTGHLLGAAGAVEAIFSVLAINSQVAPPTINLEEPDEGCDLDFVPHTARNMDIDVVLSNSFGFGGTNGTLAFRRFA

SEQ ID NO: 13687 - protein, 206 aa, Pseudomonas fluorescens
VTGLFITLEGPEGAGKSTNREYLAERLRAAGIEVVLTREPGGTPLAERIREVLLAPVDEVMNPDTELLLVFAARAQHLAEVIRPALARGAVVLCDRFTDSTYAYQGGGRGLSLERIAALETFVQGDLRPDLTLIFDLPVEIGLARASARGRLDRFELEGREFFEAVRNAFLKRAEDDPARYVRIDAGQPLVKVQQSLDTLIPNLLE

SEQ ID NO: 13688 - protein, 296 aa, Pseudomonas fluorescens
KTGGCMTWTAVTEHRAQLGEGPFWDALTQALYWVDIAGRQALRLIGQNVQIWQMPEHVSAFIPCASGDALVTLSSGVYRLDLDSPGLEPRLTLFCIADPQPGNRANEARCDGQGRLWLGTMQNNIGEQGEDLPIIRRSGGLFRIDPDKRVTPLLRGLGIPNTLLWSDDGTTLLFGDSLDSTLYRYFIHTDGNLDTAQPWYSADQHGGPDGSAMDAEGYVWNARWDGSCLLRLTPDGQIDRRIELPISRPTSCVFGGTDLKTLYITSAKSPLNHPLDGAVLSLQVDVAGKLCTRFAG

SEQ ID NO: 13689 - protein, 248 aa, Pseudomonas fluorescens
RLKNKVVLLTGAAQGIGEAIVATFASQQAKLVISDIQAEKVEKVAAHWREQGADVQAIKADVSRQQDLHAMAKLAIELHGRIDVLVNCAGVNVFRDPLEMTEEDWKRCFAIDLDGAWYGCKAVLPQMIEQGIGSIINIASTHSTNIIPGCFPYPVAKHGLLGLTRALGIEYAPKGIRVNAIAPGYIETQLNVDYWNGFADPHAERQRAFDLHPPKRIGQPIEVAMTAVFLASDEAPFINASCITIDGG

SEQ ID NO: 13690 - protein, 510 aa, Pseudomonas fluorescens
MTALNLIPGQLSLAQLRDVYQNPVKLTLDNSASAQIEASVACVEQILAENRTAYGINTGFGLLASTRIASEDLENLQRSLVLSHAAGVGQPISDELVRLIMVLKVNSLSRGFSGIRRVVIDALIALINAEVYPHIPLKGSVGASGDLAPLAHMSLVLLGEGKARHKGEWMDATEALKVAGLTPLTLAAKEGLALLNGTQVSTAFALRGLFEGEDLFAGALALGGLTVEAVLGSRSPFDARIHAARGQKGQIDAAAAYRDLLGERSEVSDSHQNCEKVQDPYSLRCQPQVMGACLTQFRQAAEVLAIEANAVSDNPLVFAAEGDVISGGNFHAEPVAMAADNMALAIAEIGSLSERRISLMMDKHMSQLPPFLVANGGVNSGFMIAQVTAAALASENKALSHPHSVDSLPTSANQEDHVSMAPAAGKRLWEMAENTRGILAVEWLAAVQGLDLRNGLKTSAKLEQARGILRREVPFYEKDRFFAPDINAATELLASRILTELVPAKLLPSL

SEQ ID NO: 13691 - protein, 493 aa, Pseudomonas fluorescens
MSQAEKIVIADAPMRWQDVVAVARHGAQLELSAQTWARIENAQGIVQRIVASGERAYGVNTGLGALCNVSLKDEQLSQLSRNTLLSHACGVGPVLADEQTRAIMCAAIRNYSHGKSGIHRRVVEALLALLNRGITPQVPSQGSVGYLTHMAHIGIALLGVGNVSYRGQVVCAQQALAEEGLQPVQLGAKDGLCLVNGTPCMTGLGCLAIADATRLLQWADVIGAMSFEAQRGQIAAFDAEIIALKPHPGMQQVGVNLRALLDGSEVIASSKGIRTQDALSIRSIPQVHGAARDQLEHAIKQIETELNGCTDNPLLLGTPDDFRVMSQANPHGQSVALAADLLAIAMAEIGSIAERRLDRLINPHVSGLPAFLVANPGVNSGMMIVQYVAASLCAENRQLAQPAVLDNYVTSGLQEDHLSMGTNAALKLHRALENCTQILAIEYLLAAQAFEFLKEQRFGAGTDTAWRLLREKVPAYDQDRWLAPDIAAAASVL

SEQ ID NO: 13692 - protein, 650 aa, Pseudomonas fluorescens
IHKILIANRGEIACRIQRTAQALGYRTVAVFSDADADALHVEMADEAVNIGPAPVQQSYLNIPAILDAARRSGADAIHPGYGFLSENAEFARACKQAGLTFIGPSVEAIELMGSKRQSKIAMLAAGVPCIAGYQGAEQDDATLTREAERIGYPLMIKASAGGGGRGMRLVHSAEELPAQLRTARSEALNGFGSDELILEQALIEPRHVEVQLFGDHHGQLIYLGERDCSIQRRHQKVIEEAPCPVMTEELRQAMGEAALKAGRAVNYVGAGTVEFLLDTDGRFYFLEMNTRLQVEHPVTELITGLDLVAWQLSVAEGQPLPLTQAQVKLDGHAMEVRLYAEDPTQGFLPQTGRVEAWAPALDRGSRIDHGLIEGQSISPFYDPMLGKLIAHGATREEARRKLLCAVQDSVLLGVQSNQRLLASLLQHPQFISGEFGTGFIPQHFADHDCLHAYSPSNEELAIAALLFYRSAAQQHRATLSGWRNNAGAPLLYRIGLDARDWNVQLRASPDNAFEVQVVERVIELKLIEHTAGAVTLEVDGLRQRRAYRLCDEQLWLFTHPGSLHLVDRTHAVIDSQTSVSSGTLKAPMDGAIIDVLVSEGSPVSKGQLLVVLEAMKMEHPLKAGIDGVLKRVQVKVGDQVKNRQVLLQVE

SEQ ID NO: 13693 - protein, 1317 aa, Pseudomonas fluorescens
MATTTLGVKLDDPTRERLKAAATSIDRTPHWLIKQAIFNYLEKLEGGATLTELNGLTAKDADDAGEVHTDHAHQCFLEFAESILPQSVLRASITAAYRRPEPEVVPMLIEQARLPAPMAEATNKLAATIAEKLRNQKSAGGRAGIVQGLLQEFSLSSQEGVALMCLAEALLRIPDKGTRDALIRDKISTGNWQPHLGNSPSLFVNAATWGLLLTGKLVSTHNEAGLTSSLSRIIGKSGEPMIRKGVDMAMRLMGEQFVTGETIAEALANASKFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLSVPEVIYPQFATHNAHTLSAIYHIAGQNYYPGQYEFQCLHGMGEPLYEQVVGKVSEGKLNRPCRVYAPVGTHETLLAYLVRRLLENGANTSFVNRIADQSVSIQELVADPVAQIEQMATVEGGFGLPHPRIPLPRDLYGSERANSAGIDMANEHRLASLSCALLATAHNNWKAAPMLGCASSNEAPAPVLNPSDLRDVVGHVQEATVEDVDNAIQCALNAAPIWQATPPAERAAILERAADLMEGEIQPLMGLLAREAGKTFANAIAEVREAVDFLRYYAVQARNDFSNDAHRPLGPVVCISPWNFPLAIFSGQVAAALAAGNPVLAKPAEQTPLVAAQAVRLLLEAGIPEGVLQLLPGRGETVGAGLVGDERVKGVMFTGSTEVARLLQRNIAGRLDNQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQGMRDKGRNVYQVAIADTEEVKRGTFVMPTLIELESFDELQREIFGPVLHVVRYKRKEIDQLIAQINASGYGLTLGVHTRIDETIAKVIDNVNAGNVYVNRNIVGAVVGVQPFGGEGLSGTGPKAGGPLYLYRLLSTRPTDAIEQSFARADAAVAPDVRLRDAMSKPLTALKAWADSNKFADLSTLCVQYAAQSQSGITRVLAGPTGEKNSYAILPREHVLCLADIEGDLLTQLAAVLAVGGSAVWPESDTSKALFARLPKEIQARIKLVSDWNKDDVVFDAVLHHGHSDQLRAVCQQIAKRAGAIVGVQGLSQGETNIALERLVIERALSVNTAAAGGNASLMTIG

SEQ ID NO: 13694 - protein, 215 aa, Pseudomonas fluorescens
MVLRSEILVNKNVLPTKEQALPGRETPMALPEKHFVFTETPLLGPFFQDVDFAIFGLGCFWGAERRFWQREGVVSTVVGYAGGFTPNPTYEEVCSGLTGHAEVVLVVFDKAKVSYEELLAMFWELHNPTQGMRQGNDIGTQYRSVIYATHPEQLDAALKSKAVYQAELSKAGLGEISTEIEQAPTVYFAETYHQQYLAKNPEGYCGIGGTGVCMP

SEQ ID NO: 13695 - protein, 490 aa, Pseudomonas fluorescens
PSPAAGVVHAISVKLNDEVGTGDLILDLEVAGAAAPAAAAPAQAAAPAAAPAPAAAPAAPVADSVQDIHVPDIGSAGKAKIIEVLVKAGDSVEADQSLITLESDKASMEIPSPAAGVVESISIKLDDEVGTGDLILKLKVKGAAPAAAPAPAAAAAPSAPAPAAAPAAAAPAAAAPVAAPAKPGAKVHAGPAVRQLAREFGVELSAVGASGPHGRILKEDVQTYVKAMMQKAKEAPAAAAGATGGAGIPPIPVVDFSRFGEIEEVPMTRLMQVGAANLHRSWLNVPHVTQFDSADITELEAFRTAQKSVAEKAGVKLTILPLLLKSCAHLLKELPDFNSSLAPSGKAIIRKKYVNIGFAVDTPDGLLVPVIKNVDQKSLLQLAAEAASLAEKARTKKLSSDEMQGACFTISSLGHIGGTGFTPIVNAPEVAILGVSKATIQPVWDGKAFQPKLMLPLSLSYDHRVINGAAAARFTKRLSDLLADIRTILL

SEQ ID NO: 13696 - protein, 640 aa, Pseudomonas fluorescens
LLVANRGEIACRVMRTAKALGLTTVAVHSATDREARHSREADIRVDLGGSKAADSYLQIDKLIAAAKASGAQAIHPGYGFLSENAGFARAIEAAGLIFLGPPASAIDAMGSKSAAKSLMETAGVPLVPGYHGEAQDLDTFRDACERIGYPVLLKATAGGGGKGMKVVEDVSQLGEALASAQREAQSSFGDSRMLVEKYLLKPRHVEIQVFADQHGNCLYLNERDCSIQRRHQKVVEEAPAPGLSPELRRAMGEAAVRSAQAIGYVGAGTVEFLLDARGEFFFMEMNTRLQVEHPVTEAITGLDLVAWQIRVARGEALPITQDQVPLNGHAIEVRLYAEDPSNDFLPATGRLDLYRESAAGPGRRVDSGVEEGDEISPFYDPMLGKLIAWGEDREQARLRLLSMLDEFAIGGLKTNINFLRRIIGHPAFAAAELDTGFIPRYQEQLLPAPAALSDEFWEAAAQAFAQSLPEMARADDPASPWALQSGLRAGLPREITLHLSCEGQDRALTLGAGGKAKLIGEQLVLEHDGLRRQLRAIRRGEALFLQWDGELRRVETYDPISAVEASHSHQGGLTAPMNGSIVRVLVEAGQSVEAGAQLVVLEAMKMEHSIRAPHAGVIKVLYCQEGEMVSEGSALVELEE

SEQ ID NO: 13697 - protein, 262 aa, Pseudomonas fluorescens
MSDFNTLELHSDPRGFATLWLSREEKNNAFNAEMIRELILALDKVASDASLRFLLVRGRGKHFSAGADLAWMQQSAELDYHTNLDDARELAELMYNLAKLKIPTVAVVQGAAFGGALGLISCCDMAIGADDAQFCLSEVRIGLAPAVISPFVVQAIGERAARRYALTAERFGGQRAREIGLLSESYPATELEQKVEQWIDNLLLNSPAAMRASKDLLREVGNGALTPALRRYTENAIARIRVSPEGQEGLRAFLQKRPPSWQ

SEQ ID NO: 13698 - protein, 387 aa, Pseudomonas fluorescens
MSYPSLNFALGETIDMLRDQVQSFVAKEIAPRAAQIDSDNLFPADLWRKFGDMGLLGITVPEEYGGAGLGYLAHVVAMEEISRGSASVALSYGAHSNLCVNQINRNGNHEQKAKYLPKLISGEHVGALAMSEPNAGSDVVSMKLRADKRGDRFVLNGSKTWITNGPDANTYVIYAKTDLEKGPHGITAFIVERDWKGFSRSNKFDKLGMRGSNTCELFFDDVEVPEENILGVLNGGVKVLMSGLDYERVVLSGGPTGIMQACMDLIVPYIHDRKQFGQSIGEFQLIQGKVADMYTQLNASRAYLYAVAQACERNETTRKDAAGVILYTAERATQMALDAIQILGGNGYINEFPAGRLLRDAKLYEIGAGTSEIRRMLIGRELFNETR

SEQ ID NO: 13699 - protein, 538 aa, Pseudomonas fluorescens
LLAMTIGQKFDETVAQYPDGEALVVRHQQLRYTWRQLADAVDVHARALLALGLQAGDRLGIWAPNCAQWCITQFATAKLGVILVNINPAYRSSELEYVLKQSGCQWLVCAGAFKSSNYHGMLQGLLPELAEQSIGELRSERLPELRGLISLDPQPPSGFLPWSQLADLAASVSPEQLRERSDSLHFDQPVNIQYTSGTTGFPKGATLSHYNILNNGYMVGESLGLTAADRLVIPVPLYHCFGMVMGNLGCITHGSTMIYPNDAFDPLLTLSTVAEEKATALYGVPTMFIAMLDQPQRAEFDLSTLRTGIMAGATCPIEVMRRVINEMHMSEVQIAYGMTETSPVSLQTGPSDELELRVTTVGRTQPQLESKIIDEAGNPVPRGTIGELCTRGYSVMLGYWNNPNATAEAIDAAGWMHTGDLASMNDEGYVCIAGRNKDMIIRGGENIYPRELEEFFFTHPAVADVQVIGIPCSRYGEEIVAWIKFHPGHSATEQELQAWCKERIAHFKTPRYFKFVEEFPMTVTGKIQKFRMREISIE

SEQ ID NO: 13700 - protein, 393 aa, Pseudomonas fluorescens
MDFAYSPKVQELRERVTAFMDTYVYPAEAVFERQVAEGDRWQPTAIMEELKAKAKAEGLWNLFLPESELGAGLTNLEYAPLAEIMGRSLLGPEPFNCSAPDTGNMEVLVRYANEEQKQRWLEPLLRGEIRSAFAMTEPDVASSDATNMAARAVRDGDEWVINGKKWWTSGACDPRCKILIFMGLSNPDAPRHAQHSMILVPVDTPGVKIIRPLPVFGYDDAPHGHAEVLFDNVRVPYENVLLGEGRGFEIAQGRLGPGRIHHCMRSIGMAERALELMCKRSVSRTAFGKPLARLGGNVDKIADSRMEIDMARLLTLKAAYMMDTVGNKVAKSEIAQIKVVAPNVALRVIDRAIQIHGGAGVSNDFPLAYMYAMQRTLRLADGPDEVHRAAIGK

SEQ ID NO: 13701 - protein, 270 aa, Pseudomonas fluorescens
MKIVSFNINGLRARPHQLAALIEKHQPDVIGLQETKVHDDQFPLEEVRALGYHVYFHGQKGHYGVALLSRQEPIAVHKGFATDEEDAQRRFIWGTFADANGVPVTIMNGYFPQGESRDHPTKFPAKQRFYSDLQALLESQFHNEQPLVVMGDVNISPEDCDIGIGPDNMKRWLKTGKCSFLPEEREWMARLKNWGLTDSFRHLNPDVTDTFSWFDYRSRGFEDEPKRGLRIDVILASHGLLPRVKAAGVDYELRGMEKPSDHAPIWLELS

SEQ ID NO: 13702 - protein, 403 aa, Pseudomonas fluorescens
RMRQQRDAVVKLLMWEIGKNLKDSEKEFDRTCDYIVDTINALKELDRRSSRFELEQDTLGQIRRVPLGVALCMGPYNYPLNETFTTLIPALIMGNTVVFKPAKLGVLLIRPLLEAFRDSFPTGVINVIYGSGRETVSALMASGKIDIFAFIGTNKAASDLKKLHPKPHRLRAALGLDAKNPGIVLPEVDLDNAVSEAVTGSLSFNGQRCTALKILFVHEDVVDSFIEKFNAKLASLKPGMPWDSGVSLTPLPESGKVDYLHGLVADAQSKGAQVVNPNGGESRESFFYPAVLYPVTPQMRVYQEEQFGPVVPIVPYRHLDTVIDYVLESDFGQQLSIFGTNPVAVGRLVDTFANQVGRINLNAQCQRGPDTYPFNGRKNSAEGTLSVHDALRVFSIRTLVATK

SEQ ID NO: 13703 - protein, 426 aa, Pseudomonas fluorescens
MQTSNAGVSRTRQVVAAVIGNALEWYDFIVYGFLASIIARQFFPSDDDYASLLMALATFGVGFFMRPVGGILLGIYSDRKGRKAAMQMIIRLMTVSIALIAFAPNYAAIGMGAPLLIVVARMLQGFATGGEYASATAFLVESAPAHRKGLYGSWQLVGQCLAVFSGAAMVALVTHLFSPEALDSWGWRIPFVLGLLIGPVGLWIRKHMEEPEEFLEARKKAKGAAPGLWQVLREHRRSLLVSMGLACGATVSFYVVLVNMPTFAHKNLGLPLDQVLLVQMLAVGLMTVVIPFSGALSDRLGRRPVLMAFTLAFFVMVYPLYVWVATAPSIERLLVMQLLLCTAIGGVFGPAPTALAEQFPIEVRSTGVSVAYNVAVMVFGGFAPLIVTWLSKVLNTPVAPSFYVLFACLLTLLGTYCLQEAPRAKK

SEQ ID NO: 13704 - protein, 329 aa, Pseudomonas fluorescens
MKILVTGASGFIGGRFARFALEQGLEVRVNGRRAEGVEHLVRRGAEFVQGDLSDPDLVRALCSDVEAVVHCAGAVGLWGRYQDFHQGNVQVTENVVEACLKQRVRRLVHLSSPSIYFDGRDHLGLTEEQVPKRFKHHYAATKYLAEQKVFGAQEFGLETLALRPRFVTGAGDMSIFPRLLNMQRKGRLAIIGNGLNKVDFTSVHNLNEALLSSLLADASALGKAYNISNGAPVPLWDVVNYVMRKMEVPQVTQYRSYGLAYSVAALNEGVCKLWPGRPEPTLSRLGMQVMNKNFTLDISRARHYLDYDPKVSLWTALDEFCSWWKAQDI

SEQ ID NO: 13705 - protein, 532 aa, Pseudomonas fluorescens
TCGEVLVKLLEDYGVEQVFGIPGVHTVELYRGLARSSINHVTPRHEQGAGFMADGYARTSGKPGVCFIITGPGMTNITTAMGQAYADSIPMLVISSVQSRSQLGGGRGKLHELPNQSALVGGVAAFSHTLMSASELPGVLARAFALFQAGRPRPVHIEIPLDVLVEEADELLTSVPVNIDRAGAAPAAVSRMTELLAGARRPLILAGGGAIDAAAELTELAELLDAPMALTINAKGMLPSSHPLLIGSTQSLVATRALVADADVILAIGTELAETDYDVTFAGGFEIPGKLLRVDIDPDQTVRNYPPHVALVADSRNAAQALLSALSHKPLAERRNDWGQVRAARLREDLAATWDAPTLAQTRFLETVLHELPNAVFVGDSTQPVYTGNLTFNPERPRRWFNSSTGYGTLGYALPAAIGAWLGGNLEHGARPPVVCLIGDGGLQFTLPELASAVEARTPVIILLWNNQGYEEIKKYMVNRAIEPVGVDIYTPDFIGVAKALGCAAQAISSAEHLRGALRAATDRQGPTLIEI

SEQ ID NO: 13706 - protein, 471 aa, Pseudomonas fluorescens
LYINGQWSAGREHLRVINPATEALLTTVNGGDESAVHQAVTAATEAFKAWSKTTGAERASILRNIANGVRNGREHLMNLQSSNNGKPQFEAGIDVDDVIATFEYYAELAEGLDAKLDSNVPLPSDDFSARLRREPCGVVGLIVPWNFPMVTTAWKLAPALAAGCCVVLKPSEVTPLPELELATIIAESGLPKGVFNLVCGTGLAVGAPLSADPRIAKVSFTGSNAVGVQVMQRAAETVKGVSLELGGKSSLLILEDADLDLAVELACGGGFFNAGQMCSATSRVLVADELADEFLIRLKAHAEKIRVADPFDPEVEMGALVNQAQYQRVLGHIDRGLSAGAKLICGGNRPADLPRGYFLQPTIFTEVPLDSALWCEEIFGPVICVRSFATEAEAIALANDSQFGLVASVVTRNAETADRVANALQAGLVWLNAPQVIFPQTAWGGYKQSSIGRELGPWGLAAFQEIKHVIR

SEQ ID NO: 13707 - protein, 395 aa, Pseudomonas fluorescens
LHPVAGFELGIASAGIKRPGRKDVVVMRCAEGSTVAGVFTLNAFCAAPVILAKKRVQNAVRYLLTNTGNANAGTGEPGLAAAERTTAKLAELTGVDASQILPYSTGVIGEPLPVEKIEGALQAALDDLSENNWEAAATGIMTTDTLPKGASRQFQHDGVTITVTGISKGAGMIRPNMATMLGYIATDAKVSRDVLQNLMLDGANKSFNRITIDGDTSTNDCCMLIATGKAALPEINRAEGELFAKLKQAVFEVCMDVAQAIVRDGEGATKFVTVEVNGGGNHQECLDVGYTVAHSPLIKTALFASDPNWGRILAAVGRAGVPDLDVSKIDVFLGEVCIASRGARAATYTEAQGSAVMQQEEITIRIELGRGDCSETIWTTDLSHEYVKINAEYRT

SEQ ID NO: 13708 - protein, 125 aa, Pseudomonas fluorescens
MSNIPAELRFAESHEWARLEADGTVTVGISDHAQEALGDVVFVELAEVGKVFAAGDTAGVVESVKAASDIYSPVGGEVIAVNEDLAGSPEELNNDPYAAWIFKLKPSDKAELDKLLDAAAYKAAI

SEQ ID NO: 13709 - protein, 444 aa, Pseudomonas fluorescens
MIHIPKAEYARRRKALMAQMEPNSIAILPAAAVAIRNRDVEHVYRQDSDFQYLSGFPEPQAVIVLMPGREHGEYVLFCRERNAERELWDGLRAGQEGAIRDFGADDAFPITDIDDILPGLIEGRDRVYSAMGSNPEFDRHLMDWINVIRSKAHLGAQPPNEFVALDHLLHDMRLYKSAAEVKVMREAARISAQAHIRAMQASRAGLYEYSLEAELDYEFRKGGAKMPAYGSIVAAGRNSCILHYQQNDALLKDGDLVLIDAGCEIDCYASDITRTWPVNGKFSAEQKAIYELVLASQEAAFAEIAPNKHWNQAHEATVRVITTGLVKLGLLQGEVDELIATEAYKAFYMHRAGHWLGMDVHDVGEYKVGGEWRVLEVGMALTVEPGIYIAPDNQNVAKKWRGIGVRIEDDVVVTKSGCEILTGGVPKTVAEIEALMAQARTCAA

SEQ ID NO: 13710 - protein, 535 aa, Pseudomonas fluorescens
ITHRYGERQALDGIAFGLPAGTRCGLIGPDGAGKSSLLGLIAGVKALQQGQLEVLGGPIQDRSHRNTLYARIAFMPQGLGGNLYPELSIRENVHFFATLFGLSADESAQRLHNLLLATDLLRFADRPAGKLSGGMKQKLGLCCALIHEPDLLILDEPTTGVDPLSRRKFWELIDDVRRQRPQLTLLVATAYMEEAEQFEHCLMLDGGRMIATGLSRELAAVTPSGKLDDAFTHFQGESRHATQPLHIPPYTGNTDIAIEAHDLTLRFGNFTAVDRVSFAIGRGEIFGFLGSNGCGKTTTMKVLTGLMPASEGNATLLGNPVDAKDLATRKRVGFMSQSFSLYGELSVRQNLELHARLFDLPKTESAQRIDALIQRFDLHGVANQSSGALPLGIRQRLSLAVAVLHSPEVLILDEPTSGVDPAARDDFWRLLIELSRDQGVTIFLSTHFMNEAQRCDRISLMHAGKVLACDTPTALQQQFGGKSLEAAFVTCLEQAQGSAETAPPPAPSPAPKAPASSVRERVFSFGHLTPVARRE

SEQ ID NO: 13711 - protein, 284 aa, Pseudomonas fluorescens
MPIAQLISPTALDARKAQPGLVILDCRFALEDPDYGQRSYAEGHIAGAHFADLERDLSGPVTKGVTGRHPLPEPAALIERLQAFGINNDSDVVLYDDGPGAYAARAWWLLAWLGKRDGVFILDGGLKAWHAAGLPLSLDPPSAARGSFSGQPDMSLLLSAEQLQQRLGQPALTLLDARALPRFKGEVEPIDPIAGHIPGAQCAAFTDNLGSDGRFLPADQLKQRFAAKLGERSPSDLVAYCGSGVTACHNLFALCLAGYPLGSLYAGSWSEWINDPARGIASGE

SEQ ID NO: 13712 - protein, 455 aa, Pseudomonas fluorescens
  unsure (1)..(455): unsure at all Xaa locations
AAQQVXKRMNALARRAAGLLLSTVCLPLSALAADPQPTHEFTLDNGLKVVVREDHRAPVVVSQVWYKVGSSYETPGQTGLSHALEHMMFKGSEKVGPGEASLILRDLGAEENAFTSDDFTAYYQVLARDRLGVAFELEADRMANLRLPADEFAKEIEVIKEERRLRTDDKPMAKAYERYKAMAYPASGYHTPTIGWMADLERMKVEELRHWYQSWYVPNNATLVVVGDVTPDEVKTLAQRYFGPIPKRDVPPAKKPLELAEPGERQITLHVQTQLPSLMLGFNVPSIATAEDKRSVNALRLISALLDGGYSGRIPTQLERGEELVSGGSSSYDAYTRGDSLFTLSATPNTQKKKTMAQAEAGLWKLLEQLKTSAPSAEELERVRAQVIAGLVFERDSITSQATAIGQLETVGLSWKLMDTELADLESVTPQDIQNAAKLYFTRERLSVAHVLPLE

SEQ ID NO: 13713 - protein, 272 aa, Pseudomonas fluorescens
MSNTRIAFIGAGNMAASLIGGLRAKGLEAAHIRASDPGEETRAKVSAEHGIETFADNAQAIDGADVVVLAVKPQAMKLVCEAIRPSLKPNQLVVSIAAGITCASMTAWLGEQPIVRCMPNTPALLRQGVSGLYATGKVSAEQRQQAEELLSAVGIALWLNEEQQLDAVTAVSGSGPAYFFLLIEAMTAAGVKLGLPKETAEQLTLQTALGAAQMAVSSDVDAAELRRRVTSPAGTTEAAIKSFQAGGFEALVEKALGAAAHRSAEMAEQLGK

SEQ ID NO: 13714 - protein, 333 aa, Pseudomonas fluorescens
MTPLDTKRPLQLNDQGQLRHFLSLDGLRRELLTEILDTADSFLEVGARAVKKVPLLRGKTVCNVFFENSTRTRTTFELAAQRLSADVITLNVSTSSASKGETLLDTLRNLEAMAADMFVVRHGDSGAAHFIAEHVCPQVAIINGGDGRHAHPTQGMLDMLTIRRHKGGFENLSVAIVGDILHSRVARSNMLALKTLGCPDIRVIAPKTLLPIGIEQYGVKVYTDMTEGLKDVDVVIMLRLQRERMTGGLLPSEGEFYRLFGLTTARLAGAKPDCIVMHPGPINRGVEIESAVADGPHSVILNQVTYGIAIRMAVLSMAMSGQTAQRQFEQENA

SEQ ID NO: 13715 - protein, 587 aa, Pseudomonas fluorescens
MIPMLSSRHRRALRLTSSFLAPYRWPAFGALLALIVTAGITLSMGQGIKLLVDQGFMTQSPHLLNQSIGLFMLLVLGLAVGTFARFYLVSWIGERVVADIRRQVFNHLVYLHPGFYEDNRSSEIQSRLTADTTLLQSVIGSSLSLFLRNLLMVIGGVVLLFITNPKLTSIVVIALPLVIAPILIFGRRVRNLSRLSQDRIADIGSYVSETLGQIKTVQAYNHQVQDEQRFASTVEQAFETARKRIFQRAWLITLVIVLVLGAVAVMLWVGGMDVIAGRISAGELAAFVFYSLIVGSAFGTLSEVIGELQRAAGAAERIAELLRSENIIQPPTTGLVTLPERVKGELELQDVRFSYPSRPDSLAVDGLSLTINAGETLALVGPSGAGKSTVYDLLLRFYDPREGRILIDGVPLTSLDPLDLRRCFALVSQTPALFFGSVEENIRYGCPTATLEQVREAARIAHAHDFIEQMPDGYQTHLGDGGLGLSGGQRQRLAIARALLVDAPILLLDEATSALDAQSEHLIQQALPSLMQNRTTLVIAHRLATVKNADRIAVMDQGKLVAIGTHQELIASNPLYARLAALQFSDG

SEQ ID NO: 13716 - protein, 911 aa, Pseudomonas fluorescens
MPSLDSLNSLKTLKVDDKTYHYFSLPDAAKTLGDLDKLPMSLKVLLENLLRWEDEKTVTGADLKALAAWLKERRSDREIQYRPARVLMQDFTGVPAVVDLAAMRAAMAKAGGDPQRINPLSPVDLVIDHSVMVDKFASASAFEQNVDIEMQRNGERYAFLRWGQSAFDNFSVVPPGTGICHQVNLEYLGRTVWTKDEDGRTYAFPDTLVGTDSHTTMINGLGVLGWGVGGIEAEAAMLGQPVSMLIPEVIGFKLTGKLKEGITATDLVLTVTQMLRKKGVVGKFVEFYGDGLADLPLADRATIANMAPEYGATCGFFPVDDVTLDYLRLSGRPPEVVKLVEAYTKAQGLWRLPGQEPVFTDSLALDMGSVEASLAGPKRPQDRVSLPNVGQAFSDFLDLQFKPTSKEEGRLESEGGGGVAVGNADLVGETDYEYDGHTYRLKNGAVVIAAITSCTNTSNPSVMMAAGLLAKKAVEKGLTRKPWVKSSLAPGSKVVTDYYKAAGLTQYLDQLGFSLVGYGCTTCIGNSGPLPEPIEKAIQKADLTVASVLSGNRNFEGRVHPLVKTNWLASPPLVVAYALAGSVRTDISSEPLGNDQQGNPVYLRDIWPSSKEIADAVNQVNTAMFHKEYAEVFAGDEQWQAIEVPQAATYVWQADSTYIQHPPFFDDIAGPLPVIADVKGARVLALLGDSVTTDHISPAGNIKADSPAGRYLREQGVEPRDFNSYGSRRGNHEVMMRGTFANIRIRNEMLGGEEGGNTIYIPTGEKLAIYDAAMRYQASGTPLVVIAGQEYGTGSSRDWAAKGTNLLGVKAVIAESFERIHRSNLVGMGVLPLQFKLDQNRKSLNLTGKETLDIQGLSGVELTPRMNLTLVITRENGRQEKIEVLCRIDTLNEVEYFKSGGILHYVLRQLI

SEQ ID NO: 13717 - protein, 201 aa, Pseudomonas fluorescens
IKLYNFPRSGHAHRVELMLSLLQLPTELIFVDLAKGEHKQPGYLAINSFGQVPAIDDNGVVLADSNAILVYLAQKYGNGRWLPSDPVGAAHVQRWLSAAAGPIAFGPAAARLITVFGAKFNAEEVITRAHNFLKVMDLELGKTPYLAGTEPTIADVSAYSYIAHAPEGNVSLDDYANVRAWLSRIEALPGFVGMPRTVAGL

SEQ ID NO: 13718 - protein, 259 aa, Pseudomonas fluorescens
QADARLQAKALGDSWRPLRVAKVEMESRHIRSIYLEPNDGAGLPVFLAGQHLPLRFTLDGEVHIRTYSLSGAPSDDFFRISVKREGRVSTHLHEQIRVGDVLEARLPQGHFTVAALERKPLVLLAAGVGITPLLSMLREVVYQGLRTRRIRPTLFVQSSRSLADQPFRAEVDRLLEDAGDAVKVLRVLSQPEDDLVEGKDFDLRGRIDGDLLRNLLTDEDFDQVDFVLCGPGGFTQGIYDILRELNVRDGQIHAETFGP

SEQ ID NO: 13719 - protein, 323 aa, Pseudomonas fluorescens
MTKSALITGITGQDGAYLAKLLLDKGYKVHGLVARRSSDSRWRLREMGVEADIVYLDGDMADACSVQRAVIKSAPDEVYNLAAQSFVAASWDQPVTTGIVDGLGVTHLLEAIRQFSPHTRFYQASTSEMFGLIQAEQQDENTPFYPRSPYGVAKLYGHWITVNYRESFNLHASSGILFNHESPLRGIEFVTRKVTDAAARIKQGKQQELALGNIDAKRDWGFAGDYVEAMWLMLQQDKPDDFVVATGVTTTVREMCRIAFDHVGLNYRDYVKIDPAFFRPAEVEVLLGNPAKAQRVLGWKPKTDLDTLIRMMMDADMKRVAKE

SEQ ID NO: 13720 - protein, 904 aa, Pseudomonas fluorescens
MATIHVDGKALEVDGADNLLQACLSLGLDIPYFCWHPALGSVGACRQCAVKQYTDENDTRGRIVMSCMTPATDNTWISIDDEESKAFRASVVEWLMTNHPHDCPVCEEGGHCHLQDMTVMTGHNERRYRFTKRTHQNQQLGPFISHEMNRCIACYRCVRFYKDYAGGTDLGVFGAHDNVYFGRVEDGTLESEFSGNLTEVCPTGVFTDKTHSERYNRKWDMQFSPSICHGCSSGCNISPGERYGELRRIENRYNGSVNQYFLCDRGRFGYGYVNRTDRPRQPLLADGTKLGLDAALDKAADLLRGRNIVGIGSPRASLESNYALRELVGAEHFYSGIEASELERIRLVLQVLKDSPLPVPNMRDIEDHDAVFVLGEDLTQTAARMALALRQSVKGKAEDMAEAMRVQPWLDAAVKNIGQHELNPLFIASLAETKLDDIAEECVHAAPDDLARIGFAVAHALDASAPAVEGLDAEALELAKRIADALLAAKRPLIIAGTSLGSKALIEAAANIAKALKLREKNGSISLIVPEANSLGLAMLGGESVDAALQAVIDGKADAIVVLENDLYTRTAKAKVDAALNAAKVVIVADHQKTATSDRAHLVLPAASFAEGDGTLVSQEGRAQRFFQVFDPQYMDASILVHEGWRWLHALRATLLNQPIDWTQLDHVTAAVASSTPQLARIVDAAPSASFRIKGLKLAREPLRYSGRTAMRADISVHEPRTPQDKDTAFAFSMEGYSGSAEPRQQVPFAWSPGWNSPQAWNKFQDEVGGHLRAGDPGTRLIESTGDSLNWFASVPRAFNPAQGTWQAVPFYHLFGSDENSSKAAPVQERIPAAYVALAKSEADRLGVNDGALLSLNVAGQTLRLPLRINEELGAGLVALPAGIAGIPPAFAGVSVDGLQEAAQ

SEQ ID NO: 13721 - protein, 414 aa, Pseudomonas fluorescens
KIQVPAVGDKITVNADHSLNVPDNPIIPFIEGDGIGVDVSPVMIKVVDAAVEKAYGGKRKISWMEVYAGEKATQVYDQDTWLPQETLDAVKDYVVSIKGPLTTPVGGGIRSLNVALRQQLDLYVCLRPVVWFEGVPSPVKKPGDVDMVIFRENSEDIYAGIEWKAGSPEATKVIKFLKEEMGVTKIRFDQDCGIGIKPVSKEGTKRLVRKALQYVVDNDRKSLTIVHKGNIMKFTEGAFKDWGYEVAKEEFGAELLDGGPWMKFKNPKTGREVVVKDAIADAMLQQILLRPAEYDVIATLNLNGDYLSDALAAEVGGIGIAPGANLSDTVAMFEATHGTAPKYAGKDQVNPGSVILSAEMMLRHLGWTEAADLIIKGTNGAIKAKTVTYDFERLMEGATLVSSSGFGEALIKHM

SEQ ID NO: 13722 - protein, 749 aa, Pseudomonas fluorescens
LEVTLNLAFKEARSKRHEFMTVEHLLLALLDNEAAATVLRACGANLDKLKHDLQEFIDSTTPLIPVHDEDRETQPTLGFQRVLQRAVFHVQSSGKREVTGANVLVAIFSEQESQAVFLLKQQSVARIDVVNYIAHGISKVPGHGDHSEGEQDMQDDEGGESSSSGNPLDAYASNLNELARQGRIDPLVGRETEVERVAQILARRRKNNPLLVGEAGVGKTAIAEGLAKRIVDNQVPDLLANSVVYSLDLGALLAGTKYRGDFEKRFKALLNELKKRPQAILFIDEIHTIIGAGAASGGVMDASNLLKPLLSSGDIRCIGSTTFQEFRGIFEKDRALARRFQKVDVVEPSVEDTIGILRGLKGRFEQHHNIEYSDESLRAAAELASRYINDRHMPDKAIDVIDEAGAYQRLQPVEKRVKRIEVPEVEDIVAKIARIPPKHVTSSDKELLRNLERDLKLTVFGQDAAIDSLSTAIKLSRAGLKSPDKPVGSFLFAGPTGVGKTEAARQLAKALGIELVRFDMSEYMERHTVSRLIGAPPGYVGFDQGGLLTEAITKQPHCVLLLDEIEKAHPEVFNLLLQVMDHGTLTDNNGRKADFRNVIVIMTTNAGAETAARASIGFTHQDHSSDAMEVIKKSFTPEFRNRLDTIIQFGRLSHEVIKSVVDKFLTELQAQLEDKRVLLEVTDAARSWLAAGGYDSAMGARPMARLIQDKIKRPLAEEILFGELAEHGGVVHIDIKDGELTFDFETTAE

SEQ ID NO: 13723 - protein, 395 aa, Pseudomonas fluorescens
HFDAIGRVPGDPILGLMEAYAQDSNPRKFDLGVGVYKDAQGLTPIPEAVKIAEARLVESQDTKTYIGGHGNPLFGKVINELVLGVDSKLIAEQRAGATQTPGGTGALRLAADFIAQCLPGKGVWLSNPTWPIHETIFAAAGVKISHYPYVGSDNRLDVDAMLAVLNEVPKGDVVLLHACCHNPTGFDLSHDDWQRVLEVVRRRDLLPLIDFAYQGFGDGLEQDAWSTRLFAAELPELLITSSCSKNFGLYRDRTGALIVSAKTADKLIDIRSQLAHIARNLWSTPPDHGAAVVATILADPELKRRWADEVEAMRLRIAQLRSGLVEALEPHGLRERFAHIGVQRGMFSYTGLSPEQVKNLREHHSVYMVSSGRANVAGIDATRLDLLAEAIANVC

SEQ ID NO: 13724 - protein, 466 aa, Pseudomonas fluorescens
MSGQNSQSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYIHYWAPEIPSWVTAAAFFVLINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVILLSLTPWDSLLETLNASGDSYSGSPFVQVFSMLGSNTAAHILNFVVLTAALSVYNSGTYCNSRMLLGMAEQGDAPKALAKIDKRGVPVRSILASAAVTLVAVLLNYLIPQHALELLMSLVVATLVINWAMISFSHFKFRQHMNKTHQKPLFKALWYPYGNYICLAFVLFILGVMLLIPGIQISVYAIPVWVVFMWICYVIKNKRGAQQALH

SEQ ID NO: 13725 - protein, 539 aa, Pseudomonas fluorescens
TALPAWQALKDHRQAMQDFSMREAFNADPQRFNQFTLSSCGLFLDYSKNLINAETRNLLVGLANEVDLKGAIKALFDGEIVNSSEGRPALHTALRRPVGDKLSVNGVNVMPEVHKVLNQITDLVGRIHDGLWRGYTEKPITDVVNIGIGGSFLGPELVSEALLSYAQKGVRCHYLANIDGSEFHELTQKLRAETTLFIVSSKSFNTLETLKNAQAARAWYLAQGGSEAELYRHFIAVSSNNAAAVAFGIREENIFPMWDWVGGRYSLWSAIGLPIALAIGMSNFKELLSGAYTMDQHFQSAPFEQNMPVLLALLGVWYGNFWGAQSHAILPYDHYLRNITKHLQQLDMESNGKSVRQDGTPVSTDTGPVIWGGVGCNGQHAYHQLLHQGTQLIPADFIVPIVSFNPVSDHHQWLYANCLSQSQALMLGKTLPEAEAELRDKGMSEDQVQKLAPHKVIPGNRPSNTLVVERISPRRLGALVAMYEHKVFVQSVVWGINAFDQWGVELGKELGKGVYNRLVGSEETAAEDASTQGLINYFR

SEQ ID NO: 13726 - protein, 649 aa, Pseudomonas fluorescens
NKNKEPVMFDISTFPKADAVRRAAQLSQDDYQRLYRESIEHPSTFWAEQATRFLDWSTPWQTVQRYDLKTGDAAWFAGGKLNVSYNCIDRHLETRGDQTAILWEGDDPAESTQITYSKLHHHVCRLANVLKSRGVKKGDRVCIYMPMIPEAAYAMLACARIGAIHSVVFGGFSPDSLRDRILDADCRTVITADEGVRGGKFVPLKQNVDKALQSCPNVSTVVVVERTQNKVDWVEGRDLWYHQAVRDVSDECPPEPMDAEDPLFILYTSGSTGKPKGVLHTTGGYLLQAAMTFKYVLDYRDGEVFWCTADVGWVTGHSYIVYGPLANGATTLIFEGVPSYPSTSRFWQVIDKHKVNIFYTAPTALRALMREGAGPLQETSRQSLKLLGSVGEPINPEAWEWYFNVVGEQRCPIVDTWWQTETGGIMLSPLVSAQQIKPGCATRPMFGVQPVLLDEHGKEIKGAGSGVLAIKSSWPAQIRSVYGDPQRMVDTYFKPYPGYYFTGDGARRDEDGDYWITGRIDDVINVSGHRIGTAEVESALVLHDSIAEAAVVGYPHDVKGQGIYAFVTPMNGTEPNDELKKELLAHVSKEIGSFAKPDLIQWAPALPKTRSGKIMRRILRKIACNELDSLGDTSTLADPSVVQGLIDKR

SEQ ID NO: 13727 - protein, 1162 aa, Pseudomonas fluorescens
LRLKCIKLAGFKSFVDPTTVNFPSNMAAVVGPNGCGKSNIIDAVRWVMGESSAKNLRGESMTDVIFNGSTSRKPVSQASIELVFDNSDGTLLGEWAAYAEISIRRKVTRDSQTTYYLNGAKCRRRDITDIFLGTGLGPRSYSIIEQGMISKLIESKPEDLRNFIEEAAGISKYKERRRETENRIRRTHENLARLTDLREELERQLERLHRQAEAAKKYQEYKAEERQLKAQLSALRWQDLNDQVSQRESIIGNQEISFEALVAEQRNADAAIERLRDGHHDLSERFNLVQGRFYSVGGDIARVEQSIQHGQQRLRQLQDDLKEAERARLETESHLGHDRTLLLTLGEELDQLTPEQEITNAAAEDAAAALEDSETVMHGWQEQWDAFNLTAAEPRRQAEVQQSRIQQLETSMERLADRQKRLSEERALLSADPEDAAIMELSEQLAESEATLEDLQTSEAAQVEKLEQLRQELQQALTAQQQAQGDLQRLNGRLASLEALQQAALDPGTGTAEWLKEHNLAERPRLAEGLKVEAGWELAVETVLGADLQAVLVDDFDGFDLSGFAQGDLRLLSPGNDGVRVAGSLLDKVEAQVDLSPWLAQVKPVDSLEQALALRGQLAAGQSLISRDGYWVGRHFLRVRRASEAESGMLARGQEIESLHAEREEREATVEAMEARLQTLRAQQRQQENGREHLRRLLQDEARQQGELKAQLSAGKAKAEQLNLRRTRLDEELVELAEQRELEHENIGEARIQLQEALDAMALDTEQRELLLAQRDSLRERLDRVRQEARQHKDHAHQLAVRLGSLRAQHDSTRQALERLEMQAERLTEKREQLSLNLEEGEAPLEELRLKLEELLDKRMSVDDELKTAQIALEDADRELRDAEKRRTQAEQQSQLIRGQLEQQRMEWQALTVRRKALQDQLLEDGYDLHGVLNTLTAEASERAAEEELERIAARIQRLGAINLAAIDEYQQQSERKRYLDAQDADLVEALETLENVIRKIDKETRNRFKDTFDQINGGLQALFPKVFGGGRAYLELTGEDLLDTGVTIMAQPPGKKNSTIHLLSGGEKALTALALVFAIFKLNPAPFCMLDEVDAPLDDANVGRYARLVKEMSQTVQFIYITHNKIAMEMADQLMGVTMHEPGCSRLVAVDVEEAMAMVDA

SEQ ID NO: 13728 - protein, 337 aa, Pseudomonas fluorescens
MYTLARQLLFKLSPETSHDLSLDLIGAGGRLGLNGLLCKAPASLPVNVMGLQFPNPVGLAAGLDKNGAAIDGFAQLGFGFVEIGTVTPRPQPGNPKPRIFRLPEAEAIINRMGFNNLGVDNLLARVAAAKYKGVLGINIGKNFDTPVERAVDDYLICLDKVYAHASYVTVNVSSPNTPGLRSLQFGDSLKQLLADLATRRAELALRHGKHVPLAIKIAPDMTDEETAQVAQALIETGMDAVIATNTTLSRVGVEGMEHGDEAGGLSGAPVREKSTHTVKVLASELGGKLPIIAAGGITEGKHAAEKIAAGASLVQIYSGFIYKGPALIRESVDAIAA

SEQ ID NO: 13729 - protein, 699 aa, Pseudomonas fluorescens
TTASTCCYCGVGCGVLIEHDGERILGVSGDPAHPANFGKLCSKGSTLHLTGDLAARALYPELRLGKGLARSRCDWDTALDHATNVFADTIAEHGPDSVAFYISGQLLTEDYYAFNKLARALVGTNNIDSNSRLCMSSAVVGYKRSLGADAPPCSYEDLELSDCVVIVGSNMAYAHPVLFRRLEEAKSRRPQMKVVVIDPRRTDTCDLADLHLAILPGTDVALFHGILHLLLWEDWIDRDFIKAHTDGLAELKSLVRDYTPAMVSQLCGISVEQLQQCAEWIGTAPSFLSLWCMGLNQSTAGSAKNSALINLHLATGQIGRPGAGPFSLTGQPNAMGGRETGSLSNLLPGHREVANPEHRAEVAAYWGVDKLPENTGLSAIELFEQVRGGKIKALWIACTNPAQSMPDQTAVRAALETCPFVVLQEAFRTTETAAFADLLLPAASWGEKEGSVTNSERRISHVRQAIAAPGEARPDWAITVDFAQRLEKRLRPQQPGLFAFEQPAQLFDEYKQLTRGRDLDLSGISHGLIDELGPQQWPFPAGARQGTARLYGDGIFPTANGRARFVADPYRAAKEQRDARFPLTLITGRLRDQWHGMSRTGTAAQLFGHVSEAVLSLHPDELRRHRLQPGDLVNLKSRRGAVIVAVASDDSVRPGQAFLPMHWGDRFLKGGVNSLTLPAFDPLSKQPELKHSGVRLEPV

SEQ ID NO: 13730 - protein, 127 aa, Pseudomonas fluorescens
MSELRFTEDHEWLRAEADGSVTVGITAFAQNALGDVVFVQLPELQAYEKGAEAATVESVKAASGVYMPLDGEVLATNPALEDSPELVNEDPLGEGWFFRFKPADATAVAKLLDQDAYDRLIKAQAEA

SEQ ID NO: 13731 - protein, 336 aa, Pseudomonas fluorescens
MAFNIHNRNLLSLEHHTPRELRYLLDLSRDLKRAKYTGTEQQHLKGNNIALIFEKTSTRTRCAFEVAAYDQGANVTYIDPNSSQIGHKESMKDTARVLGRMYDAIEYRGFKQEIVEELAKFAGVPVFNGLTDEYHPTQMIADVLTMREHADKPIHEISYAYLGDARNNMGNSLLLIGAKLGMDVRICAPKALWPHDDLVDRCKKYAEESGARITLTEDPKAAVKGVDFIHTDVWVSMGEPVEAWAERIQQLLPYQVNAELMKATGNPRTKFMHCLPAFHNSDTKVGKQIAEQYPHLKNGIEVTDDVFESPACIAFEQAENRMHTIKAILVSTLADL

SEQ ID NO: 13732 - protein, 418 aa, Pseudomonas fluorescens
MTTEKAKYGVHSEAGKLRKVMVCSPGLAHQRLTPNNCDELLFDDVLWVAQAKRDHFDFVTKMRERGIDVLEMHNLLTDIVGNPEALDWILERKVTADSVGLGLINEVKSWLKSLEPRHIAEFLIGGVSADDLPDSFGGKTIQMFRDFLGHSSFILPPLPNTQFTRDTTCWIYGGVTLNPMYWPARRQETLLTTAIYKFHPQFTNADFEIWYGDPDKDHGSSTLEGGDVMPIGNGVVLIGMGERSSRQAIGQLALNLFKNKAVEKVIVAGLPKSRAAMHLDTVFSFCDRDLVTIFPEVVNQIVAFTLRPDESKQGGIDIRREEGTFLDVVAKALNLPKLRVVETGGNSFAAEREQWDDGNNVVAVEPGVVIGYDRNTYTNTLLRKAGVEVITISAGELGRGRGGGHCMTCPIIRDPIDY

SEQ ID NO: 13733 - protein, 475 aa, Pseudomonas fluorescens
MSQPTQKLRLGALIALVVGSMIGGGIFSLPQNMAARADAGAILIGWGITAIGMLTLAFVFQTLANRKPELDSGVYAYAKAGFGDYMGFSSAWGYWISAWLGNVGYFVLLFSTLGYFFPVFGQGNTPIAIGCASVLLWAVHFLVMRGIKEAALINQLTTVAKIIPLIMFVVIAAVAFKADVFTRDIWGRSNPNFGGVMDQVRNMMLVTVFVFIGIEGASVYSARAEKRTDVGRATVIGFLGVLALLVLVNVLSLGIMSQPELATLQNPSLAAVLEHIVGPWGALLISVGLAISLLGALLSWALLCAEILFATAKDNTMPAFLKKENANHVPVNALWLTNVMIQIFLLITLFSAGTYTSLIYLASSMILVPYLWSAAYAVLLSGRGETYEHASAERTKDLLIGGIALCYAVWLLYAGGVKYLLLSALLYAPGVILFAKAKHEQGEPLFTTLEKGIFTCVIAGAGLAAYGLYSGVLSL

SEQ ID NO: 13734 - protein, 480 aa, Pseudomonas fluorescens
TVEPCTFALFGALGDLALRKLFPALYHLDGAGLLHEDTRIIALAREAGTEQQHLAFIAAELRRYVGKELDEAVAERFLARLTYLHVDFLKAEDYVALAELAGSTQRMIAYFATPAAVYGAICENLANVGLAENTRVVLEKPIGSDLESSRKVNDAVAQFFPENRTYRIDHYLGKETVQNLIALRFANSLFETQWNQNYISHVEITVAEKVGIEGRWGYFDKAGQLRDMIQNHLLQLLCLIAMDPPADLSADSIRDEKVKVLKALAPISPEGLTTQVVRGQYIAGHSEGKSVPGYLEEPNSNAQSDTETFVALRADIRNWRWAGVPFYLRTGKRMPQKLSQIVIHFKEPSHYIFAPEQRLQISNKLIIRLQPDEGISLRVMTKEQGLDKGMQLRSGPLQLNFSDTWRSARIPDAYERLLLEVMNGNQNLFVRKDEIEAAWKWCDQLIAGWKKSGDAPKPYAAGSWGPMSSIALITRDGRSW

SEQ ID NO: 13735 - protein, 309 aa, Pseudomonas fluorescens
FWLDASDRSRLFVNHWLPNAPLKAVILLAHGMAEHSGRYARLAEAFCAEGYGVYAPDQRGHGKTADHGTLGHFADDDGWCKVVGDLASLNQFLGQRHSGVPIVLLGHSMGSYIAQAYLLHHSASLHGAILSGSNFQPVALYRAARQIARFEKLRQGAKGRSALIEWLSFGSFNNKFKPARTAFDWLSRDPAEVDKYATDPLCGFRCTNQLWIDLLGGLQQISKASNLAQIDPGLPLLVIGGECDPVSEGKRLTDLANALRAAGSQNLQLKIYPQARHELFNESNRDEVTADVMAWIDHALSHRRPHRSE

SEQ ID NO: 13736 - protein, 562 aa, Pseudomonas fluorescens
MQPDFWNDKRPAGVPLDIDAGEFKSVIEVFERSCKKFADRPAFSNMGVTLTYAELERQSAAFAGYLQAHTDLVPGDRIAVQMPNVLHYPIAVFGALRAGLIVVNTNPLYTAREMRHQFKDSGARALVYLNMFGQKVQEVLADTDIQYLIEAKMGDLMPTAKGWLVNTVVSKVKKMVPAYSLPQAISFKSALRMGRGLGIKPLKVGLDDIAVLQYTGGTTGLAKGAMLTHGNLVANMQQVRACLGQFGSDGQPLLREGQEVMIAPLPLYHIYAFTANCMCMMVSGNHNVLITNPRDIGGFIKELKNWKFSALLGLNTLFVALMDHPDFKTLDFSTLKLTNSGGTALVKATAERWEQITGCRITEGYGLTETSPVACTNPYGELSRIGTVGLPVPGTLLKVINDDGVEQPLGERGELCIKGPQIMKGYWNKPEATAEVLDAEGWFKSGDIAVIDPDGFVRIVDRKKDMIIVSGFNVYPNEIEDVVMAHPKVANCAVIGVPDERSGEAVKLFVVARETGVSLEELKAYCKENFTAYKVPKHIVLRESLPMTPVGKILRRELRDIA

SEQ ID NO: 13737 - protein, 562 aa, Pseudomonas fluorescens
MIEDFWKDKYPAGIAADINPDEYPNIQAVLKQSCQRFADKPAFSNLGKTLTYGELYELSGAFAAYLQQHTDLQPGDRIAVQLPNVLQYPVAVFGAIRAGLIVVNTNPLYTAREMEHQFNDSGAKALVCLANMAHLAETVVPKTGVKHVIVTEVADLLPPIKRLLINSVIKYVKKMVPAYHLPKAVKFNDVLSKGQGQPVAEANPDSGDVAVLQYTGGTTGVAKGAMLTHRNLVANMLQCKALMGSNLNEGCEILITPLPLYHIYAFTFHCMAMMLIGNHNILISNPRDLPAMVKELSKWKFSGFVGLNTLFVALCNNEGFRKLDFSALKVTLSGGMALQLAAAERWKAVTGCPICEGYGMTETSPVATVNPIQNIQIGTIGIPVPSTLCKVIDDAGVEQPLGEIGELCVKGPQVMKGYWQRQEATDEMLDSEGWLKTGDIALIQPDGYMRIVDRKKDMILVSGFNVYPNELEDVLAALPGVLQCAAIGVPDEKSGEAIKIFIVAKPGVTLTKEQVMEHMRANVTGYKVPRSVEFRDALPTTNVGKILRRELRDEELKKIKAK

SEQ ID NO: 13738 - protein, 451 aa, Pseudomonas fluorescens
ISARIDRLPAVATIWRLVALLSIGGFFELYDLFQTAYISPGLIRDGIFAIGNQGVFGFSDQAAFASATFLGLFLGASLLSPMADRFGRRAIFTFALVWYTVATVLMGVQSSALGIICMRFLVGIGLGIELVTIDAYLSELVPKRMRSSAFAFAFFVQFLSVPAVALMSWWLVPQAPFGISGWRWVVLASAVFALFIWWLRKRLPESPRWLAQHGRFDEANRILDGIEARCEKDHRQPLDAPEAVAVDVEGKGRFADIWQPPYRRRALMLIVFHIFQAIGFFGFGNWLPALLSGQGVSVTHSLMYAFIITLAYPLGPLLFVKFANRFENKWQIVGSALGAMTFGTLFALQTSAVGLIFCGVMITFCNAWLSFSYHSYQSELFPTNIRARAVGFCYSFSRLSTVFSSLLIGLFLDHFGTPGVLAFIVASMLIVMLTIGCFGPRTRNLALENIA

SEQ ID NO: 13739 - protein, 798 aa, Pseudomonas fluorescens
MKTTIELPLLPLRDVVVYPHMVIPLFVGREKSIEALEAAMTGDKQILLLAQRNPADDDPGEEALYRVGTIATVLQLLKLPDGTVKVLVEGEQRGAVERFSEVDGHCRAEVSLIDEVDAAERESEVFVRSLLSQFEQYVQLGKKVPAEVLSSLNSIDEPGRLVDTMAAHMALKIEQKQEILEIIDLSARVEHVLALLDAEIDLLQVEKRIRGRVKKQMERSQREYYLNEQMKAIQKELGDSDEGHNEIEDLKKRIDAAGLPKDALAKATAELNKLKQMSPMSAEATVVRSYIDWLVQVPWKAQSKVRLDLARAEDILDADHYGLEEVKERILEYLAVQKRVKKIRGPVLCLVGPPGVGKTSLAESIAHATNRKFVRMALGGVRDEAEIRGHRRTYIGSMPGRLIQKMTKVGVRNPLFLLDEIDKMGSDMRGDPASALLEVLDPEQNHNFNDHYLEVDYDLSDVMFLCTSNSMNIPPALLDRMEVIRLPGYTEDEKINIAVKYLSPKQIAANGLKKGELEFDEEAIRDIIRYYTREAGVRGLERQIAKVCRKAVKEHALEKRFSVKVTADLLEHFLGVRKFRYGLAEQQDQIGQVTGLAWTQVGGELLTIEAAVVPGKGQLIKTGSLGDVMVESITAALTVVRSRAKSLGIPLDFHEKRDTHIHMPEGATPKDGPSAGVGMCTALVSALTGIPVRADVAMTGEITLRGQVLAIGGLKEKLLAAHRGGIKTVIIPEENVRDLKEIPDNIKQDLQIKPVKWIDEVLQIALQYAPEPLPDVAPEIVAKDEKRESDSKERISTH

SEQ ID NO: 13740 - protein, 490 aa, Pseudomonas fluorescens
LDRLGVNPALYQNGKVPVHSPIDGSRIGAVNWEGPAEVEQHISRADHAFEQWRKVPAPRRGELVRQFGEVLREYKTELGELVSWEAGKITQEGLGEVQEMIDICDFAVGLSRQLYGLTIASERPGHHMRETWHPLGVVGVISAFNFPVAVWAWNTTLALVCGNPVVWKPSEKTPLTALACQALFERVLKNFSDAPAHLSQVIIGGRDAGEALVDDPRVALISATGSTRMGREVAPKVAARFARSILELGGNNAMILGPSADLDMAVRAILFSAVGTAGQRCTTLRRLIAHESVKEEIVTRLKAAYSKVRIGHPLEGNLIGPLIDKHSFENMQDALEQALSEGGRVFGGKRQLEDQFPNAYYVSPAIVEMPEQSDVVCSETFAPILYVVGYSDFEEALRLNNAVPQGLSSCIFTTDVREAEKFMSAVGSDCGIANVNIGPSGAEIGGAFGGEKETGGGRESGSDAWRAYMRRQTNTVNYSLELPLAQGITF

SEQ ID NO: 13741 - protein, 448 aa, Pseudomonas fluorescens
MSQPWSPDSWRALPIQQQPQYPDAAHLRQVEQTLASYPPLVFAGEARELRRQFAEVTQGRAFLLQGGDCAESFAEFSAAKIRDTFKVLLQMAIVMTFAAGCPVVKVGRMAGQFAKPRSANDETIDGVTLPAYRGDIVNGIGFDSASRVPDPERLLQSYHQSTATLNLLRAFAQGGFADLHQVHKWNLDFIANSALAEKYSHLADRIDETLAFMRACGMDSSPQLRETSFFTAHEALLLNYEEAFVRRDSLTNDYYDCSAHMLWIGDRTRQLDGAHVEFLRGVNNPIGVKVGPSMNPDDLIRLIDVLNPDNDPGRLNLIARMGANKVGVHLPALIRAVQREGKQVLWSSDPMHGNTIKASSGYKTRDFAQILGEVKQFFQVHEAEGSYAGGIHIEMTGQNVTECIGGARPITEDGLSDRYHTHCDPRMNADQSLELAFLIAETLKQVKR

SEQ ID NO: 13742 - protein, 568 aa, Pseudomonas fluorescens
MGLCGCLRGRPMTQEIGGFAALELHPNIVAAVVATGYEEPSAIQQQSIPIILAGHDMIGQAQTGTGKTAAFALPILHRIDPSKREPQALILAPTRELALQVATAFETYAKQMPGVTVVAVYGGAPMGPQLKAIRNGAQIVVATPGRLCDHLRRDEKVLQTVNHLVLDEADEMLKLGFMDDLEVIFKAMPETRQTVLFSATLPQSIRAIAERHLRDPKHVKIQSKTQTVTAIEQAHLLVHADQKTSAVLSLLEVEDFDALIMFVRTKQATLDLASALDAKGYKAAALNGDIAQNQRERVIDSLKDGRLDIVVATDVAARGLDVPRITHVFNVDMPYDPESYVHRIGRTGRAGREGRALLLVTPRERRMLQVIERVTGQKVAEVRLPDAQAVLDARIKKLTNSLSPLVADAESTHGDLLDRLTADIGCTPRALAAALLRKATNGQALNLAAIEKERPLVPNSAPRGDRPERSGDRPDRGDRERRAPMPLGEGRARCRTALGARDGIAAKNLLGAILNEGGLAREAIGRIQVRDSFSLVELPEDGLDKLLTKLKDTRVAGKQLKLRRYRED

SEQ ID NO: 13743 - protein, 256 aa, Pseudomonas fluorescens
MHPYFSLQGRTALVTGGTRGIGKMIAKAYVEAGARVYVCSRDAEACHQTAEELSALGTCLGIAANLATEEGVKELAARLGEQITHLDILVNNAGTTWGAPLESYPVKGWEKVMQLNVTSVFSCIQQFLPLLRKSGSAANPARIINIGSVAGISSFGEQAYAYGPSKAALHQLSRILARELVSQHINVNVIAPGRFPSKMTQHIGSDQQALADDTALIPMKRWGREEEMAALAISLASTAGAYMTGNIIPLDGGFSL

SEQ ID NO: 13744 - protein, 891 aa, Pseudomonas fluorescens
  unsure (1)..(891): unsure at all Xaa locations
MINVDLQQLIQALDAETRRDLERSAERCVARGGSKILVEDLLLGLLERPNGLLSRALQDADVDAGELSAALQSRVEHSASRNPVFAPELVQWLQDALLVANLELGQTSVEDAALILALLRNPMRYAGSRYQPLLAKLNIDRLKEFALSQQPQAAANGKPAAQGESLLERFTHNLTQQARDGKLDPVLCRDGAIRQMVDILARRRKNNPIVVGEAGVGKTAIVEGLASRIAAGEVPQVLKGVELLSLDMGLLQAGASVKGEFERRLKGVIDEVKASPKPIILFIDEAHTLIGAGGNAGGSDAANLLKPALARGELRTIAATTWAEYKKYFEKDPALARRFQPVQLHEPTVSEAVTILRGLAQVYEKSHGIYLRDDAVVSAAELSARYLAGRQLPDKAVDVLDTACARVRISLAAAPESLERLRGELAEGGRQRQALRRDAEAGLLIDHEALEALEARLDEAEAEMVALETQWTEQKQLAERLLELRQQLAKAREAAAVEPVVTVEEDAEGTVIETHAAEVDEALSVEALEAQLNETHSALTAAQVKERLVSFEVCPRLVAEVISAWTGVPLAQLAREHNAKVASFATDLRTRIRGQEQAVHALDRSMRATAAGLNKPDAPVGVFLLVGPSGVGKTETALALADLLYGGDRFITTINMSEFQEKHTVSRLIGAPPGYVGYGEGGMLTEAVRQKPYSVVLLDEVEKADPDVLNLFYQIFDKGVANDGEGREIDFRNTLILMTSNLGSDKISDLCEDGARPTAEVLEETIRPVLSKHFKPALLARMKVVPYYPVGGPVLRELIEIKLGRLGERLNRRQLDFTWCQNLVDHLSERCTQSESGARLIDHLLDQHVLPLVADRLLDAMATGESLKRVHATLDGEASVTCEFAXGECDV

SEQ ID NO: 13745 - protein, 247 aa, Pseudomonas fluorescens
MDHVFQGKLAVITGASSGIGLAATERLLDQGARVLAMSRKLGALAELLERYPQQLVWHSGDVAQAADLAALAEQAARIGPVSFVVPNAGIAELADGLDSSAFGRQWAVNGAGALNTLAALRPHLADKASVVFIGTFLARISFAGLAAYIASKAALIAHARTLAVELAPHGVRINCVSPGPTATPIWSTLGLSDEALGDVAQGVNKRLLGGQFLEPAAVADVILFQLGNGARGVIGQDWVVDSGYTLS

SEQ ID NO: 13746 - protein, 456 aa, Pseudomonas fluorescens
QSLNTTLLIIGGGPGGYVTAIRAGQLGISTILVEGESLGGTCLNIGCIPSKALIHVAEQFHQTQHHNQHSALGISVSAPTLDITKSVEWKDGIVDRLTTGVAALLKKNKVQVINGWAKVIDGKTVEVGDTRIQCEHLVLATGSKSVNLPILPIGGPIISSTEALAPKSVPKRLIVVGGGYIGLELGIAYRKLGAEVSVVEAQDRILPAYDAELTQPVHDALKQLGVKLYLKHSVLGFDGTLQVRDPNGDTLNLETDQVLVAVGRKPNTQGWNLEALNLDMNGSAIKIDSRCQTSMRNVYAIGDLSGEPMLAHRAMAQGEMVAELISGKTREFNPTAIAAVCFTDPELVVVGKTPDEAKAAGLDCIVSNFPFAANGRAMTLESKTGFVRVVARRDNHVIVGWQAVGVGVSELSTAFAQSLEMGARLEDIGGTIHAHPTLGEAVQEAALRALGHALHL

SEQ ID NO: 13747 - protein, 423 aa, Pseudomonas fluorescens
MGTHVIKMPDIGEGIAEVELSQWHVKVGDLVVEDQVLADVMTDKAMVDIPSPVHGKVIALGGQPGEVMAVGSILISIEVEGAGNLKESDKPAPVAAKETPVAPKVEAVVESKPAAPRTAPVCQGPMVARQADERPLASPAVRKHALDLGIQLRLVRGSGPAGRVLHEDLDAYLAQGQSNASAPVAAAYAQRNDEEQIQVIGMRRKIAQRMQDATQRAAHFSYVEEIDVTAIEELRAHLNEKHGASRGKLTLLPFLVRALVVALRDFPQMNARYDDEAQVITRLGAVHVGVATQSDVGLMVPVVRHAEARSLWDSAAEISRLANAARNGKASRDELSGSTITLTSLGALGGIVSTPVLNLPEVAIVGVNKIVERPMVVKGQVVIRKMMNLSSSFDHRVVDGMDAALFIQAIRGLLEQPATLFVE

SEQ ID NO: 13748 - protein, 352 aa, Pseudomonas fluorescens
MNDHNNNIQLETAMTTTTMTMIQALRSAMDVMLERDDNVVVFGQDVGYFGGVFRCTEGLQTKYGTSRVFDAPISESGIVGVAVGMGAYGLRPVAEIQFADYVYPASDQIISEAARLRYRSAGEFTAPMTLRMPCGGGIYGGQTHSQSIEAMFTQVCGLRTVMPSNPYDAKGLLIASIENDDPVIFLEPKRLYNGPFDGHHDRPVTPWSKHPQAQVPDGYYTVPLDVAAITRPGKDVTVLTYGTTVYVSQVAAEESGVDAEVIDLRSLWPLDLETIVKSVKKTGRCVVVHEATRTCGFGAELVSLVQEHCFHHLEAPIERVTGWDTPYPHAQEWAYFPGPSRVGAALKRVMEV

SEQ ID NO: 13749 - protein, 299 aa, Pseudomonas fluorescens
  unsure (1)..(299): unsure at all Xaa locations
ELIVDARNAVGESPVWVPQENALYWVDIPNGGLQRWDADTGHVHAWKAPEMLACLARHSRGGWVAGMESGFFQLRPHSDGSLDSDLLATVEHSRQDMRLNDGRCDRQGRFWAGSMVLNMGLNLPEGRLYRYAAGQTGAIEAQLDGFIVPNGLGFSPDGKTMYLSDSHPNVQLIWAFDYDICSVGHTPFQTRRGGSVXDMXTHFYGRPDALPXAGQIARSCYWICANDVGLIHRFTPEGRLDRSLPVPVKKPTMCAFGGSRMDTLFVTSIRPADDQDPHSLAGGVFALNPGIKGLPEPLF

SEQ ID NO: 13750 - protein, 434 aa, Pseudomonas fluorescens
VKPVKVGICGLGTVGGGTFNVLQRNAEEIARRAGRGIEVAQIAMRTPKPQFQTTGIAITNDVFEVATNPEIDIVIELMGGYTVARELVLKAIENGKHVVTANKALIAVHGNEIFAKAREKGVIVAFEAAVAGGIPVIKAIREGLSANRINWVAGIINGTGNFILTEMREKGRTFEDVLAEAQALGYAEADPTFDVEGIDAAHKLTILASIAFGVPLQFDKAYTEGITKLTTADVNYAEALGYRIKHLGVARSTAAGIELRVHPTLIPADRLIANVNGVMNAVMVNGDAAGSTLFYGAGAGMEPTASSVIADLVDVVRAMTSDPENRVPHLAFQPDSLSAHPILPIEACESAYYLRIQAKDHPGVLAQVASILSERGINIESIMQKEVEEHDGLVPMILLTHRVLEQHINDAIAALEALAGVVGPVVRIRVEHLN

SEQ ID NO: 13751 - protein, 474 aa, Pseudomonas fluorescens
MQTKLLINGQLVNGEGPAQPVLNPARGEVLVEINEATEAQVDAAVRAADSAFAEWSQTTPKDRSLLLLKLADAIEAHGEELAKLESDNCGKPYNAALNDEIPAIADVFRFFAGASRCMSGSAGGEYLPGHTSMIRRDPVGVIASIAPWNYPLMMVAWKIAPALAAGNTVVLKPSEQTPLTALRLAELASDIFPAGVLNLVFGRGPSVGSPLVTHPKVRMVSLTGSIATGSNIISSTADSVKRMHMELGGKAPVIIFDDADIDAAVEGIRTFGFYNAGQDCTAACRIYAQQGIYDKFVEKLGAAVSSIKYGLQDDPSTELGPLITAQHRDRVAGFVERAVAQPHIRLITGGKAVDGNGFFFEPTVLADAQQDDEIVRREVFGPVVSVTKFTDEAQALEWANDSDYGLASSVWTADVGRAHRLSARLQYGCTWVNTHFMLVSEMPHGGQKLSGYGKDMSMYGLEDYTTVRHVMFKH

SEQ ID NO: 13752 - protein, 474 aa, Pseudomonas fluorescens
MHTALLIDGELVAGQGFVEPILNPATGEVLTQIAEASTEQVEAAILAAHRAFAEWSRTTPQQRSNLLLEIANAVEKHADHLARLEALNCGKPLHLARQDDLTATIDVFRFFAGAVRCQTGQLSGEYVPGYTSMVRRDPIGVVASIAPWNYPIMMAAWKIAPALAAGNTLVFKPSEHTPLSILALAPALAEILPRGVINIVCGGGEGVGSHLVGHPKVRMVSLTGDIVTGQKILQAAAKTLKRTHLELGGKAPVIVCNDADLKAVVEGVRTYGYYNAGQDCTAACRIYAQAGIHDKLVAELGAAVSSLRFAGKRDADNEIGPLISTRQRDRVASFVERALGQPHIERVTGAAVHSGAGFFYQPTLLAGCKQSDEIVQREVFGPVVTVTRFDELAQAVDWANDSEYGLASSVWTQNLDKAMQVAARLQYGCTWINSHFMLASEMPHGGLKRSGYGKDLSSDSLQDYSVVRHIMARH

SEQ ID NO: 13753 - protein, 340 aa, Pseudomonas fluorescens
LTSKMLEEALSSFEAVQAQLQQLDPPMIEIAGRLRRQPPQVAMTVARGSSDHAASYFAYLTMQQLGVPVASLPMSVVTMQQAPLKVSGQVAFAFSQSGQSPDLVNSLRLLRKRGALSVSMVNAADSPLEAACEFSLPLLAGTESSVAATKSFIATLSASARLIAHWKEDAELLEAHNALPEGLREAAQQDWSPAIDALRDCERLMVIGRGAGFAIAQEAALKFKETSAIQAEAFSSAEVRHGPMALIDEHYPLLVFAPRGAEQAGLLSLAAEMRQRGARVLLAAPDDVSERDLTLSRAAHPALDPILAIQSFYVMAAGLAVARGMDHDQPRHLSKVTRTQ

SEQ ID NO: 13754 - protein, 825 aa, Pseudomonas fluorescens
APLSGPVLTLAKVPDAVFASGAMGDGIAIDPLNDTLYSPCAGVVIHVARTGHALTVRADNGAELLLHLGLDTVELQGEGFSMLVKEGARVSNGQPLLRYDLDKVGRQCKSLVSLLILTNSQDFQARPITLKTVKVGEPLLHIVARHSAAANTEELGGPQVHGHVKVAHRGGLHARPAALIRQTAQGFKSQSQLHFAGKSAPCNSLIGLMGLAIGEQDEVQVSCQGPDAQAALQALLVALATALPEDHHAAAPLAATPRNRPAEAGVLHGVCAAPGLVGGPLFRLNAISLPADSGNHQPEQQLQILDTALNQVRSEIDGTLAQAKKQRNADEEAIFAAHLALLEDPALLDAARQSIETGTAATHAWSQSIDAQCQVLQNTGSPLLAERANDLRDLKQRVLRALLGEAWHYDVPAGAIVAAHELTPSDLLQLSAQGVAGLCMAEGGATSHVAILARGKGLPCMVALGSVLLDQTQGQSVVLDADGGRLELTPNAERLAEVQQAQIDRQQRRDAQQAQAHLPAETRNGVAIEVVANVASSHEAADAFANGADGVGLLRTEFLFVDRHTAPDVEEQRAAYQAVIDAMGDKSVIIRTIDVGGDKQLDYLPLPVEANPVLGLRGIRLAQARPEILDQQLRALLQVSPLQRCRILLPMVTEVDELLHIRQRVDALCLELGINQRPEIGVMIEVPAAALQAEQLAEHADFLSIGTNDLSQYTLAMDRDHAGLAARVDALHPALLRLIAMTCEGAAVHKRWVGVCGALASDPLATPVLIGLGVSELSVSPVQIGEIKDRVRQLHEAECQRLARDLLKLSSAAAVRHACHQHWPL

SEQ ID NO: 13755 - protein, 438 aa, Pseudomonas fluorescens
MRISIFGLGYVGAVCAGCLSARGHDVVGVDVAKDKIDMINAGKSPIVEPGLGELLAQGIQTGRLRGTTNFAEAIRDTDLSMICVGTPSKKNGDLELNYIEAVCREIGFVLREKSTRHTIVVRSTVLPGTVANVVIPILEDCSGKKAGVDFGVAVNPEFLRESTAIADYDLPPMTVIGEFDKASGDVLQSLYEELDAPIIRKDIAVAEMIKYTCNVWHATKVTFANEIGNIAKAVGVDGREVMDVVCQDKTLNLSQYYMRPGFAFGGSCLPKDVRALTYRAGSLDVEAPLLNSLMRSNESQVQNAFDIVESHDKRKVALLGLSFKAGTDDLRESPLVELAEMLIGKGYDLSIYDSNVQYARVHGANKDYIESKIPHVSSLLNSDFDSVIDNSDVIILGNRDEKFRALAEEAPQGKQVIDLVGFMSKATSAGSRTEGICW

SEQ ID NO: 13756 - protein, 373 aa, Pseudomonas fluorescens
KTRFHDFKLAPELMHAIHDLGFPYCTPIQAQVLGYTLAGKDAIGRAQTGTGKTAAFLISIITQLLQTPPPKERYMGEPRALIIAPTRELVVQIAKDAADLTKYTGLNVMTFVGGMDFDKQLKHLEARHCDILVATPGRLLDFNQRGDVHLDMVEVMVLDEADRMLDMGFIPQVRQIIRQTPPKSERQTLLFSATFTDDVMNLAKQWTTDPAIVEIEVTNVANENVEQHIYAVAGADKYKLLFNLVNDNGWERVIVFANRKDEVRRIEERLVRDGINAAQLSGDVPQHKRIKTLEGFREGKIRVLVATDVAGRGIHIDGISHVINFTLPEVPDDYVHRIGRTGRAGADGVSISFAGEDDSYQLPSIEEKLGRKI

SEQ ID NO: 13757 - protein, 218 aa, Pseudomonas fluorescens
MTEPLILQPVKPADACVIWLHGLGADRYDFLPVAEALQESLLSTRFVLPQAPTRPVTINGGYAMPSWYDIKAMSPARAIDRDELEASADRIIELIEEQRSSGIDASRIFLAGFSQGGAVVYHTAFLKWQGPLGGVLALSTYAPTFSDELELSASQQRIPVLALHGQFDNVVQNSMGRTAYEYLKANGVTVTWQEYPMEHEVLPEEIRDIGTWLSERLR

SEQ ID NO: 13758 - protein, 964 aa, Pseudomonas fluorescens
MQTDTTRENPQGTLPQAADSNSDLAATAPGQLRVIKRNGTVVPYTDDKITVAITKAFLAVEGGTAAASSRIHDTVARLTEQVTATFKRRMPSGGTIHIEEIQDQVELALMRAGEQKVARDYVIYRDARSKERATRTTAEAPVQAHPSIRITRADGSLAPLDMGRLNTIVTEACEGLAEVDGDLIQRETLKNLYDGVALNDVNTALVMTARTLVEREPNYSFVTARLLMDTLRAEGLGFLGVAESATHHEMADLYAKALPAYVAKGIEFELLNPVLASFDLEKLGKAINHERDQQFTYLGLQTLYDRYFIHKDGVRFELPQIFFMRVAMGLAIEEKQKEDRAIEFYNLLSSFDYMASTPTLFNAGTLRPQLSSCYLTTVPDDLSGIYHAIHDNAMLSKFAGGLGNDWTPVRALGSYIKGTNGKSQGVVPFLKVVNDTAVAVNQGGKRKGAVCAYLETWHMDIEEFIELRKNTGDDRRRTHDMNTANWIPDLFMKRVFDDGKWTLFSPSEVPDLHDLTGKAFEERYEYYEALTEYPGKIKLFKTIQAKDLWRKMLSMLFETGHPWLTFKDPCNLRSPQQHVGVVHSSNLCTEITLNTNKDEIAVCNLGSINLPNHIVDGKLDTAKLKRTIDVAVRMLDNVIDINYYSVPQAKNSNFRHRPVGLGIMGFQDALYLQHIPYGSDAAVEFADKSMEAVSYYAIQASCDLADERGSYETFQGSLWSKGVLPLDSQQILIEARGQKYIDVDLTESLDWAPVRARVQKGIRNSNIMAIAPTATIANITGVSQSIEPTYQNLYVKSNLSGEFTVINPYLVRDLKARGLWDSVMINDLKYYDGSVQQIERIPQELKELYATAFEVDTKWIVDAASRRQKWIDQAQSLNLYIAGASGKKLDVTYRMAWYRGLKTTYYLRALAATSTEKSTINTGKLNAVSSGGNHGDDSVLAAPAGPAPVPKACAIDEPDCEACQ

SEQ ID NO: 13759 - protein, 555 aa, Pseudomonas fluorescens
SKTGPVTPVNFLRPIIQADLDSGKHTQIVTRFPPEPNGYLHIGHAKSICVNFGLAQEFGGVTHLRFDDTNPAKEDQEYIDAIESDVKWLGFEWSGEVRYASQYFDQLHDWAVELIKAGKAYVDDLTPEQAKEYRGSLTEPGKNSPFRDRSVEENLDWFARMRAGEFPDGARVLRAKIDMASPNMNLRDPIMYRIRHAHHHQTGDKWCIYPNYDFTHGQSDAIEGITHSICTLEFESHRPLYEWFLDALPVPARPRQYEFSRLNLNYTITSKRKLKQLVDEKHVNGWDDPRMSTLSGFRRRGYTPASIRNFCEMIGTNRSDGVVDFGMLEFSIRQDLDANAPRAMCVLRPLKVVITNYPEDQVENLELPRHPQKEELGVRQLPFAREIYIDRDDFMEEPPKGYKRLEPNGEVRLRGSYVIRADEAIKDADGNIVELRCSYDPDTLGKNPEGRKVKGVIHWVPAAASIECEVRLYDRLFRSPNPEKAEDSASFLDNINPGLLQVLTGCRAEPSLGNAQPEDRFQFEREGYFVADIKDSKPGQPVFNRTVTLARSWGQ

SEQ ID NO: 13760 - protein, 108 aa, Pseudomonas fluorescens
DTLTRLAQVLEERKGAAADSSYVASLYHKGLNKILEKVGEESVETIIAAKDAAVSGDCSDVIYETADLWFHSMVMLAQLGQHPQAVLDELDRRFGLSGHVEKASRPSA

SEQ ID NO: 13761 - protein, 422 aa, Pseudomonas fluorescens
MSDLKTAALEYHANPRPGKLSVELTKATATARDLSLAYSPGVAEPVREIARDPELAYKYTGKGNLVAVISDGTAILGLGNLGPLASKPVMEGKGVLFKRFAGIDVFDIEVDSESPQAFIDTVKRISITFGGINLEDIKAPECFEIERALIEQCDIPVFHDDQHGTAIVTAAGMINALEIAGKTLADAKIVCLGAGAAAISCMKLLVSMGAKVENIFMVDRTGVIHAGRDDLNQYKAVFAHPTEKRTLDDAIEGADVFVGLSGPNLLSAEQLKRMAANPIVFACSNPDPEISPELAHATRNDVIMATGRSDYPNQVNNVLGFPFIFRGALDVRAKRINEEMKIAAANALRELAKLPVPQEVCDAYGGISLEFGREYIIPKPMDKRLITVISDAVAKAAIETGVATLPYPKNYPLKSVDDVFNG

SEQ ID NO: 13762 - protein, 170 aa, Pseudomonas fluorescens
NLILVGPMGAGKSTIGRLLAKELRLPFKDSDKEIELRTGANIPWIFDKEGEPGFRDREQAMIAELCAFDGVVLATGGGAVMRDANRKALHEGGRVVYLHASVEQQVGRTSRDRNRPLLRTANPEKTLRDLLAIRDPLYREIADLVVETDERPPRMVVLDILDRLAQLPPR

SEQ ID NO: 13763 - protein, 366 aa, Pseudomonas fluorescens
MQTLKVDLGERSYPIHIGEGLLDQPELLAPHIHGRQVAIISNETVAPLYLERLTRSLAQFSVVSVVLPDGEAFKNWETLQLIFDGLLTARHDRRTTVIALGGGVIGDMAGFAAACYQRGVDFIQIPTTLLSQVDSSVGGKTGINHPLGKNMVGAFYQPNVVLIDTASLKTLPARELSAGLAEVIKYGLICDEPFLTWLEDNVDALRALDQTALTYAIERSCAAKAAVVGADEKETGVRATLNLGHTFGHAIETHMGYGVWLHGEAVAAGTVMALEMSARLGWISEQERDRGIRLFQRAGLPVIPPEEMTEADFLEHMAIDKKVIDGRLRLVLLRRMGEAVVTDDYPKEVLQATLGADYRALAQLKG

SEQ ID NO: 13764 - protein, 557 aa, Pseudomonas fluorescens
QREFVAMIVGIDLGTTNSLVAVWRGDATELVPNAPGQFLTPSVVGLDDQGRILVGQAARERLHTHPRLTASLFKRHMGSATEVYLGDKKFRPEELSALVLKSLKEDVERTYGQTVTEAVISVPAYFSDAQRKATRIAGELAGLKVEKLINEPTAAALAYGLHQRDKETSFLVFDLGGGTFDVSILELFEGVMEVRASAGDNFLGGEDFDNVLLEHFIDQHRNVSDFPERSTILQPLRREAERVRRALGQDASAEFRLQVGEKQWTQTITQAQMATLYMPLLERLRAPIERALRDARIRVSDLDEILLVGGTTRMPLVRKLAAGLFGRFPSISLDPDQVVAQGAAIQAALKARSAALEEVVLTDVCSYTLGIETSTQVGRQYESGHYLPIIERNSIVPVSRVKTVQTLHDNQEQVVVKIFQGESRLVKDNVALGQLDIKVPKRKAGEVELDVRFTYDNNGLLEAQVSIPLTGQQHSLVIENNPGVLTPEEIQQRLQALAQLKIHPREQQVNTLLSARLERLYQESLGDLRDQIGYWAKQFQQALDSQDERQIRETRTE

SEQ ID NO: 13765 - protein, 313 aa, Pseudomonas fluorescens
VSKMMVFTGNANPDLARRVVRQLHIPLGDISVGKFSDGEITAEINENVRGKDVFIIQPTCAPTNDNLMELVVMADAFRRSSATRITAVIPYFGYARQDRRPRSARVAISAKVVADMLTVVGIDRVLTVDLHADQIQGFFDIPVDNIYGSPVLVDDIEDQRFENLMIVSPDIGGVVRARAVAKSLGVDLGIIDKRREKANHSEVMHIIGDVEGRTCILVDDMVDTAGTLCHAAKALKEHGAAKVFAYCTHPVLSGRAIENIENSVLDELVVTNTIPLSAAAQACARIRQLDIAPVVAEAVRRISNEESISAMFR

SEQ ID NO: 13766 - protein, 279 aa, Pseudomonas fluorescens
RLTLPSPAKLNLMLHILGRREDGYHELQTLFQFLDYGDEITFAVRDDGVIRLHTEFDGVPHDSNLIVRAAKKLQEQSACSLGIDIWIDKILPMGGGIGGGSSNAATTLLGLNHLWRLGWDEDRLAALGLTLGADVPVFVRGHAAFAEGVGEKLTPVEPAEPWYVVLVPQVSVSTAEIFSDPLLTRNTPPIKVRPVPEGNSRNDCLPVVSRRYPEVRNALNLLGNFTEAKLTGTGSCVFGGFPSKAEADKVSALLTETLTGFVAKGSNVSMLHRKLQSLL

SEQ ID NO: 13767 - protein, 357 aa, Pseudomonas fluorescens
ATAFNTLPLSAAMLANLDSLGYAQMTPIQAQSLPVILKGMDLIAQAKTGSGKTAAFGIGLLNPINPRYFGCQALVICPTRELADQVAKEIRRLARAEDNIKVLTLCGGVSFGPQIGSLEHGAHIIVGTPGRIQQHLRKGSLVLDGLNTLILDEADRMLDMGFYDAIEDIIEQTPARRQTLLFSATYPVGIKQLASKFMRDPQTVKAEAFHDDTQIEQRFYEISPEERMSAVTKVLHHFRPASTVAFCFTKQQVQETVDHLTSKGISAVGLHGDLEQRDRDQVLAMFANRSTSVLVATDVAARGLDIDALDMVINVELARDSEIHIHRVGRTGRAGEKGIAVSLVAPSEAHRAQAIEQ

SEQ ID NO: 13768 - protein, 560 aa, Pseudomonas fluorescens
MSQEFDYIIVGAGSAGNTLATRLTEDEGVTVLLLEAGGPDYRFDFRTQMPAALAFPLQGRRYNWAYETDPEPHMDGRRMECGRGKGLGGSSLINGMCYIRGNAMDYDGWAKLPGLEDWSYLDCLPYFRKAETRDIGPNDYHGGDGPVSVTTPKAGNNPLFHAMVEAGVQAGYPRTEDLNGYQQEGFGPMDRTVTPNGRRASTARGYLDVAKKRSTLTIVTHALTDKVLFEGKRAVGVRYLVGAAEERVEARARKEVIVCSGAIASPQLLQRSGVGPAKLLESLDIPVVHDLPGVGENLQDHLELYLQYACTQPVSLYPSLLWYNQPAIGAEWLFNGTGIGASNQFEAGGFIRTRPEFEWPNIQYHFLPVAINYNGSNGVKEHGFQAHMGSMRSPSRGRVQVKSKDPRQHPSILFNYMATEQDWQEFRDGIRLTREIMQQPALDAFRGREISPGIEVQTDEQLDKFIREHAETAFHPSCSCKMGTDDMAVVDGEGRVHGMQGLRVVDASIMPIITTGNLNAPTIMMAEKIADKIRGRQPLPRSKAPYYVAGDAPVKGKAMR

SEQ ID NO: 13769 - protein, 490 aa, Pseudomonas fluorescens
MARFELQKLYIDGAYSDAGSDATFEAINPANGEVLAHVQRATKEDVERAVVSAEKGQKIWAAMTAMERSRILRRAVDILRERNDELAALETLDTGKAFSETKYVDIVTGADVLEYYAGLVPAIEGEQIPLRDTSFVYTRREPLGVVAGIGAWNYPIQIALWKSAPALAAGNAMIFKPSEVTSLTTLKLAEIYTEAGVPNGVFNVLTGSGREVGTWLTEHPRIEKISFTGGTDTGKKVMASASASSLKDVTMELGGKSPLIICDDADLDRAADTAMMANFYSSGQVCTNGTRVFVPSHLKAAFEAKIVERVARIRVGNPEDENTNFGPLVSFPHMESVLGYIAKGKEEGARVLCGGERLTDGEFAKGAFVAPTVFTDCTDDMTIVREEIFGPVMAILSYETEEEVIRRANDTDFGLAAGIVTRDLNRAHRVIHQLEAGICWINAWGESDAKMPVGGYKQSGVGRENGISSLNNFTRIKSVQVELGDYVSVF

SEQ ID NO: 13770 - protein, 325 aa, Pseudomonas fluorescens
MSPAELHADSIVIDGLIIAKWNRELFEDMRKGGLTAANCTVSVWEGFQATVNNIAASQKLIRENSDLVIPVRTTADIRKAKEQGKTGILFGFQNAHAFEDQIGYVEVFKQLGVGIVQMCYNTQNLVGTGCYERDGGLSGFGREIVAEMNRVGVMCDLSHVGSKTSEEVILESKKPVCYSHCLPSGLKEHPRNKSDEELKFIADHGGFVGVTMFAPFLAKGIDSTIDDYAEAIEYTMNIVGEDAIGIGTDFTQGHGQDFFEYLTHDKGYARRLTNFGKIINPLGIRTVGEFPNLTETLLKRGHSERVVRKIMGENWVNVLKDVWGE

SEQ ID NO: 13771 - protein, 402 aa, Pseudomonas fluorescens
EQAALIAQLQSETAALREELDETNQGVLALYAELDTQAEQLRQASDLKSRFLSYMSHEFRTPLGSILSINSLLADELDGPLSPEQHKQVAFVSTAARELSDMVDDLLDLAKIEAGRISISAAWFDMFDLFAALRGMFRPIVDATAVDLIFEEPVGLPRLYTDDKKLAQILRNFISNSLKFTTRGEVRISARLEGEGKVRFAVSDTGIGIAAELHGTLFEDFSQVDSPLQKRLRGTGLGLSLCKRFAELLGGEVGVESTPGVGSSFFVIIPLHLPRRTSMKHDIRLLIVDDNVATRYALRRRLERHGYEVLEAGTGGEGLALIASQSLDALILDVNLPDMSGFDIVRKLRADPGTALLPVIHVSAASIQTGDIITGLDAGADAYLIHPVDPDVLLATLRTLLR

SEQ ID NO: 13772 - protein, 573 aa, Pseudomonas fluorescens
NTLEQEYDIVVIGGGTAGPMAAIKAKEKNKELRVLLVDKANVKRSGAISMGMDGLNNAIIPGHSTPEQYTKEITIANDGIVNQAAVYAYATHSFETIEQLDRWGVKFEKDETGDYAVKKVHHMGAYVLPMPEGHDIKKVLYRQLKRARVNITNRLVCTRLLTDEEGAVNGVMGFDCRTADFHVIKAKAVILACGAAGRLGLPSSGYLMGTYENPTNAGDGYAMAYHAGAELANLECFQINPLIKDYNGPACAYVTGPLGGYTANNKGERFIECDYWSGQMMWEFHQELESGNGPVFLKLDHLAEETIQNIEEILHSNERPSRGQFHANRCTDYRTQMVEMHISEIGFCSGHSASGVWVNERAETSVKGLYSAGDMAAVPHNYMLGAFTYGWFAGNNAAEFVAGREFSVLDAEQIEKEKARVYAPLDREHGLPPAQVEYKLRRFVNDYLQPPKVTKKMEIGLQRFSDIERDLNEMKANNAHELMRAMETSVIRDCAEMAARASLFRAESRWGLYHYRVDHPQRDDREWFCHCHLKKGEDGRMTSFKKAVEPYIIPLDAEEMQAYDRLRVGAFAA

SEQ ID NO: 13773 - protein, 477 aa, Pseudomonas fluorescens
SVRRTKIVATLGPASNSPEVLEQLILAGLDVARLNFSHGTPDEHKARAKLVRDLAAKHGRFVALLGDLQGPKIRIAKFANKRIELKIGDQFTFSTSHPLTEGNQQVVGIDYPDLVKDCGVGDELLLDDGRVVMRVETATATELNCVVTIGGPLSDHKGINRRGGGLTAPALTEKDKADIKLAAEMEVDYLAVSFPRDAADMNYARQLRDEAGGTAWLVAKIERAEAVADDETLDGLIKASDAVMVARGDLGVEIGDAELVGIQKKIILHARRHNKAVIVATQMMESMIQNPMPTRAEVSDVANAVLDYTDAVMLSAESAAGAYPLEAVQAMARICVGAEKHPTSKTSSHRIGKEFERCDESIALATMYTANHFPGVKAIIALTESGYTPLIMSRIRSSVPIYCFTPHREAQARAAMFRGVYTVPFDPASLAPNEVSQKAIDELVKRGVVEKGDWVILTKGDSYHTTGGTNGMKILHV

SEQ ID NO: 13774 - protein, 254 aa, Pseudomonas fluorescens
  unsure (1)..(254): unsure at all Xaa locations
MPEAILLHRERGLLTLRLNRPDKKNALTRAMYSQLADALKQANHDPEINAVLITGSAECFTAGNDIADFIQQPPSDLDSPVFHFMLNLLECRKPVIAAVAGAAVGIGTTLLLHCDLVYVARDARLRMPFVNLGLCPEFGSSLILPRLLGQAKASELLLLGEGFTGEQAAQWGIATEALGSGEAALTKAREMALRFDELPAEAVRISKQLMRAPDRELIRKVIEEEGALFTQRLRSPEALAALTGFIKRHXDIRR

SEQ ID NO: 13775 - protein, 468 aa, Pseudomonas fluorescens
MSVATSLIEESSARIASAPAETLYQFNESPLLARQSRQESNARSYPRRIPLALKRAKGLYVEDVEGRSFIDCLAGAGTLALGHNHPVVIEAIQQVLSDELPLHTLDLTTPVKDQFVQDLFGLLPPALAKEAKIQFCGPTGTDAVEAALKLVRTATGRSTVLSFSGGYHGMSQGALSLMGSLGPKKPLGALLSSGVQFMPFPYDYRCPFGLGGAAGVKANLSYLENLLNDPEAGVQLPAAVIVEAVQGEGGVIPADIEWLRGLRRITEKAGVALIIDEIQSGFARTGKMFAFEHAGIIPDVVVLSKAIGGSLPLAVVVYREWLDSWQPGAHAGTFRGNQMAMAAGSAVMRYLVEHKVCEHAAAMGERLSEHLRILQRDFPQLGDIRGRGLMLGVELVDPSGTPDALGHPPAFARLAPLVQRECLKRGLILELGGRHGAVVRFLPPLVITAAEIDRVAEIFGRALSAATA

SEQ ID NO: 13776 - protein, 659 aa, Pseudomonas fluorescens
PSTLVQALQRRAALTPDRLALRFLAETEEQAVVLSYRELDQRARTIAAALQAEAGFGDRAVLLFPSGPDYVAAFFGCLYAGVIAVPAYPPESAKRHHQERLLSIIADAEPRLLLTSADLRDALQQIEGAPPLLCVDTLDAELVERWVEPTLPQDHIAFLQYTSGSTALPKGVQVSHGNLVANELLIRHGFGIDVNPDDVIVSWLPLYHDMGLIGGLLQPIFSGVPCILMSPAYFLGRPLRWLEAISQYGGTISGGPDFAYRLCSERVSESALERLELSRWRVAYSGSEPIRLDTLERFAEKFTACGFSEDSFMASYGLAEATLFVAGTPRGTGIPALRVDDQALAQNRAEAGEGSPIMSCGISQPDHAVLIVEPNTLEELADTAVGEVWAAGPSIALGYWRNPEATAKTFVQHAGQTWLRTGDLGFMRDGELFITGRLKDMLIVRGHNLYPQDLEKTVENEVEVVRKGRVAAFAVNQNGEEGIGIAAEISRSVQKILPPEALIKSIRQAVAEAYQEAPSVVVLLNPGALPKTSSGKLQRSACRNRLADGSLDSYAVFPSTTAETSESTASVSELETVIGKIWAEQLNVKQVNGDDHFFLLGGNSIAATQVIAKVREELGLELNLRLLFEAPTLSAFAAAVAQQQQDGGSAQGEITALSR

SEQ ID NO: 13777 - protein, 253 aa, Pseudomonas fluorescens
SIFRADLFSGQTVIVTGGGSGIGRCTAHELAALGANVVLVGRKPEKLQTVAAEIAEDGGRAHWQACDIRDEEAVKALVSELIREHGPIHGLVNNAGGQYPSPLASINQKGFETVLRTNLVGGFLMAREVFNQSMSKHGGNIVNMLADMWGGMPGMGHSGAARSGMDNFTKTAAFEWGYAGVRVNAVAPGWIASSGMDTYEGAFKAVIPTLREHVPLKRIGTESEVSAAIVFLLSPAAAFISGSTLRIDGAASL

SEQ ID NO: 13778 - protein, 374 aa, Pseudomonas fluorescens
IFTPEHEALRRTVRQFVEHEINPHVDEWEKAGRFPIHEIFRKAGDLGLLGISKPEKFGGMGLDYSYSIVAAEEFGTIHCGGIPMSIGVQTDMCTPALARFGSDELREEFLRPAITGEQVGCIGVSEVGAGSDVAGLKTTARKDGDDYVINGSKMWITNSPSADFICLLANTSDDKPHINKSLIMVPMNTPGISLSSHLDKLGMRSSETAQVFFDNVRVPQRNRIGHEGAGFMMQMLQFQEERLFGAANMIKGLEYCVDSTIEYCKERKTFGNALIDNQVIHFRLAELQTEIECLRALVYQATEQYVKGQDVTRLASMAKLKAGRLGREVSDSCLQYWGGMGFMWDNPVARAYRDVRLVSIGGGADEIMLGIICK

SEQ ID NO: 13779 - protein, 274 aa, Pseudomonas fluorescens
MSLKGKTLFITGASRGIGREIALRAAQDGANIVIAAKSAEPHAKLPGTIHSVAVEVEAAGGKALALQLDVRDEEAVRQALAQANQHFGGIDALVNNAGAIKLTGVQHIELKRFDLMHQINTRAVLLCSQAALPYLKKSSGHILNLSPPLNLASKWFAQYSPYTVTKYGMSMLTVGMSEEFANYGISVNSLWPQTMIATAAIEFQLGNRESFKHARTPAIMADAAHVILSSSGRRITGRLLIDEEILRESGVSEFDHYRFEPKSDAKLMTDLFID

SEQ ID NO: 13780 - protein, 570 aa, Pseudomonas fluorescens
IKEHYDVIVIGSGYGGGIAASRLSRDGKRVCLLERGREIQPGEYPNTMIAATEELQVHDPDGHIGSRTGLFDLHVNAQQNVVVGCGLGGTSLINANVSLEPTADVFKDPRWPLAVREDHDGLLKAGYEKAREMLKPNPYPSTAPNLPKLDANKKSADFLKQGAHFYKPPINVTFDKLPNNLNHVGVEQLPCNHCGDCVSGCNNKAKNTTLMNYLPDATNHGAEIFCQAQVRHLERDGNGWIVHFQYLDSGREKFDAPTLFVKADIVVVSAGTLGSTEILLRSRDKGLVMSGQLGENMSGNGDILGFGHNCEQTINGIGFGAHSAKELQPVGPCITSIIDMRTEGDRSSRMVIEEGSIPGALGRADGAGDGRVRRDDRQAHRRQLQRQGEVQGARSRKLPARPVPRRAAQHADLPDHEPRQRPGTHGPRQQGSTAHRLAGRRRAGKLQDRNERLYQSTKALGGIWVENPIWTKLLKHSIVSVHPLGGCVMGEDAAQGVVNHKGQVFSGASGTDVYANLYVTDGAVIPTSLAVNPLLTISAVSERNMGLLAADRGWTIDYTLPSAPRKQTAP

SEQ ID NO: 13781 - protein, 430 aa, Pseudomonas fluorescens
MKKAKLSLAWQILIGLVLGIAIGALLNHFSAEKAWWISNVLQPAGDIFIRLIKMIVIPIVISSLIVGIAGVGDAKKLGRIGLKTIIYFEIVTTIAIVVGLLLANLFHPGAGIDMSTLGTVDISKYQATAAEVQHEHAFIETILNLIPSNIFAAMARGEMLPIIFFSVLFGLGLSSLQSDLREPLVKMFQGVSESMFKVTHMIMNYAPIGVFALIAVTVANFGFASLLPLAKLVILVYVAIAFFAFVILGLIAKMFGFSVIKLMRIFKDELVLAYSTASSETVLPRVIEKMEAYGAPKAICSFVVPTGYSFNLDGSTLYQSIAAIFIAQLYGIDLSISQQLLLVLTLMVTSKGIAGVPGVSFVVLLATLGSVGIPLEGLAFIAGVDRVMDMARTALNVIGNALAVLVIARWEGMYDDAKGQRYWNSLPHWR

SEQ ID NO: 13782 - protein, 526 aa, Pseudomonas fluorescens
PHNEIPTGGSAHDTFWDFVSLVPESAHMVIWAMSDRAIPKSLRSMQGFGVHTFRLINAEGKSRFVKFHWRPTAGTCSLVWDEAQKLAGKDTDYHRRDLWEAIEMGDYPEWELGVQVIEEENEHDFDFDILDPTKLIPEEIVPITPLGKMTLNRNPDNFFAETEQVAFCPGHIVPGIDFSNDPLLQGRLFSYTDTQISRLGGPNFHELPINRPVAPFHNGQRDAQHRTVIDKGRASYEPNSIDGGWPKETPPAAQDGGFESYPERIDANKIRQRSESFSDHFSQARLFFNSMSAHEKEHIIAAYSFELGKVEREFIRARQVNEILANIDLELAKRVAANLGLPAPGKGTVDVPKTSLDRSPSLSQANLLPENIKTRKVAILAANGVDGAAIDAMKKALAAEGAHAKLLGPTSAPVKTADGKSLAVDASMEGLPSVAFDAVFVPGGAASVKALSGDGVALHYLLEAYKHLKAIALQGEAKQLLDVLKLEADAGLLEGKDVGALTKPFFSAIGQHRVWDREAKAKAIPA

SEQ ID NO: 13783 - protein, 435 aa, Pseudomonas fluorescens
MDVSVFGTGYVGLIQAAALADVGHRVLCVDIDPNKIKQLQQAVPPISEPGLSATLEENIKAGRLLFSTQASDAVEHAGLIFIAVGTPADEDGSADLSHVLNVARQIASCMEDDRTLIIKSTVPVGTADQVLHTAEEELQRRGKNGLAVRVVSNPEFLKEGSALADCMRPDRIIVGTLDPEAREQMSELYAPFCRNHEKLMFMDNRSAELTKYAANAMLATRISFMNELANLTELLGADIEAVRKGIGSDPRIGYHFIYPGCGFGGSCFPKDLRALLHTAEHNGMPLKLLRSVTDVNDAQRHILFSKLRAQFPQGLAGKSIAIWGLAFKPNTDDMREAPSRYLMEALWAEGASVQAYDPEAMSECRRIYGYRNDLHLCATRDDTLEDADALVICTEWKNFRVVDFELLAEKLRAKVIVDGRNLYNPEQVAAAGLHY

SEQ ID NO: 13784 - protein, 802 aa, Pseudomonas fluorescens
VAAFRDAVLTKLTYAVGKDPDHAFDHDWFEAIALAARDHMVEHWMDHTRQIYRKGQKRVYYLSLEFLIGRLLYDSLSNLGLLDVAREALTELGVDLERIRILEPDAALGNGGLGRLAACFMESMSTLGIAGHGYGIRYEHGLFRQAIVDGWQQEQTEHWLDFGNPWEFERPEVVYPIGFGGSVETVTDANGNSRQVWHPAETVRAIAYDTPVVGWRGASVNTLRLWRARAMEDLHLERFNAGDHLGAVAEVARAESISRVLYPADSTEAGQELRLRQEYFFVAASLQDLLRRHRNMHTSVLTLGDHAAIQLNDTHPSIAVAELMRQLVDVYDVAWDAAWQVTVDTLSYTNHTLLPEALETWPVGLMERMLPRHMQIIYLINAQHIDSLRAKGIHDFDVLRAVSLIEEDNGRRVRMGNLAFLGSHSVNGVSGLHTQLMRKTVFAELHKLYPERINNKTNGITFRRWLYQANPELTSMLVDALGPDVLDNPEERLLDLEPFAEKPAFRKAFAEQRLHSKKALAYLIHERLGIAVNPAAMFDVQVKRIHEYKRQLLNLMHTVALYQAIRAEPEIDWVPRVKIFAGKAAASYHQAKLIIKLTNDIARVVNNDPTVRGLLKVVFLPNYNVSLAESIIPAADLSEQISTAGFEASGTSNMKFGLNGALTIGTLDGANVEMCENIGAEHMFIFGLSAQQVEARKQNHEFSAVPDIAASHRLNDVLQAIRSGVFSPDDTSRYTGLIDSLVDYDRFFVCADFDSYWEAQMRVDAHWHDANNWWRSAVLNTSRMGWFSSDRTIREYATDIWK

SEQ ID NO: 13785 - protein, 508 aa, Pseudomonas fluorescens
MTTTPKPLVLMILDGFGHSDSPESNAVYAAKKPVLDRLWATVPNGLISGSGMDVGLPDGQMGNSEVGHMNLGAGRVVYQDFTRVTKAIRDGEFFENPTICAAVDKAVAAGKAVHFMGLLSDGGVHSHQDHLIAMAELAFKRGAEKIYLHAFLDGRDTPPKSAASSIELLDATFQALGKGRIASLIGRYYAMDRDNRWDRVAQAYNLIVDGKGEINAATAQEGLEAAYARGESDEFVKATSIGEPVKVEDGDAVVFMNFRADRARELSRVFVEDGFKEFERARQPKVQYVGLTQYAESIPAPAAFAPGSLENVLGDYLAKNGKTQLRIAETEKYAHVTFFFSGGREEPFPGEERILIPSPKVATYDLQPEMSAPEVTDRIVEAIENQRYDVIVVNYANGDMVGHSGVFEAAVKAVECLDTCVGRIVEALEKVGGEALITADHGNVEQMADESTGQAHTAHTTEPVPFIYVGKRDLKVREGGVLADVAPTMLKLLGLEKPAEMTGTSILV

SEQ ID NO: 13786 - protein, 256 aa, Pseudomonas fluorescens
MALAKRIIPCLDVDNGRVVKGVKFENIRDAGDPVEIARRYDEQGADEITFLDITASVDGRDTTLHTVERMASQVFIPLTVGGGVRTVQDIRNLLNAGADKVSINTAAVFNPEFVGEAAQHFGSQCIVVAIDAKKVSGPGETPRWEIFTHGGRKPTGLDAVEWAKKMEGLGAGEILLTSMDQDGMKNGFDLGVTRAISDALGIPVIASGGVGNLQHLADGILEGHASAVLAASIFHFGEYTVQEAKAYMSKRGIVMR

SEQ ID NO: 13787 - protein, 195 aa, Pseudomonas fluorescens
MAERKASVERDTLETQIKASINLDGTGKARFNIGVPFLEHMLDQIARHGLIDLDIECKGDLHIDDHHTVEDVGITLGQAFAQAIGDKKGIRRYGHAYVPLDEALSRVVIDFSGRPGLQMHVPYTRATVGGFDVDLFQEFFQGFVNHALVSLHIDNLRGTNTHHQIETVFKAFGRALRMAVELDERMAGQMPSTKG

SEQ ID NO: 13788 - protein, 458 aa, Pseudomonas fluorescens
LAKVVPMSSTQSSNGLEQGLKPRHVTMLSIAGVIGAGLFVGSGHAIAAAGPAVLLAYAAAGALVVLVMRMLGEMAVASPDTGSFSTYADRAIGHWAGFTIGWLYWWFWVLVIPLEANAAATILHAWFPGVDIWAFALIITMLLTVTNLFSVKNYGEFEFWFALLKVVAIIGFIILGVAAIFGFLPNSQVSGVSHIFDTQGFLPNGMGAVLGAILTTMFSFMGTEIVTIAAAESKNPGKQISKATNSVIWRIGLFYLVSIFIVVALVPWNDPVLASVGSYQTVLERMGIPNAKMIVDIVVLVAVTSCLNSALYTSSRMLFSLGKRGDAPVMSTRTNKSGTPYWAVMLSTGAAFLCTFANYVAPAAVFEFLLASSGAIALLVYLVIAISQLRMRKQRMARGEKIVFSMWLFPGLTYAVIAFIVAALTIMLFQDAHRVEILATGLLSLVVVATGLLVARRR

SEQ ID NO: 13789 - protein, 533 aa, Pseudomonas fluorescens
DNLIEIRDLAVEFGFGERVHRVVEGVSFDIKRGETLALVGESGSGKSVTAHSILRLLPYPLARHPAGSINYSGQNLLELGEKTIRHIRGNRIAMIFQEPMTSLNPLHSIEKQINEVLGIHKGLTGKVATKRTLELLEMVGIPEPHKRLKALPHELSGGQRQRVMIAMALANEPELLIADEPTTALDVTVQLKILDLLKELQARLGMALLLISHDLNLVRRIAHRVCVMQRGCIVEQASCEELFRSPQHPYTRELLGAEPSGGPASNKIGAPLLEVEDLKVWFPIKKGLLKRTVDHVKAVDGINFSLPQGQTLGIVGESGSGKSTLGLAILRLIGSKGAIRFEGKQLDCLTQSEVRPLRREMQVVFQDPFGSLSPRMCVNDIVGEGLRIHKMGTAAEQEAAIIAALKEVGLDPETRHRYPHEFSGGQRQRIAIARALVLKPALILLDEPTSALDRTVQRQVVELLRSLQAKYNLTYLFISHDLAVVKALSHQLMVVKHGQVVEQGDAQSIFAAPQHSYTQQLLEAAFLAPATAQ

SEQ ID NO: 13790 - protein, 264 aa, Pseudomonas fluorescens
MGFLAGKRVLIVGVASKLSIASGIAAAMHREGAELAFTYQNDKLKGRVEEFAQGWGSSPELCFPCDVASDEEIAKVFEELSKKWDGLDCIVHSVGFAPGDQLDGDFTEATTREGFRIAHDISAYSFVALAKAGREMMKGRNGSLLTLSYLGAERTMPNYNVMGMAKASLEAGVRYLAGSLGPDGTRVNCVSAGPIRTLAASGIKNFRKMLAANEAQTPLRRNVTIEEVGNAGAFLCSDLASGISGEIMYVDGGFNTTAMGNIEE

SEQ ID NO: 13791 - protein, 276 aa, Pseudomonas fluorescens
MGFVTTKDGVEIFYKDWGPKDAPVIHFHHGWPLSADDWDAQMLFFLAQGFRVVAHDRRGHGRSSQVWDGHDMDHYADDVAAVVNHLGTQKAVHVGHSTGGGEVIHYIARHGEDRVSKAAIISAVPPLMVKTESSPGGLPKSVFDDLQAQLAANRAQFYRDVPSGPFYGYNRPGAKPSEGIIANWWRQGMIGSAKAHYDGIVAFSQTDFTADLKSISIPVLVMHGDDDQIVPYENAGVLSAKLLKNSTLKIYPGFPHGMPTTEAPTINADLLAFIRG

SEQ ID NO: 13792 - protein, 713 aa, Pseudomonas fluorescens
LANCADEPIRFPGAIQPHGLLLTLSEPDLSIIQISANVETLLARPAQELIGQPLQSLIGDAHAAQVREALQQAALSDAPPLHFRLNGTAFEGLLHRHQDVLILELEIHVENFQPRNVAGTETHLGRMLARLQKAQSLQALYDISVKEIQAMTGYDRVLIYRFEEEGHGQVIAEASDPSMEVFNGLFFPASDIPEQARELYRTNWLRIIPNADYQPVPLVPKLRPDTQTPLDLSFATLRSVSPIHCQYMKNMGVLSSMSISLLKGDKLWGLISCGNRQPLHVPHELRTACQTIGQVLSLQISAMEALEVSRQREEKLEALALLNQAMIDSPQNVFDGLANQPQVLMALANAGGIAIIEDKQLHRYGNCPEPEEIRALHKWLQERGEPVFASHHLASVYPPAAHYQQVASGVLAMSLPKPVDNGVLWFRPEVKENINWSGDPRKPLDLENSDAGLRLRPRTSFEIWKVEMAGISTKWSHGDLFAANDLRRSALENDLARQVRREQEAVRARDELVAVVSHDLRNPMTVISMLCGMMQKAFSSDGPHTSRRISTAIDTMQQAAGRMNTLLEDLLDTSKIDAGRYTIAPQKLDVAQMFEEAQSLLAPLALDKDISISFEADPDLSIHADPERLFQVLSNLVGNAIKFTPRLGTVDVYAKSVGDDIVFTVRDSGEGIPKDHLPHVFDRYWTVKEGNPTGTGLGLYITQGIVEAHGGQI

SEQ ID NO: 13793 - protein, 858 aa, Pseudomonas fluorescens
MNTEFRKNLPGTPLDFFDVRAAVDGIQPGSYDTLPYTSRVLAENLVRRCDPATLTDSLKQLIERKRDLDFPWFPARVVCHDILGQTALVDLAGLRDAIAQQGGDPAQVNPVVPTQLIVDHSLAVEAGGFDAQAFEKNRAIEDRRNEDRFHFINWTKKAFKNVDVIPPGNGIMHQINLEKMSPVIQVRDGVAFPDTCVGTDSHTPHVDALGVIAIGVGGLEAESVMLGRASWMRLPESVGVELTGKLQPGITATDMVLALTEYLRKQKVVGAWLEFFGEGASALTLGDRATISNMAPEYGATAAMFYIDQQTIDYLKLTGREDQQVQLVEQYAKQIGLWADSLKGAQYERGLTFDLSSVVRNMAGPSNPHARVAVSDLAAKGIAGQWEDVPGQMPDGAVIIAAITSCTNTSNPRNVIAAGLLARNANKLGLTRKPWVKSSLAPGSKTVALYLDEAGLTTELEQLGFGVVAFACTTCNGMSGALDPVIQQEIIDRDLYATAVLSGNRNFDGRIHPYAKQAFLASPPLVVAYAIAGTIRFDIEKDVLGVVDGKEIRLKDIWPSDEEIDAVVKSSVKPEQFRQVYIPMFAIHEDTGPKVTPLYDWREMSTYIRRPPYWEGALAGARPLKGMRPLAVLPDNITTDHLSPSNAIMLDSAAGEYLAKMGLPEEDFNSYATHRGDHLTAQRATFANPKLFNEMVVENGKVKQGSLARVEPEGQVMRMWEAIETYMERKQPLIIIAGADYGQGSSRDWAAKGVRLAGVEAIAAEGFERIHRTNLVGMGVLPLEFKPGTDRKTLGIDGSETYDVIGERTPRADLTLVIHRKNGERVDVPVTCRLDTAEEVSIYEAGGVLQRFAQDFLE

SEQ ID NO: 13794 - protein, 375 aa, Pseudomonas fluorescens
MAEAKVLSGAGLRGQVAGQTALSTVGQAGAGLTYRGYDVRELAADAQFEEVAYLLLYGELPTKAQLADYQGKLSKLRDLPQALKEVLERIPADAHPMDVMRTGCSFLGNIEPEKDFSEQRDKTDRLLAAFPAIMCYWYRFSHDGKRINCVSDEPSIGGHFLHLLHDKKPSELHVKVMNVSLILYAEHEFNASTFTARVCASTLSDLYSCVTAAIGSLRGPLHGGANEAAMEMIERFSSPEEAVKGTLGMLERKDKIMGFGHAIYKDSDPRNEVIKGWSKKLADEVGDKVLFAVSEAIDKTMWEQKKLFPNADFYHASAYHFMGIPTKLFTPIFVCSRLTGWAAHVFEQRANNRIIRPSAEYTGVEQRKFVPIEQR

SEQ ID NO: 13795 - protein, 235 aa, Pseudomonas fluorescens
DVVELATTYANKSAQDILKLAFAEFGDDLWISFSGAEDVVLVDMAWKLNKNVKVFSLDTGRLHPETYRFIDQVREHYKIDIELVSPDYTKLEPFVKEKGLFSFYKDGHGECCGIRKIEPLRRKLSGVKAWATGQRRDQSPGTRSAVAVMEIDTAFSTPERTLYKFNPLAQMTSEEIWGYIRMLELPYNSLHERGFISIGCEPCTRPVLPNQHEREGRWWWEEATQKECGLHAGNI

SEQ ID NO: 13796 - protein, 243 aa, Pseudomonas fluorescens
LSGKVALIQGGSRGIGAAIVKRLAAEGAAVAFTYVSSAAKAEELQNSITATGGKALAIKADSADASAIRNAVNATVETFGRLDILVNNAGVLAVAPLEDFKLEDFDQTLAINVRSVFIASQEAAKHMGEGSRIINIGSTNADRMPFAGGGVYAMSKSALVGLTKGLARDLGPRGITINNVQPGPVDTDMNPAHGEFADSLIPLMAVGRYGTAEEIASFVTYLASPEAGYITGASLTIDGGFGA

SEQ ID NO: 13797 - protein, 212 aa, Pseudomonas fluorescens
MDGLLLDTEGIYTEVTSLIAERYGRTFDWSIKQNIIGRGAGDLARYVVEALDLPITAEEFLVIREPLMRERFPTAQAMPGAEELIRHLKAHNIPIAVGTSSSRQSFGQKTTLHRDWFALFDFIVTADDPEVGAAKPAPDIFLTAARRLGVAPEDCLVFEDSPFGVTAAKAAGMTAIAIPDAAMADEKYAHADGILRTLKAFTPSACGLPALD

SEQ ID NO: 13798 - protein, 186 aa, Pseudomonas fluorescens
MTRSLPENYREILIGLGEDPDREGLLDTPVRAAKAMQYLCHGYEQSVDEIVNGALFASDSDEMIIVADIELYSLCEHHLLPFIGKAHVAYIPTGKVLGLSKIARLVDMFARRLQIQENLTRQIAEAVRQVTDAAGVAVVIEARHMCMMMRGVEKQNSTMNTSVMLGAFRESSNTRQEFLQLIGRSK

SEQ ID NO: 13799 - protein, 232 aa, Pseudomonas fluorescens
TAPILITGAGQRVGLHCAQRLLEDGHRVIFTYRSERPGVKTLRDLGALGLHADFSSEASILAFITELKSHTDSLRAIVHNASEWLAETADGEAEAFSRMFNIHMLAPYLINLHCAELLQRSSPADIIHISDDVTRKGSSKHIGYCASKAGLDSLTLSFAARYAPSIKVNGIAPALLLFNPDDDAEYRAKALAKSALGIEPGSEVIYQSLRYLLDNPYVTGTTLTVNGGRHVK

SEQ ID NO: 13800 - protein, 303 aa, Pseudomonas fluorescens
MNESVRFEDKVVIVTGAGGGLGRAHALLFAKQGAKVLVNDLGGSTQGEGANASAADRVVAEIREAGGIAEANHDSVTDGDKLVQNALDVFGRVDVVVNNAGILRDKTFHKMEDADWDLVYRVHVEGAYKVTRAAWPHLREQNYGRVIFTASTSGIYGNFGQSNYGMAKLGLYGLTRTLAIEGRKNNILVNAIAPTGGTRMTEGLIPPQVFEQLKPELVSPLVVYLASEQCQETSGLFEVGGGWMGKVRWERSLGAGFDPRVGFSPEDVAAHWQQICDFEGAAHPKDNIEALKEMMGNLQKYSL

SEQ ID NO: 13801 - protein, 431 aa, Pseudomonas fluorescens
MNLDSALAYQSGFGNEFSSEALPGALPVGQNSPQKAPYGLYTELFSGTAFTMTRSEARRTWMYRIQPSANHPAFVKLERQLAGGPLGEVTPNRLRWNPLDLPTEPTDFIDGLVSMAANSGADKPAGISIYHYGANRSMERVFFNADGELLLVPQLGRLRIATELGVLDVAPLEIAVLPRGLKFRVELLDPQARGYVAENHGAPLRLPDLGPIGSNGLANPRDFLTPVAAYENLQQPTTLVQKFLGQLWGTELNHSPLNVVAWHGNNVPYKYDLRRFNTIGTVSFDHPDPSIFTVLTSPTSVHGLANLDFVIFPPRWMVAENTFRPPWFHRNLMNEFMGLIQGEYDAKAEGFVPGGASLHSCMSAHGPDGETCTKAINADLKPAKIDNTMAFMFETSQVLRPSRFALDCPQLQSTYDACWATLPATFDPTRR

SEQ ID NO: 13802 - protein, 316 aa, Pseudomonas fluorescens
VDKILHQPLGGNEMPRFGGIATMLRLPHVPTAAGLDAAFVGVPLDIGTSLRPGTRFGPRDIRTESVMIRPYNMATGAAPFDSLSVADIGDVAINTFNLLDAVRIIEEAYDNILEHNVIPMTLGGDHTITLPILRAIHKKHGKVGLVHIDAHADVNDHMFGEKIAHGTTFRRAVEEGLLDCDRVVQIGLRAQGYTADDFNWSRDQGFRVVQAEECWHKSLAPLMAEVREKVGGGPVYLSFDIDGIDPAWAPGTGTPEIGGLTTIQAIEIVRGCQGLDLIGCDLVEVSPAYDTTGNTSLLAANLLYEMLCVLPGVVHR

SEQ ID NO: 13803 - protein, 376 aa, Pseudomonas fluorescens
EVAPVFSQFALHERLLKAVAELKFVEPTPVQAAAIPLALQGRDLRVTAQTGSGKTAAFVLPILNRLIGPAKVRVSIKTLILLPTRELAQQTLKEVERFSQFTFIKSGLITGGEDFKVQAAMLRKVPDILIGTPGRMIEQLNAGNLDLKEVEVLVLDEADRMLDMGFAEDVQRLVDECPNRQQTMLFSATTGGSGLREMIAKVLNNPEHLQLNAVSQLNDTTRQQIITADHNQHKEQIVNWLLANETYQKAIVFTNTRAMADRIYGRLVAQEYKAFVLHGEKDQKDRKLAIDRLKQGGVKILVATDVAARGLDVDGLDLVINFDMPRSGDEYVHRIGRTGRAGNDGLAISLICHGDWNLMSSIERYLKQSFERRTIK

SEQ ID NO: 13804 - protein, 606 aa, Pseudomonas fluorescens
LYRRFEQLIDIFRDAPTASPPDRVLPFYTYYLKQVWPSFAALLIVGLFGALIEVALFSYLSRIIDLAQGTPNVDFFKVHGVELAWMAVVALLLRPLFLALHDMLVHQTLSPSMTSMIRWQNHSYVLKQSLNFFQNDFAGRIAQRIMQTGNSLRDSAVQAVDALWHVLIYAISSLVLFAEADWRLMIPLLTWIAAYIGALYYFVPRVKNRSVEASDARSKLMGRIVDGYTNIATLKLFAHTNFEQHYAREAIQEQTEKAQLAGRVVTSMDVAITTMNGLLIVGTTALALWLWTQSLISVGAIALATGLVIRIVNMSGWIMWVVTGIFENIGMVQDGLQTISQPVSVTDREQAKPLAVARGEVRFEHVDFHYGKKKGIIGDLNLTIKPGEKIGLIGPSGAGKSTLVNLLLRLYDVEGGRILIDGQNIAEVGQESLRARIGMITQDTSLLHRSIRDNLLYGKPDATDAELWEAVRKARADEFIPLLSDAEGRTGFDAHVGERGVKLSGGQRQRIAIARVLLKDAPILIMDEATSALDSEVEAAIQESLETLMQGKTVIAIAHRLSTIARMDRLVVLENGKIAESGNHAELLAHGGLYARLWAHQTGGFV

SEQ ID NO: 13805 - protein, 349 aa, Pseudomonas fluorescens
VQSFNTYVAQFNADNAEAIASGEVQALTESSAAFIEKASGIKSRFVMDKDGILDPARMAPRLPERSNDEWSVLCQMAIGAAEQALQRAGKTAADIDGVIVACSNLQRAYPAIAIEVQEALGIQGFGFDMNVACSSATFGIQQAANTVQLGQARAILMVNPEVCTGHLNFRDRDSHFIFGDAATAVIIERADLATSKHQFDVVSTKLLTKFSNNIRNNFGFLNRAAEEGIGARDKLFVQEGRKVFKDVCPMVAELIGEHLEENKLNVGDVKRFWLHQANLSMNHLIVRKLLGREATEEEAPVILDTYANTSSAGSVIAFHKYQDDLAAGSLAVLSSFGAGYSIGSVILRK

SEQ ID NO: 13806 - protein, 478 aa, Pseudomonas fluorescens
  unsure (1)..(478): unsure at all Xaa locations
LTTAAGAPVVDNNNVQTAGPRGPMLLQDVWLLEKLAHFDREVIPERRMHAKGSGAFGTFTVTHDITRFTKARLFSSVGKTTDVFVRFSTVAGERGAADAERDIRGFAIKFYTEQGNWDLVGNNTPVFFLRDPLKFPDLNHAVKRDPRTNMRSARNNWDFWTLLPEALHQVTIVMSDRGLPRTYRHMHGFGSHTFSFISPANERFWVKFTWKTQQGIENLTDQQAATLIGDDRESAQRDLYNAIEEGHFPQWKLYVQVMPELDAETYPINPFDLTKVWPHADYPLIEVGVLELNRNPDNYFADVEQAAFNPANVVPGISFSPDKMLQARLFSYGDAQRYRVGVNHHQIPVNAPRCPVNSYHRDGQMRTDANAGSTIGYEPNSYGQWAEQPDFSEPPLALKGSAGHWNHREDDDYFSQPGALFRAMSTAQQQVLFENTARSIHGASAQTRQRHIDNCTRADPAYGAGVAQAIEALGXSAM

SEQ ID NO: 13807 - protein, 446 aa, Pseudomonas fluorescens
YIDGAFVPVQGRETIECINPATESVIGTVTLANREDARQAIAAAQRAQVTMGRTSKAERIDMLRRLQAAVLESTEEIRDTAIDEYGAPLARAQWVSQYASQSFANTAQVLENHQLVRPVGRATVVMEPVGVSALFAPWNSTAGTVCSKLAAAIAGGCASVIKPSELSPLQTQVLALALHRAELPNGVINIVLGRGSDVGDEISTSPHIAKISFTGSTATGKLIARAGIETMKRVSLSLTGKSASIVLDDADLETAIPMALNAAFMNNGQACVAGTRLLVPRGCLPQVIERVKTLVDATVVGDPRDPATAIGPLVNQAQFDRVQGFIRRGLEQGARLIVGGEGRPHGLSKGYFVKPTVFADVSNDMDIAREEIFGPVLSIIAYDDEEDAIRLANASVYGLQAYVFTREVERGRRIAARLEAGSVLINRIAPELLAPFGGVKQSGIGR

SEQ ID NO: 13808 - protein, 322 aa, Pseudomonas fluorescens
IMKAVVIQAFGGPEVLTVHDIQLAEPGPGQVVVKVMAAGINFMDTGARRGLGAAWELPLTLGAEGAGVVLASGPQVTEFAVGARVAWHYVPGSYAEQVIAPVSQLVPLPDDIDFSTAASLMMQGLTASNLVDKVHAIQPGDVAFVHAAAGGVGLMLTQMIKLRGGKVIGRVSHADKVEAVLAAGADYVVIGRAQNIAGQVMRLTEGQRVNVVYDGTGAEGFADSLEMLDYFGTLALYGPFMNPTPPIDIFSMPRSIKLTYPSVMHYVRDREVLLEKSRQLFAWVSTGKLKTFIGKRYSLDEAQQAHIDIESRNTTGKLIIVP

SEQ ID NO: 13809 - protein, 482 aa, Pseudomonas fluorescens
FHRLMLRQSLSFFSDEFSGRVTTKVMQTALAVREVLFTVIEIAPGIGVYFIAIIALAGGFALKLMLPFIAWVALFGLAMLYFVPRLGQVGQEQAHARSSMTGRVSDAYTNITTVKLFSHSKREAHFARAAMEDFKQTGFRQMRLVSQFEIVNQALVVGLIMGAGGYALWLWHQGEVGTGAVAAITAMALRINGMSHWIMWQMTSLFENIGTVQDGMDTLTRGPKVQDAPDAGVLVPSGGAVEFDNVSFNYNGERQVLDGLSLSIRPGEKIGLVGRSGAGKSTLINLLLRFYDVDRGEIRIDGQNIAQVTQDSLRSAIGMVTQDTSLLHRSIRDNIAYGRPDATDEQIQRAAANAQADGFINQLSDRQGHTGYDTLVGERGIKLSGGQRQRIAIARVMLKNAPILLLDEATSALDSEVEVAIQESLDEMMQGKTVIAIAHRLSTIAAMDRLIVMDEGRIIEQGTHTELLAKNGTYARLWQHQS

SEQ ID NO: 13810 - protein, 398 aa, Pseudomonas fluorescens
LVWQIVAGLLLGVLVGWYFNTHPQYQSWVSAEILKPLGDIFIKMMKMVVVPIVLCCMILGIAGGGDNKSFGRMGIKSLGYFFAITGLAIVIGLCFANLFEPGTGTDISGIAHGATAITMEPSKGALVIMQNIVPDNVLVAMSEAKLLSVLFFAVLFGVALNALPKEKSAPVVALVQGISDAMFRIVSIVMAYAPIGVFGMIGATVATFGFASLLPLLKLIGVVYLALIVFALVVLGGISYLIGENIFKLIRYFRDELILAFSSAASAAVMPQLMSKLENYGVPRRIVSFVVPVGYAFNLDGASIFLGVATIFIAQLYGIDLSLSQEILLVVTMVLTSKGAAGVPGFAIVILSATLASAGLPLEGVALIAGIFRIIDSGTTTLNVLGNAIAPLVIAKWE

SEQ ID NO: 13811 - protein, 432 aa, Pseudomonas fluorescens
  unsure (1)..(432): unsure at all Xaa locations
AVSSRRLPTRRRWFMLSLLLIATIINYIDRVNISIAAPFMAKDLGLDKIEMGLIFSAFAWTYALALVPAGFIADRFGSRFTYGVSLISWSTVTVFQGFATGFASLFGLRLAVGAMEAPAFPANSRAVTVWFPARERGMASSIYVCGQYLGTALFTGALLWLATTFDWRHVFYSTGALGIVFGVLWLYLYRDPLNCKKVSKEELKYIEAGGGLVKSSQERTRFNWRQIAELFSYRQVWAICIGKFASTSALYFFLTWFPTYLIEERHLTTIKAGIFAVMPFVGATVGILLAGIVSDLLIRRGYSMSFARKLPLVVGSMLGMSIVLVNFTDSNVICIAVLTIAFFAQGIASSSWAAVSEVAPKELIGLTGGITSLAANIGGIVTPIVIGAIVHATGSFAWAFWFIGAVALIGTLSYSLLLGRLYRIELKTRXSQ

SEQ ID NO: 13812 - protein, 224 aa, Pseudomonas fluorescens
KVALVTGAGSGIGRSVALGLLADGYTLVLAGRRPDPLQALVDLAAGEGREALAVPTDVRDPASVDQLFATIAEVYGRLDVVFNNAGVNAPAVPLDELTFEQWRNVIDTNLNGVFLCARGAFGLMRRQQPQGGRIINNGSISAHTPRPFSSAYTASKHAVLGLTKSLALDGRDFNIACSQIDIGNALTEMSVRMTKGRAPGQRQHRPWSRWSTSSHVADAVRYIA

SEQ ID NO: 13813 - protein, 478 aa, Pseudomonas fluorescens
NKTLTTASGAPVADNQNSRSSGPRGPLLLDDFHLIEKLAHFNRENIPERRVHAKGSGAYGTFTVTRDITQYTSAKLFSAVGKQTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLISAQGERHWVKWHYKTKQGIKNLAPADAARLAGTDPDYAQRDLFEAIERGDFPKWSVCIQIMTEAQAAAHYENPFDVTKTWSQKEFPLIEVGELELNRNPLNYFAEVEQAAFGPSNMVPGVGLSPDRMLQGRVFAYADAHRYRVGTNHQQLPVNAPRSPVNTYQRDGSMAFGSNGGAAPNYEPNSYVESPKQAPHYAEPALALSGAADRYDHREDSDYYSHAGALFRLMSDEQKALLVSNIAGAMGGVSSDVIDRQLQHFYKADPAYGEAIAKLLNVQL

SEQ ID NO: 13814 - protein, 714 aa, Pseudomonas fluorescens
VLKKLGIKGRVLLLTLLPTSLMALVLGGYFTWTQQSDLQTQLMQRGEMIAEQLAPLVAPAMGHGDAELLERIATQSLEQPDVRAVTFLAPDRSPLAHAGPTMLNQAPSGDSAHLLRRSGNDATRYLLPVFGKHRNLAGELIPQESDRLLGWVELELSHNGMLLRGYRSLFASLLLIGAGLAGAALLALRMGRTINRPLSQIKQAVAQLKDGHLETRLPPLGSQELDELASGINRMAGTLQNAREELQHSVDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDHIPFNLRDLLQDTLTILAPAAHAKQLELVSLVYRDTPLSLVGDPLRLKQILTNLVSNAIKFTREGTIVARAMLEEENDDSVQLRISIQDTGIGLSNQDVRALFQAFSQADNSLSRQPGGTGLGLVISKRLIEQMGGEIGVDSTPGEGSEFWISLNLPKTRDDAEDLPAAPLLGRRVAVLENHELARQALQHQLEDCGLDVTPFNTLESLTNGVTGAHQTDQAIDLAVLGITSNDMPPERLNQHIWDLEHLGCRVLVLCPTTELTLYHLSVPNPHSQLQSKPACTRKLRRALSDMVNPRQSRSEPGEPLSSRAPKVLCVDDNPANLLLVQTLLEDMGAKVLAVESGYAAVKAVQSESFDLV

SEQ ID NO: 13815 - protein, 404 aa, Pseudomonas fluorescens
MRRVVITGLGIVSCLGNDKETVSANLRASRPGIRFNPEYAEMGLRSQVSGSIDLNLEELIDRKIYRFVGHAAAYAYLAMKDAIADSGLTEEQVSNPRTGLIAGSGGASTLNQMEALDILREKGVKRVGPYRVTRTMSSTVSACLATPFKIKGLNYSIASACATSAHCIGTAMEQIQMGKQDIVFAGGGEEEHWSQSFLFDAMGALSSKRNDTPEQASRAYDADRDGFVIAGGGGMVVVEELEHALARGAKIYAEIRGYGATSDGYDMVAPSGEGAIRCMQQALSTVDTPIDYLNTHGTSTPVGDVAEMKGVREVFGDKAPAISSTKSLSGHSLGAAGVHEAIYCMLMMEGNFIAGSANIDELDPEVADLPVLTKTRENATINTVMSNSFGFGGTNATLVLKRWE

SEQ ID NO: 13816 - protein, 634 aa, Pseudomonas fluorescens
  unsure (1)..(634): unsure at all Xaa locations
RWDINTRTQLISLGPALLLTLLLISFFTFVRIQDLRQELNHTGQLIANQLAPATEYGVISGNNEVLESLLKATLATPNVRFLEVQDSANRILSYVEQPADAHNRPHQVEVFQAPVRLQRIALHNDFFQDGKSSPGVASEDYLGRVIVGLSNDAFSQRQQEILLKAGILALFALLFTFVLARRLAGSLSQPIRDIGNAVKAIQDGDYKTPLPIVDDTELGALSQHINNLAQALEQASREQHQAMAQLIQTREEAEKANNAKSDFLAMMSHELRTPMNGVLGMLQLLETTDMTEEQVEYAALASESTEHLLKVINDILDFSRIERSELELEHIPFNLAEVIGACAQSFQHSAAQRGLALQLRIPEDLRDLQVQGDPTRIRQILVNLVGNALKFTEQGRVSIEAQWQSLDHELLWFTCAVRDSGIGISPESLELMFNAFQQADSSISRRYGGTGLGLPIARTLAERMGGTLRAQSEEGRGSVFTLEIPLALYKQALPALAAPRTLNGASHGEGRNVLLVEDNPVNQTVIEAMLRSLGFTVSVATDGVQAVRSAGDNRFEAILMDCRLPLIDGYEATRRIRQLPGCGQVPIIALTANALQGDRENCLAAGMNDYLAKPFKHNDLQQILQRWVQXQGPF

SEQ ID NO: 13817 - protein, 340 aa, Pseudomonas fluorescens
MTEQRPIAVLGGGSFGTAVANLLAENGHQVRQWMRDPEQAEAIRVNRENPRYLKGIKILPGVTAVTDLQETLDACELCFVALPSSALRTVLAAHAERLSGKMLVSLTKGIEAQTFKLMSQILEEIAPQARIGVLSGPNLAREIAEHALTATVVASEDEELCKAVQAALHGRTFRVYASADRFGVELGGALKNVYAIIAGMAVALEMGENTKSMLITRALAEMTRFAVNQGANPMTFLGLAGVGDLIVTCSSPKSRNYQVGFALGQGLSLDEAVSRLGEVAEGVNTLKVLKAKAQEVGVYMPLVAGLHAILFEGRTLEQVIGLLMRAEPKTDVDFISTSGF

SEQ ID NO: 13818 - protein, 544 aa, Pseudomonas fluorescens
PLDVFYEREARHPRQRFLVQPIGGGQVETLTWADVGHQARCAAHWLRSRELPQGSHIALISKNCAHWIIADLAIWMAGHVSVPLYPNLTAESVNQVLTHSESVLAFIGKLDDWPGMSPGVPAGLTTVSLPLHPPGTFDFNWDDLQRSSPIQDDPRPAAEQLATIIYTSGTTGLPKGVMHSFANLGFATTRGTQLFGLNENDRLLSYLPLCHVAERMFVELASIYTGQTVFFAESLDTFLADLKRARPTAMFGVPRIWTKFQMGVYSKIPAKRLDFLLGLPFIGKRVGHKVLAGLGLDALRVALSGAAPVPLTLLRWYQKLGLDVLEVYGMTESCGYSHICLPGQYKEGWIGRPCPEVEVRIDESGEVQVRSQANMLGYFKEPQKTAETLTEDGFLRTGDKGEQDAEGRLRLTGRLKEIFKTSKGKYVAPAPIENRLAVHSRIEQVCVVGDGLSAPLGLCVLSAVGREEPRAPLHSSLEKLLEEVNAVLDKHERLRRLVVVKDSWAVENGFLTPTLKIKRNIIEDTYGARFEEWSERSEAVLWQD

SEQ ID NO: 13819 - protein, 252 aa, Pseudomonas fluorescens
  unsure (1)..(252): unsure at all Xaa locations
GQVAVVTGAANGIGRATAQAFAAEGLKVVVADLDAAGGEGTVALIRTAGGEATFVRCNVTVESEVKNLMDEVINTYGRLDYAFNNAGIEIEKGKLAEGSMDEFDAIMGVNVKGVWLCMKYQLPLLLAQGGGAIVNTASVAGLGAAPKMSIYAASKHAVIGLTKSAAIEYAKKKIRVNAVCPAVIDTDMFRRAYEADPKKGEFANAMHPVGRIGKVEEIASAVLYLCSDGAAFTTGHSLAVDGGVTAFXGGVG

SEQ ID NO: 13820 - protein, 299 aa, Pseudomonas fluorescens
SSALSIRQLTKTYGNGFQALSGIDLDVAEGDFFALLGPNGAGKSTTIGILSTLVNKTSGTVNIFGHDLDKNPAALKRSIGVVPQEFNFNQFEKTFDIVVTQAGYYGIPARIAKERAEQYLTQLGLWDKRDVPSRSLSGGMKRRLMIARALVHEPRLLILDEPTAGVDIELRRSMWTFLTELNQKGITIILTTHYLEEAEQLCRNIGIIDHGTIVENTSMRQLLGQLHVETFLLDLKNDLSAAPQLAGYPARLLDGHTLEVQVDKSVGITALFGQLALQNIEVLSLRNKTNRLEELFVSL

SEQ ID NO: 13821 - protein, 294 aa, Pseudomonas fluorescens
LMSNIHGIIGYTITPFGANGEGVDLPALGRSIDRLIAGGVHAIAPLGSTGEGAYLSDAEWDQVAEFSIKHVAKRVPTVVSVSDLTTAKAVRRARFAEAHGADVVMVLPTSYWKLTEAEILAHYRAIGDSIGVPIMLYNNPATSGTDMSVELILRIVNGVENVTMVKESTGDIQRMHKLQLLGEGRVPFYNGCNPLALEAFAAGAKGWCTAAPNLIPQLNLDLYEATLAGDLGKARELFYRQLPLLDFILKGGLPATIKAGLRLTGLEVGDPRLPVFPLAEAGRTQLQALLYTLR

SEQ ID NO: 13822 - protein, 380 aa, Pseudomonas fluorescens
SSTFFIPAVNIMGSGCLDEAMNAIRNYGFRKALIVTDAGLAKAGVATMIAEKLAMQDIDSVVFDGAKPNPSIANVEAGLALLKESRCDFVVSLGGGSPHDCAKGIALCATNGGQIRDYEGVDQSTKPQLPLIAINTTAGTASEMTRFCIITDETRHVKMAIVDRNVTPLLSVNDPALMVAMPKSLTAATGMDALTHAIEAYVSTAANPITDACALKAMTLISNNLRLVVRDGSDLAARENMAYAQFLAGMAFNNASLGYVHAMAHQLGGFYDLPHGVCNAVLLPHVQTFNAQVCAGRLTDVAHAMGADIRGFSPEEGAQAAIAAIRCLARDVEIPGGLRDLGAKCTDIPVLAANALKDACGFTNPRVADQRQIEEIFRSA

SEQ ID NO: 13823 - protein, 289 aa, Pseudomonas fluorescens
YSQTLIVQEVSPRDGLQIEPTWVETEDKIALIDQLSRAGFSRIEAGSFVSPKAIPALRDGEQVFKGIQRQPGVIYVALIPNLKGAQRALESGADELNLVMSASQTHNLANMRMRCEASLVAFGEIVTFASGSGVRLNGSIATTFGCPFEGRIDEDRVLQILEAYQQLGIQGISLADTTGMANPRQVDRLVRRVLQRVSAADLTLHFHNTRGLGLCNVLAAYEAGARRFDAALGGLGGCPFAPGASGNICTEDLVNLCDEVGIHTGIDLPLLLKLSRGLPALLGHDVPGQ

SEQ ID NO: 13824 - protein, 441 aa, Pseudomonas fluorescens
FEKVLIANRGAIACRILRTLRELHVEGVAVYSEADAASLHILQADEAHSLGEGAAASTYLAVDKILAIAKATGATAIHPGYGFLSENAAFAEACANHGIAFIGPTPEQLRVFGLKHTARALAKQHGVPMLEGTELLDSLDAALIAGAQVGYPVMLKSTAGGGGIGMRVCRNASELSESFEAVKRLGQNNFSDAGVFIEKYIQRARHLEVQVFGDGQGAVIALGVRDCSVQRRNQKVLEETPAPNLPDGMADELCAAAIKLAKAVNYRSAGTVEFVFDSDAQRFYFLEVNTRLQVEHGVTEQVWGVDLVRWMIELAAGDLPPLSTLFEGLKPDGHAIQARLYAEDPGRDFQPSPGLLTAVEFPAANGIQLRIDTWVEAGCEIPPYFDPMIAKLISWAPTREQARAELHQALGDSLLYGVETNRDYLRQILLDTPFASGQPWT

SEQ ID NO: 13825 - protein, 679 aa, Pseudomonas fluorescens
LLNIGMSGLAASSSSLAVTGNNIANVDTAGYSRQQTVQGTKSSIQYGNVFIGTGTTLADVRRVYNSYLESQLRTATSLNSEAAAFGAQATALDGSLSDTNTGLTGVLQKFFTSMQGVSTSATDDTSRQSVLTGAQALTSRFNALAKQMNDQNATLNGNLSDMASQVNKLATSIATLNQKIGEISTSGGQPNDLLDSRNEAVRQLSELTGAQVVERGTSFDIYIGSGQPLVIGNTTNTLSTVPLKGDPSRMGIQMDRGSSTIDITSAMTGGEIGGLLTYRKEVLDPALNELGRVALVVADQINRQQAQGIDKNGDFGAAIFNNINSAALISQRSIAQSGNSAGSGNLDVTIKDTGKLTTSDYQVTFTSATNYTVKRSDGTDMGSFSTTTTPPPVIDGFTLALNGGALSAGDTFKVTPTRNAASSIQTVLTDPKKIAAAGPLTGVASANNSGTYTQPTLTDVVDIYNPASQAELQNALKYSTPVKLVFGATTSGSQTYNMVDAKGATIGSGVIVPGQANTLNLKIGMVDSTGAPVMDTTVIPNVQKTFTVQTTVGATPKSGETFTINLTGAASSDNRNAQALVGLQTKQTVDTGTASKGISLTDAYNKLVTNVGTQAAQSKSDSAATTVILDQAQGARDSLSQVNLDEETGNLVKYQQYYTASSQIIKAAQETFATLINSL

SEQ ID NO: 13826 - protein, 279 aa, Pseudomonas fluorescens
  unsure (1)..(279): unsure at all Xaa locations
FSQKAAMRKKQRAALXRTRGETMKAVILAGGLGTRISEESHLKPKPMIEIGGKPILWHIMKQYSAHGIHDFVICLGYKGYAIKDFFANYFLHTSDVTFDMRENRMDVHQNYSEPWRVTLIDTGEETMTGGRLRRAARYLENEQAFCFTYGDGVSDLNISSLVDFHLTHGKLATVTAVQPPGRYGALDRDGDRVLGFTEKPRGDGGWINGGFFVLSPKVLPLIEGDETSWESGPLDGLAERGELMAYQHEGFWQPMDTLRDKNHLEALWQSGEAPWKQWD

SEQ ID NO: 13827 - protein, 347 aa, Pseudomonas fluorescens
FWRGKRVLVTGHTGFKGSWLTLWLQSLGAQVSGFSLDPSTEPSLFELARVSEGINDQRGDLRDLGALLEIIADTEPEIVLHLAAQPLVREGYRDPLGTYSSNVMGTLNLLEAIRQVGCVRACVLVTTDKVYANKEWLWPYREDEALGGHDPYSSSKACCELLAQSYAASFFPADKYAEHGLALATARAGNVLGGGDFAPERLIPDVLKAWSADEPVTLRYPQAVRPWQHALEPLAGYLQLAAGLYEQGPEYAGAWNFGPGEADMCSVGEVVELLSNRWPQARGLRLEKSDLHEAGLLRLDSSRARQVLGWQPRWTLQQCLTQTLDWHLAWQNGDDMRTVTLGQLNLY

SEQ ID NO: 13828 - protein, 297 aa, Pseudomonas fluorescens
SYVPVAGVDNYAQGAKFEKDEEFILGKIGSAFLPRKDAEQETSDLCVEAANALFASNPDLKRESIDALIVVTQNGDEEGLPHTAAIVQDKLGLPTNVAAFDISLGCSGYVYGIYAIKGFMEAAGLKNGLLITADPYSKIVDPEDRNTTMLFGDAATATWMGEDPVWALGKAKFGTDGSGAPHLKVTDGVFFMNGRQVFNFALLKVPAHLHELLDDSGLKADDIDAFCIHQGSAAIVDAVARRFEGEPEKFIKDMVETGNTVSSSVPLLLEKHVMDSDWNRIAISGFGVGLSWGSAII

SEQ ID NO: 13829 - protein, 447 aa, Pseudomonas fluorescens
MRLERTSFAKRLSTYAEATEIAGAPILEGRLLRMVGLTLEAEGLRAAMGTRCMVINDDTYHPSQVEAEVMGFSGSKVFLMPVGSVAGIAPGARVVPLADTGRLPMGMSMLGRVLDGAGRALDGKGGMKAEDWVPMDGPTINPLNRDPISVPLDVGIRSINGLLTVGRGQRLGLFAGTGVGKSVLLGMMTRFTEADIIVVGLIGERGREVKEFIEHILGEEGLKRSVVVASPADDAPLMRLRAAMYCTRIAEYFRDKGKNVLLLMDSLTRFAQAQREIALAIGEPPATKGYPPSVFAKLPKLVERAGNAEKGGGSITAFYTVLSEGDDQQDPIADSARGVLDGHIVLSRRLAEEGHYPAIDIEASISRVMPAVVAPEHMQRAQYFKQLWSRYQQSRDLISVGAYVAGGDRETDLAINLQPQLVRYLRQGLNDKISLGESEAYLETIFA

SEQ ID NO: 13830 - protein, 724 aa, Pseudomonas fluorescens
DLSLLLNSLNDAQRQAVAAPVGRQLVLAGAGSGKTRVLVHRIAWLIQVENASPHSILSVTFTNKAAAEMRHRIEQLLGINPAGMWVGTFHGLAHRLLRAHWQEAGLSQTFQILDSDDQQRLVKRVIRELGLDEQRWPARQAQWFINGQKDEGLRPQHIQASGDLFLATMRGIYEAYEAACQRAGVIDFSELLLRALDLWRDHPGLLAHYQKRFRHILVDEFQDTNAVQYAWLRLLGKGGDSLMVVGDDDQSIYGWRGAKIENIHQYSSDFPDSVTIRLEQNYRSTAGILKAANALIANNTGRLGKELWTDGGDGEAINLYAAFNEHDEARYVVETIESALKTGLARSDIAILYRSNAQSRVLEEALLRERIPYRIYGGQRFFERAEIKNAMAYLRLLEGRGNDAALERVINVPARGIGEKTVEAIRDHARHSDVSMWEAMGQLVANKGLTGRAAGALGAFIELIENLAAKCAEMPLHLMTQTVIEQSGLIAYHEAEKGEKGQARVENLEELVSAARNFENTEEDEELTPLAAFLGHASLEAGDTQADEHEDSIQLMTLHSAKGLEFPYVFLVGMEEGLFPHKMSLEEPGRLEEERRLAYVGITRAMQNLVMTYAETRRLYGSETYNKVSRFVREVPKGLIQEVRLSNSVSRPFGGNQSMGGSNLFSGSEIPETGLSLGQAVRHSIFGDGVILNFEGAGAQARVQVNFAEGSKWLMLGYAKLEAI

SEQ ID NO: 13831 - protein, 1076 aa, Pseudomonas fluorescens
ITKILIANRGEIAVRIVRACAEMGIRSVAIYSDADRHALHVKRADEAHSIGAEPLAGYLNPRKLVNLAVETGCDALHPGYGFLSENAELADICAERGIKFIGPSAEVIRRMGDKTEARRSMIKAGVPVTPGTEGNVSGIEEALSEGDRIGYPVMLKATSGGGGRGIRRCNSREELEQNFPRVISEATKAFGSAEVFLEKCIVNPKHIEAQILGDSFGNVVHLFERDCSIQRRNQKLIEIAPSPQLTPEQRAYIGDLSVRAAKAVGYENAGTVEFLLAEGEVYFMEMNTRVQVEHTITEEITGIDIVREQIRIASGLPLSVKQEDIQHRGFALQFRINAEDPKNNFLPSFGKITRYYAPGGPGVRTDTAIYTGYTIPPFYDSMCLKLVVWALTWEEAMDRGLRALDDMRLQGVKTTAAYYQEILRNPEFRSGQFNTSFVESHPELTNYSIKRQTRRAGPGHRRRHRRPRRPVRNRTMTKKIFVTDTILRDAHQSLLATRMRTEDMLPICDKLDKVGYWSLECWGGATFDACVRFLKEDPWERLRQLRAALPNTRLQMLLRGQNLLGYRHYSDDVVKAFVAKAAVNGIDVFRIFDAMNDVRNLRVAIEAVKAAGKHAQGTIAYTTSPVHTIDAFVAQAKQMEAMGCDSVAIKDMAGLLTPYATGELVRALKAEQSLPVFIHSHDTAGLAAMCQLKAIENGADHIDTAISSFASGTSHPGTESMVAALKGTEFDTGLNLELLQEIGLYFYAVRKKYHQFESEFTAVDTRVQVNQVPGGMISNLANQLKEQGALNRMGEVLAEIPRVREDLGFPPLVTPTSQIVGTQAFFNVLAGERYKTITNEVKLYLQGGYGKAPGTVNEKLRRQAIGSEEVIDVRPADLLKPEMTKLRADIGALAKSEEDVLTFAMFPDIGRKFLEERAAGTLTPEVLLPIPEAGKVASAGGEGVPTEFVIDVHGETYRVDITGVGVKAEGKRHFYLSIDGMPEEVVFEPLNEFVGGGSSKRKQASAPGHVSTTMPGNIVDVLVKEGDTVKAGQAVLITEAMKMETEVQAAIAGKVTAIHVAKGDRVNPGEILIEIE

SEQ ID NO: 13832 - protein, 478 aa, Pseudomonas fluorescens
MISIMSSAASFRTENDLLGTLEVPAQAYYGIQTLRAVNNFRLSGVPISHYPKLVVGLAMVKQAAADANRELGHLSEAKHAAISEACARLIRGDFHEEFVVDMIQGGAGTSTNMNANEVIANIALEAMGHQKGEYQYLHPNDDVNMAQSTNDAYPTAIRLGLLLGHDALLASLDSLIQAFAAKGEEFNHVLKMGRTQLQDAVPMTLGQEFRAFATTMGEDLARLKTLAPELLTEVNLGGTAIGTGINADPRYQALAVQRLALISGQPLVPAADLIEATSDMGAFVLFSGMLKRTAVKLSKICNDLRLLSSGPRTGINEINLPARQPGSSIMPGKVNPVIPEAVNQVAFQVIGNDLALTMAAEGGQLQLNVMEPLIAFKILDSIRLLQRAMDMLREHCIVGITANEARCRELVEHSIGLVTALNPYIGYKNATRIARIALESGRGVLELVREEGLLDEAMLADILRPENMIAPRLVPLKA

SEQ ID NO: 13833 - protein, 327 aa, Pseudomonas fluorescens
LFPATRLRRNRRDDFSRRLVRENVLTVDDLILPVFVLDGENRREAVASMPGVERLTIDLLLEEAAKWVELGIPALALFPVTPPELKSLDAAEAWNPEGIAQRATRALRDRFPELGVITDVALDPFTTHGQDGILDEEGYVQNDITVDALVKQALSHAAAGAQVVAPSDMMDGRIQAIREALELAGHVNVRIMAYSAKYASAYYGPFRDAVGSAANLGKANKASYQMDPANSDEALHEVGADLSEGADMVMVKPGMPYLDILFRVKDAFKVPTFVYQVSGEYAMHMAAIQNGWLSEGVILESLTAFKRAGADGILTYFAVRAAQLLRE

SEQ ID NO: 13834 - protein, 247 aa, Pseudomonas fluorescens
VTAWRLLLTRPAEDCSALAAVLAEQGFFSSCLPLLEIAPLPVSDTMRRTIMQLPRYSAVIVVSKPAARIAVDLLDALRLATPTMPWFSVGAATAAILRDRGLDVSFPDAGDDSEALLQLPRLLEAVAMPGSQVLILRGEGGRELLGERLRTLGASVEYLELYRRDLPDYPPQELPRRIAAERLNGLVVSSGQGFEHLRQLAGDSWPALAQLPLFVPSPRVAEQASAAGARTVVDCRGASAAALLTAL

SEQ ID NO: 13835 - protein, 312 aa, Pseudomonas fluorescens
MSSREIRIATRKSALALWQAEYVKARLEAAHPGLLVTLVPMVSRGDKLLDSPLSKIGGKGLFVKELETALLENEADIAVHSMKDVPMDFPEGLGLFCICEREDPRDAFVSNTYSSLDALPAGSIVGTSSLRRQAQLLTRRPDLEIRFLRGNVNTRLAKLDAGEYDAIILAAAGLIRLGFEDRITSAISVDDSLPAGGQGAVGIECRSADTEIHALLAPLHHADTADRVTAERALNKHLNGGCQVPIACYAVLEGDQLWLRGLVGEPSGGKLLNAQARAPRAAAETLGVQVAEDLLSQGADDILKAVYGEAGH

SEQ ID NO: 13836 - protein, 456 aa, Pseudomonas fluorescens
NQSWGGRFSEPVDAFVARFTASVTFDQRLYRHDIMGSIAHATMLAKVGVLTDAERDSIIDGLKTIQGEIEAGQFDWRVDLEDVHMNIEARLTDRIGVTGKKLHTGRSRNDQVATDIRLWLRDEIDLILSEITRLQKGLLEQAEREAASIMPGFTHLQTAQPVTFGHHMLAWFEMLSRDYERLVDCRKRTNRMPLGSAALAGTTYPIDREYTAQLLGFDAVGGNSLDNVSDRDFAIEFCSAASIAMMHLSRFSEELVLWTSAQFQFIDLPDRFCTGSSIMPQKKNPDVPELVRGKTGRVFGALMGLLTLMKGQPLAYNKDNQEDKEPLFDAADTLRDSLRAFADMIPAIKPKHAIMREAALRGFSTATDLADYLVRRGLPFRDCHEIVGHAVKYGVDTGKDLAEMSLEELRQFSDQIEQDVFAVLTLEGSVNARDHIGGTAPAQVKAAVVRGQALIA

SEQ ID NO: 13837 - protein, 181 aa, Pseudomonas fluorescens
MSLEQNYTAILGQLGEDVSREGLLDTPKRAAKAMQYLCRGYQQTLEEVTNGALFSSDNSEMVLVKDIELYSLCEHHLLPFIGKAHVAYIPSGKVLGLSKVARIVDMYARRLQIQENLSRQIADAVQQVTGALGVAVVIEAKHMCMMMRGVEKQNSSMITSVMLGEFRENAATRSEFLSLIK

SEQ ID NO: 13838 - protein, 363 aa, Pseudomonas fluorescens
MSGNTYGKLFTVTTAGESHGPALVAIVDGCPPGLEISLEDLQRDLDRRKPGTSRHTTQRQEADEVEILSGVFEGRTTGCSIGLLIRNTDQKSKDYSAIKDLFRPAHADYTYHHKYGERDYRGGGRSSARETAMRVAAGAIAKKYLASQGIVIRGYMSQLGPIEIPFKTWESVEQNAFFSPDPDKVPELEAYMDQLRRDQDSVGAKITVVAEGVMPGLGEPIFDRLDAELAHALMSINAVKGVEIGAGFACVAQRGTEHRDELTPEGFLSNNAGGILGGISSGQPIVAHLALKPTSSITTPGRSIDIDGNPVDVITKGRHDPCVGIRATPIAEAMMAIVLMDHLLRHRGQNADVRVSTPVLGQL

SEQ ID NO: 13839 - protein, 612 aa, Pseudomonas fluorescens
MRHAPSDTITWGMMLRKLPMIAKAIPRVVKGMKVANVKDPTQTCGLGWTFEQATLRNPEGPALLSGEVVLSYSQVNQWANRIAHYLIGQGIGKGDVVAVFIENRPELLVTILALAKVGAVSALLNTSQTRDTLIHSINLVTPAAIVVGEELLPAFAAVREQVSIPATRAWFVADQDTFSHPGIAPEGYINLISASADASGDNPASSRQIFFDDPCFYIYTSGTTGLPKAGVFKHGRWMRSSASFGMIALDMRPDDIVYCTLPLYHATGLCVCWGSAVNGASGFAIRRKFSARQFWSDVRRYRATTIGYVGELCRYLVDQPLSADDSRHDVRKMIGNGLRPGAWAEFKTRFGVDHICELYAASDGNIGFTNILNFDNTIGFSLMAWELVAYDQDSGEPIRGADGFMRKVGRGERGLLLARIDDKAPLDGYTDPQKTAKVVLQDVFIKGDRFFNTGDLLRNIGFGHAQFVDRLGDTYRWKGENVSTTEVENLLLQHPHISEAVAYGVEIPNTNGRAGMAAITPAESLATLDFAELLAFVRQRMPAYAVPLFLRVKVKMETTGTFKYQKTRLKNEGFDPRQTGDDPIYAWLPGTETYVQVSDGILADIRAGKFRY

SEQ ID NO: 13840 - protein, 169 aa, Pseudomonas fluorescens
MSDQSRQMTPEEAAEFTEQVFNKAREGDAVMLDRLITAGLPVNLTNSKGDTLLMLASYYGHVDAVQVLLKHKADPEQRNGNGQSPIAGAAFKGDLAVVKALVEGGAQIEGASFDGRTALMMAAMFNRVEIVDYLIDQGADPKAKDANGITALDAARTMGAVDTTAQLEK

SEQ ID NO: 13841 - protein, 400 aa, Pseudomonas fluorescens
TQALIFDALRTPRGKGKADGSLHSVKPVNLVAGLLTALQARTALDTSQVDDVVLGCVTPIGDQGSDIAKTAVQVADWDVSVAGVQINRFCASGLEAVNLGAMKVRSGFEELVVVGGVESMSRVPMGSDGGAWALDPQTNLHSHFTPQGVGADLIATLEGFSRQDVDAYALHSQQKAARARADGSFNKSLVPVQDQNGIILLDHDEFIRAESTLEGLGKLKPSFEMIGQLGFDATALRVYSHVERINHVHTPGNSSGIVDGAALMLIGSEAKGRALGLQPRARIVATAVTSTDPTIMLTGPAPATRKALAKAGLRVEDIDLFEVNEAFASVVLKFIKDMAVDPDKVNVNGGSIAIGHPLGATGCAILGTLLDELEARRLRYGLATLCVGGGMGIATIIERL

SEQ ID NO: 13842 - protein, 229 aa, Pseudomonas fluorescens
MSDLIAYHLEDGIATLTLSNGKVNAISPDVIAAFNAALDQAVADRAIVIITGQPGILSGGYDLKVMTAGPKEAVSLVTAGSTLARRLLSHPFPVIVACPGHAVAKGAFILLSADYRIGVDGPFSIGLNEVQIGMTMHHAGIELARDRLRRSAFHRSVINGEMFDPQSAVDAGFLDKVVAAEELQGAALAAARQLKKINMTAHKNTKLKVRKALLETLDNAIIQDQEHLG

SEQ ID NO: 13843 - protein, 178 aa, Pseudomonas fluorescens
MAELTTLARPYAKAAFEHAQAHQQLANWSAMLGLAAAVSQDDTMQRVLKAPRLTSAEKAATFIDVCGDKFDAKAQNFINVVAENDRLPLLPEIAALFDLYKAEQEKSVDVEVTSAFALNQEQQDKLAKVLSARLNREVRLQVEEDSSLIGGVVIRAGDLVIDGSIRGKIAKLAEALKS

SEQ ID NO: 13844 - protein, 510 aa, Pseudomonas fluorescens
LNPSEISEIIKGRIEKLDVTSQARNEGTVVSVSDGIVRIHGLADVMYGEMIEFPGGVYGMALNLEQDSVGAVVLGAYTTLAEGMSAKCTGRILEVPVGKELLGRVVDALGNPVDGKGPLGNTETDAVEKVAPGVIWRKSVDQPVQTGYKAVDAMIPVGRGQRELIIGDRQIGKTALAIDAIINQKDSGIFCVYVAIGQKQSTIANVVRKLEENGALANTIIVAASASESAALQFLAPYSGCTMGEFFRDRGEDALIVYDDLSKQAVAYRQISLLLRRPPGREAYPGDVFYLHSRLLERASRVSEEYVEKFTNGAVTGKTGSLTALPIIETQAGDVSAFVPTNVISITDGQIFLESAMFNSGIRPAVNAGVSVSRVGGAAQTKIIKKLSGGIRTALAQYRELAAFAQFASDLDEATRKQLEHGQRVTELMKQKQYAPMSIADMSLSLYAAERGFLTDIEITKIGSFEQALIAFFNRDHADLMAKINVKGDFNDEIDAGLKAGIEKFKATQT

SEQ ID NO: 13845 - protein, 286 aa, Pseudomonas fluorescens
MAGAKEIRSKIASIKSTQKITSAMEKVAVSKMRKAQMRMAASRPYAERIRQVIGHLANANPEYRHPFMIDREVKRVGYVVVSSDRGLCGGLNTNLFKALVKDMAVNRENGVEIDLCVVGSKGAAFFRNFGGNVVAAISHLGEEPSINDLIGSVKVMLDAYLDGRIDRLSVVSNKFINTMTQQPTVEQLIPLVATPDQELKHHWDYLYEPDAKELLDGLMVRYVESQVYQAVVENNAAEQAARMIAMKNATDNAGDLISDLQLIYNKARQAAITQEISEIVGGAAAV

SEQ ID NO: 13846 - protein, 458 aa, Pseudomonas fluorescens
MSSGRIVQIIGAVIDVEFPRDSVPSIYDALKVQGAETTLEVQQQLGDGVVRTIAMGSTEGLKRGLDVNNTGAAISVPVGKATLGRIMDVLGNPIDEAGPIGEEERWGIHRAAPSFAEQAGGNELLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKQGSITSIQAVYVPADDLTDPSPATTFAHLDATVVLSRDIASLGIYPAVDPLDSTSRQLDPNVIGNDHYETARGVQYVLQRYKELKDIIAILGMDELSEADKQLVNRARKIQRFLSQPFFVAEVFTGASGKYVSLKDTIAGFKGILNGDYDHLPEQAFYMVGGIEEAIEKAKKL

SEQ ID NO: 13847 - protein, 610 aa, Pseudomonas fluorescens
MCGIVGAVAERNITAILLEGLKRLEYRGYDSAGVAVLTNDGTLERTRRVGKVSELDAALAEHPLVGRLGIAHTRWATHGAPNERNAHPHFSGGIAVVHNGIIENHEALREQLKALGYVFTSDTDTEVIAHLLTHKLKDLHDLTVALKATVKELHGAYGLAVINAQQPDRLVAARSGSPLVIGLGLGENFLASDQLALRQVTDRFMYLEEGDIAEIRRDSVQIWDVNGQAVERQTVQYSDGAEAAEKGEYRHYMLKEIHEQPVVVQRTLEGRLSENQVLVQAFGPQAAELFVKVRNVQIVACGTSYHAGMVARYWLEELAGIPCQVEVASEFRYRKVVVQPDTLFVTISQSGETADTLAALRNAKELGFLASLAICNVGISSLVRESDLTLLTQAGREIGVASTKAFTTQLVGLLLLTLSLGQVRGTLADGVEARLVEELRRLPTRLGEALAMDGTVEKIAELFAEKNHTLFLGRGAQFPVAMEGALKLKEISYIHAEAYPAGELKHGPLALVDNDMPVVTVAPNNELLEKLKSNLQEVRARGGELIVFADEKAGMTNGEGTHVVQMPHIHDILSPILYTIPLQLLSYYVAVLKGTDVDQPRNLAKSVTVE

SEQ ID NO: 13848 - protein, 154 aa, Pseudomonas fluorescens
QSLHRLPPEMMDINEIREYLPHRYPFLLVDRVVELDTEGKRIRAYKNVSINEPFFNGHFPAHPIMPGVLIIEAMAQAAGILGFKMLDVKPADGTLYYFVGSDKLRFRQPVLPGDQLILEAKFISCKRQIWKFECQASVDGKPVCSAEIICAERK

SEQ ID NO: 13849 - protein, 431 aa, Pseudomonas fluorescens
  unsure (1)..(431): unsure at all Xaa locations
MAKIVDIKGREVLDSRGNPTVEADVLLDNGIIGSACAPSGASTGSREALELRDGDKSRYLGKGVLKAVANINGPIRDLLLGTDPSDQKALDQAMIKLDGTENKATLGANAILAVSLAAAKAAAQDQDLPLYAHIANLNGTPGVYSMPVPMMNIINGGEHADNNVDIQEFMVQPVGAKSFSEGLRMGTEIFHHLKAVLKARGLSTAVGDEGGFAPNLASNEDALKVISEAVANAGYKLGTDVTLALDCAASEFFEDGKYNLSGEGQVFTAEGFADYLKGLTERYPIISIEDGLDESDWAGWKILTDKIGEKTQLVGDDLFVTNTKILKEGIDKKIANSILIKFNQIGTLTETLEAIQMAKAAGYTAVISHRSGETEDSTIADLAVGTSAGQIKTGSLCRSDRVSKYNQLLRIEEQLNGKAKYNGRSEFRGXA

SEQ ID NO: 13850 - protein, 371 aa, Pseudomonas fluorescens
SMIKSRAAVAFEAKKPLEIVEVDVAMPKAGEVLLRVVASGVCHTDAYTLSGADPEGIFPSILGHEGGAIVEAIGEGVTSVAVGDHVIPLYTPECGQCKFCKSGKTNLCQAIRATQGKGLMPDGTSRFSYKGQTIFHYMGTSTFSEYTVLPEISVAKISKDAPLEKVCLLGCGVTTGIGAVINTAKVKPGDTVAIFGLGGIGLSAVIGAVKAKASRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRTELPSYVDMAQSGEIPLDTFITHTMGLEDINKAFDLMHEGKSIRTVIHF

SEQ ID NO: 13851 - protein, 211 aa, Pseudomonas fluorescens
MTSQRTRERLIQRLYEEGVSNASVLEVIRRTPRHLFVDEALAHRAYEDTALPIGNNQTISQPYMVARMSELLLEAGPLDKVLEIGTGSGYQTAVLSQLVERVFSVERIKVLQDRAKERLIELNLRNVVFRWGDGWEGWPALAPYNGIIVTAVATDVPQALLDQLAPGGRMVIPVGSGEVQQLMLIVREENGFSRHVLGAVRFVPLLNGPLA

SEQ ID NO: 13852 - protein, 853 aa, Pseudomonas fluorescens
LSSHTPMMQQYWRLKNQHPDQLMFYRMGDFYEIFYEDAKKAAKLLDITLTARGQSAGQAIPMCGIPYHAAEGYLAKLVKLGESVVICEQVGDPATSKGPVERQVVRIITPGTVSDEALLDERRDNLIAAVLGDERLFGLAVLDITSGNFTVLEIKGWENLLAELERVNPVELLIPDDWPKDLPAEKRRGVRRRAPWDFERDSALKSLCQQFSTQDLKGFGCETLTLAIGAAGCLLAYAKETQRTALPHLRSLRHERLDDTVVLDGASRRNLELDTNLAGGRDNTLQSVVDRCQTAMGSRLLTRWLNRPLRDLTVLLARQTSITCLLDRYRFENLQPQLKEIGDIERILARIGLRNARPRDLARLRDALGALPELQVAMTDLEAPHLQRLATTTSTYPELAALLEKAIIDNPPAVIRDGGVLKTGYDSELDELQSLSENAGQFLIDLEAREKARTGLANLKVGYNRIHGYFIELPSKQAESAPADYIRRQTLKGAERFITPELKEFEDKALSAKSRALAREKMLYEALLEDLISQLPPLQDTAGALAELDVLSNLAERALNLDLNCPTFVSEPCMRISQGRHPVVEQVLTTPFVANDLSLDDNTRMLVITGPNMGGKSTYMRQTALIVLLAHIGSFVPAASCELSLVDRIFTRIGSSDDLAGGRSTFMVEMSETANILHNATERSLVLMDEVGRGTSTFDGLSLAWAAAERLAQLRAYTLFATHYFELTVLPEAEPLVANVHLNATEHNERIVFLHHVLPGPASQSYGLAVAQLAGVPSEVIVRAREHLSRLEDTALPHEAPKPAAKGKPAAPQQSDMFASLPHPVLDELAKLDLDDVTPRRALEMLYALKNRI

SEQ ID NO: 13853 - protein, 382 aa, Pseudomonas fluorescens
MPAFQEYFDPSHQMVRDSVSRFVEREILPDIDAWEEAENFPRELYLKAGAAGILGIGYPEALGGSHEGDLFAKIAASEELMRCGSGGLVAGLGSLDIGLPPIVKWARPEVRDCVVPQVLRGEKISALAVTEPGGGSDVANLQTRAVRDGDYYRVSGSKTFITSGVRADYYTVAVRTGAPGFGGISLLLIEKSTPGFTVGRQLKKMGWWASDTAELFFDDCRVPVGNLIGAENMGFACIMGNFQSERLALALMANMTAQLALEESVKWAKEREAFGKPIGKFQVIKHRLAEMATTLEVSREFTYRQAAKMAAGQSVIKEISMAKNFATDTSDRITNEAVQILGGLGYVRESLVERLYRDNRILSIGGGTREVMNEIISKQMGL

SEQ ID NO: 13854 - protein, 182 aa, Pseudomonas fluorescens
MVFDSFDIKSLIRPVIDFPKPGVIFRDITPLFQSPKALRLVMDSFAHRYVEADFTHIGAMDARGFLIGSVLAYQLNKPLVLFRKQGKLPADVLAEGYATEYGEAFLEVHADSLCEGDSVVMFDDLIATGGTLIAAANLIRRMGARVHEAAAIIDLPELGGSQRLEDMGIPTFCLTQFALTDK

SEQ ID NO: 13855 - protein, 798 aa, Pseudomonas fluorescens
MTTPIPCYHCALPVPSGSRFTAVVLGESREFCCPGCQAVAEAIVAGGLESYYQHRSEASANPEALPVQLVDELELYDRADVQQPFVRHEGELAETTLLMEGISCAACGWLIEKHLRTLPAVAEARLNLSNHRLHVRWADAQLPLSQILGELRHIGYAAHPYQADRASEQLASENRLALRQLGVAGLLWFQAMMATMATWPEFNIDLSPELHTILRWVALFLTTPIVFYSCAPFFKGAMRDLRTRHLTMDVSVSLAIGAAYVAGIWTSITGVGELYFDAVGMFALFLLAGRYLERRARERTAAATAQLVNLLPASCLRLDDAGQSERILLSELRLGDRVLVQPGSVLPADGKILDGQSSIDESVLTGEYLPQPRAKGDAVTAGTLNVEGALTVEVQALGQDTRLSAIVRLLDRAQAEKPRLAEIADRAAQWFLLLSLIAAAAIGLLWWELDSSRAFWIVLAMLVATCPCALSLATPTALTAATGTLHKLGLLLTRGHVLEGLNQIDTVIFDKTGTLTEGRLVLRSIRPLGALDNDHCLSLAAALENRSEHPIARAFGRAPLAAEDVHSTPGLGLEGLVGEQRLRIGQADFVCDLSGAPVPSMPNEPGQWLLLGNRQGPLAWFALDDRLRDDAPALLAACKARGWRTLLLSGDSSPMVASVAAELGIDEARGGLRPDDKLQVLQQLHRNGRKVLMLGDGVNDVPVLAAADISVAMGSATDLAKTSADAVLLSNRLDALVQAFTLARRTRRVIIENLLWAALYNGLMLPFAALGWITPVWAAVGMSISSLTVVLNALRLTR

SEQ ID NO: 13856 - protein, 262 aa, Pseudomonas fluorescens
MQISLARQVALVTGASSGIGHGAAKALAAAGAAVVINYNRQAEPAEALARQIVADGGQAIAIGADVSKEEDVERLFQQTLDAFGTLDILVANSGLQKDAAAVDMSLADWNAVIDVNLTGQFLCARAALRIFNRQGVREGVSRAAGKIIHMSSVHQRIPWAGHVNYAASKGGVDQLMQTLAQEVSHQRIRINGIAPGAIRTAINKDATEGDAAQALLKLIPYGRIGDVEDVANAVVFLASDASDYIVGTTLFIDGGMSLYPEF

SEQ ID NO: 13857 - protein, 326 aa, Pseudomonas fluorescens
MTEIESSVDDLLMSEEQANNLTYFAFAKQHNAEPALAPTKASVGALPDVLAGRYHLERLLGAGGMGAVYRARDLLHEQFGDPDPYIALKILSEEFAESPDASALLYSEFALTRRLRHDNVLRPHTFEVDTDCQRAFITMELMRGLTLDKLLCERPLGLPWKELRDIALPLLDALAYAHRRGVLHGDMKPSNVMLSEDGVRLFDFGLGQAEEGILPGLPHLSRERFNAWTPGYAAPELLEGQPLSASADVYGVACVIYELAGGKHPFRRLPSTQARDEHLERELQAPANLPTHCWPALRTALAFDAAERNISAEQLRDALGATSSWL

SEQ ID NO: 13858 - protein, 259 aa, Pseudomonas fluorescens
MRIISVNVNGIQAAVERGLLSWLQAQNADVICLQDTRASAFELDDPAFQLDGYFLYACDAEVPAQGGVALYSRLQPKAVISGLGFETADRYGRYLQADFDKVSIATLLLPSGMNGDEDLNQKFKLMDDFGKYLDKQRRKRREYIYCGSLYVAQQKLDIKNWRDSQQSPGFLAPERAWMDEIVGNMGYVDALREVSREGDQYSWWPDNEQAEMLNLGWRFDYQILTPGLRRFVRSARLPRQPRFSQHAPLIVDYDWTLTI

SEQ ID NO: 13859 - protein, 300 aa, Pseudomonas fluorescens
MTLERDAAANTAKVLSEALPYIRRYVGKTLVIKYGGNAMESEELKTGFARDIVLMKAVGINPVVVHGGGPQIGDLLKRLSIESHFVDGMRVTDAATMDVVEMVLGGQVNKSIVNLINRHGGSAIGLTGKDAGLIRAKKLTVTRQTPEMTQPEIIDIGHVGEVVGINTELLNLLVKGNFIPVIAPIGVGENGESYNINADLVAGKVAEALKAEKLMLLTNIAGLMDKSGTVLTGLSTQQVDDLIADGTIYGGMLPKIRCALEAVQGGVGSSLIIDGRVPNAILLEIFTDTGVGTLISNRKR

SEQ ID NO: 13860 - protein, 451 aa, Pseudomonas fluorescens
IFRAYDIRGTVPEFLNAETAYWIGRAIGSQSLAQGEPNVSVGRDGRLSGPELVAALIRGIAESGCHVSDVGLVPTPALYYAANVLAGKSGVMLTGSHNPSNYNGFKIVIAGDTLANEQIQALHERLKTGNLSSGTGSVTQVEILDRYNTEIVQDIKLARRLKVVVDCGNGAAGVIAPQLIEALNCEVIPLFCDVDGNFPNHHPDPGKPENLVDLIAKVKETNADIGLAFDGDGDRVGVVTNTGTIVFPDRLLMLFARDVVARNPDAEIIFDVKCTRRLIPLIKEYGGRPLMWKTGHSLIKKKMKQSGALLAGEMSGHIFFKERWFGFDDGIYSAARLLEILSKEKSSAEELFATFPNDISTPEINIHVTEESKFSIIDALHDAQWGPGADLTTIDGVRVDYAKGWGLVRASNTTPVLVLRFEADDEAELQRIKAVFHAQLKRVAPDLQLPF

SEQ ID NO: 13861 - protein, 491 aa, Pseudomonas fluorescens
ADWEQRARDLKIEGRAYLNGEYTDAVSGETFECISPVDGRLLGKIASCDADDAQRAVENARATFNSGVWSRLAPTKRKATMIRFAGLLKQHAEELALLETLDMGKPISDSLYIDVPGAAQALSWSGEAIDKIYDEVAATPHDQLGLVTREPVGVVGAIVPWNFPLMMACWKLGPALSTGNSVILKPSEKSPLTAIRIAELAVEAGIPKGVLNVLPGYGHTVGKALALHNDVDTLVFTGSTKIAKQLMIYSGESNMKRVWLEAGGKSPNIVFADAPDLQAAAESAASAIAFNQGEVCTAGSRLLVERSIKDKFLPMVIEALKAWKPGNPLDPATNVGALVDTQQMNTVLSYIESGHSDGAKLVAGGKRILQETGGTYVEPTIFDGVSNAMKIAQEEIFGPVLSVIAFDTAEEAINIANDTPYGLAAAVWTQDISKAHLTAKALRAGSVWVNQYDGGDMTAPFGGFKQSGNGRDKSLHAFDKYTELKATWIKL

SEQ ID NO: 13862 - protein, 420 aa, Pseudomonas fluorescens
  unsure (1)..(420): unsure at all Xaa locations
DQRRVVVTGMGLVSPLGSGVEVVWQRLLAGRSGLRNLPDAVIADLPTRVGGVVPTMEEDAEAGFDPDRATPPKEQKKMDRFILFAMEAARXALEQAGWHPTESGAQERTATIIGSGVGGFGAIADAVRTTDSRGPRRLSPFTIPSFLVNLAAGHVSIQHGLKGPLGAPVTACAAGVQAIGDAARLIRAGEADIAVCGGAEACIDRVSLAGFAAARALSSGYNDTPERASRPFDSGRDGFVMGEGAGLLVIESLEHALARGAQPLVELVGYGTSADAYHLTAGPEDGSGARRAMALALAQAGITPDQVQHLNAHATSTPVGDLGELAAIKSVFGAQSAIAVTSTKSATGHLLGAAGGLEAIFTLLAIRDQIVPPTLNLENPDPVSEGVDIVHGQARSMPIEYALSNGFGFGGVNASVLFKR

SEQ ID NO: 13863 - protein, 276 aa, Pseudomonas fluorescens
SDSDIAIKVENLSKCYQIYDQPHDRLKQFLVKGRKFYREFWALNDVSFEIRKGETVGIIGRNGSGKSTLLQMICGTLNPTSGSVQTHGRIAALLELGSGFNPEFTGRENIYMNAAVLGLSTEETDARYDRIVEFADIGSFIEQPVKTYSSGMMVRLAFSVAIHVEPDILIVDEALSVGDAYFQAKCAKMIQGIIAAGSTVLFVSHDTASVKSLCSRALLLESGRSQYLGDVNTAVEKYYSALIESQRVDRGPEEVVKQTAAVASEYTDGVESFQSM

SEQ ID NO: 13864 - protein, 284 aa, Pseudomonas fluorescens
KGIILAGGSGTRLHPLTLGVSKQMLPIYDKPMIFYPLSVLMLAGMREILIISTPEDLPCFKKLLGDGSLYGIKLSYAEQPSPDGLAQAFIIGEEFIGKDPCCLILGDNIFYGQHFSDNLRSASAQASGATVFGYHVSDPERFGVVEFDKTGQALSIEEKPLKPKSNYAVTGLYFYDNDVVKIAKGIKPSERGELEITDVNRAYLEQKSLKVEMLGRGFAWLDTGTHDSLLEASHFVHTIEQRQGLKVACLEEIAYHNGWITAEQLSAQADALKKTGYGQYLQKL

SEQ ID NO: 13865 - protein, 442 aa, Pseudomonas fluorescens
MRVTVFGTGYVGLVTGACLADVGHDVMCVDVDNAKIESLKQGIIPIYEPGLDALVAQNQREGRLHFTTDARQAVDFGQLQMIAVGTPPNEDGSADLQHVLAVARTIGEYMTEHKVIVNKSTVPVGTADKVSRTVDAILQARDAGLDFDVCSNPEFLKEGSAIEDFAKGARIIVGTESETVKAIMRECYAPYSRNHDKLIFMDVRAAELTKYAANAMLATKISFMNEIAQMAERLGADIEQVRLGIGSDPRIGFQFIYPGCGYGGSCFPKDVQALARTAQEIGYEAQLLNAVEAVNNRQKNVMFEKLSLAFDHDLKNKTIAVWGLSFKPNTDDMRAAPSRNLIEAIWAAGGKVQAFDPAAMSEATRIYGARDDLQLTANREMALEGADALVICTEWKQFRTVDFKKLKTCLNYPVLVDGRNLFDPAAAKEAGFMYYAIGRADS

SEQ ID NO: 13866 - protein, 552 aa, Pseudomonas fluorescens
MSKQPSLSYKDAGVDIDAGEALVERIKSVAKRTARPEVMGGLGGFGALCEIPAGYKQPVLVSGTDGVGTKLRLALNLNKHDSIGQDLVAMCVNDLVVCGAEPLFFLDYYATGKLNVDVAATVVTGIGAGCELAGCSLVGGETAEMPGMYEGEDYDLAGFCVGVVEKAEIIDGSKVATGDALIALPSSGPHSNGYSLIRKIIEVSGADIETVQLDGKPLTELLMAPTRIYVKPLLKLIKDTGAVKAMAHITGGGLLDNIPRVLPKGAQAVVDVASWNRPAVFDWLQEKGNVDETEMHRVLNCGVGMVICVAQEHVEVALNTLRDAGEQPWVIGQIAAAAEGAAQVELKNLKGSLMSQTCDVVVLLSGTGSNLQALIDSTRTGDSPVRIAAVISNRADAYGLQRASDAGIATRSLDHKGFEGREAFDTALIELIDEFNPKLVVLAGFMRILSADFVRHYQGRLLNIHPSLLPKYKGLHTHQRALEAGDAEHGCSVHFVTEELDGGPLVVQAVIPVELHDSPQSLAQRVHAQEHLIYPMAVRWFAEGRLSLGEQG

SEQ ID NO: 13867 - protein, 634 aa, Pseudomonas fluorescens
MSVETQKETLGFQTEVKQLLHLMIHSLYSNKEIFLRELISNASDAVDKLRFEALAKPELLEDGAELKIRVSFDKDAKTVTLEDNGIGMNRDDVITHLGTIAKSGTADFMKNLSGDQKKDSHLIGQFGVGFYSAFIVADKVDVYSRRAGTAASEGVHWSSKGEGEFEVATIDKPERGTRIVLHLKSGEEEFADGWRLRNIIKKYSDHIALPIELPKEVAAAEGEEKPEVEWETVNRASALWTRPRTEVKDEEYQEFYKHIAHDFENPLSWSHNKVEGKLEYSSLLYVPARAPFDLYQREAPKGLKLYVQRVFVMDQAESFLPLYLRFIKGVVDSNDLSLNVSREILQKDPIIDSMKSALTKRVLDMLEKLAKNEPEQYKGFWKNFGQVMKEGPAEDFANKEKIAGLLRFASTNGTDGEQIVGLAEYLARAKEGQDKIYYLTGETYAQVKNSPHLEVFRKKGIEVLLLTDRIDEWLMSYLSEFDGKTFVDVARGDLDLGNLDSEEDKKAAEEVAKSKEGLVERLKTALGDSVAEVRVSHRLTDSPAILAIGEQDLGLQMRQILEASGQKVPDSKPIFEFNPSHPLIEKLDNEASEDRFSDLSHILFDQAALAAGDSLKDPAAYVSRLNKLLVELSA

SEQ ID NO: 13868 - protein, 292 aa, Pseudomonas fluorescens
VLINKDTKVICQGFTGAQGTFHSEQAIAYGTKMVGGVTPGKGGTTHLNLPVFNTVKEAVEATGATASVIYVPAPFCKDSILEAAFGGIKLIVCITEGIPTLDMLDAKVKCDELGVTLIGPNCPGVITPGECKIGIMPGHIHLPGKVGIVSRSGTLTYEAVKQTTDAGFGQSTCVGIGGDPIPGSNFIDILKLFQEDPKTEAIVMIGEIGGSAEEEAAAYIKANVTKPVVSYIAGVTAPPGKRMGHAGAIISGGKGTADEKFAALQDAGVKTVRSLADIGKALAELTGWEVKK

SEQ ID NO: 13869 - protein, 388 aa, Pseudomonas fluorescens
MNLHEYQGKQLFAEYGLPVSTGFAVDTPEAAAEACDKIGGNEWVVKAQVHAGGRGKSGGVKLVRSKEDAKAFAQQWLGKRLVTYQTDANGQPVTKILVESCTDIAKELYLGAVVDRSSRRIVFMASTEGGVDIEKIAHDTPEKILKATIDPLVGAQPFQGRELAFQLGLEGKQVAQFAKIFVGLAKLFKDHDLALLEVNPLVIKADGDLHCLDAKINIDANAMYRQPKLKTFHDPSQDDPREAHAAKFELNYVALEGNIGCMVNGAGLAMGTMDIVNLHGGKPANFLDVGGGATKERVTEAFKIILSDSNVAAVLVNIFGGIVRCDMIAEGIIGAVKEVGVKIPVVVRLEGNNAELGAKVLAEKRFEHHRCYQPDRRCSTSRKAAEGK

SEQ ID NO: 13870 - protein, 478 aa, Pseudomonas fluorescens
MSQKFDVVVIGAGPGGYVAAIKAAQLGLSTACIEKYTDAEGKQALGGTCLNVGCIPSKALLDSSWKYKEAKESFNVHGISTGEVKMDVAAMVGRKAGIVKNLTGGVATLFKANGVTSIQGHGKLLAGKKVEVTKPDGSVEVIEAENVILAPGSRPIDIPPAPVDQKVIVDSTGALEFQSVPKRLGVIGAGVIGLELGSVWSRLGAEVTVLEALDTFLMAADTAVSKEALKTLTKQGLDIKLGARVTGSKVNGDEVVVNYTDANGEQTITFDKLIVAVGRRPVTTDLLAADSGVTLDERGFVHVDDHCATTVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIGMEFGTSAEDLGMMVFSHPTLSEALHEAALAVNGGAIHIANRKKR

SEQ ID NO: 13871 - protein, 407 aa, Pseudomonas fluorescens
MAIEIKAPTFPESVADGTVATWHKQPGDAVKRDELIVDIETDKVVLEVLATADGVLGAIVKGEGETVLSDEVLGSIVEGGAASAAPAAAAAPAAAAAAPAAADGEDDPIAAPAARKLAEENGINIASVAGTGKGGRVTKEDVVAAVAAKKAAPAAAPAKAAAPAAAAPVFAAGDRIEKRVPMTRVRATVAKRLVEAQSNMAMLTTFNEVDMTEVMALRSKYKDLFEKSHNGVRLGFMSFFVKAATEALKRFPAVNASIDGNDIVYHGYADIGVAVSSDRGLVVPVLRNAEHMSLAEIEGGIATFGKKARDGKLSMDEMTGGTFTITNGGTFGSMMSTPIVNPPQAAILGMHNIIQRPMAINGQVVIRPMMYLALSYDHRLIDGKEAVTFLVTIKNLLEDPARLLLDI

SEQ ID NO: 13872 - protein, 941 aa, Pseudomonas fluorescens
MQESVMQRMWNSAYLSGGNAAYVEELYELYLHDPNAVPEEWRTYFQKLPADGSSATDVSHSTIRDHFVLLAKNQRRAQPVSAGSVSSEHEKKQVEVLRLIQAYRMRGHQAAQLDPLGLWQRPAPADLSINHYGLTNADLDTTFRAGDLFIGKEEASLREIHEALQQTYCRTIGAEFTHITDSEQRQWFQQRLESVRGRPEYSADIKSHLLERVTAGEGLEKYLGTKYPGTKRFGLEGGESLIPMLDELIQRSGSYGTKEVVIGMAHRGRLNVLVNTFGKNPRELFDEFEGKKKVELGSGDVKYHQGFSSNVMTTGGEVHLAMAFNPSHLEIVSPVVEGSVRARQDRRNDPTGEKVLPISIHGDAAFAGQGVVMETFQMSQTRGFKTGGTVHIVINNQVGFTISNPLDSRSTEYATDVAKMIQAPILHVNGDDPEAVLFVTQLAIDYRMQFKRDVVIDLVCYRRRGHNEADEPSGTQPLMYQQITKQRTTRELYADRLTQAGVLDAERVQAKVDEYRNALDNGLHVVKSLVKEPNKELFVDWRPYLGHAWTARHDTRFDLKTLQELSAKLLEIPEGFVVQRQVAKIYEDRQKMQAGGLPINWGYAETMAYATLAFEGHPIRMTGQDIGRGTFSHRHAVLHNQKDAGTYIPLKHLYEGQPRFDLYDSFLSEEAVLAFEYGYSTTTPNALVIWEAQFGDFANGAQVVIDQFITSGEHKWGRLCGLTMLLPHGYEGQGPEHSSARLERYLQLCAEHNIQVCMPTTPAQIYHLLRRQVIRPLRKPLVVLTPKSLLRHKLAISTLEDLAEGSFQTVIPEIDALDPKKVERVVLCSGKVYYDLLEKRRAEGREDIAIVRIEQLYPFPEDDLKEVLAPYTNAKAAVWCQEEPMNQGAWYCSQHHLRRSISNLNKSLVLEYAGREASAAPACGYASMHAEQQEQLLQDAF

SEQ ID NO: 13873 - protein, 233 aa, Pseudomonas fluorescens
MLQVSVYRYNPDQDAAPFMQEFQVDTGGKDLMVLDVLALIKEQDEGFSYRRSCREGVCGSDGMNINGKNGLACITPLSAVVKGNKLIVRPLPGLPVIRDLVVDMSIFYKQYEKVKPFLQNDTPAPAIERLQSPEEREKLDGLYECILCACCSTSCPSFWWNPDKFLGPAALLQAYRFLADSRDTKTSERLASLDDPFSVFRCRGIMNCVNVCPKGLNPTKAIGHIRNMLLSSG

SEQ ID NO: 13874 - protein, 587 aa, Pseudomonas fluorescens
IPTISFDAIIIGGGGAGMRAALQLAQGGHKTAVITKVFPTRSHTVSAQGGITCAIASADPNDDWRWHMYDTVKGSDYIGDQDAIEYMCQEGPAAVFELDHMGLPFSRTEQGRIYQRPFGGQSKDYGKGGQAARTCAASDRTGHALLHTLYQGNLKAGTTFLNEYYAVDLVKNQEGEFVGVIAICIETGETTYIRAKATVLATGGAGRIYASTTNALINTGDGVGMALRAGVPVQDIEMWQFHPTGIAGAGVLVTEGCRGEGGYLINKHGERFMERYAPNAKDLAGRDVVARSMVKEIIAGNGCGPNGDHVMLKLDHLGEEVLHSRLPGICELSKTFAHVDPVVAPVPVVPTCHYMMGGVATNIHGQAITQDAEGVDQIIPGLFAVGEVACVSVHGANRLGGNSLLDLVVFGRAAGLHLEKALTDGIEYDDATEADIEAALARLNALNNRTDGEDVATLRRELQSCMQNYFGVFRTGEYMQKGIAQLADLRKRIANVKINDKSQAFNTARIEALELQNLLEVAEATAIAAEVRKESRGAHAREDFEDRDDENWLCHTLYFPGEKRVAKRAVNFSPKTVPTFEPKVRTY

SEQ ID NO: 13875 - protein, 428 aa, Pseudomonas fluorescens
MADKKAQLIIEGAAPVELPILTGTVGPDVIDVRGLTATGRFTFDPGFMSTASCESKITYIDGDNGILLHRGYPIEQLAEKSDYLETCYLLLNGELPTAEQKAQFVGTVKNHTMVHEQLKTFFNGFRRDAHPMAVMCGVVGALSAFYHDSLDINNPQHREISAIRLVAKMPTLAAMVYKYSMGQPMMYPRNDLSYAENFLHMMFNTPCEIKPISPVLAKAMDRIFILHADHEQNASTSTVRLAGSSGANPFACIAAGIAALWGPAHGGANEAVLTMLDEIGDVSNIDKFIAKAKDKNDPFKLMGFGHRVYKNRDPRATVMKQTCDEVLKELGIQNDPQLELAMRLEEIALTDPYFIERSLYPNVDFYSGIILKAIGIPTSMFTVIFALARTVGWISHWKEMLSSPYKIGRPRQLYTGYESRDITKLEDR

SEQ ID NO: 13876 - protein, 354 aa, Pseudomonas fluorescens
MALISMRQMLDHAAEFGYGVPAFNVNNLEQMRAIMEAADKTDSPVIVQASAGARKYAGAPFLRHLILAAIEEFPHIPVCMHQDHGTSPDVCQRSIQLGFSSVMMDGSLGEDGKTPTDYEYNVRVTQQTVAMAHACGVSVEGELGCLGSLETGMAGEEDGIGAEGVLDHSQMLTDPEEAADFVKKTQVDALAIAIGTSHGAYKFTKPPTGDVLAIDRIKEIHKRIPNTHLVMHGSSSVPQEWLAIINQYGGDIKETYGVPVEEIVEGIKHGVRKVNIDTDLRLASTGAMRRLMATNPSEFDPRKFFGETVKAMRDVCIARYEAFGTAGNASKIKPISLEAMFQRYLKGELNAKVN

SEQ ID NO: 13877 - protein, 386 aa, Pseudomonas fluorescens
MTVLKMSDLDLQGKRVLIREDLNVPVKDGVVTSDARILASLPTIKLALEKGAAVMVCSHLGRPTEGEFSAENSLKPVADYLSKALGREVPLVADYLGGVDVKAGDIVLFENVRFNKGEKKNADELAQQYAALCDVFVMDAFGTAHRAEGSTHGVAKFAKVAAAGPLLAAELDALGKALGAPAKPMAAIVAGSKVSTKLDVLNSLSQICDQLIVGGGIANTFLAAAGHPVGKSLYEPDLLDTARAIAAKVSVPLPVDVVVAKEFAESAEATVKLIADVAADDMILDIGPQTAANFAELLKSSKTILWNGPVGVFEFDQFGNGTKVLAEAIAESAAFSIAGGGDTLAAIDKYGVAEKISYISTGGGAFLEFVEGKVLPAVEVLESRAK

SEQ ID NO: 13878 - protein, 340 aa, Pseudomonas fluorescens
PYKVALNGYGRIGRCVLRALFERGSAAGFEIVAINDLADMASIEYLTRFDSTHGRFPGEVKVEGDCLHINGHCVKVLRSATPEGIDWASLGVDLVLECSGAWHTRADGQRFLDAGAPRVLFSQPMASEADVDATIVYGVNQDCLTGDELLVSNASCTTNCGVPLLRLLDQAVGLDYVSITTIHSAMNDQPVIDAYHHEDLRRTRSAFQSVIPVSTGLARGIERLLPELAGRIQAKAVRVPTVNVSCLDITMQTASDTDAGEVNRILRDAATSGPLKGLLAYTELPHASCDFNHDPHSAIVDASQTRVSGPRLVNILAWFDNEWGFANRMLDVAEHYLQTA

SEQ ID NO: 13879 - protein, 665 aa, Pseudomonas fluorescens
MPSRRERANAIRALSMDAVQKANSGHPGAPMGMADIAEVLWRDYLKHNPSNPLFADRDRFVLSNGHGSMLIYSLLHLTGYDLSIDDLKQFRQLHSRTPGHPEFGYTPGVETTTGPLGQGLANAVGFALAEKVLGAQFNRPGHNIVDHHTYVFLGDGCMMEGISHEVASLAGTLGLGKLIAFYDDNGISIDGEVEGWFTDDTPKRFESYNWQVIRNVDGHDPEEIKTAIETARKSPLPTLICCKTTIGFGSPNKQGKEDCHGAPLGDAEIALTRQALNWNHGPFEIPADIYAEWDAKEKGRAAEAEWDQRFAAYSAAFPTEANELIRRLSGELPADFSEKADAYIAEVAAKGETIASRKASQNALNAFGPLLPEVLGGSADLAGSNLTLWKGCKGVSAEDASGNYMYYGVREFGMTAIMNGVALHGGLVPYGATFLMFMEYARNAVRMSALMKQRVIHVYTHDSIGLGEDGPTHQPIEQLTSLRSTPNLDTWRPADAVESAVAWKNALERKDGPSALIFSRQNLQHQTRDAGQIADIRRGGYVLKDCAGEPELILIATGSEVGLAVQAYDKLTEQGRKVRVVSMPCTSAFDAQDASYKQSVLPLQVGARIAIEAAHADFWFKYVGLEGRVIGMTTYGESAPASALFEEFGFTLENILGQAEELLED

SEQ ID NO: 13880 - protein, 396 aa, Pseudomonas fluorescens
MSEYSLFTSESVSEGHPDKIADQISDAVLDAIIAQDKHARVAVETLVKTGVAIVAGEVTTSAWVDLEQIVRDVICDIGYTSSDVGFDGATCGVMNIIGKQSPDINQGVDRAKPEDQGAGDQGLMFGYASNETDVLMPAPITFSHQLVQRQAEARKSGLLPWLRPDAKSQVTCRYEGGKVVGIDAVVLSTQHNPEVSYNDLREGVMELIVKHVLPAELLSKDTQFHINPTGQFIIGGPVGDCGLTGRKIIVDSYGGMARHGGGAFSGKDPSKVDRSAAYAGRYVAKNIVAAGLAERCEIQVSYAIGVAQPTSISLNTFGTGKISDDKIIKLVREVFDLRPYAITTMLDLLHPMYQETAAYGHFGRAPQTKTVGEDTFSTFTWEKTDRADALRSAAGL

SEQ ID NO: 13881 - protein, 469 aa, Pseudomonas fluorescens
MSAVITPADFNDYKVADISLAAWGRRETIIAESEMPALMGLRRKYASEQPLKGAKILGCIHMTIQTAVLIETLVALGAEVRWSSCNIFSTQDQAAASIAAAGIPVFAWKGETEEEYEWCLEQTILKDGQPWDANMILDDGGDLTELLHKKYPQVLDRVHGVTEETTTGVHRLLDMLAKGELKIPAINVNDSVTKSKNDNKYGCRHSLNDAIKRGTDHLLSGKQALVIGYGDVGKGSAQSLRQEGMIVKVSEVDPICAMQACMDGFELVSPFIDGINDGTEASIDKALLGKIDLIVTTTGNVNVCDANMLKALKKRAVVCNIGHFDNEIDTAFMRKNWAWEEVKPQVHKIHRTGAGSFDPQNDDYLILLAEGRLVNLGNATGHPSRIMDGSFANQVLAQIFLFGQKYADLSPAQKAERLTVEVLPKKLDEEVALEMVRGFGGVVTQLTKQQADYIGVTVEGPFKPHAYRY

SEQ ID NO: 13882 - protein, 622 aa, Pseudomonas fluorescens
MSFASLGLSEALVRAIEDAGYTEPTPVQQRAIPAVLQGRDLMVAAQTGTGKTGGFALPILERLFPNGHPDKSQRHGPRQPRVLVLTPTRELAAQVHDSFKIYARDLKFVSACIFGGVGMNPQVQAMSRGVDVLVACPGRLLDLCGQGSVDLSHVEILVLDEADRMLDMGFVHDVKKVLARLPAKRQNLLFSATFSKDITDLAGKLLHNPERIEVTPPNTTVERIEQRVFRLPASHKRALLAHLITAGAWEQVLVFTRTKHGANRLAEYLDKHGLPAVAIHGNKSQNARTKALADFKAGEVRILVATDIAARGLDIDQLPHVVNFELPNVDEDYVHRIGRTGRAGRSGEAISLVAPDEEKLLKSIERMTKQKIADGDLMGFDASTIEAEKPEVRERPDMRNPRNARGPRGDGPNGGGGGGGRKDKGKDKGKEKPAGERGERPARQQKPREGTPAREQRQPSQPPRAAADRAPDEFLDDDIDNFGNRVDYVPKQAPTGGRNRRPGAPAQGAGSGAPRGGQSQGRQNGPRNSNGSSTGTPPGKRSGPRNGAPRDGQGRRDENSRNRRPARDDQQRAEPAVQNPRSSGPKIMHKESKADRFPTPEQLDQLPSRPRGEKPALLTRNR

SEQ ID NO: 13883 - protein, 492 aa, Pseudomonas fluorescens
MSVGWLRACALVVLGLFSVTALAKDKTAIVIGGGLSGLTAAYELQNKGWQVTLLEAKPSLGGRSGMATSEWIGNDKTQPVLNKYVSTFKLSTTPAPEFVRTPGYLIDGEYFSAADLTTKQPATAEALKRYEKTRDDLARSIDDPQNPAATNTLHALDQINVSSWLDKQNLPATARQLINQDIRTHYDEPSRLSLLYFAQQSRVYRGVSDRDLRASRLVGGSPVLAQAFVKQLKTIKTNSPVSAITQDKDGVTVKVGSVGYQADYVVLAVPLRALNKIQLTPALDAQHLAAIKGTNYGWRDQIMLKFKTPVWESKARMSGEIYSNTGLGMLWIEPALKGGANVVINLSGDNARVMQAFGDKQMVDQVLIRLHAFYPQARGSFTGYEIRRYSTDPSTGGSYLAFGPGQISKYWRLWERPLQRIAFAGEHTDTLYPGTLEGALRTGQRAASQVEDLAAGKSFEPVKVGPAAATAAAAGAGAAVAAKKGNFFTNLF

SEQ ID NO: 13884 - protein, 468 aa, Pseudomonas fluorescens
MGLNNQWMQRDLAVLWHPCTQMKDHEQLPLIPIKRGEGVWLEDFEGKRYLDAVSSWWVNVFGHANPRINQRIKDQVDQLEHVILAGFSHQPVIELSERLVKMTPEGLNRVFYADNGSSCIEVALKMSFHYWLNRGQPNKKRFVTLTNSYHGETMAAMAVGDVPLFTETYKALLMDTIKVPSPDCYLRPQGMSWEEHSRNMFAAMEQTLAENHDSVAAVIVEPLIQGAGGMRMYHPVYLKLLREACDRYGVHLIHDEIAVGFGRTGTMFACEQAGIRPDFLCLSKALTGGYLPLAACLTTDEVYSAFYDDYPTLRAFLHSHSYTGNPLACAAALATLDIFEQDNVIENNRALAQRMASATAHLVDHANVSEVRQTGMVLAIEMVKDKATKEAYPWQERRGLKVFQHALERGALLRPLGSVVYFLPPYVITPEQIDFLAEVASEGIDIATRDSVSVAVPKDFHPGFRDPG

SEQ ID NO: 13885 - protein, 301 aa, Pseudomonas fluorescens
VSSLLVFPGQGAQQPGMLQRLPRETLIEASDSLGEDVLQLDSSEALRSTRAVQLCLLIAGVAASRRLLQDGLTADYVAGLSIGAYPAAVVAGALSFSDALHLVSLRGELMQQAYPQGFGMTAIIGLQLSTVETLLAQVHGAETPVYLANINADNQVVIAGSDKAMQAVAELARARGAGLAKRLAVSVPSHCPLLDEHAQTLAEAFTRVELKSPKIAYLSGSRARPVTQVEALRDDLAFNMCRVVDWRGTVQSAYERGVRLQIELPPGAVLTGLARRVFEQGTVAAFDSARLDTLQALLREE

SEQ ID NO: 13886 - protein, 216 aa, Pseudomonas fluorescens
SWKEALRAEFDQPYMTELRTFLQQERAAGKEIYPPGPMIFNALNSTPLDKVKVVILGQDPYHGPGQAHGLCFSVQPGVPAPPSLVNIYKELKRDLNIDIPNHGYLQSWADQGVLMLNTTMTVERANANAHKDKGWQFFTDRIIEVVSQKQPHLVFMLWGAHAQSKQKLIDATKHLVLTSVHPSPLSAYRGFLGCGHFSRTNKFLEQNGEAPIEWRL

SEQ ID NO: 13887 - protein, 536 aa, Pseudomonas fluorescens
MSQQFQHDVLVIGSGAAGLSLALTLPGHLRIAVLSKGDLANGSTYWAQGGVAAVLDDTDTVESHVDDTLNAGGGLCHEDAVRFTVEHSKEAIQWLIDQGVPFTRDEQSGTEDGGFEFHLTREGGHSHRRIIHAADATGAAIFTTLLAQAKERPNIELLEQRVAVDLITERRLGLEGERCLGAYVLNRKTGEVDTFGARFVILASGGAAKVYLYTSNPDGACGDGIAMAWRSGCRVANLEFNQFHPTCLYHPQAKSFLVTEALRGEGAHLKLPNGERFMQRFDSRAELAPRDIVARAIDHEMKRLGVDCVYLDISHKPEAFIKSHFPTVYERCLGFGIDITKQPIPVVPAAHYTCGGVMVDQQGRTDVPGLYAIGETSFTGLHGANRMASNSLLECFVYARSAAADILEQLPDVLIPRALPAWDASQVTDSDEDVIIAHNWDELRRFMWDYVGIVRTNKRLQRAQHRVRLLLDEIDEFYSNYKVSRDLIELRNLAQVAELMIRSAMERKESRGLHYTLDYPDLLPEALDTILVPPTY

SEQ ID NO: 13888 - protein, 291 aa, Pseudomonas fluorescens
MIAGSMVALVTPMDAQGRLDWDSLSKLVDFHLKNGTHAIVAVGTTGESATLDVEEHIAVIKAVVKQVAGRIPVIAGTGANSTREAVELTRNAKEAGADACLLVVPYYNKPTQEGLYQHFKHIAEAVDIPQILYNVPGRTSCDMQAETVIRLSTVPNIIGIKEATGDLKRAKAIIDGVSKDFIVLSGDDPTAVELILLGGKGNISVTANVAPREMADLCEAALKGDAETARAINEKLMPLHKDLFIEANPIPVKWALVEMGLMHQGIRLPLTWLSAPCHETLRSALRQCNVL

SEQ ID NO: 13889 - protein, 405 aa, Pseudomonas fluorescens
DEKASDAIHRRTAPSGPHLGAYPIIASKDPILIRHQRHAIEQGLAEPAKLLVGRVDKGRMTARKMAEVLNGIRPTLSYGDFGHVDLVVEAVVENPKVKQAVLAEVEDKVKEDTILASNTSTISISLLAKALKRPENFVGMHFFNPVHMMPLVEVIRGEKSSELAIATTVAYAKKMGKNPIVVNDCPGFLVNRVLFPYFGGFAKLVSAGVDFVRIDKIMEKFGWPMGPAYLMDVVGIDTGHHGRDVMAEGFPDRMKDDRRSAIDVLYEAKRLGQKNGKGFYAYEADKKGKQKKVADPSVLEVLKPIVYEQREVTDEDIINWMMIPLCLETVRCLEDGIVETAAEADMGLVYGIGFPPFRGGALRYIDSIGVAEFVALADQYADLGALYHPTAKLREMAKNGQSFFG

SEQ ID NO: 13890 - protein, 409 aa, Pseudomonas fluorescens
  unsure (1)..(409): unsure at all Xaa locations
MSLNPRDVVIVDFGRTPMGRSKGGMHRNTRAEDMSAHLISKLLERNTKVDPAEVEDVIWGCVNQTLEQGWNIARMASLMTQIPHTSAGQTVSRLCGSSMSALHTAAQAIMTGNGDVFVVGGVEHMGHVSMMHGVDPNPHMSLYAAKASGMMGLTAEMLGKMHGITREQQDAFGVRSHQLAHKATVEGKFKDEIIPMQGYDENGFLKTFDYDETIRPETTLESLAALKPAFNPKGGTVTAGTSSQITDGASCMIVMSAQRAQDLGIQPLAVIRSMAVAGVDPXIMXLXSXVPATXESTXTCRXWVFNDIRLLRALNEAXXPHRXPCQWAERPLKVLPTRXXXARXXPWARAXARXXPXGXHXRXSVXXPXXPXXFPXHFAERMKQNGGTFGVATMCIGLGQGISTVFERV

SEQ ID NO: 13891 - protein, 870 aa, Pseudomonas fluorescens
MGKSLVIVESPAKAKTINKYLGNQYVVKSSIGHIRDLPTSGSASASKEPAAKRGKAAAGEAPALSPKEKARKQLVSRMGVDPEHGWKAKYEILPGKEKVIEELRRLAKDADTIYLATDLDREGEAIAWHLREAIGGDDSRYKRVVFNEITKKAIQEAFSEPGELDIDRVNAQQARRFLDRVVGYMVSPLLWAKIARGLSAGRVQSVAVKLVVEREREIRAFNPEEYWEVHADLGTAKGSTVRFEVAREKGEAFKPLNEAQATAALEKLKSSSYSIVKREDKPTSSKPSAPFITSTLQQAASNRLGFGVKKTMMMAQRLYEAGYITYMRTDSTNLSADAVAMARDYIETEFGKKYLPESPNVYSSKEGAQEAHEAIRPSDANTTPAKLAGMERDAERLYELIWRQFLACQMLPAQYLSTTVSVAAGDFELRAKGRILKFDGYTRVLPQITKPGDDDVLPDMAQGDVMKLIKLDPSQHFTKPPARYSEASLVKEMEKRGIGRPSTYAAIISTIQDRGYVTLHNRRFYSEKMGDIVTERLSESFSNLMDYGFTAGMEENLDDVAQGERDWKNVLDEFYGDFKKKLEVAENPEAGMRANQPVMTDIPCTTCGRPMQIRTASTGVFLGCSGYSLPPKERCKATVNLVPGDEIAADDEGESESLVLRGKHRCPICSTAMDAYLLDEKRKLHICGNNPDCAGYEIEEGSYRIKGYEGPSLECDKCGSEMQLKTGRFGKFFGCTNPTCKNTRKLLKSGDAAPPKMDPVKMPELKCEKVNDTYILRDGASGLFLAASQFPKNRETRAPLVIEILPHKDEIDPKYHFLCEAPQKDPDGLPAVIRYSRKTKEQYVQTEVDGKPTGWKAFFDGGKWTVEDKR

SEQ ID NO: 13892 - protein, 461 aa, Pseudomonas fluorescens
MIPLIGQLYRNNNVVSSIYGRSLINQSVIAILKAHRFARHRSADDSELSVHETFPLLKAMSELKLGAASVDLGKLAYKFRNEGNGRTAEQFVREEMADVVGQQNASARKGTDVVLYGFGRIGRLLARILIEKTGGGDGLRLRAIVVRKGAENDLTKRASLLRRDSVHGSFNGTITIDEENNTITANGNLIQVIYAKNPTEVDYTQYGIKDALLVDNTGVWRDADGLGQHLACPGIDRVVLTAPGKGKLKNIVHGINHNEITADDKIVSAASCTTNAIVPVLKAVNDKFGIINGHVETVHSYTNDQNLIDNFHKGDRRGRSAALNMVITETGAATAAAKALPELAGKLTGNAIRVPTPNVSMAILNLNLEKAATREEMNEYLRYMALHSDLHKQIDFVNSQEVVSTDFVGSRHAGVVDAEATIVQDNRVVLYVWYDNEFGYSCQVVRVMEDMAGVNPPAFPR

SEQ ID NO: 13893 - protein, 315 aa, Pseudomonas fluorescens
MAVYNYDVVVLGSGPAGEGAAMNAAKAGRKVAMVDSRRQVGGNCTHLGTIPSKALRHSVRQIMQFNTNPMFRAIGEPRWFSFPDVLKSAEKVISKQVASRTGYYARNRVDVFFGTGSFADEQTIEVVCANGVVEKLVAKHIIIATGSRPYRPADIDFHHPRIYDSDTILSLGHTPRKLIVYGAGVIGCEYASIFSGLGVLVELVDNRGQLLSFLDSEISQALSYHFSNNNITVRHNEEYDRVEGVDNGVILHLKSGKKIKADALLWCNGRTGNTDQLGLENIGVKVNSRGQIEVDENYRTCVQNIYGAGDVIGWP

SEQ ID NO: 13894 - protein, 307 aa, Pseudomonas fluorescens
MTSKLEQLKQFTTVVADTGDFEAIARVKPVDATTNPSLLLKAAAIPAYAELLNASVRDCKGDVGLASDRFGVAVGQEILKVIPGRISTEVDARLSFDQDAVLKRAHRLIELYDKAGVGRDRVLIKIASTWEGIRAAEILEKEGIQTNLTLLFSFAQAAACADAGVFLISPFVGRIYDWYKKANGNDYTGADDPGVQSVTRIYNYYKANDYKTVVMGASFRNLSQIEQLAGCDRLTISPDLIEKLAADTGKLERKLAPGHAGEARLSLNEAQFRWLSNEDAMATEKLAEGIRQFARDQEKLEALLQAK

SEQ ID NO: 13895 - protein, 277 aa, Pseudomonas fluorescens
MIRKCLFPAAGYGTRFLPATKAMPKEMLPIVNKPLIEYAVEEARDAGLQHMAIVTGRGKRALEDHFDISYELEHQIRGTEKEKFLAGTRELIDTCTFSYTRQVEMKGLGHAILSGRPLIGDEPFAVVLADDLCLNLEGDGVLTQMIELYKKFRCSIVAIQEVPRDQTHKYGVIAGEAISEGIYRVNHMVEKPAPQDAPSNLAIIGRYILTPDIFDLIADTEPGKGGEIQITDALMKQAQNGCVLAYKFKGLRFDCGDAEGYLQATNFCYENVYLKGR

SEQ ID NO: 13896 - protein, 576 aa, Pseudomonas fluorescens
SLKIYFRLLGYVRPYISLFLISIVGFLIFASTQPMLGYILKYFVDGLSNPEAVLFPTVPYLRDLQLLQAVPLLIILIAAWQGLGSYLGNYFLAKVSLGLVHDLRVQLFNNLLVLPNRYFDKHNSGHLISRITFNVTMVTGAATDAIKVVIREGMTVIFLFASLLFMNWKLTLVMVAILPLIAVMVRTASKKFRKQSKKIQLAMGDVTHVASETIQGYRVVRSFGGEAYEEKRFLDASQGNTDKQLRMTRTGAIYTPLLQLVIYSAMAILMFLVLYLRGDASAGDMVAYITLAGLLPKPIRQLSEVSSTIQKGVAGAESIFEQLDVEPEVDTGTVERDSVSGRLDVRNLSFTYPGTERQVLDDISFSVEPGQMVALVGRSGSGKSTLANLIPRFYHHDKGEILIDGVEVEQYKLLNLRRHIAQVTQHVTLFSDTVANNIAYGDLAGAPREDIEKAARDAYAMDFIAQLPEGLDTQVGENGVLLSGGQRQRLAIARALLKNAPLLILDEATSALDTESERHIQAALDQVMKGRTTLVIAHRLSTIEKADLILVMDQGRIVERGTHDDLLAQNGYYARL

SEQ ID NO: 13897 - protein, 198 aa, Pseudomonas fluorescens
HSLATTPAISPYNLALPRQARAALNGQRPRCLWLTGLSGAGKSTLANSLELHLHQFGRHTFLLDGDNVRNGLCRDLGMDDAGRRENIRRMAEVARLMVDAGLIVIVAAISPFRAERDAARRLFAEGDFVEVHVSTSLTVCERRDPKGLYQAVRQGRIQHFTGIDSPYEAPLAAECRIDTEEIEPSEACERLAALLLEK

SEQ ID NO: 13898 - protein, 281 aa, Pseudomonas fluorescens
KERLFIISQYLLPHHLLSRLAGCIAECRVRWFKNAFTTWFAKRYQVDMSQALVEDVTAYEHFNAFFTRALKDGARPLDQTPGAILSPADGAISQLGPIEHGRIFQAKGHSFSVLELLGGDAANAAPFMGGEFATVYLSPKDYHRVHMPLAGTLREMVYIPGRIFSVNQTTAENVPELFARNERVACIFDTERGPMAVVLVGAMIVASIETVWAGLVTPPKRELKTFRYDEAARAPIHLEKGAELGRFKLGSTAIVLFGPDQVKWVEELKAGSPVQMGQALA

SEQ ID NO: 13899 - protein, 271 aa, Pseudomonas fluorescens
MSDFSGLALVIEPSDLLPRLESRDLILVDLTSAARYAEGHIPGARFVDPKRTQLGQAPAPGLLPSKEKLEELFGELGHRKDAVYVVYDDEGGGWAGRFIWLLDVIGHDQYHYLNGGLPAWLAEGSPMSIQIPPAVGGPVALTLHEEPTATREYLQSRLGAADLAIWDARGPLEYSGEKVLAAKGGHIPGAVNFEWTAGMDQARQLRIRTDMPQILEDLGITRDKEIITHCQTHHRSGFTYLVAKALGYPRVKGYAGSWGEWGNHPDTPVEL

SEQ ID NO: 13900 - protein, 198 aa, Pseudomonas fluorescens
MKILLIGAGGTIGSAVDKELSQRHEVIRIGRSSGDFQVDISDSASIRKLFEQTGKFDALVCAAGNVTFAPLGEMTEDSFALGLKDKLMGQVNLLLIGREFANDGASFTFTTGVLSHDPIRSGVSAALVNGALDSFVRAAAIELPRGLRVNSISPTVLVEAMGSYAPYFRGYKPVPAADVALAYAKSVEGLQTGQTFHV

SEQ ID NO: 13901 - protein, 213 aa, Pseudomonas fluorescens
MIDLYYWTTPNGHKISLFLEEAGLRYDVHPINISQGEQFQPHFLKIAPNNRIPAIVDHEPADGGEPLSLFESGAILLYLAEKTGKFLPKDLRGRQVALQWLFWQMGGLGPMAGQNHHFSQFAPEKIPYAIKRYVDETARLYGVLDKQLANNEFVAGGEYSIADMAIYPWIVSHKWQSQNLEDFPNVQRWFNHIKDRPATVKAYALVQKINPPK

SEQ ID NO: 13902 - protein, 378 aa, Pseudomonas fluorescens
  unsure (1)..(378): unsure at all Xaa locations
RLWGARFKSGPSAALAALSRCPERYFRLTPYDLAGSKAHAGELQRAGLLDEQETRTMIEALDGIGADFAAGRIAPTLDDEDVHTFIERLLTERLGALGGKLRAGRSRNDQTANDLRLFLRDHVRTLAVEVLALQTALVDQAEQHVESICPGFTHLQQAQPIVFAHHLLAHAQSMLRDVQRLMDWDARTSLSPLGAAAMAGSAIARQPQQSAKEMGYAGVCENSIDAVASRDHVAEFLFIASMLGINISRLAEEFCLWSSRQFRWVDLDDAYATGSSIMPQKKNPDIAELARGKAGRLIGNLTGLLSTLKSLPLSYNRDLSEDKNGVLDSVDTLLLVLPAMAGMVAXMTVNVEELRRQAPLGFTLATEIADWLRVPGVP

SEQ ID NO: 13903 - protein, 447 aa, Pseudomonas fluorescens
MKITVFGSGYVGLVQAAVLAEVGHDVVCMDIDEKKIELLRQGHVSIFEPGLASLVREGLDAGRLQFTCDEILAVQHGKVAFIAVGTPSNEDGSADLRYVLSVGDAVARHREKPLILVEKSTVPVGTGDTLRAHLDKALVKAGRLLQFDIVSNPEFLKEGSAVADCRRPDRIVIGCEREEVRDVMRDLYSPFNRNHDRIMFMDLRSAELTKYAANCMLATKISFINQIAELAEHLGADIESVRQGIGADSRIGYHFIYPGCGYGGSCFPKDMRALIHSAEEAHCSSDLLQAVEAINQRQKHKLFERINAFYKGELRGKTFAVWGLAFKPNTDDMRDAPSRVLLESLWAAGANVRAFDPEAMQETQNLYPDESKLMLMGTPESVLAGSDALIICTEWQQFKAPDFDLIQQRLKAPVIFDGRNLYDAERLARNGFHYFPMGRGESRTLPI

SEQ ID NO: 13904 - protein, 459 aa, Pseudomonas fluorescens
  unsure (1)..(459): unsure at all Xaa locations
MNVSVFGIGYVGLVQGAALAEVGHNVLCVDVDAGRVEALKEGTLPLYEPGLKILVRDNYQSGRLQFGTDLVDAVHHGDVLLIAVGTPPDEDGSADLQYVLSVARTIALNLDRHQIIVDKSTVPVGTGDRVRACIEQVLADNGRGDLTFDVVSNPEFLKEGCAVEDCMRPDRIIIGTDSPRAEEVMRELYEPFNRSREKIIVMDVRSAELTKYAANCMLATKISFMNEMACLAEKLGADIEKVRHGIGADPRIGYQFIYPGLGYGGSCFPKDVKALIQAADGVDIDARVLKAVEARNQEQKASLYRKVFDHFDGHLRGKTFALWGLSFKPNTDDMREAPSRVLMEALWQAGASVQAFDPKAMEEAQRLYGSRDDLTLTGTKEAALKNADALIIVTEWQSFRAPDFDQLSRLLKQPLIFDGRNLFDPQRLSKRGFTYVSVGRQTPSVLXKERRHVQTGNSR

SEQ ID NO: 13905 - protein, 475 aa, Pseudomonas fluorescens
SYDQLYLFIGGEWIDAQGRSTAAVVNPATGREIGRVPLATAGDLDRALEVSRVGFEQWRQTVPDQRAKILKRAADLILERAPHIAAQMTLEEGKPLSESMDEVVRAAEYFEWFAESARRIDGRVVPANRPGVLQLVKRQAIGPVAAFTPWNFPAITPARKLSAALAAGCSVILKPGEESPSTALALARALDDAGLPKGVLQVVFGVPDQVSSQLIASAIIRKVTFTGSVPIGRLLSARAAEGVKPITLELGGHGPVLVFADADVEKAAVEGVANRFRGTGQVCISSTRFIVQRGAYQAFVDHFVTATKALKIGDGFDPQTQVGPLANPRQLVKMEQLIADAVEKGARVLVGGEALPGDGFFFQPTVLADVPMNARIMHEEPFGPIAVLMPFDELADGLQEANRLPYGLSAYAFTSNARTAIDVADGLEAGMIGINQYRIVATELPFGGMKESGHGSEGGVEGIEHYLTHKFISQV

SEQ ID NO: 13906 - protein, 311 aa, Pseudomonas fluorescens
DPLIHILDDSFLDLRVFNASVEKLATGMRWAEGPVWIGDGRYLLVSDIPNNRIMRWDEITETFTVYREHSNFSNGMCRDRQGRLIVCEGSTTTSEGRRITRTEYNGTTTVLADSFEGKPFNSPNDIVCKSDGSIWFTDPPFQTGNNYEGHKITPSQPHAVYRIDGESRKVTRVIDDLNGPNGLCFSPDEKTLYVVEGRAKPNRLIWAIAVKDDGTLGERRKHIEGLDYAAIDGIKCDETGNLWCGWGGNGDPRADLEKLDGVRVFNPQGKAIGHISLPERCPNLCFGGREGNRLFMASSHSIYSLFVNTRG

SEQ ID NO: 13907 - protein, 212 aa, Pseudomonas fluorescens
MSLRLGDIAPDFEQDSSAGKIRFHEWLGDSWGVLFSHPADFTPVCTTELGFTAKLKDEFTKRGVKAIALSVDPVDSHHKWIEDINETQNTIVNFPILADADRKVSDLYDLIHPNANDTLTVRSLFVIDPNKKIRLTITYPASTGRNFHEILRVIDSLQLTDNYKVATPANWQDGEEVVIVPSLKDEDEIKQRFPKGYRAVKPYLRLTPQPNK

SEQ ID NO: 13908 - protein, 444 aa, Pseudomonas fluorescens
NPQTREWQALSSDHHLAPFSDFKQLKEKGPRIITNAKGVYLWDSEGNKILDGMAGLWCVAIGYGRDELADAAAKQMRELPYYNLFFQTAHPPALELAKAIADVAPEGMNHVFFTGSGSEGNDTMLRMVRHYWAIKGQPNKKVIISRKNGYHGSTVAGASLGGMTYMHEQGDLPIPGIVHIAQPYWFAEGGDMTPEEFGIWAANQLEEKILEVGVDNVGAFIAEPIQGAGGVIIPPDTYWPRIKEILAKYDILFVADEVICGFGRTGQWFGSDFYDLKPHMMTIAKGLTSGYIPMGGLIVRDEVVAVLNEGGDFNHGFTYSGHPVAAAVGLENIRILREEKIIERAHEETAPYLQKRLRELNDHPLVGEVRGVGLLGAIELVQDKATRKRYEGKGVGMICRQFCFDNGLIMRAVGDTMIIAPPLVISKAEIDELVTKARKCLDLT

SEQ ID NO: 13909 - protein, 463 aa, Pseudomonas fluorescens
MTNPALIDELKTLVEPGKVLTDADSLNAYGKDWTKHFAPAPSAIVFPKTIEQVQAVVRWANEHKVALVPSGGRTGLSAAAVAANGEVVVSFDYMNQILDINLTDRTAVCQPGVVTEQLQNAAEEHDLYYPVDFASAGSSQIGGNIGTNAGGIKVIRYGMTRNWVAGMKVVTGKGDVLELNKDLIKNATGYDLRQLFIGAEGTLGFVVEATMRLDRAPKNLTAMVLGTADFDSIMPVLHAFQGRLDLTAFEFFSDKALAKVMGRGDVPAPFETDCPFYALLEFEATTEEVANTALETFEHCVEQGWVLDGVMSQSETQLQNLWKLREYISETISHWTPYKNDISVTVSKVPAFLQEIDAIVGEHYPDFEIVWFGHIGDGNLHLNILKPDNLSKDEFFAKCATVNKWVFETVEKYNGSISAEHGVGMTKRDYLTYSRSPVEIEYMKAVKAVFDPNGIMNPGKIFA

SEQ ID NO: 13910 - protein, 758 aa, Pseudomonas fluorescens
MLNTLRKIVQEVNSAKDLKAALGIIVLRVKEAMGSQVCSVYLLDPETNRFVLMATEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVPGSPGAAVGTAVVMLPPADLDVVPDKTITDIDAELALFKTAIEGVRADMRALSAKLATQLRPEERALFDVYLMMLDDASLGSEITNVIKTGQWAQGALRQVVTDHVNRFDLMDDEYLRERASDVKDLGRRLLAYLQEERQQNLVYPEKTILVSEELTPAMLGEVPEGTLVGLVSVLGSGNSHVAILARAMGIPTVMGLVDLPYAKVDGIEMIVDGTRGEVYTNPSEVLRKQFTEVVEEEKQLALGLDTLRDLPCVTLDGHRMPLWVNTGLLADVARAQKRGAEGVGLYRTEVPFMINQRFPSEKEQLAIYREQLAAFHPQPVTMRSLDIGGDKSLSYFPIKEDNPFLGWRGIRVTLDHPEIFLVQTRAMLKASEGLNNLRILLPMISGIHELEEALHLIHRAWGEVRDEGTDVPMPPVGVMIEIPAAVYQTKELARMVDFLSVGSNDLTQYLLAVDRNNPRVADLYDYLHPAVLQALQTVVRDAHAEGKPVSICGEMAGDPAAAVLLMAMGFDSLSMNATNLPKVKWMLRQIHLSKAKDLLAELMTIDNPQVIHSSLQLALKNLGLAKMVNPAAVKP

SEQ ID NO: 13911 - protein, 726 aa, Pseudomonas fluorescens
VHSSEDSCCSSKVAAPSLVQLSEAKSADARLSSFRIEAMDCPTEQTLIQNKLGKLAGIQQLEFNLINRVLGVTHNLPDTAPIIDAIKSLGMQAEPLEAGVESTVAAPVKKHWWPLALSGVGALAAEVIHFTSAAPTWVVAIIALTSILSGGLTTYKKGWIALKNRNLNINALMSIAVTGAVLIGQWPEAAMVMFLFTVAELIEARSLDRARNAISGLMQMTPEQATVLQADGNWVELDVKSIDLGARVRVKPGERIALDGEVVSGSSTIDQAPITGESLPVEKTVGDKVFAGTINQAGSLEYAVTAAANNSTLARIIHAVEQAQGARAPTQRFVDQFSKIYTPVVFVLALAVAIIPPLFMAAAWFDWIYRALVLLVVACPCALVISTPVTIVSGLAAAARKGILVKGGVYLEGGFKLDYLALDKTGTITHGKPVQTDYLSLDPTADATAPAIAAALAGRSDHPVSLAIANAAVDKGFAALLVDNFEALAGRGVKGEVNGQVYHLGNHRLVEELGLCSPQLEEKLFALEKQGKSVVLLLDSSGPLALFAVADTVKETSREAIRQLHDLGVKTLMLTGDNVHTAQAIAAQVGIDQAKGDLLPTDKLQAIEDLYAKGRRVGMVGDGINDAPALARAEIGFAMAAAGTDTAIETADVALMDDDLRKIPAFISLSRHTAAILKQNIALALVIKAIFLGVTFAGLATMWMAVFADMGVSLLVVFNGLRLLRK

SEQ ID NO: 13912 - protein, 164 aa, Pseudomonas fluorescens
PLSLIAALGENRVIGVDNSMPWHLPGDFKYFKATTLGKPIIMGRKTWDSLGRPLPGRLNIVVSRQAGLVLEGAEVYPSLEAAVVRAEEWAKDQGVDELMLIGGAQLYAQGLAQADRLYLTRVALSPEGDAWFPEFDLNQWKLVSNVPNPAEGDKPAYNFEVWEK

SEQ ID NO: 13913 - protein, 462 aa, Pseudomonas fluorescens
MNLPLILNLLVFLALLFGLAQTRHTSWSLAKKVLLALVLGVAFGIALHTIYGAGNPVLKASIGWFDLVGNGYVQLLQMIVIPLVFASILSAVARLHNASSLGKISFLTIGTLLFTTAIAALIGIGLTNLFGLTAEGLVAGTQEMARLQTIQTDYAGKVADLNVPQLLLSFIPQNPFADLARAKPTSIISVVIFAAFLGVAALQLLKDDVEKGQKVINAIDTLQAWVMRLVRLVMKLTPYGVLALMTKVVAGSNLQDIIKLGSFVVVSYLGLGLMFVVHGLLVSAAGINPLRFFRKIWPVLTFAFTSRSSAASIPLSIEAQTRRLGIPQSVASFAASFGATIGQNGCAGLYPAMLAVMVAPTVGINPLDPLWIATLVAIVTLSSAGVAGVGGGATFAALIVLPAMGLPVSLVALLISVEPLIDMGRTALNVSGSITAGAITSQVMQQTDKALLDADEHAELAQ

SEQ ID NO: 13914 - protein, 530 aa, Pseudomonas fluorescens
MPVPDPFREGLARGWKTYNGAQLTDDLTLEADVAIIGSGAGGGTTAEILSAAGYKVLLIEEGPLKTSSDFKLLEDQAYSSLYQEGIGRMSKDGAITILQGRAVGGTTLINWTSSFRTPEPTLEHWAKEHNVKGHSPADMAPWFEKMEQRLGVAPWMVPPNANNDVIRKGCEQLGYSWHVIPRNVRGCWNLGYCGMGCPTNAKQSMMVTTIPATLEKGGELLYLARAEKLLINGDKVTGLQCVAMDERCVEPTGRTITVKARHYVLAGGGINSPALLMRSDAPDPHKRLGKRTFLHLVNMSAGRFDEVINPFYGAPQSIYSDHFQWKDGTTGPMAYKLEVPPLHPALAATLLGGFGQESAQHMADLPHTHAMLALLRDGFHPDSQGGSVELRGDGSPVLDYQVSPYTWEGLRRSFHSMAEIQFAGGAKAVMPMHADARYVNSLAEARSLIDSLSLELYRTRLGSAHVMGGCAMGEDPKTAVTDSLGRHHQLRNLSIHDGSLFPTSIGANPQLSVYGLTAQLATSLGERLRK

SEQ ID NO: 13915 - protein, 338 aa, Pseudomonas fluorescens
PLTGALAAGNRVMLKLSESTPATGLLLKELLARIFPEDLVCVVLGEADVGVAFSKMRFDHLLFTGSTSVGRHVMRAAAENLTPVTLELGGKSPAIVSHDVPLKDAAERIAFGKTLNAGQTCVAPDYVLVPEARIGGFVEAYRQAVRGFYPTLADNPDYTAIINERQLARLNSYLSDATSKGALLIPLFDQGQGRRMPHSLLLNVSDEMTVMQDEIFGPLLPIVPYQDLDQAFAYINQRPRPLALYYFGYDKREQQRVLSETHSGGVCLNDTLLHVAQDDMPFGGIGPSGMGHYHGHEGFLTFSKAKGVLVKQRFNAAKLIYPPYGKSIQKLIQKLFIR

SEQ ID NO: 13916 - protein, 413 aa, Pseudomonas fluorescens
MALIVQKFGGTSVGTVERIEQVADKVKKFRDAGDDLVVVLSAMSGETNRLIDLAKQISGEDQPVPRELDVIVSTGEQVTIALLAMALIKRGVPAVSYTGNQVRILTDSAHNKARILQIDDQKIRGDLKAGRVVVVAGFQGVDEHGNITTLGRGGSDTTGVALAAALKADECQIYTDVDGVYTTDPRVVSVAQRLDKITFEEMLEMASLGSKVLQIRAVEFAGKYNVPLRVLHSFKEGPGTLITIDEEETMEQPIISGIAFNRDEAKLTIRGVPDTPGVAFKILGPISAANIEVDMIVQNVAHDNTTDFTFTVHRNDYQSAQTVLENTAREIGAREVVGDTKIAKVSIVGVGMRSHAGVASRMFESLAKESINIQMISTSEIKVSVVIEEKYLELAVRALHTAFELDAPARQGE

SEQ ID NO: 13917 - protein, 483 aa, Pseudomonas fluorescens
SLYIAGEWLAGQGEAFQSLNPVTQQVLWSGEGATAAQVESAVQAARQAFPGWARRTLEDRISVLEAFAAALKNHADELARTIGEETGKPLWEAATEVTSMVNKIAISVQSYRERTGEKSGPLGDATAVLRHKPHGVVAVFGPYNFPGHLPNGHIVPALLAGNSVLFKPSELTPKVAELTVKCWIEAGLPAGVLNLLQGARETGIALAANPGIDGLFFTGSSRTGNHLHQQFAGRPDKILALEMGGNNPLVVDQVADIDAAVYTIIQSAFISAGQRCTCARRLLVPEGAWGDSLLKRLVEVSSTIEVGAFDQQPAPFMGSVVSLGAAKALMDAQAHLLANGAVSLLAMTQPQAQSALLTPGIVDVTAVADRSDEELFGPLLQVIRYADFAAAIAEANDTAFGLAAGLLSDSEERYQQFWLESRAGIVNWNKQLTGAASSAPFGGVGASGNHRASAYYAADYCAYPVASLETPSLVLPAALTPGV

SEQ ID NO: 13918 - protein, 406 aa, Pseudomonas fluorescens
MSVEHAAVQRADFDQVMVPNYAPAAFIPVRGAGSRVWDQAGRELIDFAGGIAVNVLGHAHPALVGALTEQANKLWHVSNVFTNEPALRLAHKLIDATFAERVFFCNSGAEANEAAFKLARRVAFDRFGTEKYEIIAALNSFHGRTLFTVNVGGQSKYSDGFGPKITGITHVPYNDLAALKAAVSDKTCAVVLEPIQGEGGVLPAELAYLQGARELCDANNALLVFDEVQTGMGRTGNLFAYQHYGVTPDILTSAKSLGGGFPIAAMLTTEALAKHLVVGTHGTTYGGNPLACAVAEAVIDVINTPEVLNGVHAKHDKFKTRLQQIGEKYGLFTQVRGLGLLIGCVLSDAWKGKAKDIFNAAEQEGLMILQAGPDVIRFAPSLVVEDADIDAGLDRFERAAAKLTQA

SEQ ID NO: 13919 - protein, 658 aa, Pseudomonas fluorescens
ATTGSYKNNYYTEVGKMSAASLYPVRPEVLANTLTDEATYKAMYQQSVVNPDGFWREQAKRLDWIKPFTTVKQTSFDDHHVDIKWFADGTLNVSYNCLDRHLAERGDQVAIIWEGDDPSESRNITYRELHEQVCKLANALRGQDVHRGDVVTIYMPMIPEAVVAMLACTRIGAIHSVVFGGFSPEALAGRIIDCRSKVVITADEGIRAGKKISLKANVDDALTNPETSSIQKVIVCKRTGGDIKWNQHRDIWYEDLMKVAGTVCAPKEMGAEEALFILYTSGSTGKPKGVQHTTGGYLLYAAMTHERVFDYRPGEIYWCTADVGWVTGHSYIVYGPLANGATTLLFEGVPNYPDITRVAKIVDKHKVNILYTAPTAIRAMMASGTAAVEGADGSSLRLLGSVGEPINPEAWDWYYKNVGKSRCPIVDTWWQTETGGNMMSPLPGAHALKPGSAARPFFGVVPALVDNLGNIIEGEAEGNLVILDSWPGQARTLYGDHDRFVDTYFKTFRGMYFTGDGARRDADGYYWITGRVDDVLNVSGHRMGTAEIESAMVAHPKVAEAAVVGVPHDIKGQGIYVYVTLKNGEEPSEQLRLELKNWVRKEIGPIASPDVIQWAPGLPKTRSGKIMRRILRKIATAEYEGLGDISTLADPGVVQHLI

SEQ ID NO: 13920 - protein, 416 aa, Pseudomonas fluorescens
MLSWDEFDKEDSEVAAVKGANAGHASEANMDRLDSAGGAAALEARAVTAEDSAAVARAKAALDSLDVAEGLAELEGSAARVAVDEKRMINCRADLNQLVPFKYDWAWQKYLDGCANHWMPQEVNMTADIALWKNPEGLTDDERRIVMRNLGFFSTADSLVANNLALAVYRLITNPECRQYILRQAFEEAIHTHAYQYCIESLGMDEGEIFNMYHEIPSVAKKAAWGLKYTRAISDPEFNTGTVETDKELLRNLIAYYCVLEGIFFYCGFTQILSMGRRNKMTGVAEQFQYILRDESMHLNFGIDVINQIKIENPHLWDAEMKEEASQMILQGTQLEIEYARDTMPRGVLGMNAAMMEDYLKFIANRRLSQIGLKEEYPGTTNPFPWMSEIMDLKKEKNFFETRVIEYQTGGALSWD

SEQ ID NO: 13921 - protein, 254 aa, Pseudomonas fluorescens
GKPMNRKIALITGASRGLGKNAALHLAAQGVDIIGTYNSRADEAQALVQELEALGANAVMLQLDVGRSEGFAEFAVRVEQALQQLERPRFDFLINNAGIGVHASFADTTPEQFDLLMNVQLKGPFFLTQQLLPLINDGGRIINISSGLARFTLPGYAAYAAMKGAMEVLTRYQAKELGARQIAVNILAPGAIETDFGGGAVRDNSALNAMVASNTALGRAGQPDDIGGALALLLSPGAQWINGQRIEASGGMFL

SEQ ID NO: 13922 - protein, 233 aa, Pseudomonas fluorescens
LIIITGASSGIGEATARRLSAAGHPLLLLARRIERLEALALPNTLSRRVDITDRAALLAAVAEAEAQFGPADALINNAGVMLLGEMSKQDPAQWDQMLDVNVKGLLNGVHAVVAGMIERKHGTIINVSSVAGRKTFPNHVAYVGTKFAVHGLSENLREELSPHNVRVTTIAPGAVETELLSHTTDEAIKTGYQAWKQDMGGTVLSAEDVATAIAYAYGQPQGVCIREIVMAAT

SEQ ID NO: 13923 - protein, 399 aa, Pseudomonas fluorescens
MAEQGSPRRFARIDRLPPYVFNITAELKMAARRRGEDIIDLSMGNPDGATPPHIVEKLVQVAQREDTHGYSTSKGIPRLRRAISNWYKERYEVEIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVVHDLAYADIVYDGWKAPSIMQVPGAKDMAVEFFTLSKSYNMAGWRIGFMVGNPELVSALARIKSYHDYGTFTPLQVAAIAALEGDQQCVRDIAEQYRQRRNVLVKGLHELGWMVENPKASMYVWAKIPEAYAHLGSLEFAKKLLAEAKVCVSPGVGFGEYGDDHVRFALIENQDRIRQAVRGIRGMFRADAL

SEQ ID NO: 13924 - protein, 171 aa, Pseudomonas fluorescens
MNHPITALVIMGVAGCGKTCVSEALCQLSGATAIEGDTFHPAANIEKMSAGIPLNDEDRAGWLDSLCDELRRVDALGERPVLTCSALKHSYREVLRSALPGLGFVFLELTPEVAAERVSHRPGHFMPATLIESQFATLESPKGEPLTLALNASIHSVEELAAQAHVWWQAH

SEQ ID NO: 13925 - protein, 286 aa, Pseudomonas fluorescens
GQVIIDLVMAVDALPQIGGDVLAQSASFEAGGGFNVMAAAARNGLPVVYLGRHGNGRFGDLARQAMNAEGICIGIDQPAEHDTGICVALTDASAERSFISYIGAEGEVTTAELNSVTAEEGDYVYVSGYSLLHSGKAQALLDWTLALPKTINVVFDPGPLVESPDSPMMQALLPRIDVWTSNSVEALRFTGATDIETALDRLAVHLPQEVLMVVRDGPQGCWIHQCGERQHVPGFKVQAVDSNGAGDAHAGVFVAGLAQGLAAHEAARRANAAAALAVTRWGPRPP

SEQ ID NO: 13926 - protein, 158 aa, Pseudomonas fluorescens
MTIEIRPATPSDAPQILAFITELADFEKARHEVIASVADIERSLFSEGATAHGLICLRDGLPIGFAVFFFSYSTWLGSNCLYLEDLYITPEQRGGGAGKTLLRHLAKIACANDCGRFEWSVLDWNTPAIEFYKSLGAQPQEEWVRYRMDGKVLREFAE

SEQ ID NO: 13927 - protein, 344 aa, Pseudomonas fluorescens
IGYAAQTATTPLAPMKFERRSPRADDVAIEILYCGVCHSDIHQARNEWGIAVYPLMPGHEIVGKVTAVGANVTKHKVGDLVGVGCMVDSCRTCEACQSNLEQYCLEGPTMTYATPDRVDGSNTMGGYSDSIVVSEHFVVRIPEKLDLAAAAPILCAGITTYSPLKHYGVKAGDKVGILGMGGLGHMGIKFAKAMGAEVTLFTRSASKAEEGRRQGADHVIVSTDEEQMKAAAGRFDFLLDTIPVQHDLNPYLDTLRFDGVHILVGLIEPIDPPVHAAKLVLGRRVLAGSLIGGVAETQEVLDFCAEHNISCDIEMLDIRQINEAYARMIAGDVKYRFVIDMATL

SEQ ID NO: 13928 - protein, 394 aa, Pseudomonas fluorescens
MREVVIVDSVRTGLAKSFRGKFNQTRPDDMAAHCVNALLSRNDIDPASVEDCIVGAGSNEGAQGYNIGRNVAVLSQLGTGTAGMTLNRFCSSGLQAIAIAANQIASGCSDIIVAGGVESISLTLKSVNTDHLINPLLKQQTPGIYYTMGQTAEVVARRYGVSREAQDRYSLQSQIRTAQAQAAGLFNDEIVPMAVKYRVEDKNSGDVQILDGIVDRDDCNRPDTTYESLAGLKPVFAEDGSVTAGNSSQLSDGASMTLVMSLEKALQLGLKPKAFFRGFTVAGCEPDEMGIGPVFSVPKLLKAKGLQVADIDLWELNEAFASQCLYARDRLEIDNEKYNVNGGSISIGHPFGMTGSRQVGHLVRELQRRNLRYGIVTMCVGGGMGATGLFEAVR

SEQ ID NO: 13929 - protein, 462 aa, Pseudomonas fluorescens
RIETDSLGQIEVPDDAYWGAQTQRSLINFAIGQERMPLPVLHALALIKKAAARVNDRNGDLPADIARLIEQAADEVLDGQHDDQFPLVVWQTGSGTQSNMNVNEVIAGRANELAGNPRGGKTPVHPNDHVNRSQSSNDCFPTAMSIATAQAVQTQLLPAIAELSGGLAELSARHMKLVKTGRTHMMDATPITFGQELSGFIAQLDYAERAIRAALPAVCELAQGGTAVGTGLNSPHGFGEAIAAELAALSGLPFVTAPNKFAALAGHEPLTTLSGALKTLAVALMKIANDLRLLGSGPRAGFAEVRLPANEPGSSIMPGKVNPTQCEALSMLACQVLGNDVAIGFAASQGHLQLNVFKPVIIHNLLQSIRLLADGCSNFQQHCIAGLEPDADVMAKHLERGLMLVTALNPHIGYDKSAEIAKKAYSEGKTLREAALELGYLTDEEFDAWVRPENMIEAGAKG

SEQ ID NO: 13930 - protein, 603 aa, Pseudomonas fluorescens
  unsure (1)..(603): unsure at all Xaa locations
TPAVKRVDRLSWAEVRRLALHHKKSLWIANGVAVLATLCSVPIPLLLPLLVDEVLLGHGDAALKVMNHLLPSMWQQAAGYIGLMLVVTLTLRCSALCFGVLQARLFARLAKDIVYRIRVRLIERLKRISLGEYESLGSGTVTTHLVTDLDTLDKFVGETLSRFLVAMLTLVGTASILMWMHWKLALLILLFNPLVIYATVQLGKRVKHLKKLENDSTSRFTQALSETLDAIQEVRAGNRQGFFLGRLGLRAQEVRNYAVNSQWKTDASNRASGLLFQFGIDIFRAAAMLTVLFSDLSIGQMLAVFSYLWFMIGPVEQLLNLQYAYYAAGGALSRINELLARADEPQYPGGVDPFKGRDTVGIQVQGLSFGYGDELVLDQLNLSIAPGEKVAIVGASGGGKSTLVQLLLGLYTPLAGTIRFGGSSQQEIGLETVRENVAVVLQHPALFNDTVRANLTMGRTRSDEACWQALEIAQLEPTIRALPDGLDSIVGRSGVRLSGGQRQRLAIARMILAEPKVVILDEATSALDAATEYNLHQAMARFLHGRTTLIIAHRLSAVKQADRVLVFDGGQVAEDGDHQQLIADGGLYAKLYGHLQRLXVSSI

SEQ ID NO: 13931 - protein, 246 aa, Pseudomonas fluorescens
MFDYSARPELLKDRIILVTGAGRGIGAAAAKTYAAHGATVLLLGKTEANLTEVYDEIEAAGHPQPAVIPFNLETALPHQYDELAAMIETEFGHLDGLLHNASIIGPRTPIEQLSGENFMRVMQVNVNAMFMLTSTLLPLLKLSQDASVVFTSSSVGRKGRAYWGAYGVSKFATEGLMQTLADEVENVAPVRSNSINPGATRTSMRAQAYPGENPLNNPTPEEIMPVYLYLMGPDSTGINGQAFNAQ

SEQ ID NO: 13932 - protein, 360 aa, Pseudomonas fluorescens
VSKRAFNFCAGPAALPEAVLLRAQSEMLDWHGKGLSVMEMSHRSDDYVAIAEKAEQDLRDLLSIPSNYKVLFLQGGASQQFAEIPLNLLPENGTADYVETGIWSKKAIEEARRFGNINVAASAKPYDYLAIPGQNEWKLTPGAAYLHYASNETIGGLQFDWVPEAGDVPLVVDMSSDILSRPIDVSQYGLIYAGAQKNIGPSGLVVVIVREDLLGRARSSCPTMLDYKISADNGSMYNTPATYSWYLSGLVFEWLKEQGGVAAMEQRNKAKKDRLYAFIDNSDFYTNPISVNARSWMNVPFRLADERLDKAFLAGADARGLLNLKGHRSVGGMRASIYNALGLDAVEALVGYMAEFEKEH

SEQ ID NO: 13933 - protein, 365 aa, Pseudomonas fluorescens
  unsure (1)..(365): unsure at all Xaa locations
NFLALAQPGVQQLSPYVPGKPVDELARELDLDPASIVKLASNENPLGASPKALAAIREALDELTRYPDGNGFALKSLLAEQCRVELNQVTLGNGSNDILELVARAYLAPGLNAVFSEHAFAVYPIATQAVGAQAKVVPAKEWGHDLPAMLAAIDANTRVVFIANPNNPTGTWFGAEALDDFLQDVPEHVLVVLDEAYIEYAEGSDLPDGLDFLAAYPNLLVSRTFSKAYGLAALRVGYGLSTPVVADVLNRVRXPFNVNSLALAAACAALKDEEYLAQSRQLNESGMQQLEAGFRELGLSWIPSKGNFICVDLGQVAAPVFQGLLREGVIVRPVANYGMPNHLRVTIGLPAENSRFLEALRKVLA

SEQ ID NO: 13934 - protein, 675 aa, Pseudomonas fluorescens
DVTALQSAAPMIGRLVVVGLGLIGGSFAKGLRESGVCREVVGVDLDPQSRKLAVELGVVDRCEDDLVAACRGADVIQLAVPILAMEKVLARLAGMDLGQAILTDVGSAKGNVVRAATEAFGGMPARFVPGHPIAGSEQSGVEASNSELFRRHKVILTPLEQTDPAALAVVDRLWRELGADVEHMQVERHDEVLAATSHLPHLLAFGLVDSLAKRNENLEIFRYAAGGFRDFTRIAGSDPVMWHDIFLANREAVLRTLDTFRSDLDALRDAVDAGDGHQLLGVFTRARVAREHFSKILARRAYVDAMNSNDLIFLAQPGGRLSGRIRVPGDKSISHRSIMLGSLAEGVTEVEGFLEGEDALATLQAFRDMGVVIEGPHHGRVTIHGVGLHGLKPAPGPIYLGNSGTSMRLLSGLLAAQDFDSTLTGDASLSKRPMNRVANPLREMGAVIETAAEGRPPMTIRGGHKLKGLTYTMPMASAQVKSCLLLAGLYAEGKTTVTEPAPTRDHTERMLRGFGYPVSVNGATASVESGGKLTATHIEVPGDISSSAFFLVAASIAEGSELVLEHVGINPTRTGVIDILRLMGADITLENQREVGGEPVADLRVRAAKLKGIEIPEALVPLAIDEFPVLFVAAACAEGRTVLTGAEELRVKESDRIQVMADGLLALGVKCEPTP

SEQ ID NO: 13935 - protein, 255 aa, Pseudomonas fluorescens
MIQISALPAFTDNYIWLLQDHATQRCAVVDPGDAAPVQAWLDAHPGWVLGDILITHHHHDHVGGVETLKKATGATVYGPASENIPGRDVALKDNDTVRVLGWDFDVYAVPGHTLGHIAYYHHGLLFCGDTLFAAGCGRLFEGTPQQMHQSLSRLAALPEDTLVYCTHEYTLSNLKFAAAVEPDNRDIAARLEKVTRQRENGVMTLPSTLALEKLTNPFLRTGEILVTQKVDERNGPQNRAPSEVFAALRAWKDTF

SEQ ID NO: 13936 - protein, 751 aa, Pseudomonas fluorescens
MYKDLKFPVLIVHRDIKADTVAGDRIRGIARELELEGFSIVSATDYTEGRLVASTHHGLACMLIAAEDASTNSHLLQNMAELIGLARVRAPDLPIFALGEQVTLENAPADAMAELNQLRGILYLFEDTVPFLARQVARAARKYLDGLLPPFFKALVQHTADSNYSWHTPGHGGGVAYHKSPVGQAFHQFFGENTLRSDLSVSVPELGSLLDHTGPLAEAEARAARNFGADHTFFVINGTSTANKIVWHSMVGRDDLVLVDRNCHKSVLHAIIMTGAIPLYLCPERNELGIIGPIPLSEFSRESIQAKIDASPLTKGREPKVKLAVITNSTYDGLCYNAELIKQSLGNSVEVLHFDEAWYAYAAFHEFFAGRYGMATSRSEDSPLVFTTHSTHKLLAAFSQASMIHVQDGGARQLDRDRFNEAFMMHISTSPQYSIIASLDVASAMMEGPAGRSLLQETFDEALSFRRALANLRQHIAADDWWFSIWQPPGVEGIDRVQTEDWLLQPDADWHGFGEVSDDYVLLDPIKVTLVMPGLTAGGALSDKGIPAAVVSRFLWERGLVVEKTGLYSFLVLFSMGITKGKWSTLLTELLEFKRSYDANISLDTCLKCVEQEDPVRYRGMGLRDLCDQLHACYRSNATARHLKRMYTVLPEIAMKPAHAYDQLVRGEVEAVPIDELEGRVAAVMLVPYPPGIPLIMPGERFTESTRSIIEYLRFARTFDTTFPGFVVDVHGLQHEDEGNGRHYTVDCVKE

SEQ ID NO: 13937 - protein, 755 aa, Pseudomonas fluorescens
PNMANESKCPFNHAAGGGTTNRDWWPNQLNLKILSQHSPASDPMGKDFDYAKAFKSLDFQALKRDLTALMTDSQEWWPADFGHYGPLFIRMAWHSAGTYRTADGRGGAGSGQQRFAPLNSWPDNVSLDKARRLLWPIKQKYGRNISWADLIVLTGNVALESMGFKTFGFSGGRADVWEPDEDVYWGSENKWLGGDNRYGKDPESMQPPGEGTLVAEPAEHGNEESRTNQGERNLENPLAAVQMGLIYVNPEGPEGNPDPVASAKDIRETFGRMAMNDEETVALIAGGHAFGKTHGAGPADNVGPEPEAAGLEEQGLGWKNSFGTGKGADTITSGLEVTWTTTPTKWSNNYLENLFGFEWELTKSPAGAHQWKPKNGAGAGTIPHAHDPNKRIDPTMLTSDLALRFDPTYEKISRRFLANPDQLADAFARAWYKLIHRDMGPLSRYLGPELPQEELLWQDPIPEATHPLVDDSDIRALKGKILASGLSVSELVSTAWAAASTFRGSDKRGGANGGRLRLAPQKFWQANQPEQLDKVLKVLEGIQNEFNAGAAGKQVSLADLIVLAGNAGVEQAAQNAGHTVTVPFNPGRTDATQEQTDVESFGFLEPHTDGFRNYAASTYRVPAEALLIDKAQLLTLSAPEMTVLIGGLRVLDTNVGKTQHGVFTDRPGTLTNDFFRNLLDMGVEWKPTSKTEFEGRDRKTGSVKWTATRVDLVFGSNSVLRALAEVYASSDAKEQFVTDFVAAWAKVMDLDRFDL

SEQ ID NO: 13938 - protein, 378 aa, Pseudomonas fluorescens
MIPRTLFSSEHELFRDSVRTFLEKEAVPFHGQWEKQGYIDRKLWNKAGEAGMLCSNLPEEYGGLGADFLYSAVVIEEVGRLGLTGIGFSLHSDIVAPYILHYGSEALKQKYLPKLVSGEMVTAIAMTEPGAGSDLQGVKTTAVLDGDEYVINGSKTFITNGFLADLVIVVAKTDPKAGAKGTSLFLVEANTPGFDKGKRLDKVGMKAQDTSELFFQDVRVPKENLLGQAGAGFAYLMQELPQERLTVAIGGLASAEAALQWTLDYTRERKAFGKSIADFQNTRFKLAEMATEIQIGRVFVDRCLELHLQGKLDVPTAAMAKYWGTDLQCKVLDECVQLHGGYGFMWEYPVARAWADARVQRIYAGTNEIMKEIIARSL

SEQ ID NO: 13939 - protein, 560 aa, Pseudomonas fluorescens
MLQTRVIPPAEGAYQYPLLIKRLLMSGARYEKTREIIYRDQLRYSYPTLIERVAQLANVLTAAGVKAGDTVAVMDWDSHRYLECMFAIPMIGAVIHTINVRLSPEQILYTMNHAEDRFVLVNSEFVGLYQAIAPHLTTVEKTLLLTDLPEKTADLPNLVGEYEQLLAAASPQYDFLDFDENSVATTFYTTGTTGNPKGVYFTHRQLVLHTMGVSTIMGAIDSVRLLGTNDVYMPITPMFHVHAWGLPYVATMLGLKQVYPGRYDPEFLVELWRKEKVTFSHCVPTILQMVLNAKGAQGTDFGGWKIVIGGSALNRTLYETAKSKGIQLTAAYGMSETGPLVSCAHLNDELMAGTEDERTTYRIKAGVPGPLVEAAIVDTEGNFLPADGETQGELVLRAPWLTEGYFNEPQKGAELWAGGWLHTGDVATLDAMGVIDIRDRIKDVIKTGGEWISSLDLEDLISRHVAVREVAVVGIADPQWGERPFALLVVREGHAIGARELKEHLKPFVELGHLSKWAIPSQIALVTEIPKTSVGKLDKKRIRLDITEWQANNSTFLSTL

SEQ ID NO: 13940 - protein, 185 aa, Pseudomonas fluorescens
MSADLEHIRQIMREADCLYTEAEVEAAIARVGAQINEQLADSNPVVFCVMNGGLIFSGKLLTHLQFPLEASYLHATRYRNETSGGDLFWKAKPEVSFIDRDVLIIDDILDEGHTLGAIIDFCRHAGARKVHTAVLIDKDHDRKARPDLKADFVGLPCIDRYIFGYGMDYKGYWRNANGIFAVKGM

SEQ ID NO: 13941 - protein, 336 aa, Pseudomonas fluorescens
MTDHALLLVNLGSPASTSVADVRRYLNQFLMDPYVIDLPWPVRRLLVSLILIKRPEQSAHAYASIWWDEGSPLVVLSRRLQQQMKAQWTHGPVELAMRYGEPSIETNLLKLVAAGHKRITLAPLYPQFADSTTTTVIEEAKRVVREKKLDVQLSVLQPFYDQPEYLDALVASARPHLQQDYDHLLLSFHGLPERHLTKLDPTGNHCFKNEDCCKNASAAVLATCYRAQCLRTAALFAERMGLPDGKWSVSFQSRLGRAKWIEPYTEARLDELAKSGVKKILVMCPAFVADCIETLEEIGDRGKEQFREAGGEELVLVPCLNDDPQWAKALATLCER

SEQ ID NO: 13942 - protein, 243 aa, Pseudomonas fluorescens
WLTGASSGIGAALAEEILKTGAHLAVSSRQVAPLKVLSQRYPGQVLLVPGDLTNSQTVREIGEQIAADWGSLDSVILNAGTCEYVDARQFDASIVEHVVRTNLLASSYCIEAALPLLRKGTAPHLVGMASSVTYVPLPRAEAYGASKAGLRYLFESLRIDLAAEGIEVTVISPGFVDTPLTAKNDFPMPLSWPVDKAARHIFAKLKDRPLEIAFPALFIAALWPLSKMPARVQLAIGKRMVRS

SEQ ID NO: 13943 - protein, 419 aa, Pseudomonas fluorescens
MAFLALGINHKTASVDVRERVAFTPEQLVEALQQLCRLTDSREAAILSTCNRSELYIEQDQLSADIVLRWLADYHHLSLDELRASAYVHEDDAAVRHMMRVASGLDSLVLGEPQILGQMKSAYAVAREAGTIGPLLGRLFQATFNAAKQVRTDTAIGENPVSVAFAAVSLAKQIFSDLQRSQALLIGAGETITLVARHLHELGVKRIVVANRTLERASLLAEQFGAHAVLLSDIPAELVRSDIVISSTASQLPILGKGAVESALKLRKHKPIFMVDIAVPRDIEPEVGELDDVYLYSVDDLHEVVAENLKSRQGAAQAAEEMVSVGADDFMVRLRELAAVDVLKAYRQQSERLRDEELQKALRLLANGGNAEDVLGQLARGLTNKLLHAPSVQLKKLSAEGRLDALAMAQELFALEGSP

SEQ ID NO: 13944 - protein, 300 aa, Pseudomonas fluorescens
MSANVVVIGSLNMDLVTRAPRLPRGGETLIGHSFATVSGGKGANQAVAAARLGAQVSMVGCVGNDEYGVQLHDALLAEQIDCQAVSVVEDSSGVALIVVDDNSQNAIVIVAGANGSMTPAVIDRFDAVLQAADVIICQLEIPDATVGHALKRGHELGKMVILNPAPASRPLPVDWFAAIDYLIPNESEAAALCGLPVDSLETAEKAAAHLISLGAGKVIITLGAQGSLFANGTGYQYFPAPKVKAVDTTAAGDTFVGGFAAALAAGKTEDEAIRFGQVAAALSVTRAGAQPSIPTTSDVQ

SEQ ID NO: 13945 - protein, 258 aa, Pseudomonas fluorescens
WNTQSASFCFASNRAPPAGITVCPAACRNSTLQPKSFKAGQNIHAWWWPAERADAPAILYLHGVRWNLTGQLFRIEQLRAAGYSVLAIDYRGFGQSRGDLPSESTVYEDARVAWERFQLLQPDPNKRLIYGHSLGGAVAIDLAAELGRDATRNHTPLPVRGLVIESTFTSLADVAAAVANTSLPVRWLLSQKFDSIDKIAEIHMPLLVVHGLADAFVPSRFSEQLFAAARQPKRLLLVPGATHNNSMALGGQNYRKAI

SEQ ID NO: 13946 - protein, 322 aa, Pseudomonas fluorescens
MQPQAFYRAVADDFSAVDGIIKKQLTSRVPLVSKIGDYITSAGGKRLRPLLVLLCGKALGREGDDMRLLAATIEFLHTATLLHDDVVDMSGMRRGRSTANAMWGNAPSVLVGDFLYSRSFEMMVELGSMPVMKILSQATRIIAEGEVLQLSKVRDASTTEETYMEVIRGKTAMLFEASTHSAAALAGATAEQSEALRTFGDHLGVAFQLVDDLLDYKGDAETLGKNVGDDLAEGKPTLPLIYTMREGTPEQAALVRQAIQKGGIEDLESIRIAVEASGSLEYTAQLARDYVARAIKCLDALPASEYRDALVELSEFAVARTH

SEQ ID NO: 13947 - protein, 445 aa, Pseudomonas fluorescens
MIESVESFLARLKKRDPDQPEFHQAVEEVLRSLWPFLEANPHYLTSGILERICEPERAVVFRVSWVDDQGRVQVNRGFRIQMNSAIGPYKGGLRFHPSVNLGVLKFLAFEQTFKNSLTSLPMGGGKGGSDFDPKGKSDAEVMRFCQAFMSELYRHIGADVDVPAGDIGVGAREIGFLFGQYKRLSNQFTSVLTGKGMTYGGSLIRPEATGFGCVYFAEEMLKRREQTVEGKRVAISGSGNVAQYAARKVMDLGGKVISLSDSEGTLYCEAGLSEEQWLALLELKNVKRGRISELASAFGLEFRAGQLPWSLPCDIALPCATQNELDAESARTLLRNGCVCVAEGANMPTTLEAVDIFIEAGILFAPGKASNAGGVAVSGLEMSQNAMRLLWTGGEVDSKLHGIMQSIHHACVHYGEENGRINYVKGANIAGFVKVADAMLAQGVV

SEQ ID NO: 13948 - protein, 495 aa, Pseudomonas fluorescens
LAASLLTLSVNAAPLTRDNGAAVGDNQNSQTAGANGPVLLQDVQLIQKLQRFDRERIPERVVHARGTGAHGTFTTTNDLSDLSKAKVFTAGQVTPVFVRFSAVVHGNHSPETLRDPRGFATKFYTADGNWDLVGNNFPTFFIRDAIKFPDMVHAFKPDPRTNLDDDSRRFDFFSHVPEATRTLTELYSNSGTPASYREMDGNSVHAYKLVNAKGDVHYVKFHWKSLQGIKNLDPKQVEKVQGRDYSHMTHDLVENIQKGNFPKWDLYIQVLNPQDLSKFEFDPLDATKIWPGVPERKVGQMVLNRNPANVFQETEQVAMAPSNVVPGIEPSEDRLLQGRIFAYADTQMYRLGANALQLPINAAKTAVNNGNQDGAMNAGASTSGVNYEPSRLQPREETAGARYSQTALQGSTQQAKIQREQNFKQAGDLYRSFSKKERQDLIESFGGSLASADDESKHIMLSFLYKADPEYGAGVTKVAKGDLSRVKALAAKLAD

SEQ ID NO: 13949 - protein, 145 aa, Pseudomonas fluorescens
MPPIVLVLNGPNLNLLGTREPATYGHETLADISALCGRAAEEFGLAVEFRQTNHEGELLDWIHGARQRCAGIVINPAAWTHTSVAIRDALVASELPVIEVHLSNVHAREPFRHHSFVSAIATAVMCGFGSHGYRLALEHFSQRLK

SEQ ID NO: 13950 - protein, 282 aa, Pseudomonas fluorescens
MNRNNVILAGLIGAGIQASRTPALHEHEGDEQGLRYLYRLIDLDQLQLDSNALPDLLLAAERMNYTGLNITFPCKQAIIPLLDELSPEARGIGAVNTVVLKDGKRVGHNTDCLGFAEGFRRGLPDVARERVVQMGAGGAGAAVAHALLSEGVQQLSIFDVDVERAESLANNLNQHFGAGRAVAGHDLASTLSQANGLVNTTPMGMAKLPGMPVPTELLRPELWVAEIVYFPLETELLRNARALGCRTLDGGNMAVFQAVKAFELFSGRVPDAQRMLAHFQSM

SEQ ID NO: 13951 - protein, 262 aa, Pseudomonas fluorescens
LPKLGLGTWPMLGDECTRAVEQALELGYRHIDTAAAYNNEDAVGQALANTPTPREQIHVTTKVWWDQLQPDAMRHSLDRSLKALRSEYVDLFMIHWPTTDWDLPHTLETLASFKEQGLARNIGVANFPLPLLRKVVEEYGIPLSAIQIEYHVLLGQNALLDYARQHDLALTAYTPLARNKVSEIPQIQQIAEKHGVLPTQVALKWLLDQDNVAAIPKASSKTNQLANLASLQVELDDDDRALIAALSKRERQVSPDFAPVWD

SEQ ID NO: 13952 - protein, 263 aa, Pseudomonas fluorescens
MKIDLSGKLAIVSGSTAGIGLGISQSLAEAGATVVVIGRDAAKVEQALTSIRAQVPGAQLRGLTADLGTAEGAQKLFAAEPKADILVNNLGIYNAVDFFDAPDDEWTRFYEINVISGVRLSRHYVPAMVEQGWGRVIFLSSESGVATPADMINYGVTKSANLAVSHGLAKRLAGTGVTVNAILPGPTFTDGVEEMLKDAAAESGRSLRDEADAFVRRARPSSIIQRVADVEEVAHLVTYIASPLSSATTGAALRVDGGVVDSL

SEQ ID NO: 13953 - protein, 225 aa, Pseudomonas fluorescens
RGSDLLSAHDAVFNRAFGAFLFDMDGTVLNSIAAAERIWSAWAVRHGVNVETFLPTIHGVRAIDTITRLNLPGVDAEAQAAFITEAEIEDVEGIVEIPGAAAFLKSLPADRWAMVTSAPRDLALRRMGAAGIPEPAVMITAEDVTAGKPDPAGYRLAARRLGLEPADCLIFEDATVGIQAAEAAGAPLMIITTTHQHPLETAHATIASYRDIALSIDSDGQLRLQ

SEQ ID NO: 13954 - protein, 157 aa, Pseudomonas fluorescens
MAYTFITLPSPVGELKLVANGSRLAAILWENDKPNRVRLGPMSEAPDNPVLMKTARQLEEYFAGTRNAFDLELDFAGTEFQKKVWAALLTIPFGETRTYSQIAEQIGHPSAVRAVGAANGRNPISIIAPCHRVIGASGKLTGFAGGLEAKERLLTLE

SEQ ID NO: 13955 - protein, 1465 aa, Pseudomonas fluorescens
GSVPLAFAAIYNNGGTLNTAYVEPPTATIVMADTALKIGETSLVTITFSRAVTGFTNADLTIANGTLTAVSSSDGGLTWTATFTPTNNITDSTNLITLDNTGVTAISDGVAGVGTTSSVNYAIDTARPTVTIVMSDTALKIGDTSLVTFTFSEAVTGFTNADLTIANGTLSAVSSSDGGITWTGTFTPTASITDTTNLISLDNTGIADLAGNAGSGTTDSANYVIDTVRPTATIVVADSNLAAGETSLVTITFSEAVSGFTTADLTVANGTLSALSSSDGGITWTVTLTPTSNITDTTNLITLDNTGVVDLAGNAGSGTTNSNNYAIDTARPTATIVVADNSLRIGETSLVTITFSEAITGLTNADLTIANGTLTAVSSSDGGITWTATFTPTASITDATNLITLNNTGIADLNGNAGSGTTDSNNYAIDTVRPTATIVVADNNLRIGETSLVTITFSEAVSGFTNADLTVANGTLSALSSSDGGITWTATFTPSASVTDTTNLITLDNTGIADLAGNAGSGTTDSNNYAIDTQRPTATIVVADSNLSAGETSLVTITFSEAVTGFTNADLTVANGTLTAVSSSDGGITWTATFTPNVGVNDATNLITLANTGIADLSGNTGSGTTNSNNYSIDTVLPTATIVIADNALKIGETSLVTITFSEAVTGFTNADLTIANGTLSAVSSSDGGITWTATFTPTTSITDATNLITLDNSGVQNLSGNAGSGTTDSNNYAIDTVRPTATMLVADTALGIGQTTLVTITFSEAVSGFTNADLTIANGTLSAVSSSDGGITWTATFTPSASIADTTNLITLDNTGIADLAGNAGSGTTDSNNYAIDTVRPTATIVVADSNLSAGETSLVTITFSEAVTGFTNADLTIANGTLSAVSSSDGGITWTATFTPTVGIHDATNLITLANTGIADLAGNAGSGTTNSNNYSIDTVLPTATIIVADPSLKIGETSLVTITFSEAVTGFTNADLTIANGTLSAVSSSDGGVTWTATFTPTTSIADATNLITLDNTGVQNLSGNAGSGTTDSNNYSIDTVRPTATIVVADTALGVGQTTLVTITFSEAVTGFTNADLTIANGTLSAVSSSDGGITWTATFTPAAGITDTTNLITLDNTGIADLAGNAGSGTTDSNNYAVDSQRPTATIVLSDNTLSAGETSLVTITFSEAVTGFDNSDLSVANGTLSNVSSSDGGITWTATFTPNIGVIDLTNLIVLNNTGITDLAGNTGTGTTNSPNYSIDTVLPTATIVIADNALKIGETSLVTITFSEAVTGFTNADLTIANGTLSAVSSSDGGITWTATFTPTTNITDATNLITLDNTGVQNLSGNAGSGTTDSNNYSIDTVRPTATIVVADTALGVGQTSLVTITFSEAVTGFTNADLIIANGTLSAVSSSDGGITWTATFTPAAGITDTTNLITLDNTGITDLAGNAGSGTTDSNNYAVDSQRPTATIVMSDIDL

SEQ ID NO: 13956 - protein, 187 aa, Pseudomonas fluorescens
DVLAPTASISRAQREARNGHRGTAMLLTGLPAAGKSTLAQALHAELFSRGLQSVVLDGDGLRVGLNRDLGFTDADRLENIRRASELAALLVENGQIVILAMIAPLAELREVFARRLGEDYREVWCSAALAVCEQRDPKGHYARARRGELAGFTGVSAPYEAPAQASLVLDTGTLTVEACLDRLLTWL

SEQ ID NO: 13957 - protein, 478 aa, Pseudomonas fluorescens
QLKDTQLFRQQAFIDGAWVDADNGQTIKVNNPATGEILGTVPKMGAAETRRAIEAADKALPAWRALTAKERAGKLRRWFELMIENQDDLARLMTLEQGKPLAEAKGEIVYAASFIEWFAEEAKRIYGDVIPGHQPDKRLIVIKQPIGVTAAITPWNFPAAMITRKAGPALAAGCTMVLKPASQTPFSAFALAELAQRAGIPKGVFSVVSGSAGDIGSELTSNPIVRKLSFTGSTEIGRQLMSECAKDIKKVSLELGGNAPFIVFDDADLDKAVEGAIISKYRNNGQTCVCANRLYIQDSVYDAFAEKLKVAVAKLKIGNGLEEGTTTGPLIDEKAVAKVQEHIADAVSKGATVLAGGKPMEGNFFEPTILTNVPKDAAVAKEETFGPLAPLFRFKDEADVIAMSNDTEFGLASYFYARDLGRVFRVAEALEYGMVGVNTGLISNEVAPFGGIKASGLGREGSKYGIEDYLEIKYLCLG

SEQ ID NO: 13958 - protein, 421 aa, Pseudomonas fluorescens
TNAELMARRTAAVPRGVGQIHPIFAESAKNATVTDVEGREFIDFAGGIAVLNTGHVHPKIIAAVTEQLNKLTHTCFQVLAYEPYVELCEKINARVPGDFAKKTLLVTTGSEAVENAVKIARAATGRAGVIAFTGAYHGRTMMTLGLTGKVVPYSAGMGLMPGGIFRALYPNELHGVSIDDSIASIERIFKNDAEPKDIAAIIIEPVQGEGGFYVAPKEFMKRLRALCDQHGILLIADEVQTGAGRTGTFFAMEQMGVAADLTTFAKSIAGGFPLAGVCGKAEYMDAIAPGGLGGTYAGSPIACAAALAVMEVFEEEKLLDRCKAVGERLVTGLKAIQAKHPVIGEVRALGAMIAVELFENGDSHKPNPTAVAAVVAKARDKGLILLSCGTYGNVLRVLVPLTSPDEQLDKGLAIIEECFSE

SEQ ID NO: 13959 - protein, 533 aa, Pseudomonas fluorescens
MPQRPNFLVILADDLGFSDIGAFGGEIATPNLDALANNGLRLTDFHTAPTCSPTRSMLLTGTDHHIAGIGTMAETLTPELIGKPGYEGYLNDRVVALPELLREAGYQTLMSGKWHLGLTAELAPHARGFERSFSLLPGAANHYGFEPTYDEHTPGLLKSTPALYIEDDTFIDELPKDFYSSDAFGDKLLQYLKERDQSRPFFAYLPFSAPHWPLQAPADIVEKYRGRYDAGPEVLRLERLEKLKSLGLIEPDVEPHPLIKLTAQWGALSDEQKRISARAMEVYAAMVERMDWNIGRVVDYLRQQGQLDNTFILFMSDNGAEGALLEAFPKFGPDLVTYLSQHYDNSLDNIGRANSYVWYGPNWAQVATAPSRLFKAFTTEGGIRVPALLHYPQLPLKGQISHGFGTVMDITPTILDLAGVRHPGKQWHGKPVAPLRGKSWLGFLSGETAQVHDEHTVTGWELFGRRAIRQGQWKAVWIPGPVGPATWQLYDLGSDPGEIHDLASSQPQKLEALIEHWQRYVEETGVILSESPF

SEQ ID NO: 13960 - protein, 235 aa, Pseudomonas fluorescens
MSNSKKTVVITGASQGLGEGMVKAFRELGYNIVATSRSIKPSNDPQILTIAGDIGDPATAQRVISEGVARFGRIDTLVNNAGIFVAKPFTAYTPEDYAAVLSVNLNGFFYITQLAIAEMEKQGKGHVVNITTSLVDHAIDGVPSVLASLTKGGLNAATKSLAIEYAKRGIRVNAVSPGIIKTPMHGEETHEALGALHPVGHMGEIDDIAQAVVYLDNANFVTGEILHVDGGQSAG

SEQ ID NO: 13961 - protein, 420 aa, Pseudomonas fluorescens
LLARRDASFARTQKHYYVDPPRIERGWRNHLIDMQGRSYLDMLNNVAVLGHGHPRMAAVASRQWSLLNTNSRFNYAAVAEFSERLLKLAPEGMDRVFLVNSGSEANDLAIRLAWAASGGRDMISVLEAYHGWTVGADAVSTSIADNPKALSSRPDWVHAVTAPNTYRGEFRGPDSAPDYVRSVEQHLAKLDEQKRQLAGFICEPVYGNAGGISLPPGYLKKVYEMVRARGGVCIADEVQVGYGRMGHFFWGFEEQGVVPDIITMAKGMGNGQPLGAVITRREIAEALEAEGYFFSSAGGSPVSCQIGMAVLDVMEEEKLWENAQVVGAHFKARLEALIDQYPLVGAVHGSGFYLGVELIRNRATLEPATEETTLLCDRLRELGIFMQPTGDYLNVLKIKPPMVTSRQSVDFFVDMVAKVL

SEQ ID NO: 13962 - protein, 405 aa, Pseudomonas fluorescens
MSQTSFAIQQAAVIGAGTMGRGIVMCLANAGVSVQWVDNNPQMLEQALSSVAETYAHNVRQGRIDQAEADARIARVSKAADYVAIRNVDLVIEAVYENLELKQKIFRELDGVLKPEALLASNTSALDIDAIAAATRRPTQVLGLHFFSPAHIMKLLEIVRGAQTAPAVLEAALELGKRMGKVSVVSGNCHGFIGNRMLHPYVLEARKMLLEGAYPHQVDAALQSFGFAMGPFRMYDVVGIDLEWRARELAGKGQDAPEVQVDNRLCEQGRFGQKSGNGYYHYEPGSRQAEHDPEVDALVLSVSEGLGFHRRDIGSEEILERCLLALVNEGAKILQEGIAESAHDIDQVYLNGYGFPAERGGPMAWADDQGLADIHKRLLALETRQGDHWRPAPLIGELAARGKGF

SEQ ID NO: 13963 - protein, 513 aa, Pseudomonas fluorescens
MTQANNAVYTDLSVDDLVKEALNRGEGELADTGALVVRTGHRTGRSPVDRFIVEEPSTQAAIAWGPINRKFPADKFDALWARVEAFNNAQEHFVSHVHVGAAEDHYLAVKMTTQTAWQNLFGRCLFINPAQYNPAGREEWQVLNVANFECVPERDGTNSDGCVIINFAQKKVLIAGMRYAGEMKKAMFSVQNFLLPAADVLPMHCAANIGEEGDVTLFFGLSGTGKTTLSADESRYLIGDDEHGWGEGVVFNIEGGCYAKCIDLSEKNEPVIWKAIKHGAVLENVVIDDAKHADYADVSLTQNSRAAYPLEHVAKRSEKNLGGEPNAVIFLTCDLTGVLPPVSILNEEQAAYHFLSGYTALVGSTEMGSGSGIKSTFSTCFGAPFFPRPAGEYAELLIKRIRGFGSKVYLVNTGWTGGGYGVGKRFNIPTTRAVIAAIQSGALIGAATEHLDTINLDVPLAVPGVETNLLNPRNTWADKAAYDEAAKALAGLFIENFKKFEVSDAIKAAGPKL

SEQ ID NO: 13964 - protein, 342 aa, Pseudomonas fluorescens
MTYTAAENRYDSIPYRRVGRSGLVLPALSLGLWHNFGDSTPIDTQRSLLRTAFDLGINHFDLANNYGPPYGSAEINFGRLLREDFKQYRDELIISSKAGWDMWPGPYGQGGGSRKYVLASLDQSLQRLGLDYVDIFYSHRFDPDTPLEETASALATAVQQGKALYIGISSYSGVKTREIAALLKEWKVPLLIHQPAYNLLNRWVEKDLLDTTDELGTGVIAFTPLAQGLLTDKYLNGVPADARVNRPGGGSLQASHLSEANIAHVRALNEIAKRRGQSLAQLALAWTLRDPRVTSALIGASRPEQIVENVGALKNLSFSAEELAEIDRFAQEGGINLWEKPS

SEQ ID NO: 13965 - protein, 335 aa, Pseudomonas fluorescens
RQYGTMSTQPIKQQLQRFNRLDLLGQPTPLEKLERLSTWLGRDVYIKRDDLTPLAMGGNKLRKLEYLAADAIAQGADTLITAGALQSNHVRQTAALAAKLGLGCVALLENPLGTDDSNYTGNGNRLLLDLFDTKVELVDNLDNADEQLAALAVRLRSNGKKPYLVPIGGSNAIGALGYVRAGLELAEQIKDTGLQFSAVVLASGSAGTHSGLALALSEALPQLPVIGVTVSRSEEDQRPKVQGLAERTADLLGVALPDSFKVELWDEYFGPRYGEPNAGTLSAVKLLASQDAVLLDPVYTGKAMAGLLDGIGRGRFDDGPIIFLHTGGAPALFAY

SEQ ID NO: 13966 - protein, 410 aa, Pseudomonas fluorescens
LADANVQSDLDIAPLLLPAQVLRNDAQAIKAAHELAQVARVQAAKRDRQRKLPWSEIEQFTRSGLGSIAIPREYGGPQVSFVTLAEVFAIISAADPALGQIPQNQFGIINLILGSATEQQKKHLLQSVLEGWRIGNAGPERGTKNTLELKARITADGDDYVINGQKFYSTGALFAHWVAVKALNDDGKQVLAFVRRGTPGLRIVDDWSGFGQRTTASGTILLNNVRVDAGLVVDNWKINEKPNTQGAVSQLIQAAIDAGIARGAIDDAIEFVKTRARPWIDANVERASDDLYVIADIGKLKIELHAAEALLRKAGQVLDQVHAAPLTAESAARASIAVAEAKVLTTEISLLASEKLFELAGSRATLAEFNLDRHWRNARVHTLHDPVRWKYHAVGAYRLNGKLPARHSWI

SEQ ID NO: 13967 - protein, 388 aa, Pseudomonas fluorescens
ITSDEQALIVASDLAEDFQRDSNLRDRERRLPLPELDVFSRSGLWGISVPKEYGGAGVSNVTLAKVIALIARADGSLGQIPQNHFYALEVLRVNGSHEQKQRLYAEVLAGQRFGNALAELGTRTAHDRVTRLERDGSGYRINGRKFYATGAIYAQRIPTSVVDENGVQQLAFVPRDSKGLTVIDDWSGFGQRTTGSGSVVFENVYVAAEDVIPFQSAFERPTPVGPLAQILHAAIDTGIARAAYEDALHFVRSKTRPWIDSGNDKATEDPLTLKSFGHLSIRLHATEALLERAGEFLDAAQAETNAETVAAASIAVAEARAISTEISLAAGSTLFELAGSQATLIEHGLDRHWRNARVHTLHDPVRWKYHAVGNYYLNDENPPLRGTI

SEQ ID NO: 13968 - protein, 291 aa, Pseudomonas fluorescens
KYKGILLAGGAGSRLHPITLGVSKQSLPVYDKPMIYYPLSVLMLAEIREILIISTPEDLPGFQRMLGDGSQLGLSLSYAVQPSPDGLAQAFIIGREFVGEDNVCLVLGDNIFYGAGFGETLLQAAARDEGATVFGYYVADPERFGVVEFDAAGKALSICEKPSDPKSNYAVTGLYFYDNEVLQIAADIKPSPRGELEITDVNNVYLQRGKLNVSVMGRGMAWLDTGTHDALMEAGNFVQAIEKRQGLKIACLEEIAYHKGWIDDAQLLVHAGSMSKTGYGQYLARLIHDDV

SEQ ID NO: 13969 - protein, 224 aa, Pseudomonas fluorescens
SGLHVISDLHALGLQIENKASLIDCIRASQNTDGGFAEQPGHLSDVFATYCAVLSLRVLGALPNDIGGCVRYLQACQNPDGGFGDVPGFGSDIWHTNLAVLSLHALEAKAPDEQGVMAFALRCRSADGGFANKPGYPPDAFSVYRVVSTLFILNRRIVDAEQTVAWLQSLQLANGSFHYRPGKAVSLVGTYMAIAAMYLLDAQPTYLQESKDWIAAHQKQDGGF

SEQ ID NO: 13970 - protein, 524 aa, Pseudomonas fluorescens
  unsure (1)..(524): unsure at all Xaa locations
NSPTTNSXHTPHLKANLSPWLLRXKQVLETSMNASLTPNETTIQKVKLLIDGEWVESQTTEWHDIVNPATQQVLAKVPFATAAEVDAAVSAAQRAFQTWKLTPIGARMRIMLKLQALIREHSKRIAVVLSAEQGKTIADAEGDIFRGLEVVEHACSIGSLQMGEFAENVAGGVDTYTLRQPIGVCAGITPFNFPAMIPLWMFPMAIACGNTFVLKPSEQDPLSTMLLVELAIEAGIPAGVLNVVHGGKDVVDGLCTHKDIKAVSFVGSTAVGTHVYDLAGKHGKRVQSMMGAKNHAVVLPDANREQALNALVGAGFGAAGQRCMATSVVVLVGAAKQWLPDLKALAQKLKVNAGNEPGTDVGPVISKKAKARILDLIESGIKEGAKLELDGRDISVPGYEKGNFVGPTLFSGVTTDMQIYTQEIFGPVLVVLEVDTLDQAIALVNANPFGNGTGLFTQSGAAARKFQTEIDVGQVGINIPIPVPVPFFSFTGSRGSKLGDLGPYGKQVVQFYTQTKTVTARWFD

SEQ ID NO: 13971 - protein, 372 aa, Pseudomonas fluorescens
FARETFQKMKAFADKQETPFVVIDTAMIAQAYDDLRAGFEFAKVYYAVKANPAVEIIDLLKEKGSSFDIASIYELDKVLSRGVSADQISYGNTIKKSKDIRYFYEKGVRLFATDSEADLRNIAKAAPGAKVYVRILTEGSTTADWPLSRKFGCQTDMAMDLLILARDLGLVPYGISFHVGSQQRDISVWDAAIAKVKVIFERLKEEDGIHLKLINMGGGFPANYITRTNSLETYAEEIIRFLKEDFGDDLPEIILEPGRSLIANAGILVSEVVLVARKSRTAVERWVYTDVGKFSGLIETMDEAIKFPIWTEKKGEMEEVVIAGPTCDSADIMYENYKYGLPLNLAIGDRLYWLSTGAYTTSYSAVEFNGFP

SEQ ID NO: 13972 - protein, 303 aa, Pseudomonas fluorescens
MNPQELKSILSAGLLSFPVTDFNAQGDFNRAGYIKRLEWLAPYGASALFAAGGTGEFFSLAASEYSEIIKTAVDTCASSVPILAGVGGSTRQAIEYAQEAERLGAKGLLLLPHYLTEASQDGVAAHVEAVCKSVNIGVVVYNRNVCRLTAPLLERLAERCPNLIGYKDGLGDIELMVSIRRRLGDRFSYLGGLPTAEVYAAAYKALGVPVYSSAVFNFIPKTAMDFYHAIAREDHATVGKIIDDFFLPYLDIRNRKAGYAVSIVKAGAKIAGYDAGPVRAPLTDLTGEEYEMLAALIDKQGAQ

SEQ ID NO: 13973 - protein, 473 aa, Pseudomonas fluorescens
YDNYINGEWVAGNDYSANINPSELSDTIGDYAKADLAQVNAAIDAARAAFPAWSTSGIQARHDSLDKVGTEILARREELGTLLAREEGKTLPEAIGEVTRAGNIFKFFAGECLRLSGDYVPSVRPGVNVEVTREALGVVGLITPWNFPIAIPSWKIAPALAYGNCVVLKPADLVPGCAWALAEIISRAGFPAGVFNLVMGSGRVVGEALVNSPKVDGISFTGSVGVGRQIAVNCVSRQAKVQLEMGGKNPQIILDDADLKQAVELSVQSAFYSTGQRCTASSRLIVTAGIHDKFVEAMAERMKSIKVGHALKAGTDIGPVVSQAQLEQDMKYIDIGQSEGARLVSGGGLVTCDTEGYFLAPTLFADSEASMRISREEIFGPVANIVRVADYEAALAMANDTEFGLSAGIATTSLKYANHFKRHSQAGMVMVNLPTAGVDYHVPFGGRKGSSYGSREQGRYAQEFYTVVKTSYI

SEQ ID NO: 13974 - protein, 431 aa, Pseudomonas fluorescens
KPTHVRYLILLMLFLVTTINYADRATIAIAGSSLQKDLGIDAVTLGYIFSAFGWAYVAGQIPGGWLLDRFGSKKVYALSIFTWSLFTVLQGFVGEFGMSTAIVALFMLRFLVGLAEAPSFPGNARIVAAWFPTAERGTASAIFNSAQYFATVLFAPLMGWIVFSFGWEHVFIVMGLLGIVFSLVWLKVIHSPRQHPMANEAEVKFIADNGGMVDMDQKQGKKADGPKWDYIRQLLTNRMMLGVYLGQYCINGITYFFLTWFPVYLVQERGMTILKAGFIASLPAICGFIGGVLGGVISDYLLRKGHSLTFARKAPIIAGLLVSSSIVACNYVDVEWMVVGFMALAFFGKGVGALGWAVVSDTSPKQIAGLSGGLFNTFGNIASITTPIVIGYIISSTGSFKWALVFVGANALVAVFSYLVIVGPIKRVVLK

SEQ ID NO: 13975 - protein, 458 aa, Pseudomonas fluorescens
MTKTRIERDSMGELQVPVDALYGAQTQRAVDNFPISGKPMPTQFIRALILAKAAAARANVELNQISAAQGKAISDAAQGLLEGDFMQHFPVDIFQTGSGTSSNMNANEVIATLASRLLEEPLNANDHVNCGQSSNDIIPTTIHVSAALALHEQLLPALLHLVQVIERKAEQVHHHVKTGRTHLMDAMPVRMSQVLNGWAQQLKANIGHLQDLLPSLQSLAQGGTAVGTGINAHPEFAARFSRQLSQLTNVQFTPGKDLFALIGSQDTAVAVSGQLKATAVSLMKIANDLRWMNSGPLAGLGEIELEGLQPGSSIMPGKVNPVIPEATAMVAAQVIGNDSVITIAGQSGNFELNVMLPIIAQNLLSSIELLANSSRLLADKAIASFRVNESRLKEALSRNPILVTALNPIIGYQKAAEIAKQAYKQGRPVIDVALEHTDLSRSQLEELLNPEKLTAGGV

SEQ ID NO: 13976 - protein, 421 aa, Pseudomonas fluorescens
MDKLIITGGARLDGEIRISGAKNSALPILAATLLCDGPVTVGNLPHLHDITTMIELFGRMGIEPVIDEKLSVEIDPRTIKTLIAPYELVKTMRASILVLGPMVARFGEAEVALPGGCAIGSRPVDLHIRGLEAMGAVIDVEGGYIKAKAPEGGLRGAHFFFDTVSVTGTENIMMAAALAKGRSVLQNAAREPEVVDLANFLNAMGAKVSGAGTDTITIDGVERLGSAFYKVMPDRIETGTYLVAAAVTGGRVKVKDTDPTILEAVLEKLREAGAEITCGEDWIELNMHGKRPKAVNVRTAPYPAFPTDMQAQFISLNAIAEGTGAVIETIFENRFMHVYELHRMGAHIQVEGNTAIVTGIETLKGAPVMATDLRASASLVISALVAQGDTLIDRIYHIDRGYECIEEKLQMLGAKIRRVPG

SEQ ID NO: 13977 - protein, 430 aa, Pseudomonas fluorescens
IRRLNAADPDFAHHLDHLLSWESVSDDSVNQRVLDIIKAVRERGDAALVEFTQKFDGLEVASMADLILPRERLELALTRITVAQREALEKAAARVRSYHEKQKQDSWSYTEADGTVLGQKVTPLDRAGLYVPGGKASYPSSVLMNAIPAKVAGVTEVVMVVPTPRGEVNELVLAAACIAGVDRVFTIGGAQAVAALAYGTESVPQVDKVVGPGNIYVATAKRHVFGQVGIDMIAGPSEILVVCDGQTDPDWIAMDLFSQAEHDEDAQAILVSPDAEFLDKVAASIDKLLPTMDRATIIETSINGRGALIHVRDMAQAIEVANRIAPEHLELSVADPQAWLPQIRHAGAIFMGRHTSEALGDYCAGPNHVLPTSGTARFSSPLGVYDFQKRSSIIFCSEAGASELGKTASILARGESLSAHARSAEYRIKD

SEQ ID NO: 13978 - protein, 350 aa, Pseudomonas fluorescens
MSKFWSPFVKDLVPYVPGEQPKLTRLVKLNTNENPYGPSPKALAAMQAELNDNLRLYPDPNSDLLKNAVAKYYGVQNNQVFLGNGSDEVLAHIFHGLLQHDQPILFPDISYSFYPVYCGLYGITFDAVPLDAQFRINPADYAKPNGGIIFPNPNAPTGCLLALEAVEQILKGSPDSVVVVDEAYIDFGGETAISLVDRYPNLLVTQTLSKSRSLAGLRVGLAVGHPDLIEALERIKNSFNSYPIDRMANVGAAAAFEDREYFDKTCALVIESREWVVAQLQAKGFEVLPSAANFIFARHPQHDAAGLAAKLREQGVIVRHFKQERIAQFLRISIGTPEQNQALIDGLGEL

SEQ ID NO: 13979 - protein, 621 aa, Pseudomonas fluorescens
SEDILAYLGQHERKELLRFLTCGNVDDGKSTLIGRLLHDSKMIYEDHLEAITRDSKKVGTTGDDIDLALLVDGLQAEREQGITIDVAYRYFSTAKRKFIIADTPGHEQYTRNMATGASTCDLAIILVDARYGVQTQTRRHSFIASLLGIKHIVVAINKMDLKGFDQGVFESIKADYLKFAEGLKMKPTSMHFVPMSALKGDNVVNKSERSPWYTGQSLMEILETVEVAGDRNFTDLRFPVQYVNRPNLNFRGFAGTLASGIVKKGDEVVVLPSGKSSRVKSIVTFEGELEHAGPGQAVTLTMEDEIDISRGDLLVHADNVPPVTDSFEAMLVWMAEEPMLPGKKYDIKRATSYVPGSIASIVNKVDVNTLEEGPASALQLNEIGKVKIALDAPIALDGYDSNRTTGAFIVIDRLTNGTVGAGMIVAQPVTHGTATHHGKLAHVATEERAQRFGQQPATVLFSGLSGAGKSTLAYAVERKLFDLGRAVFVLDGQNLRHDLNKGLPQDRAGRTENWRRAAHVARQFNEAGLLTLAAFVAPSAEGREQAKDLIGRERLLTVYVQASPTVCAERDPQGLYAAGGDNIPGESFPYDVPLDADLVIDTQSLSLDESVKQVLDLLRKR

SEQ ID NO: 13980 - protein, 678 aa, Pseudomonas fluorescens
NPLLQSYDLPPFSAIRAEHVQPAIETILADNRAAIAEILKTQGQNPTWAGLVLAMDELNDRLGAAWSPVSHLNAVCNSAELREAYESCLPALSAYSTEMGQNRELFQAYEALANSPAAAGFDVAQKTILEHALRDFRLSGIDLPEAEQKRYAEVQSKLSELGSRFSNQLLDATQAWTKHLTDEAALAGLTDSAKAQMAAAAQAKGLDGWLITLEFPSYYAVMTYAQDRALREEVYAAYCTRASDQGPNAGQNDNGPVMDEILDLRQELAKLLGFSSFSELSLATKMAESSDQVLSFLRDLAKRSKPFAAQDLQQLKAYAAEQGCADLQSWDSGFYGEKLREQRYSVAQETLRAYFPIDKVLGGLFAIVQRLYGIEIAELKGFDTWHPDVRLFEIKENGQHVGRFFFDLYARANKRGGAWMDGARDRRRTVDGVLQSPVANLVCNFTPADSGKPALLTHDEVTTLFHEFGHGLHHLLTRVEHAGVSGINGVAWDAVELPSQFMENWCWEPEGLALISGHYETGEPLPQDLLEKMLAAKNFQSGLMMVRQLEFSLFDFELHATHGDGRSVAQVLEGVRNEVSVMRPPAYNRFPNSFAHIFAGGYAAGYYSYKWAEVLSADAFSKFEEDGVLNADTGRAFREAILARGGSQEPMVLFVDFRGREPSIDALLRHSGLSEDAA

SEQ ID NO: 13981 - protein, 389 aa, Pseudomonas fluorescens
KASFNWIDPLLLDQQLTEEERMIRDTAEQFAQQSLAPRVLEAFRHEKTDPAIFREMGEVGLLGATIPEQYGGSGLNYVSYGLIAREVERVDSGYRSMMSVQSSLVMVPINEFGTEAQKQKYLPKLASGEWIGCFGLTEPNHGSDPGAMITRARKVDGGYSLTGAKMWITNSPIADVFVVWAKDDAGDIRGFVLEKGWKGLSAPAIHGKVGLRASITGEIVMDNVFVPEENIFPDVRGLKGPFTCLNSARYGISWGALGAAEFCWHTARQYTLDRQQFGRPLAATQLIQKKLADMQTEITLALQGCLRLGRMKDEGTAAVEITSIMKRNSCGKSLEIARMARDMLGGNGISDEFGVARHLVNLEVVNTYEGTHDVHALILGRAQTGLQAF

SEQ ID NO: 13982 - protein, 186 aa, Pseudomonas fluorescens
MNIPNLITVLRVLLIPIFILLFYLPYQWSYLASSSVFAFAAATDWLDGYLARRLEQSTPFGAFLDPVADKLMVAVALVLLVQEHGNLWLTLPAAVIIGREIVVSALREWMAELGARAHVAVSNLGKWKTAAQMLALVILLANPKVFSFWVVIGYALLMVSAGLTLWSMVQYLRAAWPHLKTDVEKK

SEQ ID NO: 13983 - protein, 352 aa, Pseudomonas fluorescens
MNSSVSALPLSTLNPANEALTLRLPSSLQLKQQLPLSNALNQQVVAHRQAVRAILDGHDPRLLVIVGPCSIHDPESALEYASKLSHLAEEVRDDMLLVMRAYVEKPRTTVGWKGLAYDPHLDGSDDMAAGLTLSRELMLEMIRVGLPIATELLQPMAAGYFDDLLSWVAIGARTTESQIHREMASGLSMPVGFKNGTDGGVTVAVDAMRSAAHPHRHFGVDSQGHPAIIQTPGNQDTHLVLRGGHQGPNYDRESVSRINAELNRLKIPKRMMVDCSHANSGKDPLRQPGVFNDVLEQRLKGDRSLVGMMLESHLFEGCQPLSESLRYGVSITDACLGFDSTRQLLLDAAHRM

SEQ ID NO: 13984 - protein, 255 aa, Pseudomonas fluorescens
TLSGKTALVTGSTSGIGLGIALTLAKAGANLILNGFGDASKVIAEVEQFGGKVGHHPADVSDPAQIADMIAYAEREFGGVDILVNNAGIQHVAAVEEFPVERWDSIIAINLSSVFHSTRLSLPGMRAKGWGRIVNIASVHGLVGSTGKAAYVAAKHGVIGLTKVVGLETAASNVTCNAICPGWVLTPLVQKQIDDRAAKGVDPQQAQHDLLAEKQPSLEFVTPAHLGELVLFLCSEAGSQVRGAAWNIDGGWLAQ

SEQ ID NO: 13985 - protein, 646 aa, Pseudomonas fluorescens
ILWQPDAKRIARSRMDGFRRFINQRHHLKLDDYPALHQWSIDQREAFWQAIVDFFGISFHTQPDAVLRGGLKMPGAEWFPGATLNFAEHLLSRRDDAIAVIAIGENGQRELLTWAELAQQVAGFQASLQAAGVLVGDRIAACMPNTWQTLVAMLATTSLGAIWSCSSPDFGTHGVIDRFGQIEPKVLITCAGYRYAGKEIDQTVKVNEILEQLPSLQQLIIVPYARPQAHATDYRTPANVTLWDDFYEPGDEPQFVPVPFDHPLYVLYSSGTTGVPKCIVHSTGGVLLQHVKEHGLHVDLGPGDRLFYYTTCGWMMWNWLVSALAVGSAVVLYDGSPFYPDNERLLELLDDEQVSVFGTSPKFLATLESSGIKPRESYDLSHLRTLLCTGSALSPQSYDFVYRDFKPDVCLSSMSGGTDIVSCFVNGNPMSAVRRGEIMGKSLAMAVEVWNDAGQPVVGEKGELVCTRSFPAVPIGLWNDPDGEKLRKSYFSQFPGVWAQGDYAEQLPHGGMLIHGRSDAVLNPGGVRIGTAEIYRQVEKVPQVLDSVAIGQQWQDDVRVVLFVHLKDGVTLDDTLQQQIRQVIRANTTPRHVPAKIVAVTDIPRTISGKVVELAVRNVVHGEPVKNTDALANPQALEQFRDRPEL

SEQ ID NO: 13986 - protein, 303 aa, Pseudomonas fluorescens
  unsure (1)..(303): unsure at all Xaa locations
TPRIALIGECMIELQQRADGSLQQSFGGDTLNTAVYLSRAMGGKAQVDYVTALGDDSFSDAMCRIWADEGIGLDLVQRLPGRLPGLYCIQTDAAGERRFLYWRNEAAVRDCFTTPASAPILAALADYDVLYFSGITLAVLGALGREKLIETLIEARQRDARIVFDNNYRPRLWASVEEARAAYRSVLPHVDLALLTVDDEQALFHFEDCDAVFAAYAQIGTPEVVLKRGAEACLIRCDGEAFEVPAQKVETVVDTTAAGDSFSAAYLASRLSGASPVRAAEAGHRLASQVIQVPGALIPKDXC

SEQ ID NO: 13987 - protein, 332 aa, Pseudomonas fluorescens
MTDTPHFPLSAVVGADDLKLALYLTAIDPKIGGVLIEGPRGMAKSTLARGLADLLASGQFVTLPLGATEERLVGTLDLDAALSDGRAQFSPGVLAKADGGVLYVDEVNLLPDHLVDLLLDVAASGTNLIERDGISHRHSAKFVLIGTMNPEEGELRPQLLDRFGLNVALSGHTAPAERGQIIRRRLDFDSDPQVFCAQWEADQQALRERCESARHALANIPLDDEALAQITERCFAAGVDGLRADLVWLRAARAHAAWRGAETIAEQDIDAVAELALRHRRREQSSSPAQPPAQSPSGTHAEPSEGQGQWGEMPAPALVTGARREVPTWPKK

SEQ ID NO: 13988 - protein, 1256 aa, Pseudomonas fluorescens
MHLLRTQPGGFVSDDNIADLGQTPAELVILCSGDSSLALLAEAAQQLPEDYPSVRLANPMQVQNHASVDLYVDEVLRHAKVILISLHGGIAYWRYGVERLVELSERGVQVILVPGDDRPDPELSDLSTVGAEDRDRLWQFLRQGGLGNALDFFHCLANRWLARDYVWGEPQALPRTAIYHPNKNTAALSDWQADWRPGQPVAAVLFYRSHLQAANTAFIDVFCQRLQVAGLNPLPIAVASLKEPGCLSVVEDWLDEAGASVILNTTGFAQSSPEAPHLRPFRRNIPVIQAICAQDNEPGWRESEQGLGPRDLAMHIALPELDGRIISRPISFKDLAWRSERSQSDVVCYRAQPERMDFVAELARRWVDLARVPNAEKRIALILANYPTRDGRIGNGVGLDTPAAGLNILRALQAEGYPLPAELPDSGTELIRQLLGGVSNDLDTLDQRPCQQSLAMDDYLKMFNALPEANRAAVLERWGLPQNDPMCRDGRMMIAGLRFGLTFVGIQPARGYQVDPSAVYHDPDLVPPHAYLAFYFWLRQTYGAHGVIHVGKHGNLEWLPGKGVGLSENCWPDALLGPLPNIYPFIVNDPGEGAQAKRRTQAVIIDHLMPPLTRAETYGPLRNLELLADEYYEAQLLDPRRARELQRDILQLVRDTQIDRELQLDAALDSDADAAIWLPRLDTYLCDLKESQIRDGLHIFGESPTGRLRIDTLLALLRIPRGDGKGAQSSLLRALAKAFQLGFDPLDCALAEPWTGLRPMELQSLSDEVWRTAGDTRERLELFAAHLIEQSLVGDVAQLDASGWSDVQAIIHALREVIAPRLDACGPAEMRGLLDALSGRFVPAGPSGAPSRGRLDVLPTGRNFYSVDVRNLPTTTAWRIGFQSATLILERHLQDHGDHLRQLGLSVWGTATMRTGGDDIAQAMALMGVRPVWATGSQRVDDFEILPLSLLDRPRVDVTLRVSGFFRDAFANLIRLFDAAVQAVAELDEPDDLNPLAAKVRAEREALRQSGLDDEAARRQAGWRIFGAKPGAYGAGVQGAIDGRLWQTREDLAEVYLNWGAYAYGGSDEGTAAREQFVQRLSQVQAVLQNQDNREHDLLDSNDYYQFQGGMLAAVESLRGEAAASYHGDHSQPDLPKIRTLKEELNRVIRSRAANPKWIDGVKRHGYKGAFELAATVDNLFAFDATTQLIDDHQYALLADAYLLDPATREFVREHNPHALRDMTERMLEAQQRGMWQEPGAYKEALENLLLDIEEE

SEQ ID NO: 13989 - protein, 552 aa, Pseudomonas fluorescens
MYVYDEYDQRIIEDRVKQFRDQTRRYLAGELSEEEFRPLRLQNGLYIQRFAPMLRVAVPYGQLTSRQVRMMAKIARDYDKGYAHISTRQNVQFNWPAVEDIPDILAELATVQMHAIQTSGNCLRNVTTDQFAGVAADELIDPRPWCEIVRQWTTFHPEFAYLPRKFKIAVNGSTSDRAAIEVHDIGLEPVHNAAGELGFRVLVGGGLGRTPVVGAFINEFLPWQDLLSYLDAILRVYNRYGRRDNKYKARIKILVKALTPEVFAQKVDAEMEHLRGGQTTLTEAEVHRVAKHFVDPDYKALSNQDAELAALDKEHPGFARWRTRNTLAHKKPGYVAVTLSLKPTGVAPGDITDKQLDAVADLAERYSFGQLRTSHEQNIILADVEQSQLFTLWGELREAGFATPNIGLLTDIICCPGGDFCSLANAKSIPIAESIQRRFDDLDYLFDIGELDLNISGCMNACGHHHVGHIGILGVDKKGEEFYQVSLGGSASRDASLGKILGPSFAQEDMPDVISKLIDVYVEQRTEDERFIDTYQRIGIDLFKERVYAANH

SEQ ID NO: 13990 - protein, 365 aa, Pseudomonas fluorescens
VAGARGPYYRRLSSGFVEGRFMVKVGIVGGTGYTGVELLRLLAQHPQAEVVVITSRSEAGLAVADMYPNLRGHYDGLAFSVPDIKTLGACDVVFFATPHGVAHALAGELLAAGTKVIDLSADFRLQDADEWAKWYGQPHGAPELLDEAVYGLPEVNREQIRKARLIAVPGCYPTATQLGFLPLLEAGIADASHLIADCKSGVSGAGRGAAVGSLYSETSESMKAYAVKGHRHLPEIRQGLRRAAGKDVGLTFVPHLTPMIRGIHSTLYATVVDRSVDLQALFEKRYANEPFVDVMPAGSHPETRSVRGANVCRIAVHRPQDGDLVVVLSVIDNLVKGASGQAVQNMNILFGLDERLGLSHAGMLP

SEQ ID NO: 13991 - protein, 253 aa, Pseudomonas fluorescens
ALITGASSGIGLAMAEALARRGRSLILVARQRDQLESIAIELTQRFGVEVLFRACDLGEPLRLSGFLLELEEGDRQIDLLVNCAGIGTCGPFLAQDWMTEQDLIEVNILALTRLCHAIGNSMALQGGGQILNVASVAAFNPGPWMSTYYASKAYVLHFSEALRVELKKCAVKVSVLCPGPTRTAFFRTAQLNNDKLNASKLLMSPEEVALYTVRALEKNRAIIIPGRRNRWFAFLPRLGSRWLNRTIVGMVNK

SEQ ID NO: 13992 - protein, 382 aa, Pseudomonas fluorescens
MSLSSFKIAHKLITGAGAIEQLAAELTRLDIDNPLIVTDAALVKSGTVELALAQIGEREYEIFDRVLPDPEIAIVEDCMRVYREGGHDGLIGLGGGSAIDIAKSVAAYAGYHGALEDLFGVDQVPRKGPPLIAIPTTAGTGSEVTNVAILSDKVAQLKKGIVSDYLLPDVALVSPQMTLTCPRSVTAASGVDALVHAIESYLSLNASPITDSLAIGAIKLIARSLPKAYANPSNLQAREDMATASLMAGMAFGNAGVGAVHALAYPLGGRFNIAHGVSNALLLPYVMTWNKMACVERMQDIAEAMGVKTAHLSLNEAADSAVAAMTELCAAVEIPLGLRSFGVPEEAIPAMAVEAAGIERLMRNNPRKLSAADIEKIYRAAY

SEQ ID NO: 13993 - protein, 218 aa, Pseudomonas fluorescens
KAMILAAGKGERMRPLTLTTPKPLVRAGGVPLIEYHLRALAAAGFNEIVINHAWLGQQIEDHLGDGSQFGVSIQYSPEGEPLETGGGIFRALPLLGEDAFLVVNGDIWTDYDFSVLHQPINGLAHLVLADNPAHHPTGDFTLTDGQVRDGQADLATLTYSGIAVLHPQLFDGCRDGAFKLAPLLRKAMADGQVTGERLKGHWVDVGTHERLAEAEALI

SEQ ID NO: 13994 - protein, 817 aa, Pseudomonas fluorescens
IGTSLFWKCPCLRRPSPSPHRNPGQRLAVTLRHVPGLKRSAAALRVAAGSHDVPLAWPGLAHFLEHLLFLGTERFPASQGLMAYVQGHGGQVNASTRERTTDFFFELPPASFSGGLERLSDMLARPCMNPDDQLREREVLQAEFVAWSQDAGAQQKEALFEGLSASHPLRGFHTGNRDSLPVEHADFQQALKDFHQQFYRTGQMTLSLVGPQSVEELRTLAEQFAAALTAGDKTAQAAPVCLMDNPQKSYQQVGERHGNLLFALEDLPESSAEALAFFCHWLNSAKPGGLLAHLQQQGFAEDLQACVPYQFAGQAFLHLQFTGASGSLDAIRAQLLDWLSFFAAQQDWPALREEYSAQLQRQQQVSGALQLARLDSEQLESGLSESAVAALKVILGKIGTVDNFSSHWHLPAANPFLRAAEPLANAGLIRGQTSAHRGLRTFAQDRSRSRRERSPMQFSQALPDNDDEGAVYVRWQTEAAATAELQAKLQRSLREVSDDARQAGVELSFSASADQWLLKLTGLQDTLPVVLEHALKSLTQVGADAAKGEPQPALIPIRQLLKVLPEKCLSAVGESDDAAHLWTTSRWDGLALGLSPQTQSAMGLALSRIPGIPDNQIPAPSAINAGYRWSQIDSASSEHALLLFCPTASHEIADEAAWRLLAHLCQTPFYQRLRVELQLGYAVFSGLRQLHGQTGLLFGVQSPTATAAQLLDHIQQFLDGLPALVEQLDAASLTQQRQTLADQFDDNVLSGKDAAELLWQARLAGHSSDYLLQLRSAVAQLDRPALLAAAQRLIRAEGGWHGLANSPSPGAPWHAAK

SEQ ID NO: 13995 - protein, 389 aa, Pseudomonas fluorescens
ADGLNAERLMPSVERPQQVFVRGQGSWLWDSNDRAYLDFSQAGGANSLGHSPSALVKAIANQAQALINPGFNLHNRGMLSLAERLCASTGSDQAYLLNSGSEACEAAIKLARKWGQLHRGGASRIIVARQGCHGRSLATISASDSCNLHNRFAPLLPGFDPVPFNDLPALHAAVDAQTVAIMLEPIQSDAGVIPATEHYLKGVERLCRELGILLILDEVQTGIGRCGTLLAEQSYGVRADIVVLGKGLGGGVPLAALLARGKACCFDSGELGGTHHGNALMTAAGLVVLDSVQDRAFLEQIRDNCQHLREGLARLAYRYEHGELRGQGLFWGLSLSEDSAEAVVKAALHEGLLLNAPQADCLRFTPALNVSKANIDEMLLRLARAFSRV

SEQ ID NO: 13996 - protein, 592 aa, Pseudomonas fluorescens
MADYKAPLRDMRFVLNEVFEVAKLWAELPALAETVDAETVEAILEEAGKVTSKSIAPLSRAADEEGCHWADGAVTTPAGFPQAYQTYAEGGWVGVGGDPAYGGMGMPKAVSAQVEEMVNSASLSFGLYPMLTAGACLSINAHASEELKAAYLPNMYAGVWAGSMCLTEPHAGTDLGIIRTKAEPQADGSYKVSGTKIFITGGEHDLTENIIHLVLAKLPDAPAGPKGISLFLVPKFMVNADGSLGARNPANCGSIEHKMGIQASATCVMNFDEAVGYLVGEPNKGLAAMFTMMNYERLGVGIQGLATGERSYQNAIEYARDRLQSRSPTGAQNKDKVADPIIVHPDVRRMLLTMKASNEGGRAFSTYVAMQLDTAKFSEDAATRKRAEDLVALLTPVAKAFLTDLGLETTVHGQQIFGGHGYIREWGQEQLVRDVRITQIYEGTNGIQALDLVGRKIVGSGGAFYKLFADEIRHFTATASADLGEFTKPLNDAVDTLDELTSWLLDRAKTNPNEIGAASVEYLQVFGYTAYAYMWALMAKASLGKEAQDDFYASKLGTARFYFARLLPRIHSLSASVKAGSESLFLLDAAQF

SEQ ID NO: 13997 - protein, 387 aa, Pseudomonas fluorescens
MSFDLAARLAARRADNLYRQRPLLESPQGPQVVVDGQPLLAFCNNDYLGLANHPQVIEAWRAGASKWGVGGGASHLVIGHSGPHHELEEALADLTGRPRALLFTTGYMANLGAVTALVGQGDTVLEDRLNHASLLDAGLLSGARFNRYLHNDADSLAKRLEKATGNTLVVTDGVFSMDGDLADLPALARETKAKGAWLMVDDAHGFGPLGANGGGIVEHFGLSQEDVPVLVGTLGKAFGTAGAFVAGSEELIESLIQFARPYIYTTSQPPALACATLKSLELLRSEHWRREHLQTLIRQFRHGAEQIGLELMDSFTPIQPILIGDAGRAVRLSQMLRERGLMVTAIRPPTVPAGSARLRVTLTAAHSEAQVQLLLEGLADCFAQLKS

SEQ ID NO: 13998 - protein, 628 aa, Pseudomonas fluorescens
MPTTFHEIPRKRPTTPLLDRANTPDGLRRLGEAELETLADELRLELLYTVGQTGGHFGAGLGVIELTIALHYVFDTPDDRLVWDVGHQAYPHKILTGRRERMETLRQKDGIAAFPRRSESEYDTFGVGHSSTSISAALGMAIAARLQNSDRKAIAVIGDGALTAGMAFEALNHAPEVDANMLVILNDNDMSISRNVGGLSNYLAKILSSRTYASMREGSKKVLSRLPGAWEIARRTEEYAKGMLVPGTLFEELGWNYIGPIDGHDLPTLIATLRNMRDLKGPQFLHIVTKKGKGFAPAEVDPIGYHAITKLEPLDAPAAAPKKAGGPKYSGVFGEWLCDMAAADPRLVGITPAMKEGSDLVAFSERFPLRYFDVAIAEQHAVTLAAGMACEGAKPVVAIYSTFLQRGYDQLVHDVAVQNLDVLFAIDRAGLVGEDGPTHAGSFDLSFLRCIPGMVIMTPSDENELRKMLTTGHLYNGPAAVRYPRGTGPNATIEKDLEPIEIGKGVVRRQGSKVALLVFGVQMAEALKVAETLDATVVDMRFVKPMDEALVREIANSHDLLVTIEENAIMGGAGGAVSEFLARENILKSVLHLGLPDVYVEHAKPAQMLAECGLDEVGIEAAVRERLE

SEQ ID NO: 13999 - protein, 295 aa, Pseudomonas fluorescens
MIAAYSATSQARVNAALETLFNAPLPELARLYEAMRYSVMNGGKRVRPLLAYAACEALGGKAEQANGAACAVELIHAYSLVHDDLPAMDDDDLRRGQPTTHKKFDEACAILAGDGLQSLAFSALLDPRLSDLSADIRLQQVTALAHAAGPAGMVGGQAIDLGSVGLKLDQKALEQMHRHKTGALIEVSVKLGALASGCAEKDELKSLQTYAQAIGLAFQVQDDILDVESDTETLGKRQGADIARDKPTYPALLGLDAAKAYALELRDQALHALRPFDAAAEPLRDLARYIVDRRN

SEQ ID NO: 14000 - protein, 506 aa, Pseudomonas fluorescens
MRYAHPGTEGAKVSFKSKYGNYIGGEFVAPVKGQYFTNTSPVNGQPIAEFPRSTAEDIEKALDAAHAAADAWGSTSAQARSLILLKIADRIEQNLETLAIIETWDNGKAIRETLNADIPLAADHFRYFAGCLRAQEGSAAEIDGNTVAYHIHEPLGVVGQIIPWNFPILMAAWKLAPALAAGNCVVLKPAEQTPLGISVLLELIGDLLPPGVLNVVQGFGKEAGEALATSKRIAKIAFTGSTPVGSHIMKCAAENIIPSTVELGGKSPNIFFEDIMQAEPSFIEKAAEGLVLAFFNQGEVCTCPSRALVQESIYPQFMEAVMKKVSQIKRGDPLDTDTMVGAQASEQQFDKILSYLEIAKGEGAELLTGGKVEKLEGSLATGYYIQPTLLKGTNKMRVFQEEIFGPVVSITTFKDEAEALAIANDTEFGLGAGLWTRDINRAYRMGRAIKAGRVWTNCYHLYPAHAAFGGYKKSGVGRETHKMMLDHYQQTKNLLVSYDINPLGFF

SEQ ID NO: 14001 - protein, 418 aa, Pseudomonas fluorescens
MTESVLDYMTRLGRAAREASRVIGRASTAQKNRALLAAANALDAARAELAAANEQDLATGRANGLEPALLERLELTPARIDGMIVGLRQVAALPDPVGAIRDMSFRPSGIQVGKMRVPLGVIGIIYESRPNVTIDAASLCLKSGNATILRGGSEAIHSNRAIAACIQRGLAAAELPAAVVQVVETTDRAAVGALITMPEYVDVIVPRGGRGLIERISRDARVPVIKHLDGICHVYVSEHADLPKAQRIAFNAKTYRYGICGAMETLLVDQRVAKDFLPSMAKQFREKGVELRGCERTRAIIEAVAATEEDWSTEYLAPILSIRVVDGLDQAIEHINHFGSHHTDSIVSENLADTRQFVAQVDSASVMINTPTCFADGFEYGLGAEIGISTDKLHARGPVGLEGLTCEKYIVVGDGQLR

SEQ ID NO: 14002 - protein, 427 aa, Pseudomonas fluorescens
MSRSETLFANAQKHIPGGVNSPVRAFKSVGGTPLFFKHAEGAYVTDEDDKRYVDYVGSWGPMILGHSHPDVLDAVRNQLQHGLSYGAPTAMETEMADLVCSLVPSLEMVRMVSSGTEATMSAIRLARGFTGRDSIIKFEGCYHGHSDSLLVKAGSGALTQGVPSSAGVPAAFAKHTLTLPFNDIDAVEKMLAEVGQDVACIIVEPVAGNMNCVPPAPGFLEGLRSLCDKHGVVLIFDEVMTGFRVALGGAQAYYGVTPDLTTFGKIIGGGMPVGCFGGKRLIMERIAPLGPVYQAGTLSGNPLAMAAGLTTLRLISRPGFHAELTDYTTRLLDGLQQRADAAGIPFVTTQAGGMFGLYFSGADDIVTFEDVMASDAALFGRFFHLMLEGGVYLAPSAFEAGFTSIAHGEAELKLTLDAAERAFAKLK

SEQ ID NO: 14003 - protein, 778 aa, Pseudomonas fluorescens
YLLMLLFCLPLLASAVEFDEFTQSLPLGRSLQVFEDPSGQASIADVRAQAAAGNFKPHDKATLNAGYSRSAFWLKIDLHYRPTNPSAQRSWLLELAYPPLDHLDLYLPDAAGDYRLVRQTGDALPFASREIRQNNYLFDLAFKPDQQRTVYLRLSSEGSIQAPMTLWSSTAYLEDQPVRLYVLGVIYGVLLGMLVYNLFIYLSVRDTSYLYYIFYIASFGLYQLSVNGAAVEYFWPDNPWWANAATPFFIGCAGLFGSQFARSFLQTRNHSRWLDRLLIALIAFGAMVIGLSLMTSYGLALRLATTLALTFTVVIFAAGILAWWRGLRVARYFIIAWSAFLIGGIVNTMMVLGLLPNVFLTMYASQIGSAIEVALLSLALADRINAMREQQAQTLFDAGQKLEVLNQQLAHSNKLKDEFLATLTHELRTPMNGVIGSLELMQTVELDPELEQYQQTAAGSARDMMRMVNGILTLTELQAGKLKATPGSFSLRGVVEALRMQFDGNASSKSLDFKVDVLPTLPDRLHGDSAKLAQCLECLLDNAIKFTRVGGLALRVTGKPSTDNRLALSFAVIDTGIGFTDLGEATLYQRFFQLDGSMTREYGGLGVGLAICRQLVELLGGKLTHRSEPGSGSRFQLDVEFELPEVEAVPAFSRDTVRAPQDCTVLLVDDNSVNQLVMRGMLLKLGFRVRTADHGAAALDCLQRERFDAVLIDCQLPPLDGASLCCQIRDLPGCAHLPVFMIALGADREHCASGGSIDYLSKPVKFEDLQVAMQRRVL

SEQ ID NO: 14004 - protein, 833 aa, Pseudomonas fluorescens
SLPIDEVLPALREALATRHEAVLEAPPGAGKTTRVPLALLNEAWLNGQTILMLEPRRLAARAAAERLASELGEKVGETVGYRIRLDSKVGPNTRIEVVTEGILTRRLQDDPALEGVGLLIFDEFHERSLDADLALALSLNGRELFRAEQPLKILLMSATLEGERLAGLLDNAPILRSEGRMFPVTMRWGRPFQPGEYIDQRVTQTVLEALHDETGSLLVFLPGQAEIRRVHQQLADAIGERSDVMLCPLHGELDLNAQRAAIDPAPAGQRKVVLATNIAETSLTINGVRVVIDAGLARVPRFDPGSGMTRLDTQRISKASATQRAGRAGRLEPGVCYRLWSQDQHEQLAAYGSAEILSADLAGLALQLGRWGVAPSDLIWLDVPPAAAYAQAQDLLQRLGALDGESLNRHGQAMAELPAHPRIAHLLLRGQALGLSNMACDVAALLGERDILRGAGADLHSRLVLLSGEERAARGAQGGVQRARQLARQYHGYLRGKASEPVADPDHPRWLGALLALAYPDRVAQQRRAGGAEYRLANGRAALFAEPDSLMKEPWIVIADLGSRQGQREERIYLAADFDPALFDSVLAEQVHNVDQLDWDEREGVLRAERQRKVGELILSREPLTGLDENARSQALVNLVRRKGLELLPWTPELRQWQARVACCVSSTWTPRGDSQWPDVSDATLLKTLEDWLMPYLGKVSRLSHFANLDLSSIVRNLLPWPLPQQLDEQAPHHLSVPSGSSIRLDYSEQPPILAVRLQELFGLADTPRIAGGRQVVKLHLLSPARRPVQVTQDLANFWRSTYAEVKKDLKGRYPKHYWPDDPLVAEATARAK

SEQ ID NO: 14005 - protein, 496 aa, Pseudomonas fluorescens
VFELADWQRKAAELSYPYQAVIDGKLRAAQSGQTFAAINPATGQLLANVAACGEEDVDAAVQNARQVFEAGTWAGRSPTERKQVLLRLADLILAHREELALLDSLNMGKPVMDAYNIDVPGAAGVFRWYAESLDKLYDQVAPSASNVLATITREALGVVAAVVPWNFPLDMAAWKLAPALAAGNSVILKPAEQSPFSALRLAELALEAGLPAGVLNVLPGLGEQTGKALGLHPDVDCLVFTGSTQVGKYFMQYSAQSNLKQVWLECGGKSANLVFADCQDLDLAAQKAAFGIFFNQGEVCSANSRLLVERSIHDEFVERLKAQAERWQPGDPLDPASAAGAIVDTRQTESILRFIHQAEREGATRVCGGRQLSFNGSDNFVQPTIFTDVQPHMTLFREEVFGPVLAVIPFDDEAHALHLANDSVYGLAASLWTDDLHRAHRVARQLRAGTVSVNSVDALDVTVPFGGGKQSGFGRDLSLHSFDKYTQLKTTWFQLR

SEQ ID NO: 14006 - protein, 456 aa, Pseudomonas fluorescens
MTTSRETRDYQAADAAHHIHAFVDQKALNDEGPRVMVRGDRLHLWDNDGRRYLDGMSGLWCTNLGYGRKDLNAAASRQLEQLPYYNMFFHTTHPQVIELSELLFSLLPGHYSHAIYTNSGSEANEVLIRTVRRYWQVLGKPEKKIMIGRWNGYHGSTLAATALGGMKFMHEMGGMIPDIAHIDEPYFFAHEGNLTPAEFGLRAAQQLEAKILELGADKVAGFIAEPFQGAGGMIFPPESYWPEIQRICRQYDVLLCADEVIGGFGRTGEWFAHEYFGFEPDTLSIAKGLTSGYIPMGGLILSKKMADVLVEQGGVFAHGLTYSGHPVAAAVAIANLKALRDEGVVTRVKDDIGPYLQQCLREVFGNHPLVGDIQGTGMVAALQLAEDKATRKRFANENDIAWRCRTIGFEEGVIIRSTLGRMIMAPALIASREEIDELVGKTLKALDRTAQEYGRL

SEQ ID NO: 14007 - protein, 209 aa, Pseudomonas fluorescens
VAAPAHAAPRLQVDKVSLRYSKPGGGTFTALEEVSFEVPDQQFAVLVGPSGCGKSSLLYLTAGLAEPTSGEIYVGGQQVQGPGADRGMVFQSYTLFPWLTVRQNVEFGLKRRGMPAAKRKEIVDHYVHEVGLSGFADNYAKQLSGGMMQRVAIARALANDPQILLMDEPFGALDSQTRLQMQQLLLRVWGNSKKTVLFVTHDIDEAILL

SEQ ID NO: 14008 - protein, 251 aa, Pseudomonas fluorescens
LITGASTGIGAVYAERFAKRGHDLVLVARDQARLDTLAARLRSEHDVAVDVIPADLTQLADLTTVESRLRDDARIGILVNNAGAALSGHFVDQSTDSVAQLVALNTTALVRLASAIAPRLAKAGDGAIINIGSVVGLAPEFGMSVYGATKAFVLFLSQGLSLELSPQGVYVQAVLPAATRTEIWDRSGVDINTLSEIMEVGDLVDAALVGFDRREPVTIPPLHEAERWDDLQGARQGLLGQIRQSAVAQRY

SEQ ID NO: 14009 - protein, 318 aa, Pseudomonas fluorescens
RIGEAPAPAVGAHDVLIEVHASSVNVLDSKISKGEFKLILPYAFPLILGNDLAGVVVEVGPQVTRFKPGDEVYARPPEARIGTFAQLIAVNENAVALKPANTDMAQAASLPLVALTAWQVLVETARLQKGQKVLIHAGSGGVGTVAIQLAKHLGAFVATTTSTANVEWVKALGADLVIDYTQQDFASVLHDYDVVLNSLGADVLEKSLKVLKPGGQLISISGPPTVQFAREHGLSWPLQQVMRLLSLGIRRKARKQDVSYAFVFMRANGAQLQHITALVEDGIIKPVVDRSFLFESTAEALKYVERGRAKGKVVVALK

SEQ ID NO: 14010 - protein, 237 aa, Pseudomonas fluorescens
GKVALVTGAASGIGKAIALLLHARGAQVIAEDINPEVEALARPGLVPLVADITQDGAAERAVALAVEQFGRLDILVNNAGIIINKLVIDMTREDWERIQAVNATAAFLHSREAVKAMMPNKSGSIVNIASYASYFAFPTIAAYTASKGALAQLTRTLALEVIGHGIRVNAVGVGDVVTNILNNVVDDGPAFLAQHGEAAPIGRAAQPEEIAEVVAFIASDRASFMVGSVVMADGGMT

SEQ ID NO: 14011 - protein, 246 aa, Pseudomonas fluorescens
RLEGKIALITGGTTGIGLASAQEFVAQGATVFITGRRQAELDKAVAAIGPRAIGIQGDVAKLEDLDRIYSEISAKAGHLDILFANAGGGDMLPLGSITEEHFDRIFDANVKGTLFTVQKALPLLRDGASILLTSSTTSVQGTENFSVYSASKAAVRNFARSWLLDLKPRRIRVNAISPGPVRTPGLAGLVPAEHTQGLFDQLASIVPIGRLGEPSEIAKAALFLASDDSSFVNGIELFVDRGTAQI

SEQ ID NO: 14012 - protein, 424 aa, Pseudomonas fluorescens
RPSACPGLLRIVQALDGGICRIKLDGGSITADQADAVANAAERFAGGAIEATNRGNLQIRGIGDQSAALIDSLLAAGLGPRTAAGDDVRNLMLSPAAGIDRQMRFDTRPLAGQILETLQSHPRFHELSAKFAVQLDGGEALAMLKHPHDLWLSAFESGENTLLAFGLAGCPTERPLAAVALVDGHALVVAVLELFLDLARPEQTRMRHLLDECPAPLFLEKLGQRISLKAAGDWQRAAGPEGLHLGIHPQPSAGQVYVGAAPPLGRLGPDMLRGAAQLAITFGDGSLRFTPWQSLLLPNVRETDAVQVLDELGKLNLLTHVEEPLTHLIACTGANGCGKGLADTKHDARLLATLLPHAVDVHLSGCPRSCAAAHRAAVTLLAVGPGHYDLYFRDAALPGFGALHAHNLTIEAAATLLAARSRSP

SEQ ID NO: 14013 - protein, 922 aa, Pseudomonas fluorescens
LRIAIGFTVTLLTLLCMLPAQAAQGSGWSVLLDDQGNLQLSDIRSARYTNQFSPIELDRLTAAEPDGALWLRFRLAPGKHEQVLRIFAPDLSHLNLYVLDGDRLIEQRDTGTAQPQAERPLPSSDFMLPLPQSDKPLDVYLRLVSDHQLRPYITLQAAVMAAANHNQTLIYGLLFGCLAMLILHNLIRYAYTRSRSSLWLAVCEGLLSLSLLLLLNLAGPWLPNWHAIQTPGAYLALLLTAPAGLMFAYRFFAPLGPHPLNKLLIGDILFIVICSLLLLFVNTLPLNIITYALVALAGLSMLLVGFYHWQKGYRPARLFVAAMVVFNIGTLIILPALLGLTLVAPQGLIMTLMGFICISGLLMSIALGERQRSITESRFSISRDLAASNAEINAKAEFLAKISHEIRTPMNGVLGMTELLLGTPLSVKQRDYVQTIHSAGNELLTLINEILDISRLESGQIELDDVQFDLNALIDDCLSIYRAKAEQQNVELISFIQPQVPRVISGDPTRLRQTLLSLLENALKKTEEGEVLVVVALDERSAGPRLRIAVQDSGQPMDQEERDALMHAELHSKHFLSANRLGGNLGLVIARQLIRLMQGEFGIKSGASQGSTLWLTLPLDPDRLEHPTSDLDSPLQGARVLVVDDNDTCRKVLVQQCSAWGLNVSAVPSGKEALALLRTKAHLRDYFDVVLLDQNMPGMTGMQLAAKIKEDPSLNHDILLIMLTGISNAPSKIIARNSGIKRILAKPVAGYTLKTTLADELNQRNRGQVVFQPQVASPAAPVKVPSDFRILVAEDNTISTKVIRGMLGKLNLQPDTASNGEEALQAMKAQRYDLVLMDCEMPILDGFSATQQLRAWEVGNQRIRTPIVALTAHILAEHKERARQAGMDGHMAKPVELSQLRELIEHWVAQRDQQNRATTQPS

SEQ ID NO: 14014 - protein, 448 aa, Pseudomonas fluorescens
LEKVLIANRGEIALRILRACKEMGIKTVAVYSKADKELMHLGLADESVCIGPASAAHSYLHIPAIIAAAEVTGATAIHPGYGFLAENADFAEQVENSGFAFIGPKAETIRLMGDKVSAKHAMIEAGVPTVPGSDGPLPEDEETALRIGREVGYPVIIKAAGGGGGRGMRVVHKEEDLIASAKLTRSEAGAAFGNPMVYLEKFLTNPRHVEVQVLSDGQGNAIHLGDRDCSLQRRHQKVLEEAPAPGIDENARKEVLARCVKACIDIGYRGAGTFEFLYENGRFYFIEMNTRVQVEHPVSEMVTGIDIVKEMLSIAAGNKLSYTQDDVVIRGHSLECRINAEDPKTFMPSPGTVKHFHAPGGNGVRVDSHLYSGYAVPPNYDSLIGKLITYGATRDEAMARMRNALDEIVVDGIKTNIPLHRDLTRDEGFCKGGVNIHYLEHKLAGEKH

SEQ ID NO: 14015 - protein, 145 aa, Pseudomonas fluorescens
MATLLVLHGPNLNLLGTREPGTYGSTTLAQINQDLERRAREAGHHLLYLQSNAEYELIDRIHAARGEGVDFILINPAAFTHTSVALRDALLGVSIPFIEVHLSNVHKREPFRHHSYFSDVAVGVICGLGASGYRLALEAALEQLE

SEQ ID NO: 14016 - protein, 630 aa, Pseudomonas fluorescens
  unsure (1)..(630): unsure at all Xaa locations
WTVADSRSVYGIRHWGAGYFAINDAGRVEVRPNGPSSSPIDLFEQVDQLRKSGLSLPLLVRFPDILQDRVRQLTGAFDANIERLEYQSKYTALYPIKVNQQEAVIENIIATQNVSIGLEAGSKPELLAVLALAPKGGTIVCNGYKDREFIRLALMGQKLGHNVFIVIEKESEVGLVIEEAASLKVKPQVGLRVRLSSLASSKWADTGGEKSKFGLSAAQLLSVVERFRAAGLDQGIRLLHFHMGSQIANLADYQHGFKEAIRYYGELRNLGLPVDHIDVGGGLGVDYDGTHSRNASSINYDMDDYAGVVVGMLKEFCDAQALPHPHIFSESGRSLTAHHAMLVVQVTDVEKHNDDVPQIENKEALPETVQWLVDLLGPTDIEMVTETYWRATHYMSDVAAQYADGKLTLAEKALAEQCYFAVCRRLHNSLKARQRSHRQVLDELNDKLADKYICNFSVFQSLPDTWAIDQVLPIIPLHRLDEEPLRRAVLQDLTCDSDGKINQYVDEQSIETSLPVHALNEGEDYLLGVFLVGAYQEILGDMHNLFGDTDSVNIYQNADGSVYHAGIETHDTIEDMLRYVHLSPEELMTHYRDKCASARISASERTQFLDALRLGLTRSSYLSSXGQVPL

SEQ ID NO: 14017 - protein, 421 aa, Pseudomonas fluorescens
RRVAIIGGNRIPFARSNGPYATASNQVMLTAALEGLIERYNLHGQRIGEVVAGAVLKLSRDMNLTRECVLGSRLSPATPAYDIQQACGTGLEAALLVANKIALGQIDCGIAGGVDTTSDAPISVSEGLRKILLQANRAKTTGDKLKTFLQLRPKHLIPEFPRNGEPRTGLSMGEHCESMAQTWNIPREEQDQLAFESHHKLAASYSEGWHNDLMTPFLGLTRDNNLRPDLTLEKLATLKPAFEKSAKGTLTAGNSTPLTDGASVVLLGSEEWAKERGLPILAYLRDGEAAAVDFVNGAEGLLMAPVYAVPRLLARNGMTLQDFDYYEIHEAFAAQVLCTLKAWEDPEYCKTRLGLDAPLGGIDRSRLNVKGSSLAAGHPFAATGGRIVANLAKLLDAAGQGRGLISICAAGGQGVTAIIER

SEQ ID NO: 14018 - protein, 789 aa, Pseudomonas fluorescens
MSDSITFDLPISGMTCASCAGRVERALSKVSGASAVSVNLATEQARVQAPGDSLPALMEAVERAGYSVPQQTVELNIDGMTCASCVGRVERALNKVAGVKSVSVNLANERAHLELLGAVDPQTLIAAVSKAGYSASLFELEHPQTDNRQQRLNHERWALICAIALALPLVLPMLLQPFGIHWMLPAWAQFALATPVQFIFGARFYVAAWKAVRAGAGNMDLLVALGTSAGYGLSLYEWATAAGRMPHLYFEASAVVIALVLLGKYLESRAKRQTASAIRALEALRPERAIQVIDGREQDVAISALRLGDLVLVKPGERFPVDGEVLEGQSHADEALISGESLPVPKQPGDKVTGGAINGEGRLLVSTTALGAESVLARIIRLVEDAQAAKAPIQKLVDKVSQVFVPTVLLLALATLIGWWLYGAPLETALINAVAVLVIACPCALGLATPTAIMAGTGVAARHGILIKDAEALERAHEVSAVVFDKTGTLTSGTPRIAHFSAVDGDENALLTAAGALQRGSEHPLAKAVLDACSERNLTVPDVSDSQSLPGRGIAGSLDGRRRALGNRRLLEESGLNAGDLSESAKAWETEGRTLSWLIEQSPAPRVLGLFAFGDTLKPGALHAVQQLAAQHIHSHLLTGDNRGSARVVAEALGIENVHAEVLPAEKAATVAELKKTGVVAMVGDGINDAPALAAADIGIAMGGGTDVAMHAAGITLMRGDPRLVPAALEISRKTYAKIRQNLFWAFVYNLIGIPLAAFGFLNPVLAGAAMALSSVSVVSNALLLKTWK

SEQ ID NO: 14019 - protein, 436 aa, Pseudomonas fluorescens
PVSGYHRIIFIIIALAFFFDSMDLAMMTFLLGSIKAEFGLSSAQAGLLASSSFFGMVLGASLSGLLADRFGRKPVFQWSIVLWGLASYLCSTAQTVESLTLFRILLGIGMGMEFPIAQSMLSELIPAQRRGRYIALMDGFWPLGFVAAGVLSYFLLPLIGWRDIFLVLAVPAVFVLAIRFFIPESPRWLEQAGKHDEADKVLRGIEARVQASLGGAALPEPVRLPRSVTPPGHFLSALKQIWSPLYRQRTTMIWSLWFFALLGFYGLTSWLSALLQQSGFAVTQSVYYTVLISLGGIPGFLMAAWLVERWGRKPVCIVTLLGGGVMAFLYGQSAVFGGNVALLIGTGLLMQFFLFGMWAVLYTYTPELYPTSARATGSGFASAIGRVGSLLGPLVTGLVFPITGQGGVFALGALCFTIAAGVVWLFGMETRGKTLE

SEQ ID NO: 14020 - protein, 320 aa, Pseudomonas fluorescens
MNQLPIIDISPLYSDDQNAWPAVAEQIDHACREWGFFYIKGHPISAQRIASLLDHAQRFFALPEAEKLRIDITQTRHHRGYGAIATEQLDPDKPSDLKETFDMGLHLPADHPEVLAVKPLRGPNRHPAIPGWETLMEQHYLDMQALAQTLLRAMTLALGIERDFFDTRFNEPVSVLRMIHYPPRHTASSAEQQGAGAHTDYGCITLLYQDAAGGLQVKNVKGQWIDAPPIDGTFVVNLGDMMARWSNDRYRSTPHRVISPLGVDRYSMPFFAEPHPDTRIECLPGCQDAQHPAKYPTTTCAEFLLSRFADTYAYRREQEA

SEQ ID NO: 14021 - protein, 838 aa, Pseudomonas fluorescens
LSNLGTHTDGLTDFEVDVLRAQHGLNEVEHEQPLPWWTHLWHCYKNPFNLLLTLLAVISWLTEDLKAAIVIFSMVVLSTLLRFWQESKSNQAADALKAMVSNTATVLRRDAPRAELPIKQLVPGDLIVLSAGDMIPADCRVLSAKDLFVSQAAMTGESMPVEKFPRQADRDTRNPLELDNILFMGTNVVSGTAVAVILTTGNSTYFGALAQRVGATDRAVTSFQQGVNKVSWLLIRFMFVMAPLVLFINGFTKGDWTEALLFALSIAVGLTPEMLPMIVTSTLAKGAVFLSRKKVIVKRLDAIQNFGAMDVLCTDKTGTLTQDRIFLARNVDVWGEDSDDVLEMAYLNSYYQTGLKNLLDVAVLEHVEIHRELKVGTAFRKVDEIPFDFNRRRMSVVVEGRGQPHQLICKGAVEEVLSVCSRVRHGEVDEALSDELLAKIRQVTAAFNAEGLRVVAVAARSMPEGRDTYSLGDEQELTLIGYVAFLDPPKESTAPALKALAEHGVAVKVLTGDNELVTAKICREVGLAQQGLLMGNDIERMSDAELAVAVETTNVFAKLTPSHKERIVRILKGNGHVVGFMGDGINDAPALRTADIGISVDSAVDIAKEAADIILLEKSLMVLEEGVLEGRRTFANMLKYIKMTASSNFGNVFSVLVASAFIPFLPMLPMHLLVQNLLYDISQIAIPFDNVDDEMLKQPQRWQPGDVGRFMLFFGPISSIFDITTFALMWYVFDANTPDHQTLFQSGWFVVGLLTQTLIVHMIRTPKIPFLQSRAAMPLLVMTGIIMAVGIFLPMGPLAHYFKLQALPSMYFVFLPVILLAYMALTQAVKGFYIRRFG

SEQ ID NO: 14022 - protein, 267 aa, Pseudomonas fluorescens
MSVPAFGLGTFRLQGQVVIDSVSTALELGYRVIDTAQIYENEADVGEAIAASGIARDKLFITSKIWIANFAKDRLIESLKASLQKLQTDYLDLTLIHWPSPEDQVPVEEFMGALLEAKRLGLTRQIGVSNFTIDLMKQAIAAVGAENIATNQIELHPYLQNRKVVEFAQSQGIQITSYMTLAYGEVLKDPLIVQIAERLQATPAQVTLAWAMQSGYAVIPSSTKRANLQGNLGAMALTLSDADMALIATLDRGHRLTSPKGIAPQWD

SEQ ID NO: 14023 - protein, 264 aa, Pseudomonas fluorescens
MKKMRIATFNVNGLRARLPNLLEWLRREQPDIVCLQELKMLDSAFPAADLEAAGYGAIWHGQASWNGVAILARDAQPLESRRGLPGDPDDKHSRYLEAAVHGVLVGCLYLPNGNPQPGPKFDYKLAWFERLIKYARDLQSSDHPVVLAGDYNVVPTDLDIYNTRSWLKDALLQPESRECYQRLLDQGWTDSLRHLYPEDRLYTFWDYFRQHWQKNSGLRIDHLLLNPTLSPYLHEAGVDAWVRNEPHASDHAPTWIRIGSRKRR

SEQ ID NO: 14024 - protein, 270 aa, Pseudomonas fluorescens
  unsure (1)..(270): unsure at all Xaa locations
NLKQYLQRLGFDAPPAPTLETLRLLQLRHTGAFPFENLSTLSGEPVLIDLPSIERKVLNNARGGYCYELNNLFLALLLELGFDARGISGRVVMNQPEGSWTARTHRLSLVTIDDVRYITDVGFGGMVPTAPLVLDTDAEQYTPHEPYRIEVQADGYMLRARVAGEWRPMYLFDLQRQEDIDYTLGNWYVSTHPDSPFAQRLMVARTGDGWRRTLNNGSFAIHRIGAESERREVTDVDELIELLEREFGLRLPHQLGAREALARLIQPVXT

SEQ ID NO: 14025 - protein, 398 aa, Pseudomonas fluorescens
MSLFSAVEMAPRDPILGLNEAFNADTRTNKVNLGVGVYCNEEGRIPLLRAVIEAETIRAAQHASRGYLPIDGIAAYDQAVQKLLFGNDSPLLAAGRVITTQAVGGTGALKIGADFLKQLLPNAVVAISDPSWENHRALFETAGFPVQNYRYYDAATHDVNRAGLLEDLNALPNGSIVVLHACCHNPTGVDLSPADWNNVLEAVKAKGHVPFLDMAYQGFGDGIAEDAAAVRLFAESGLTFFVSSSFSKSFSLYGERVGALSIISESKEESARVLSQVKRVIRTNYSNPPTHGASIVAAVLNSPELRAQWEAELAEMRLRIRGMREQMVALLAKKAPQRDFSFVGRQRGMFSYSGLTTEQVHRLRNEFGIYALDTGRICVAALNQSNIEAVTDAIVQVI

SEQ ID NO: 14026 - protein, 492 aa, Pseudomonas fluorescens
MTTVRTRIAPSPTGDPHVGTAYIALFNYCFAKQHGGEFILRIEDTDQLRSTRESEQQIFDALRWLGIDWSEGPDVGGPHGPYRQSERGDIYQKYCQQLVDMGHAFPCFCTAEELDQMRAEQMARGETPRYDGRALLLSKEEVARRLAAGEPHVIRMKVPSEGVCVVPDMLRGDVEIPWDRMDMQVLMKTDGLPTYFLANVVDDHLMGITHVLRGEEWLPSAPKLILLYEYFGWEQPELCYMPLLRNPDKSKLSKRKNPTSVTFYERMGFMPEAMLNYLGRMGWSMPDEREKFSLQEMVDNFDLKRVSLGGPIFDIEKLSWLNGQWLRDLPVEEFAARVQKWAFNSEYMMKIAPHVQGRVETFSQVAPLAGFFFAGGVNPDAKLFESKKLSGDQVRQLMQLILWKLESLRQWEKDSITATIQAVVESLELKLRDAMPLMFAAITGQASSVSVLDAMEILGPDLTRFRLRQAIDLLGGVSKKENKEWEKLLGAI

SEQ ID NO: 14027 - protein, 478 aa, Pseudomonas fluorescens
LLGIDLGTTNSLIAVWQDGQARLIPNALGEVLTPSVVSLDEDETILVGKAARARLTTHPERTAAAFKRFMGSDRQIELGTKTFSPEELSALVLGSLKQDAEAFLGHPVAEAVISVPAYFSDEQRKRTLFAAELAGLKVSRLINEPTAAAMAYGLHEQKFERTLIFDLGGGTFDVTVLEYALPLIEVHASTGDNFLGGEDFTAALLNACLKNWRLTPSMIDPQGMASLGDALEQLKCELGEGPQSLSWHHADKLYEWSLDEAAAVKIWEPLLVRLRAPIEQALRDARLKPRDLDSLVLVGGATRMPAVQQLVATLFGRLPYRHLDPDTLVALGAATQAACKARDGAIEELILTDVCPYTLGIATMRGKGIDGAFSPIIERNTIIPTSRVERYHTTHPRQELLRIAVYQGERPWVRDNILIDAFDVTLTPTDNIQELDVRFSYDINGLLEVDVTLLQTGERHSHSIDRSPTGLNEQARRD

SEQ ID NO: 14028 - protein, 370 aa, Pseudomonas fluorescens
MKRVGLIGWRGMVGSVLMQRMLEEQDFDLIEPVFFTTSNVGGQGPSVGKDIAPLKDAYSIEELKTLDVILTCQGGDYTSEVFPKLREAGWQGYWIDAASSLRMNDDAVIILDPVNRKVIDQQLDAGTKNYIGGNCTVSLMLMGLGGLFEAGLVEWMSAMTYQAASGAGAQNMRELIKQMGATHAAVADQLADPASAILDIDRRVAEAMRSDAYPTENFGVPLAGSLIPWIDKELPNGQSREEWKAQAETNKILGRFKSPIPVDGICVRIGAMRCHSQALTIKLNKDVPIADIEGLISQHNPWVKLVPNNREISMQELSPTKVTGTLNVPVGRLRKLNMGSQFVGAFTVGDQLLWGAAEPLRRMLRILLER

SEQ ID NO: 14029 - protein, 333 aa, Pseudomonas fluorescens
MTQTLDIAVIGATGTVGETLVQILEERDFPVGTLHLLASSESAGSSVLFRNKNVRVREVDEFDFSKVKLAFFAAGPAITLSYAARAHAAGCSLVDLSGALPADQAPQVVPEANADVLAGLKAPFQVCSPSPSATTLAVVLAPLLDLIELHYVHVTANLAVSAQGREAVTELARQTAELLNMRPLEPTFFDRQMAFNLLAQVGTPDAQGHTLLEKRLVRELRQVLAKPLLKISATCVQAPVFFGDSFSVTLQSASAVDLEKVNAALEEAEGIELVEAGDYPTAVGDAVGQDVVYVGRVRAGVDEPSELNLWLTSDNVRKGAALNAVQVAELLIK

SEQ ID NO: 14030 - protein, 204 aa, Pseudomonas fluorescens
MSAVRSKICGITRIEDALAAVEAGADAIGFVFYAKSPRAVTVQQARSIIAALPPFVTTVGLFVNASRCELGEILDAVPLDLLQFHGDETAAECEGWHRPYIKALRVKAGDNIAAACDAYPSASGVLLDTYVEGVPGGTGEAFDWSLIPQGLSKPLILAGGLTPENVADAIARVRPYAVDVSGGVEASKGIKDHAKIRAFINAVR

SEQ ID NO: 14031 - protein, 391 aa, Pseudomonas fluorescens
DLEGVAFDTLAVRAGQHRTPEGEHGDPMFFTSSYVFRTAADAAARFAGEVPGNVYSRYTNPTVRAFEERIAALESAEQAVATATGMAAIMAVVMSLCSAGDHVLVSRSVFGSTISLFEKYFKRFGVEVDYVPLADLSAWGAAIKSNTKLLFVESPSNPLAELVDITALSEIAHAKGAMLVVDNCFCTPALQQPLKLGADIVVHSATKFIDGQGRCMGGVVAGRSEQMKEVVGFLRTAGPTLSPFNAWIFLKGLETLNLRMKAHCANAQQLAEWLEQQDGIEKVHYAGLKSHPQHELAQRQQKGFGAVVSFEVKGGKEGAWRFIDATRLISITANLGDSKTTITHPSTTSHGRLAPQEREAAGIRDSLIRIAVGLEDVADLQADLSRGLAAL

SEQ ID NO: 14032 - protein, 252 aa, Pseudomonas fluorescens
PKIGTHGRVALVTGAARGIGLGIAAWLISEGWQVVLTDLDRVRGSKVAKVLGENAWFIAMDVADESQVALGVAEVLGQFGRLDALVCNAAVADPHNITLESLDLAYWNRVLAVNLGGPMLLAKHCAPYLRAHNGAIVNLASTRAAQSEPDTEAYAASKGGLLALTHALAISLGPEIRVNAVSPGWIDARDPSARRAEPLTDTDHAQHPAGRVGTVEDVAAMVAWLLSKNAGFVTGQEFVVDGGMTKKMIYTE

SEQ ID NO: 14033 - protein, 491 aa, Pseudomonas fluorescens
NDWEQRFQSLTLESRAFINGEYRPAISGETFECLSPVDGRFLASVASTDEADANLAVEAARQSFNAGVWANKAPAERKRILIRFADLILQHQEELALLETLDMGKPISDSMSIDIPATANAIRWSAEAIDKIYDEVAATPHDQLGLVTREPSGVVAAIVPWNFPLIMASWKFAPALAAGNSFILKPSEKSPLTAIRIAQLALDAGIPKGVFNVLPGFGHTVGKALALHMDVDVLAFTGSTAIAKQLMIYAGQSNMKRVWLEAGGKSPNVVFADAPDLRAAAQAAAGAIAFNQGEVCTAGSRLLVERSIREQFIPLLVERCQAWKPGHALDPATTVGAVVDQRQLDNVLRYISIGREQGAELIAGGRRTLEDTGGTYIEPTIFDGVTNAMTIAKEEIFGPVLSLITFDTVEEALHIANDSIFGLAAGVWTSNLSKAHTFARGLRAGSVWVNQYDGGDMTAPFGGFKQSGNGRDKSLHAFDKYTELKATWIKL

SEQ ID NO: 14034 - protein, 392 aa, Pseudomonas fluorescens
MQDVVIVAATRTAIGSFQGSLASVSAVDLGAAVIRQLLEQTGLDGAQVDEVIMGQVLTAGAGQNPARQSAIKAGLPHAVPAMTLNKVCGSGLKALHLGAQAIRCGDADVIIAGGQENMSLANYVMPGARTGLRMGHAQIVDTMISDGLWDAFNDYHMGITAENLVEKYEISREQQDAFAAASQQKAAAAIEAGRFVDEITPILIPQRKGDPVAFKVDEQPRGDTTADSLAKLRPAFKKDGSVTAGNASSLNDGAAAVILMSAEKAKALGLPVLAKIAAYANAGVDPAIMGIGPVSATRRCLDKAGWNIGQLDLIEANEAFAAQSLAVAKDLQWDLDKVNVNGGAIALGHPIGASGCRVLVTLLHEMIKRDAKKGLATLCIGGGQGVALALER

SEQ ID NO: 14035 - protein, 449 aa, Pseudomonas fluorescens
SINPANGEQIGHYAFESAEALDAALTRAAFGFNKWKRKPLQDRSRALTALAGALRDSSEAMATMITREMGKPIAQARGEIEKCAKLCEWYAEHGPAMLNAEATLVEGGKARIEYRPLGPILAVMPWNFPIWQVLRGAVPALIAGNTYVLKHAPNVMGSAYLLRDAFTRAGFADGVFEVINVTPEGVSSAIADPRIAAVTLTGSVRAGMAIGAQAGAALKKCVLELGGSDPFIVLNDADIDEAVQAAVIGRYQNSGQVCAAAKRLIIEEGVVEEFTRKFVDATRQLKMGDPLSADNYIGPMARFDLRDELDQQVRDTLEEGATLLLGGGKAEGPGNYYEPTVLADVTDRMTSFKQELFGPVASIITARDCAHAVALANDSEFGLTATIYTANVALAQQLTSELETGGVFINGYSASDPRVTFGGVKKSGFGRELSHFGVREFCNAQTVWL

SEQ ID NO: 14036 - protein, 520 aa, Pseudomonas fluorescens
TLTGHLLIGAADVPATEGTMKALNPATNQLLEPEFALGGASQIDQAATLADAAFDSYSHTSLAERAAFLESIADNLDAVREELAARAALETGLPQAQLEGEAAKAATQFRQFADVVRKGRFLQLAIDPAQPDRQPRPRMDHRLQKVAIGPVAIFGASNFPISYSVAGGDTASALAAGATVILKAHNAHPGASEIQARAIRKAVQMHGLHEGVFSMVRGGGNAIGEALVDHPLIKAVTFTGSEVGGMALYRRAQLRPDPIPVFTEMTSVNPTFILPAALSARGGEIGDGFVERMLVNVGQACLCPSILIAVEGEGLQALRSAMIKRVSAASARTMLTPGIHGSYVKGLVAMESVGANLVAVGAPADGQFEGRSALLEVDGQGLLSEPALAHEVFGPAALLVTVRDDEELLAVARSFKGQLSAAIHLEDRDLDLARRLLPILERRTGRIVVNAFAHPQEVTFATVHGGPFPATSDSRFTSVGMTSIERFLRPVAYQGFPDALLPEVLRDANPLDLPRSIDGQ

SEQ ID NO: 14037 - protein, 351 aa, Pseudomonas fluorescens
STYLQDSPGVHKGFDYGRSHNPTRFALERCVADLEGGTQAFAFASGLATISTVLELIDAGSHIVSGNDLYGGTFRLFDKVRQRSAGHRFSYVDLADLSAFEASLQDDTRMVMVETPTNPLLSLSDLAAIARICKARGIICVADNTFASPWIQRPLELGFDIVLHSTTKYLNGHSDVIGGIAVVGDNPALAERLGFLQNAVGAISGPFDAFLTLRGVKTLALRMERHCSNALELARWLEQQPQVKRVYYPGLESHPQHELAKRQMRGFGGMISLDLNSDLAGARRFLENVQIFALAESLGGVESLIEHPAIMTHATIPAETRAKLGIGDSLVRLSVGVEDIEDLRADLAQAL

SEQ ID NO: 14038 - protein, 468 aa, Pseudomonas fluorescens
IGGEWVDALSGKTFESLNPALAEPWAELPDADEADVERAVQAAQTAFDSPAWRGLTATARGKLLRRLGDLIAENKEQLAQLESRDNGKLIRETRGQVGYLPEFFHYTAGLADKLEGGTLPLDKPDLFAYTVHEAMGVVAAIIPWNSPLYLTAIKLAPALAAGNTIVIKPSEHASATILELARLALEAGIPPGVVNVVTGYGPSTGAALTRHPLVRKIAFTGGAATARHVVRSSAENFAKLSLELGGKSPNIIFADADLDSAINGAIAGIYAASGQSCVSGSRLLVQDDIYDEFVSRLVERAQRIRIGNPQDDSSEMGPMATAQQLAVVEGLVADAIAEGARLRLGGKRPSGVGDGWFYEPTLFECDRNSMKIMQEEVFGPVASVIRFKDEAEALAIANDSQFGLAAGIWTRDLGRAHRLARDVRSGIIWVNTYRAVSAMAPIGGFKNSGYGRESGIDSVLAYTELKTV

SEQ ID NO: 14039 - protein, 471 aa, Pseudomonas fluorescens
WIDGLWLDSGDYKDSIDPATYELIGRYAEGGLAEAQQGIEAAQRAFTQTPWKDDSQLRAQVLLELADVFELNAAELIDTLALENGKIRPEAAFEVGMVPSKLRYYAALARTEYGRAAQPRPGKISLVIRQAVGVAGIIVPWNSPVVLMIRSLAPALAAGCTTVIKMPGQTAQTNALVARIMSEAPSLPRGVINLFSEQGATGSIHLVESPKVPVISFTGSTGTGRAISAAGAQHLKRFGLELGGKTPMLVFNDADLDAVAPTLVKALTVFSGQFCMTGSRLLVQRDIAHVLTERLAARLEAVRVGPAADPDSDMGPLIDKPNVQRVNQVVEEAIAAGAQVIVRGGPVTEGPLAKGAFYRPTLLRVSDPEMAIVQRETFGPVLTLQVFDSEAEAIELANNSEFGLAASVWTRDIDRSLRVARELEAGTVWVNDWAVVYDEFEEGGFKQSGQGRLNGVAAMDDFVEYKHIALN

SEQ ID NO: 14040 - protein, 493 aa, Pseudomonas fluorescens
DVIVVGGGSAGAVLARRLSENVRRQVLLLEAGQSFAPGKYPEIVASSDVVGANGNRQFEWGYTSRPGYVEHPIGALRGKVLGGSSAINGAVAIRARATDFQRWNLPGWSFEDLLPSFKKLENHSGGASALHGHDGPLPVRQLGSADVTPMQKAFIYATVANGYRMIDDFDGANANGVGPYPMNIVDGVRVNTGMAYLTDEVRARDNLQIRADSLVDKVLFDGKRAVGVQLANGEQLRANEVILSAGSYGSAAILLRSGIGPGDDLRALDIEPVAELPVGQNLADHPFYYNAYAAKPDLIGRQSPAIGAKLWTHSRSAEHGDLDIHITATHLFPHDQSPTQVGFVLAVALTRPLSRGKVTLASRDPSVAPNIDLNFLAEPMDRQRLLDGIRLARRIGATAPLKGLIHSELNPGQGNDSDDALLASVKATLDTYHHPTSTAPMGRPGDAMAVVDLEARVIGVQGLRVVDASIFPDVPSVATNLTVIATAEKIAGL

SEQ ID NO: 14041 - protein, 679 aa, Pseudomonas fluorescens
  unsure (1)..(679): unsure at all Xaa locations
RTLYQKHIDSHTVCTLDDQGHVLLYIDRQVANEYTSPQAFSGLREAGRTVWRPAATLAVVDHVNPTAPKRIATMPDAGGARQVSYFEENCRDFGIELFDVLDKRQGIEHVVAPEQGFILPGMVVAAGDSHTTTYGALGAFGFGIGTSEIEHLLATQTLVYKRLKTLRVTVNGELGAGVTSKDIIMALIEKIGASGATGYAIEFTGPAISALSVEARMTICNMAVEAGARGAFMAPDDKVFAYLQHKPRAPKGKLWEQAIDHWKTLHSDEGAVFDREVILDVAELEPMVTWGTSPDQAAPIKAHVPDPAAQPDPILRQGLQRALDYMGLTPGMPLNEVTISHAFIGSCTNARIEDLRDVARVVRGKRVAAHVRAMIVPGSTLVRNQAEDEGLAQIFLDAGFEWRQSGCSMCLAMNDDVLAPGDRCASSTNRNFEGRQGAGARTHLMSPAMVAAAISGHLTDVRTVALEAXTMQPFDTVSGSAAPFLASNIDTDVIMPKQFLKGIDRQGLDRGLFFDLRFLASGEPNPEFVLNQPAWQDAAFLVTGPNFGCGSSREHAVWGLKQVGIRALIGTTFAGIFYDNCQRNGVLAIQLDDAQFKRVAEAISVPATARISVNLAQQTLELADGTLIEFEIDQLRKQSLLLGLDAIGTTLQRTEQIRAFEARHLADNPWLGXWQKNGR

SEQ ID NO: 14042 - protein, 331 aa, Pseudomonas fluorescens
WAATSAGAPLERFSYDPGPLGDEEVEVAVEYCGVCHSDQSLIDNDWGISQYPFIPGHEVVGRIVRTGPQVRGLEVGQRVGIGWYKGSCMHCSSCIGGSHHLCATAKPTIIGSHGGFADRLRTHWAWALKLPDNLDPALAGPLFCAGSTVFNPLVEFDIKPTDRVGVVGIGGLGHLALRFLNAWGCDVTAFTSSLSKQDEAKRLGAHKVVASTDSEALKAIAGTLDFLLITANANLDWTAMLATLRGKGRLHFVGIVPDAIPVHVFNLIPQQKSLSASPVGSPATAATMLEFCARHQILPQVEEFPMSKVNEAVDHLRSGKARYRIVLNASK

SEQ ID NO: 14043 - protein, 327 aa, Pseudomonas fluorescens
LPILDLSLLDGTPSQRQAFLDDLRHAARDVGFFYLTGHGIDAGLLEQVQDYARQFFALPDSEKNAVGMINSPHFRGYNRAASEITRGQPDQREQFDLGAERDVLPLNADSPLWARLQGPNQWPGALPQLKPLLLDWQQAMTQMSLRLLRAFAQALSLPEDAFDRLYGDKPNEHIKLMRYPGQASTASNQGVGAHKDSGFLSFLLQDQQAGLQVEIEEGRWIDALPRDNTLVVNIGELLELATNGYLRATVHRVVSPPVGSERLSIAFFLGAQLDAVVPLYPLPTALLREARGPASDPLNPLFRDVGWNYLKGRLRSHPDVAQRFYAD

SEQ ID NO: 14044 - protein, 253 aa, Pseudomonas fluorescens
MNNRFANKVALVTGAAQGIGRRVCERFLEEGAQVIAVDRSGLVHELQGEGVLSLTADLEQYADCARVMSAAVDTFGRLDVLVNNVGGTIWAKPFEHYEVEQIEAEVRRSLFPTLWCCHAALPYMLKQDRGAIVNVSSIATRSLNRVPYGAAKGGINALTACLAFENAERGIRVNATAPGGTEAPPRRIPRNAAEQSAQEQAWYQEIVAQTLDSSLMKRYGTIDEQVGAILFLASDDASYITGVTLPVGGGDLG

SEQ ID NO: 14045 - protein, 171 aa, Pseudomonas fluorescens
MTTQTETAILAGGCFWGMQDLLRRYPGVLQTRVGYTGGDVPNATYRNHGNHAEAIEIVFDPAVISYRQILEFFFQIHDPSTPNRQGNDLGPSYRSAIYYLNEQQRDIAEDTAADVDASGLWPGRVVTEIEPAGPFWEAEPEHQDYLERIPNGYTCHFIRRTEAAETRLKVQ

SEQ ID NO: 14046 - protein, 448 aa, Pseudomonas fluorescens
GQLAQGFKPRHVTMLSIAGIIGAGLFVGSGHAIAAAGPAVLLAYLFSGLLVVLVMRMLGEMAVAHPDTGSFSTYADQAIGRWAGFTIGWLYWWFWVLVIPIEALAAGHVLNQWFPQVDAWLFALLSIILLVVTNLFSVSKYGEFEFWFAMAKVVAIIGFIGLGFAVLMGWIPGREASGLSRLMEEHGGFAPNGLSAVVGAFITIMFSFIGTEAVTIAAAESSNPAQNIAKATRSVIWRIGVFYLLSIFVVISVVPWNDPLLASVGSYQRALELMNIPNAKFLVDVVVLIAVASCMNSSIYISSRMLFSLGRRGDAPQPLKVTSAAGVPRAAVIASTVIGAGVTLFSYFMPGGLFQFLLASSGAIALLVYLVIAISQLRMRRMLRRQNVELTFRMWLFPWLTWLVIAFICAALAVMMVTPEHRLEVTSTIGLALTISFIGLVTTRQHGQ

SEQ ID NO: 14047 - protein, 316 aa, Pseudomonas fluorescens
  unsure (1)..(316): unsure at all Xaa locations
MSDNIFTGCMPALMTPCTAARKPDFDALVAKGRELIDIGMSAVVYCGSMGDWPLLTEAERQEGVARLVAAGIPTIVGTGAVNTREAVSHAAHAAKVGAQGLMVIPRVLSRGASAAAQKAHFAAILQAAPNLPAVIYNSPYYGFATRADLFFELRREYPNLIGFKEFGGGADLRYAAENITSKDDAVTLMVGVDTQVVHGFVNCNATGAITGIGNALPREVLQLVALSKQAAKGDAKARRQARELESALAVLSSFDEGTDLVLYYKHLMVLNGDKEYTLHFNETDALSDSQRRYAEAQYALFRHWYENWSAQQNFAX

SEQ ID NO: 14048 - protein, 118 aa, Pseudomonas fluorescens
VEIFKEFTFESAHRLPHVPDGHKCGRLHGHSFKVAIHLSGDLDPHTGWIRDFSEIKAIFKPLYERLDHNYLNDIPGLENPTSEVLAKFIWNELKPLLPELSAIRIHETCTSGCIYRGE

SEQ ID NO: 14049 - protein, 211 aa, Pseudomonas fluorescens
IQLYSLPTPNGVKVSIMLEEIGLPYEPHRVGFDTNDQMSAEFLSLNPNNKIPAIIDPHGPEDKPLPLFESGAILIYLADKSGQLLAQEGALRYETIQWLMFQMGGIGPMFGQLGFFNKFAGKDYEDKRPRDRYVEESRRLLNVLNTRLEGRDWIMGERYTIADIATFPWVRNLIGFYEAGDLVGINNFPNVTRVLERFLTRPAVVRGLTIP

SEQ ID NO: 14050 - protein, 312 aa, Pseudomonas fluorescens
RPRRLRRNASLRSLFQETEFSLNDLVLPIFVEEEIDDFVPIKSMPGVMRIPERKLAGEIERYARAGIKSVMTFGVSHHLDANGSDTWRENGLVSRMSRIAKDAVPDMIVMSDTCFCEYTDHGHCGVMHNHEVDNDQTLINLGKQAVAAARAGADVIAPSAAMDGQVRAIRRALDDAGFSQIPIMAYSTKFASALYGPFREAGGSALKGDRKSYQMNPMNRREALRESLLDEQEGADALMVKPAGAYLDIIRDIREASTLPLAAYQVSGEYAMIKFGAQAGAIDEDRVVRESLGAIKRAGADLIFTYFAMDLA

SEQ ID NO: 14051 - protein, 273 aa, Pseudomonas fluorescens
MRTLELAGVQVPVIGQGTWRMGEDRSAHKREVAALRSGIELGMTLIDTAEMYGEGGAETVVGEAIAGLRDQVFLVSKVYPHNASRQGIPQACERSLRRLDTDYIDLYLLHWRGQYPLEETVEAFERLREDGKIGRWGVSNFDVDDLEELSHSACATNQVLYNLEERGIEFDLLPWCQQQRMPLMAYCPIGQGGAMLAEPVLKQIAARHGVTPAQVSLAWILRQDGLIAIPKAVRPEHVQLNAQAAQLPLDGGDLAALDQVFHAPQRKQRLAMV

SEQ ID NO: 14052 - protein, 266 aa, Pseudomonas fluorescens
NKDTQLCMSLSGRPGNFGLRFHNHLYEQLGLNFYYKAFSSQDLPGAVGGIRALGIRGCGVSMPFKEASIALVDELDASAAAIQSINTIVNTNGHLKAYNTDYIAIAQLLETHAVPKDTTFALRGSGGMAKAVASALRDDGYKNGLIVARNERAGRALADSLGYRWQAELGDERPQMLINVTPVGMDGGPEAGQLSFDVDVIKSADTVFDVVAIPSETPLIVRGRAEGKKVITGLEVIAIQALEQFVLYTGVRPTVEQFDAAVAFAR

SEQ ID NO: 14053 - protein, 283 aa, Pseudomonas fluorescens
MTAQLIDGKSIAASLRQQIAQRVAERRQQGLRTPGLAVILVGSDPASQVYVSHKRKDCEEVGFLSQAYDLPSETTQEALTDLIDRLNDDPAIDGVLLQLPLPEHLDASKLLERIRPDKDVDGFHPYNVGRLAQRIPLLRPCTPKGIMTLLESTGADLYGMDAVVVGASNIVGRPMAMELLLAGCTVTVTHRFTKDLAGHVGRADLVVVAAGKPGLVKGEWIKEGAIVIDVGINRQEDGKLVGDVVYETALPRAGWITPVPGGVGPMTRACLLENTLYAAETLH

SEQ ID NO: 14054 - protein, 326 aa, Pseudomonas fluorescens
  unsure (1)..(326): unsure at all Xaa locations
MHGAICSGVVSPRVLRDAGIDLPTSAAQCASSRQTWSTAAIAQCCDWPDGQRPVGSKSHRSDGLLIGPFQSAPPFDLLIVNTDGTLAERSGNGLTIFSRALLEQGLMPEEGATLRVHHDKQDSQSPVPTSVKPAQVAGVHGFWLDLGQPGFGPVAVGALGVEPVPFNGVEVNRVRPLAQLDPAWAHSQFVRIGNPHCVTLVQDEVALPSNAQMLEPPLADSLTAIAYAMPTGAGQPCPAGVNLQWATRAGDQRIVARVFERGEGPTASSGTSASAVASAAWRVGWVSAGEVQVLMPGGTAPILLEERDGELLGVRLFGTAHRTKRX

SEQ ID NO: 14055 - protein, 846 aa, Pseudomonas fluorescens
MELASLIGRLNPDNRRALERAAQRCLQRGHHFVEIEHLLLELLDIEGGDFAFLLPRFGLERDALTAEINKALDLFKTGSTRTPALSSHTLGLLEDAVVQASVLGIDSIRSGLLLLALIDRDERRSLLLNSASSLLRIPKEALRANLLEWTENSREHVGPRSVSSGSPTPRQDSVLDQYTQDLTADAHAGRIDPIVGRDGEIRQCIDILLRRRQNNPILVGAPGVGKTAVVEGLALRIAAGDVPPSLQEVSLRVLDLGLLQAGAGVKGEFEQRLKGVIDTVRSADKPIILFIDEAHTLIGAGGTEGGSDAANLLKPALARGELRTLAATTWMEYKKYFEKDPALARRFQLVQVEEPDEITAVEMLRGVAAKLEQHHGVQVLDAAIHEAVKLSHRYISGRQLPDKAISVLDTACARVALGQHDVPPPLESLRHRQQSLKEEVERLRREQATGLDHRERITLLESESKTNVQAIRELETRWSEERVAVRELLDTRRELLALSESADSDKPDEAIDSRIDHLAAELLRLEAGLDAIRQDDPLVPEQVDGKTVAAVIAGWTGIPVGKMLADEAHAVRTLGTRMGQRVMGQSTALNTIAQRLQAYRAGLTDPQKPVGVFLLVGPTGVGKTETAYALADALYGGERNLISINLSEYQEAHTVSQLKGAPPGYVGYGSGGVLTEAVRRKPYSVVLLDEIEKAHPDVLEAFYNVFDKGLMEDGTGLVVDFKNTVMLATSNVGAELLLDTPTAQLGSEAFNEALHKVLLQAFRPAFLARMTVVAYRPLDEQTLEGIVLAKLEKLRGRYKAATGKQFEFDSGIVKAVLAKCSAAGARDVENVLMTQVTGKLAEWVLE

SEQ ID NO: 14056 - protein, 628 aa, Pseudomonas fluorescens
MRLYLCEKPSQAKDIAAVLGAKRRGDGCWLGTDVTVTWCIGHLLETAPPDAYDAKYKRWVLADLPIIPDKWKMTVKPRTASQYKAVKRLLGEASELIIATDADREGEMIARELVEHCRYRGPIRRLWLSALDEASIRKALAALKPGAETFSLYHSALGRSRADWLIGMNMSRLFTLLGRQSGYQGVLPVGRVQTPTLRLVVDRDRSIADFVPVAYWAIDVQLLHGDTPFNAQWRAPNDACDDQDRCLNQALAQQAAAAISSAASARVVKLRTERMREVAPLPFDLGTLQEVCSKKLGLGAQETLDIAQALYETYKVITYPRSDCGYLPLSQHNEAPGILAALRQADPSLEALREHLEPQRRSRAWNDAKVSAHHGIIPTAAAKNLERLTGKHRAVYTLIRARYLAQFLPNHEYDRTQADFDCAGEALRAVGKQIIEPGWKRALPEALAPAKGREAPAPQTLPTLTQGAECAVADVKLKDLWTQPPKPYTEGDLIKAMKNVAKLVEDPLLKQKLKDTTGIGTEATRASIIQGLLDRGYLVKNGKALSATPAAFSLIDAVPRAIADPGTTAIWEQALDMVQSGEMSLEEFVTKQAAWMSKQVTRCAGLSLTISGPPPPARPLRHGRTNAR

SEQ ID NO: 14057 - protein, 538 aa, Pseudomonas fluorescens
FDYIVVGAGPAGCLLANRLSADPQQRVLLLEAGGRDNYPWIHIPVGYLFCIGNPRTDWCFKTEEQPGLNGRALSYPRGKVLGGCSSINGMIYMRGQANDYDGWAAEGNPGWAWNDVLPLFKQSENHFAGAADFHGDKGEWRVERQRLSWPILDAFRSAAEQSGIASIDDFNQGDNEGCGYFQVNQKAGVRWNAAKAFLKPIRDRANLTVLTDIEVDRVLFEDGRASKVSARWQGQQKNFKARKEIVLCAGSVGSPSILQRSGIGPRPLLEKLGIGVVHELPGVGGNLQDHLQLRLIYKLENARTLNQIAGSVWGKMGMGLRYLYDRSGPLSMAPSQLGAFARSGPEQTSANLEYHVQPLSLERFGEPLHSFPAFTASVCDLRPQSRGRVEIRSADPQAAPLIQPNYLSHPEDLRVAADAIRLTRRIVSAPALQAFNPVEYLPGASLQTEEQLHAAAAKIGTTIFHPVGTCRMGNDADAVVDAQLRVHGVPGLRIADASIMPRITSGNTCSPTLMIAEKAAQLILNPATINTTPVGAGL

SEQ ID NO: 14058 - protein, 253 aa, Pseudomonas fluorescens
LHEARVVLTGASGGIGIAITRALCAAGAQVLAVARHQESLRLLLDLYPQNLCWVAADLTFLSDRRKVLAAAEAIGGINLLINAAGVNHFAMLEQLDDSDINAMLAVNISAPICLTKLLLPLLKQADSAMVVNVGSTYGSIGYPGYASYCATKFALRGFSEALRRELADTRVGVLYVAPRATRTAMNSPAAQALNDALKSSVDDPQAVANAVIHAIAGDRRDLYLGWPERFFVRLNSLLPNLVDRGLRKQLPLI

SEQ ID NO: 14059 - protein, 352 aa, Pseudomonas fluorescens
MKAAIFVEKNRIVLDDKPIPEVGPLDALIRITTTTICGTDVHILRGEYPVAKGLTVGHEPVGIIERLGSQVRGFVEGQRVIAGAITPSGQSYACLCGCGSQDGPDTRHGFRAIGGWKFGNTIDGCQAEYVLVPDALANLCPIPDGLSDEQVLMCPDIMSTGFSGAERGEVSIGDSVAVFALGPIGLCAVAGARLKGASTIIGVDAVAERMTVARRLGATHVVNFREGDVVEQIMALTDGRGVDVAIEALGTQGTFESALRVLRPGGRLSSLGVYSSDLRIPLDAFAAGLGDYSIVTTLCPGGKERMRRLMAVVQSGMVDLSPLVTHRFKLDDIEAAYDLFAHQRDGVMKVAI

SEQ ID NO: 14060 - protein, 384 aa, Pseudomonas fluorescens
LMNTYQPLDLSFIKGLGTRLWDLSGREYLDAVAGVAVTNVGHSHPRIVSAISEQAGLLLHTSNLYSIDWQQSLARKLTQLAGMERAFFNNSGAEANETALKLARLYGWHKGIEQPLVVVMANAFHGRTLGTLSASDGPAVRLGFNELPGDFVKVPFGDLEALEQVQRKHGQRIVAILVEPIQGESGVQLAPPGYLKALRELCNRHAWLLMLDEIQTGIGRTGRWFAFQHEGIVPDVMTLAKGLGNGVPIGACLARGRAADLFTPGSHGSTFGGNPLACRVGCTVLEIIEEQGVLEHARVQGERLLTRLRAELADNPNVLAIRGQGLMIGIELKQPIRDLTLIAARDHGLLINVTRGKTIRLLPPLTIDEREVGMIVRGVGRSLS

SEQ ID NO: 14061 - protein, 618 aa, Pseudomonas fluorescens
MALLQIAEPGQSPQPHQRRLAVGIDLGTTNSLVAALRSGLSEPLADAEGRVILPSAVRYHADRVEVGESAKLAASSDPLNTVLSVKRLMGRGLSDVKQLGDQLPYRFVGGESHMPFIDTVQGPKSPVEVSADILKVLRQRAEATLGGELVGAVITVPAYFDDAQRQATKDAAKLAGLNVLRLLNEPTAAAVAYGLDQHAEGLVAIYDLGGGTFDISILRLTGGVFEVLATGGDSALGGDDFDHAIAGWIIESASLSADLDPGAQRSLLQAACAAKEALTDSDSVEVAYGDWKAQLTREAFDALIEPMVARSLKACRRAVRDSGVELEDVHAVVMVGGSTRVPRVREAVAEAFGRQPLTEIDPDQVVAIGAAIQADTLAGNKRDGGELLLLDVIPLSLGLETMGGLMEKVIPRNTTIPVARAQDFTTYKDGQSAMAIHVLQGERELISDCRSLARFELRGIPAMVAGAAKIRVTFQVDADGLLSVSARELGSGVEASIQVKPSYGLTDGEIAKMLKDSFQHANDDKVARVLREQQVDAQRLIEAVQGALEADGERLLDAEERMVIDLQVQELTELMKGTDGYAIEQQTKRLSQVTDAFAARRMDQTVKAALSGRNLNEI

SEQ ID NO: 14062 - protein, 138 aa, Pseudomonas fluorescens
MAVQRTFSIIKPDAVAKNVIGKITTRFEDAGLRVVASKLKQLSKAEAEGFYAEHSARGFFGELVAFMTSGPVVVQVLEGENAIARNRELMGATNPKEAAPGTIRADFAESIDANAVHGSDSEAAAAREIAYFFAATEV

SEQ ID NO: 14063 - protein, 792 aa, Pseudomonas fluorescens
ETDAEHIEHHVPGKGLALPGQNLPDKVYIIPIHNRPFFPAQVLPVIVNEEPWAETLELVSKSEHHSLALFFMDTPQEDPRHFDTKALPQYGTLVKVHHASRENGKLQFVAQGLSRVRIKTWLKHHRPPYLVEVEYPHQPTEPTDEVKAYGMALINAIKELLPLNPLYSEELKNYLNRFSPNDPSPLTDFAAALTSATGNELQEVLDCVPMLKRMEKVLPMLRKEVEVARLQKEISAEVNRKIGEHQREFFLKEQLKVIQQELGLTKDDRSADLEQFEQRLEGKVLPTQVQKRLEEEMNKLSILETGSPEYAVTRNYLDWATSVPWGVYGEDKLDLKHARKVLDKHHAGLDDIKDRILEFLAVGAYKGEISGSIVLLVGPPGVGKTSVGKSIAESLGRPFYRFSLGGMRDEAEIKGHRRTYIGAQPGKLVQALKDVEVMNPVIMLDEIDKMGQSYQGDPASALLETLDPEQNVEFLDHYLDLRMDLSKVLFVCTANTLDSIPGPLLDRMEVIRLSGYITEEKVAIAKRHLWPKLLEKAGVSKGSLSISDTALKALIDGYAREAGVRQLEKQMGKLVRKAVMKLIDDPKAAIKIGPKDLEASLGHPVFRNEQVLSGTGVITGLAWTSMGGATLPIEATRIHTLNRGFKLTGQLGDVMKESAEIAYSYVSSHLKQFGGDAKFFDEAFVHLHVPEGATPKDGPSAGVTMASALLSLARNQPPKKGVAMTGELTLTGHVLPIGGVREKVIAARRQKIFELILPEPNRGNFEELPDYLKEGITVHFAKKFSDVAKVLF

SEQ ID NO: 14064 - protein, 800 aa, Pseudomonas fluorescens
TEGASSRSRLLPNLLGILLLLMGLAMLAGGIKLSTLGGSLYYLLAGIGITLTGILMLMRRRAALGLYAIVLFASTVWALWEVGLDWWQLVPRLALWFVLGFVMLLPWFRRPLLLAGPAPMGTGGLTVAVILAGVTALASLFTHPGETFGELGRDTADTTSTAPQMPDGDWQAYGRTEFGDRYSPLKQITPANVGKLQEAWRIQTGDLPTADDPVELTNENTPLKANGMLYACTAHSKVLALDPDTGKELWRFDPQIKSPEGFKGFAHMTCRGVSYYDEAAYAKSENAASTVISEAGKAVAQACPRRLYLPTADARLIALNADTGKICEGFGTNGVVDLTQGIGPFTAGGYYSTSPAAITRDLVIMGGHVTDNESTNEPSGVIRAYDVRDGHLVWNWDSNNPDATEPLAPGQTYSRNSANMWSLASVDEKLGMVYLPLGNQTPDQWGGDRTPGAEKFSAGLVALDLATGKVRWNYQFTHHDLWDMDVGSQPTLLDMKTADGIKPALIAPTKQGSLYVLDRRDGTPIIPIREIPVPQGAVKGDHTAPTQARSDLNLLAPELTEKAMWGASPFDQMLCRIQFKELRYEGQYTPPSEQGSLIYPGNVGVFNWGGVSVDPVRQMLFTSPNYMAFVSKMIPRADVPADSKRESETSGIQKNTGAPYAVTMHPFMSPLGVPCQAPAWGYVAGIDLTTGKVVWKRKNGTSRDSSPIPIGFTLGVPSMGGSIVTAGGVGFLSGTLDQYLRAYDVNTGKELWKSRLPAGGQATPMTYTGKDGKQYVLLVVGGHGSLGTKMGDYVIAYKLP

SEQ ID NO: 14065 - protein, 453 aa, Pseudomonas fluorescens
ETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVLGGIGIIAFGFGNDGVALGISNLWAHGGFMPNGVTGVLMSLQMVMFAYLGVEMIGLTAGEAKNPQKTIPNAIGSVFWRILLFYVGALFVILSIYPWNEIGTQGSPFVMTFERLGIKTAAGIINFVVITAALSSCNGGIFSTGRMLYSLAQNGQAPAGFARTSSNGVPRRALLLSIFALLLGVLLNYLVPEKVFVWVTSIATFGAIWTWVMILLAQLKFRKGLSASERAGLKYKMWLFPVSSYLALAFLVLVVGLMAYFPDTRVALYVGPAFLVLLTVLFYVFKLQPKD

SEQ ID NO: 14066 - protein, 770 aa, Pseudomonas fluorescens
MAVAHTLGFPRIGADRELKKALEACWKGDLDQAALNQVGRELRARHWQLQKDAGIDLLPVGDFAWYDQVLTHSLTFGVIPERFDAVRDERGLPTLDTLFAMARGATSSCCGGEHGKTQYAQELTKWFDTNYHYLVPEFSADQQFKLSWEQLFDEVEEAKALGHNVKPVIIGPLTYLWLGKAKGNDFDKLDLLERLLPVYNQILGRLAAQGVEWVQIDEPILTLDLPQAWKSAFERAYHILQYSPLKKLVATYFSGLQDNLGLAVGLPVQGLHIDAVRAPDQLGQVLDRLPTYKILSVGLVNGRNVWRCELEQALAQLQPAQERFGDNLWVSSSCSLLHSPVDVEREDKLDPELKSWLAFAVQKCSEISVLRDALNDPQAPNVQSALAASRAIQQSRARSPRIHKAEVQARIEAINASDSQRHSPFAKRIAAQQARLKLPTFPTTTIGSFPQTGSIRLARQAYKQGKLSANDYHDAMRSEIRHAVQVQERLGLDVLVHGEAERNDMVEYFAEQLDGYLLTRFGWVQSYGSRCVKPAVIYGDLSRPNAMTVDWITYAQGLTDKVMKGMLTGPVTMLMWSFPREDVSRKVQAQQLALALRDEVVDLENAGIRIVQIDEAAFREGLPLRREQWQEYLDWAVEAFRLTASGVKDETQIHTHMCYSEFNDVIKAIADMDADVITIETSRSDMELLEAFEAFDYPNDIGPGVYDIHSPRVPDTAEMVKLMSKAVKRIPAQRLWVNPDCGLKTRAWPETEAALVNMVAAARQLRSQLA

SEQ ID NO: 14067 - protein, 512 aa, Pseudomonas fluorescens
MSTSTLRTPPISEIYDIAVIGGGINGVGIAADAAGRGLSVFLCEKDDLASHTSSASSKLIHGGLRYLEHYEFRLVREALAEREVLLAKAPHIVKPMRFVLPHRPHLRPAWMIRAGLFLYDHLGKREKLAGSKSLKFGADSALKSEISKGFEYSDCWVDDARLVVLNAMAAREKGAHIHTQTRCVSARRAKGLWHLNLERADGSLFSITAKALVNAAGPWVAKFIRDDLKMESPYGIRLIQGSHIIVPKLYEGDHAHILQNEDQRIVFTIPYLNNLTLIGTTDREYTGDPAKVAITDGETDYLLKVVNAHFKKQISRGDILHTYSGVRPLCNDESDNPSAVTRDYTLALSGSTEEAPLLSVFGGKLTTYRKLAESAMAQLMPFFTQMRPSWTATATLPGGEDMTTPQALSALIRDKFDWVPTEIARRWATTYGSRTWRMLEGVDTLADLGEHIGGGLYTREVDYLCTEEWATTARDILWRRSKLGLFTTPAEQERLAAYLNKVEQNRSKIEAA

SEQ ID NO: 14068 - protein, 494 aa, Pseudomonas fluorescens
MTDIENKNYIIALDQGTTSSRAIIFDRDANVVCTAQREFAQHYPQAGWVEHDPMEIFATQSAVMVEALAQAGLHHDQVAAIGITNQRETTVVWDKTTGRPVYNAIVWQCRRSTEICQQLKRDGHEDYIRDTTGLVTDPYFSGTKLKWILDNVEGSRERARNGELLFGTVDSWLIWKFTGGKVHVTDYTNASRTMLFNIHTLEWDAKMLEILDIPREMLPEVKASSEIYGRTKSGIAIGGIAGDQQAALFGQMCVEPGQAKNTYGTGCFLLMNTGDKAVKSQHGMLTTIACGPRGEVAYALEGAVFNGGSTVQWLRDELKIVNDAHDTEYFANKVKDSNGVYLVPAFTGLGAPYWDPYARGALFGLTRGVRVDHIIRAALESIAYQTRDVLDAMQQDSGERLKALRVDGGAVANNFLMQFQADILGTQVERPKMRETTALGAAYLAGLACGFWGSLEELRGKAVIEREFEPSLDEVEKEKLYKGWKKAVSRTRDW

SEQ ID NO: 14069 - protein, 305 aa, Pseudomonas fluorescens
SKKVVNMSARHFLSLMDCTPEELVSVIRRGVELKDLRNRGVLFEPLKNRVLGMIFEKSSTRTRISFEAGMIQLGGQAIFLSPRDTQLGRGEPIGDCAIVMSSMLDAVMIRTFAHSTLTEFAANSRVPVINGLSDDLHPCQLLADMQTFLEHRGSIQGKTVAWIGDGNNMCNSYIEAAIQFDFQLRVACPEGYEPNPEFVAKAGDRVTIVRDPKDAVRGAHLVSTDVWTSMGQEEETAKRLKLFAPFQVNRALLDLAADDVLFMHCLPAHRGEEISLDLLDDPRSVAWDQAENRLHAQKALLEFLV

SEQ ID NO: 14070 - protein, 701 aa, Pseudomonas fluorescens
MTKTLHHRACHLCEAICGLTIETTETDGQVQITSIKGDALDTFSRGHICPKAVALQDIQNDPDRLRQPMRRVGSEWLPIEWDEAVELVAEKLSAIQERHGQNAVAVYQGNPSVHNYGLMTHSNYFLGLLKTRNRYSATSVDQLPHHLTSYLMYGHGLLLPIPDIDHTDFMLILGGNPLASNGSIMTVPDVEKRLKAIQARGGKVVVVDPRRSETAAMADQHLFVRPGGDAALLFGVLNTLFSEGLTSDSHLPVDGLDDVRAAVAGFTAEAMSPLCAVPSEQIRQLARDFAAAPSAVCYGRMGVSTQAFGTLCHWVVQLINLVTGNLDRVGGALCTEPAVDLVASTSGGHFNKWQSRVSGRPEYGGELPVSALAEEMLTEGEGQIRALITVAGNPVLSTPNGRQLEQALDGLEFMVSVDLYINETTRYADLILPSTSALENDHYDTTFNLFAVRNVTRFNRAILAKPEGALHDWEIFVGLAKAFAAKTGKELKPTMPPSKMIDTGLRMGAYGDASEHKLSLATLFDHPHGVDLGALKPNLTPRLKTFNQRVQAAPPEILADLARFAALQAPAADELLMIGRRHVRSNNSWMHNYHRLVKGKPRHQLLMNPDDLASRGLSDGQLVRVSSRVGQIEVEVLGSADMMKGVVSLPHGWGHARPGVQMAIASGQPGSSANDLTDECQLDELSGNAALNGVPVTVAAA

SEQ ID NO: 14071 - protein, 198 aa, Pseudomonas fluorescens
VLVGKQAPDFTVPAVLGNGEIVDSFTLSSAIKGKYGLVFFYPLDFTFVCPSELIALDNRMADFKARNVEVVAVSIDSHFTHNAWRNTPVNNGGIGQVKYTMAADMKHEIAKAYDVESEGGVAFRGAFLIDDKGVVRSQIINDLPLGRNMEELIRLVDALQFHEEHGEVCPANWKKGDKGMNASPEGVAAYLTENAAAL

SEQ ID NO: 14072 - protein, 398 aa, Pseudomonas fluorescens
KVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHAIPIERHGKKKSPYSMDANLLHISYEGGVLEDTWTEHEEDMWRWTVSPEKAPDTPQYLELTYRNGDIVALDGVEMTPATVLATLNRIGGEHGIGRLDIVENRYVGMKSRGCYETPGGTIMLRAHRAIESITLDREVAHLKDELMPKYASLIYTGYWWSPERLMLQQMIDASQVNVNGVVRLKLYKGNVIVTGRKSDDSLFDANIATFEEDGGAYNQADAAGFIKLNALRMRIAANKGRK

SEQ ID NO: 14073 - protein, 252 aa, Pseudomonas fluorescens
MQLNDKVIIITGGCQGLGRSMAEYFAGKGAKLALVDLNQEKLDDAVAACKAKGVEARSYLCNVANEEQVTHMVAQVAEDFGAIHGLINNAGILRDGLLLKVKDGEMTKMSLAQWQAVIDVNLTGVFLCTREVAAKMVELKNSGAIINISSISRAGNVGQTNYSAAKAGVAAATVTWAKELARYGIRVAGIAPGFIETEMTLGMKPEALEKMTSGIPLKRMGKPEEIAHSAAYIFENDYYTGRILEMDGGLRI

SEQ ID NO: 14074 - protein, 97 aa, Pseudomonas fluorescens
MKLRPLHDRVVIRRSEEEKKTAGGIVLPGSAAEKANHGEILAVGPGKALESGEVRALSVKVGDKVVFGPYSGSNTVKVDGEDLLVMSENEILAVIEG

SEQ ID NO: 14075 - protein, 816 aa, Pseudomonas fluorescens
  unsure (1)..(816): unsure at all Xaa locations
WLTQRMRDFLQARKLNLLYVSSGADAQVWRLYNTTPMADDFPHEMLDRLETLKCDNNGALKEIWLTHNWQGHSQLYIFIRLDERDLDSGWLGLEMDDREVSNALSDHSAGEFTMFNSQGMPLFSNSHKPPPGQNLPLLRQQDFFGFVGDGWLPEQLVLRKQLKSSDRQLTYSIDLLAVLWALWPQLLGALAFCLASISLVWLLIRRLEHRFITPTLQRIQALVESELFSRDVIQTAPVALCVLRRSDARVVLENTLARHWLGRMRPATRAWLDPRCVCGXSPCLTDYFETADGRHLYLSCAPTRYKGEDVLLCAFSDISARRQIEAALERARQSADAANEAKTLFLATMSHEIRTPLYGVLGTLELLARTQLDTQQKSYLRAIEGSSATLLQLICDVLDVSKIEAGQLALELSDFSIVALAQEVVQGYAAAAQSKGLQLYACFDPQLPDSLIGDISRVRQILNNLLSNAVKFTDSGRVVLRVNVLSREGERVCVQWQVSDTGRGIAHDDQAFIFEPFYQTRGNSHVIAGTGLGLPICLRLTNLMNGTLRMVSEPGLGSSFSLTLPLEQRSGNTPPDIQPKLAGDIIYVVSPVRELADSLAGWLRRWGARPQVGAPASQVPADGGVLLELYPRRWTSAANCAGQGHVCWPAARVPVSRNAQSTAGXRIXTDLAAIRQALRQAQGGAVIEHQQTQTQALAPLHLHILVAEDNAINQLILRDQLQELGCTVALASDGEEALSLWQANTFDVVLSDVNMPRLNGYELAKTLRRLGCTTPIIGATANALRGEEALCLAAGMNHCLIKPFTLRALSIVLAPY

SEQ ID NO: 14076 - protein, 603 aa, Pseudomonas fluorescens
MVLSTNPGRWIIYRSFPRSGRSRSNPRPPRSSKIIKRLLSEASSVVIATDADREGEMIARELLELCRYRGPVLRLWLSALNEASIRKALSSLKSGQVTFPLYHSALARSRADWLIGMNLSRLFTLLGRRAGYDGVLSVGRVQTPTLRLVVDRDRAIASFVPVPYWTVDVHLSSMGQRFIASWLPPRSGRDEAGRCLQQALAHHAVQTITGEKSATVLSLQTEQLREPPPLPFDLSTLQEVCSRKLGLGVQETLNIAQALYETHKATTYPRSDCRYLPESMFNEAPAVLDALLKTDPALRPAFGSLDRSLRARVWNNAKVTAHHGIIPTTEPANLVRMSEQERQVYELIRSHYLAQFLPHHEFDRTQVELECSKERLTAVGKQILIQGWKGLLTENTEDDEPSQKHQVLPVLQQGTQCAVNDVELKSMRTVAPKPLTEGDLIKAMKNVAKLVNDPRLKQKLRDTTGIGTEATRAGIIKGLVDRGYLLKKKRALMASAAAHTLIEAAPTAVADPGMTAIWEQALDEIEAGRLTLDAFVAKQANWIAQLVAHYRSHTLAIAVETSPSCPMCNASMLRRKGKSGPFWSCSCYPDCKGTVSISKDTRR

SEQ ID NO: 14077 - protein, 558 aa, Pseudomonas fluorescens
  unsure (1)..(558): unsure at all Xaa locations
AALRWLYSFVRPHRLAIVGLLGLSVSASLLVLLQPWLTKLLIDDGLLARDFPKLLTIASLMIVAGLLGTALSGINRYLHTRLSGRILFSLRDDLYRHLQTLSASFYAQRRIGDLMSRLDGDVAEIQRFAVDSLFSAVSSVVGLLCAVAMLVTLSWKLSLLVLVLIPLDILWLRWMRRKVERDVRRLRECSADVSSFMVETLPVMKFIQSAGQQKRESHRLEALGQGYMNQLLKLQITEFFTQAVPGTLTSLARACAFLLGGYWVVQGTWQLGSLIAFSTYLGMAVGPVQSLLGLYVAIQRMTVSLGRVMELRGEEPTIVSPVLPKPMPAQSDLRFDDVHFTHPGRLSTLRGVDARIPYGLKVALSGGSGVGKSTLIDLLQRHLDPQAGRVLLGEVDVRELDLFELRRRIAVVSQDIVLFRGSLADNLAYAMPDASREAITAVAQLAQLESLIASLPEGLDSPLGERGQQLSGGQKQRIAIARALLQDPMILVMDEATSAVDEATEREVIEAIDRLFSERTRILISHRPSTLANADLHFELLDGVLKPKSVQYEIXSED

SEQ ID NO: 14078 - protein, 480 aa, Pseudomonas fluorescens
EELWSNCVFDGTWINISPDVSQVIEPATGASLGCIGMANAASVSAAARVANEVQADWFLTAYEERAAIMRKAAEIAELHFGDIVEWLVRESGSTQLKAAFETRVTIKALQESAMMPGKSQGDVLPNAPGSGRLSLARRRPLGVVGIISPFNFPLYLAMRSVAPALAVGNSVVLKPDPRTAVSGGLVIGRLFELAGLPKGVLHVLPGGGDAGAALVESPDVAMIQFTGSTAAGRKVGEAAGRNLKKVSLELGGKNSLIILDDANLDLAVANAIWGTFLHQGQICMATGRILVQRSLYPAFLKALTAKVGKLSVGDPATTKVSLGPLINAHQRDQVAKIVREAQQAGAKLEVGGRYEELFFQPTVLSDVKPDNPAFREEIFGPVAVVVPFNSDEEAIRLANDTEYGLAAGIISSNIGRAMKVGDKLRTGMLHINDQTVNDEVVNPFGGWGASGNGTSVGGAANWEEFTQWQWLTIKDEATPY

SEQ ID NO: 14079 - protein, 253 aa, Pseudomonas fluorescens
MKNRFENKVALVTGAAQGIGRRVCEQLRAEGARVVAVDRSELVHELKQDDVLTLVADLEMHTECMSVMAAAVEAFGSLHILINNVGGTIWTKPFERYEAAQIESEVRRSLFPTLWCCHAALPYMLEQGHGAIVNVSSIATRGVNRVPYGAAKGGVNALTACLAFENAERGIRVNAIATGGTEAPPRRIPRNTAQPTEEEKVWYQQIVDQTIQSSLMKRYGTIDEQVAAILFLASDDASYITGVTLPVSGGDLG

SEQ ID NO: 14080 - protein, 323 aa, Pseudomonas fluorescens
MFKGILIDKDDSGYRANLQEISDEQLPDGDVTVRVAYSTLNFKDGLAITGSSPVVRKFPMVPGIDLAGTVEVSSHPDYKVGDAVLLNGWGVGESHCGGLAQKARLNGDWLIPLPKAFTAAQAMAIGTAGYTAMLCVMALERNGVTPQQGEVLVTGANGGVGSFAIALLSKLGYRVVASTGRVSEHEYLKQLGASEIIDRATLSEPGKPLAKERWAGVIDSVGSHTLANACASTRAEGTVAACGLAQGMDFPASVAPFILRGVTLAGINSVTQPKARRIEAWDRLTKDLDFALLPLISHEIGLGEALEAAPKLLAGQLRGRVVV

SEQ ID NO: 14081 - protein, 279 aa, Pseudomonas fluorescens
MIKKCLFPAAGYGTRFLPATKAMPKEMLPVVNKPLIQYGVEEALDAGLNEISIVTGRGKRALEDHFDISYELENQIKGTDKEKYLVGIRKLLDECSFSYTRQTEMKGLGHAILTGRPLIGDEPFAVVLADDLCVNLEGDGVLTQMVKLYKQFRCSIIAIQEVDPQETSKYGVIAGEMIRDDIYRVHSMVEKPKPEDAPSNLAIIGRYILTPDIFDLIEQTEPGKGGEIQITDALMKQAQNGCVMAYKFKGKRFDCGGAEGYIEATNFCFENFYKTGKAY

SEQ ID NO: 14082 - protein, 358 aa, Pseudomonas fluorescens
MADLYENPMGLMGFEFIEFASPTPGTLEPIFEIMGFTKVATHRSKNVHLYRQGAINLILNNEPHSVASYFAAEHGPSVCGMAFRVKDSQKAYKRALELGAQPIHIETGPMELNLPAIKGIGGAPLYLIDRFGEGSSIYDIDFVFLEGVDRNPVGAGLKIIDHLTHNVYRGRMAYWANFYEKLFNFREIRYFDIKGEYTGLTSKAMTAPDGMIRIPLNEESSKGAGQIEEFLMQFNGEGIQHVAFLTDDLVKTWDQLKKIGMRFMTAPPDTYYEMLEGRLPNHGEPVDQLQSRGILLDGASDKEDKRLLLQIFSETLMGPVFFEFIQRKGDDGFGEGNFKALFESIERDQVRRGVLATE

SEQ ID NO: 14083 - protein, 307 aa, Pseudomonas fluorescens
MSEIDILSFGETMAMFVAEQSGDLAFIDQFHKRIAGADSNVAIGLSRLGFKVAWLSRVGADSLGRFVVETLAREGLDCSHVEVDPAHPTGFQLKSRNDDGNDPTVEYFRRGSAASHLSPQSITPKLLGARHLHATGIPPALSASAREMSRELMTRMRNAGRSVSFDPNLRPSLWAGEREMIREINRLAALAHWVLPGLSEGRLLTGFEDPADIAAFYLDQGAEAVAIKLGPQGAYYRTHLDQGFVAGVPVETVVDTVGAGDGFAVGMISALLEHQSFPEAVRRANWIGSRAVQSRGDMEGLPTRSEL

SEQ ID NO: 14084 - protein, 541 aa, Pseudomonas fluorescens
MRDYLSATAQFDYQHTVDAALSGTLEALNACVECCDRHALPGRIALFWEGRDGASATYTFSDLQDKAARFANFLLAQGVQKGDKVAGLLPRNIELLITVFATWRIGAVYQPLFTAFGPKALEHRLNSSGAKVVVTDAVNRPKLSEVADCPTLVTVGGPKGQGIVRGDFSFWAELPNHSSVCEPLMLTGEDPFLLMFTSGTTGPSKALSVPLKAIVAFQSYTRDAVDLRPEDAFWNVADPGWAYGIYFGVTGPLSMGHPITFYDGPFTLESTCRVINKYGITNLTGSPTAYRLLIAGGDEFAKSIKGKLRIVSSAGEPLNPEVIRWFADNLGVAIHDHYGQTELGMVLCNHHGLEHPIHLGAAGFASPGHRIVVLDEQNNELGVGQPGILAIDRTQSPMCWFAGYEGVPTKAFVGDYYLSGDTVEWNPDGSISFVGRSDDVITTSGYRVGPFDVESALIEHPAVVEAAVVGKPDPERTELVKAFVVLNPQYRAEPALAEELRQHVRKRLAAHSYPREIEFVSELPKTPSGKLQRFILRNQEI

SEQ ID NO: 14085 - protein, 253 aa, Pseudomonas fluorescens
MQIENKVFIVTGGASGLGAATAELLVAAGAKVMLVDMNAEAVAAQAQRLGAQSVVADISNEAAAEAAVQATVKAFGSLNGLVNCAGIVRGEKILGKNGPHALSSFAQVINVNLIGSFNMLRLAAAAIAESEANADGERGVIINTASVAAFDGQIGQAAYSASKGAIASLTLPAARELARFGIRVMTIAPGIFETPMMAGMTPEVRDSLAAGVPFPPRLGKPAEYAALVRHIIENSMLNGEVIRLDGALRMAAK

SEQ ID NO: 14086 - protein, 387 aa, Pseudomonas fluorescens
IVIVSAVRTPMGGFQGELKSLTAPQLGAAAIKAAVERAGVAADAVDEVLFGCVLPAGLGQAPARQAALGAGLDKSTRCTTVNKMCGSGMETAILAHDMLLAGSADVVIAGGMESMSNAPYLLDRARAGYRMGHGRVLDSMFLDGLEDAYDKGRLMGTFAEDCAETNDFSREAQDAFAIASTTRAQQAIKDGSFKDEIVPLTVTVGKEQVVISNDEQPPKAKLDKIASLKPAFREGGTVTAANSSSISDGAAALVLMRQSQAQKQGLKPLAVIHGHAAFADTPGLFPVAPIGAIKKLMKKTGWSLDQVDLFEVNEAFAVVGMAAMTHLEIPHDKLNIHGGACALGHPIGASGARILVTLLSALRQKGLKRGVAAICIGGGEATAMAVE

SEQ ID NO: 14087 - protein, 370 aa, Pseudomonas fluorescens
DQQQIRDMARQFAEERLKPFAAEWDREHRFPKEAIGEMAGLGFFGMLVPEQWGGCDTGYLAYAMALEEIAAGDGACSTIMSVHNSVGCVPILKFGNDDQRERFLKPLASGEMLGAFALTEPQAGSDASSLKTRARLEGDHYVLNGCKQFITSGQNAGIVIVFAVTDPSAGKRGISAFIVPTDSPGYKVARVEDKLGQHASDTCQILFEDVKVPVANRLGEEGEGYKIALANLEGGRVGIASQSVGMARAAFEAARDYARERDTFGKPIIEHQAVAFRLADMATQIAVARQMVHYAAALRDSGQPALVEASMAKLFASEMAEKVCSMALQTLGGYGYLNDFPLERIYRDVRVCQIYEGTSDIQRMVISRNL

SEQ ID NO: 14088 - protein, 377 aa, Pseudomonas fluorescens
HDLELTEDQVMIRDMARDFARGEIAPHAQAWEKAGWIDDGLVAKMGELGLLGMVVPEEWGGTYVDYVAYALAVEEISAGDGATGAFMSIHNSVGCGPVLNYGSEEQKQTWLADLASGAVIGCFCLTEPQAGSEAHNLRTRAELRDGQWVINGAKQFVSNGKRAKLAIVFAVTDPDLGKRGISAFLVPTDMPGFIVDRTEHKMGIRASDTCAVTLNNCSIPEANLLGERGKGLAIALSNLEGGRIGIAAQALGIARAAFEAALGYARDRVQFGKAIVEHQSIANLLADMQMQINAARLMILHAARLRTAGKPCLSEASQAKLFASEMAEKVCSSAIQIHGGYGYLEDYPVEKYYRDARITQIYEGSSEIQRMVIAREL

SEQ ID NO: 14089 - protein, 408 aa, Pseudomonas fluorescens
DPLLKLLQKPLFDPEKRHRVSLREYMDLNIDRMRAIIGNGLMTNAMWLSQPRQSEFRLMLERAALIGAVDYSLLACIVDHFIAGDAFFAHGSQHQIAQYHQEICQLKAVYAFGCTEIASGSDVANLQTTINYDPHKHCLILNSPTPQSCKFWIGNALHAAVVVMVLGRLIVKGVDEGLHWFRVRIREQENGPLLPGVRITTCDPKGGIHANQVAGIRFCNMKLPLDALMQRYARFSAQGVFSSEIPPKERLKSAMQTFIQERLFLIAGARGAASMCVYLAYRFACHRLVKGNEGSQSLLTKALFRQRLYAEQLKVLALKLLEQAVLSRFEACWHQPARRKELHILAAVVKSVGTWLGLEVMSACRELCGSQGFHHHNRIVTLVMDHGISTTFAGDNNILCCQVARDAI

SEQ ID NO: 14090 - protein, 290 aa, Pseudomonas fluorescens
  unsure (1)..(290): unsure at all Xaa locations
ANVRVLDGGMGRELKRIGAPFRQPEWSALALIEAPEYVLQAHQAFVTAGARIITTNSYAVVPFHIGDERFAEQGRALAERAGRLARQAAGESTRSGHRGRVVAAGTGVVPAGSVRSSGFSSYSPRTDCRIAGARRCVAGRNAQLHCXSACGGRSPRNGSRATLGVIHAVGREGREPRLRSNEAVADAVRVAAELGAKAVLFNCSQPEVMAAALIEARAVIENLDHPVELGVYANAFPPVSAKAEANSDLLEIRRDLGPESYLDWSKSWVAAGASIVGGCCGIGPEHIAQL

SEQ ID NO: 14091 - protein, 143 aa, Pseudomonas fluorescens
EQATFGAGCFWGAEASFRALPGVLDTRVGFARSDLGDATLIEVVQVDFDPRLISYSRLVEHFWTLHDPTSVDRQGADVGAKYRSALFFNSAEQSRLALVARQQLDASGQLGKPVATVILPLGEFQKANEEHQRYLEKHGGSAC

SEQ ID NO: 14092 - protein, 406 aa, Pseudomonas fluorescens
KSRWYSQLYVQVLIGIVIGAAIGYFVPDIGAKLQPFADGFIKLIKMLLAPIIFGTVVVGIAKMGSIKEVGRIGVKALIYFEILSTIALVVGLIVVNIVKPGVGMNINVNALDGNAISKYSQAASEQGGTIDFFLNIIPHTFLGAFSNGVMLQVILLSVLMGVALVQMGETSKPLINTIDLFLQGLFKIVAMVMRLAPIGAGAGMAFTIGKYGIGTLLSLGQLLIALYITTLIFIVVVLGTVARWSGMPLMQFLRYFKDEILITLGTCSTEAVLPRMMVKLEKLGCKKSVVGMVLPTGYTFNADGTCIYLTMAAIFIAQATNTPLTFVDQMILLGVFLLTSKGSAGVAGAGFVTLAATLTTIHSIPLVGLVLLLGIDRFLNEARAVTNLIGNGIGTIAIAKWDNSFD

SEQ ID NO: 14093 - protein, 241 aa, Pseudomonas fluorescens
MNSTGNTILVTGGTSGIGLGLALRLHKAGNNVIIAGRRKALLDKIVSENPGIESVLLDVSDAHSIQRTSEALAISHPNLNVLINNAGIMHWEDLTDPGYLSTAEDIVTTNLLGTIRMVYAFTPQLIKQPGATVINVSSSLAFVPLPATPTYSATKAAVHSFTQSLRVQLEASPVEVIELAPPGVRTTLLGQENDEHAMPLEEFLDEVFELLKISPTPPELVVERAKPLRFAEASGSHDDVL

SEQ ID NO: 14094 - protein, 689 aa, Pseudomonas fluorescens
RVVDGLALIGLDRAPVNALDQTLRAALIDACERAATDIAVGAVILYGVQGLFSAGTDIKEFGTEACFAEPDLPGILTRLSALHKPLIAAIGTFALGGGLELALACGYRIGAPDARLGLSEINLGLMPGAGGTQRLPRLIGAESALNLILSGEQIDAERARMLGILDRISSSTEQLLEEARAYANELIECCAPARPAEAWPNPAEDLPDDFLARYRVEHEPRWKSRLAPRLVLSALEAACLLPLEEGLVRELTLFKQAEASRQSKALRHVFFAEQDARRTPRIDTADPSRKINKVAVIGAGTLGGGIAMSFADVGIPVALMDLDGRTLDRGLKRVRENYQLSVKRGKLSAVQMQQRMELLFGTLDYADLSDADLIIEAVCEKMESKHQVFLALESVCKPGAILATNTSSLDIDALAKMVSRPQDVIGMHFFSPANVMRLVEIVLCQTTAPDVVTAVMDIARRIGKLPVISGNSAGSIGNRMLEPYAREAHRLVLEGATPVQVDAVLTSLDLNMGVFSMLDLAGIDVSFLMRDANREAIAHDQSYCCLAEELYALGRYGQKTGRGFYLYEGRSPREDREVIMLAEQLAREHNVTRRNIEDLEIHDRCLFVMINEGIRLLDEGIALRASDIDLVWINGYGFPAHLGGPMHYAEQLGLETVLSRIHHYRSALGEYGEMWFRPAALLERLVAAG

SEQ ID NO: 14095 - protein, 247 aa, Pseudomonas fluorescens
LAGRTVLITGASSGIGAHLARVAGHAGARVVLTARRVERLAQVAKDIEWDCGQALSVELDVTDRNSVEAAFDAAEAHFGVVDVVLNNAGIGNGQRPLEISEEQWREMLSTNLDGVWRVAQVAAQRLAKAGRKGSIVNVASILGLRVSTGYSHYCAAKAGVVQLTKSLALELARYNIRVNAIAPGYFKTEMNEAFFEGDKGNSYIRDRVPMRRLGQLHELAGPFLLLASDAGAFMTGSVLTVDGGHLV

SEQ ID NO: 14096 - protein, 389 aa, Pseudomonas fluorescens
LTEEEAAIQASVHRFAKEVLRPLGRELDRMTPEEVVAPGSPYYSLFGEFAKLGLDPALLAQLPPEMAVRIESLIGEELGWGDAGLAVSLGCADFPLQMAIAAGNAELVELCQGRIGCWMATQPDRGSDNQIFDMARDWPAGKLGNIGNLTAKVVGDEVILNGQSSAWVSNGAIAQVALGLMCADYGDGFYDENGRPHGIALIIPLDLKGVSKGKPLDKIGQRSLPQGEIYFDSVRVPRRFAIAERDQYYGAVSSSWSFAGTHMSQVFTGVARAAFEMALQYCHERRQGGHPLIDHQMTRLRLGEMLRRVEAARAVARRSLSFARLSPQTHPYATASAKVTVTEEAMAVVQEAFRLFGGNGTTREYPIEKLLRDTQSSLIEDGENRVLTM

SEQ ID NO: 14097 - protein, 514 aa, Pseudomonas fluorescens
NCEVTDMAIIDFFDRGWRINPHGAAYIQDDRVFTFTEVRNLSCRIANALLAAGLPSGTKGAIWSANDAVAWTCTLGLWRANLCWIPVGARNSAEENRHVLDAFDCEVLFFQKEFAPIIDALRPGLPKIRLWICIDEHLPGAPSLKSWIDGQPVTAPEVEYQLDDVVALSPTGGTTGLPKGVMNTHRSIQTFCAHFMINFPYGDDHPPVNLAAAPMTHTAGTLSLPCTSRGGTVVIITKPDPALMLAMIPKYKVTETFLPPTVIYRLLDVPDLAQKVDFSSLKYFLYGAAPMSVDKLKQAIETFGPVMAGGYGQTEAPASISNLPPAEHLHGGRLASDERLSSVGRPNPLVRVEILSDAGDILGQGQTGEICVRGDLVMKGYYKDPQKTAETIIDGWLHTGDIGHLDAHGYLHITDRKKDMIISGGFNVYPSEVEQVLWSHPAVQDCAVIGVPDEQWGEGVKAVVELSAGLTVTAEELIELCKSRLGSVKSPKTVDFIDALPRSPVGKVLKKDLR

SEQ ID NO: 14098 - protein, 396 aa, Pseudomonas fluorescens
MEPIYIAGIAMTEFGRHLERSLQDLALEALQGALADSGALRADIGAVFYAGITNGHLQGQLSIPGQVLCSKIGLEGVPVYNVENACASGSTAVHLAVQSLRSGATDVALALGAEKMNVPDKSRALALFETGWDVSTAEENYATLVKMGEGIIVPPGSESDRPYSKFMAIYAAMCRWHMKTYGTTQRQIAAVCAKNHQHSVHNPYSQFRKTFSIEEVLAAPPITYPITLPMCAPLSDGAAAAILCTEAGLKRIGADPKRCVRIAASVIRSFTLRGLDEPHKHVSLLAAREAYEIAGLGPQDMHVAEVHDASAMGEIIQSENLGLAPLGEGGVCAERGDFTLGGRLPINTSGGLESKGHPLGATGIGQLYELVTQLRGEAGPRQVHGARHAIQENGGG

SEQ ID NO: 14099 - protein, 434 aa, Pseudomonas fluorescens
DVVIIGAGLAGLTAARDLHLAGCESLLVLEARDRVGGRTLNHDLGSGYISEAGGQWIGPGQTAVADLARELEVGTFPSFYDGETVILGGDGRVAVDLKGTFGTDESVSAKLSELSRDVPCGAPWKSPRVAELDKLSAGDWLAQQNIKPEDRAGWNASFLLTCGVTPAKMGFLHFLSMINSAGSEYMRLDSIKDSAQGTRIVGGSQVLSSKMAQLLGDRVRLSCPVRKIADWNRDIVRLQTDQGEIRARRVIMAIHPALCQRLQFDPPLPEARAALQRAWPAHSPARKTAMVYPRPFWRDKGLNGHIIQVGGPVIWAYDNSPPNGEIGVINAFILNAAAPTDPEAAKRVQTEIYARALGDAALEPVSYHDHDWAHFDPWTITCVSPIPPGFWSTHGEALRPPCGNLFWSGTETADIWAGYMDGAVRAGRHSALQV

SEQ ID NO: 14100 - protein, 434 aa, Pseudomonas fluorescens
  unsure (1)..(434): unsure at all Xaa locations
LDVVIIGAGLSGLTSARDLQAAGCESFAVLEARDRVGGRTLNHDLGNGVISEAGGQWIGPGQTSIADLARQLDVATFPTYYKGKAVIXWTRSTSRKISATGRIPIQKSVAKLNKLAEGVPSKAPWKAKDAAELDKLSVGQWLAGQGISNVDKIGFNMSVSLTFGTTPAGMGLLHYLAMINSSDCRLEKLEGLQGGAQESRLAGGSQILSLKMAQALGDKIRLACPVRKIVGWDRDVVELHTDQGIIRTRQVIAALSPALCNQILFDPPLPSGRAELQRHWPAHAPMRKTVHVYERPFWRDQGLNGQIVPVEGPLIWAFDNSPADGSLGVLSGFVRTGQLPHDPKTAQDILSAIYASAMGEQALHPIQFHDLDWGKIDPWSLSCISPMPPGFWTQWGEYLTPAVGRLIWSGTETAEIWAGAMDGAVRAGHRAAME

SEQ ID NO: 14101 - protein, 567 aa, Pseudomonas fluorescens
TVGDFLVERLSQWGVTRIFGYPGDGINGVFGTLSRAGGKIEFVQARHEEMAAFMASAHAKFTGELGVCIATSGPGASHLITGLYDARLDHMPVLAIVGQQARTALGSHYQQELDLVSMFKDVAGAFVQQASAPSQVRHLLDRAVRTAIGERRVTALILPNDLQDLEYKAPARAHGTAHSGVGYSKPKVLPYDADLQRAADVLNAGEKVAILVGAGALHASEQVFAIAEKLGAGVAKALLGKAVLPDELPWVTGCIGLLGTEPSYKLMTECDTLLMIGSGFPYAEFLPKEGQARGVQIDLQPDMLSLRYPMEVNLAGDAAETLAALAPLLEHKPLRKWRKKIEGWRASWDKTLEKRAMAKADPVNPQRVVYELSPRLPEQAIITSDSGSCANWFARDLKIRKGMKCSLSGGLASMGAAVPYAIAAKFAFPQRPVIALVGDGAMQMNNMAELITVAKYWRQWDSPKWICAVFNNEDLNQVTWEQRVMEGDPKFGASQSIPDVPYHLFAISIGLKGIFVDREEDVAAAWEQALASEVPVVIEFKTDPNVPPLPPHIKLEQAKKFASTLLK

SEQ ID NO: 14102 - protein, 252 aa, Pseudomonas fluorescens
MSGKFSDQVAVVTGGSTGIGFSIAQALIAEGAKRVYITARAADRLEAAVARLGDKAVAVVSDVSRQADLDALKATIQTRDDRLDAVFANAGICEKNPLGETSEAAYYAMFDVNVKGVFFSVQTLLPLMKDASSIVLTASICSSNGMEGLSLYNASKAAVRSFARTWANELKDRKIRANVLSPGFTRTPLMDNGLKMSESDIAALRQHVEQITPLGYMAQPEEIASAALFLASDDARYVNGVELMVDGGLSQI

SEQ ID NO: 14103 - protein, 249 aa, Pseudomonas fluorescens
MLLQGKVAIITGAASARGIGRATATTFAQHGAWVVILDLDASAARDAAASLGEGHLGLAANVADESQVQQAVATVIEHFGRIDILVNNAGITQPLKTLDIRPGDYDKVLDVSLRGTLQMSQAVIPLMRQQASGSIVCMSSVSAQRGGGIFGGPHYSAAKAGVLGLAKAMARELGPDNVRVNSIAPGLIHTDITGGLMQDERRHAIIDGIPLGRLGEAQDVANAALFLASDLSSYLTGITLDVNGGMLIH

SEQ ID NO: 14104 - protein, 257 aa, Pseudomonas fluorescens
ALITGASTGIGSIYAEHLARRGYDLVLVARNRERLNALASRLTSETRQNIEVLQADLGRPEDLAKVERKLREDASITLLVNNAGIGTHTGLLESDVERMAEMITLNVTALTRLTYAAIPGFVARERGAVINISSIVSLAPELLNGVYGGSKAYVTAFTQSLHKELSDKGIRIQAVLPGATATDFWQIGGLPVEHLDPGIVMSAQDLVAGALQDFDNGVLISIPSMHDLQGYERYEASRQALFSELSSNRLAPRYNAN

SEQ ID NO: 14105 - protein, 783 aa, Pseudomonas fluorescens
VIIALLGLALAAGGVKLVSLGGSWYFLVGGLVMAVSGLLIARRKPAGAWLFAAFLVGTAIWAVIDAGLVFWPVFSRLFMFSAVGLVVALVYPLLKRANGDVAGRGAYGVAAVLAVGLAVAAGNMFVAHPTVAPTGTGPGLTPVEPEKAQKDWAHYGNTEGGSRFAALDQINRSNRRQAESGVGPTTPATIAESDGNGAEDQLTPLQIGNKVFICTPHNNLIALDADTGKELWKNAINAQSKVWQRCRGMAYFDASAAVAKPASAPVSETPTAPIANCTRRLLTNTIDARLIAVDADTGEFCRGFGNNGQVDLKAGLGDVPDSYYQLSSAPLMAGTTVVVGGRVADNVQTDMPGGVIRGFDVMTGAMRWAFDPGNPTDRKAPADGSTYVRSTPNSWAPMSYDPATNTVFLPMGSSSTDIYGVERSKLDHTYGASVLALDANSGEEKWVFQTVHNDLWDFDLPMQPSLIDFTKDGKTVPAVVIGTKAGQIYVLDRATGKPLTDVKEVPVKAANIPNEPYSPTQPKSVGMPQIGAQHLTESDMWGATPYDQLLCRIDFKSMRYDGLYTAPGTDKSLSFPGSLGGMNWGSISTDPVHGFIFVNDMRLGLWIQMIPSQNKAQASSGGEALNTGMGAVPLKGTPYAVNKNRFLSVAGIPCQAPPFGTLTAIDMKTQKVAWQVPVGTVEDTGPLGIRMHLPIKIGLPTLGGTLSTQGGLIFIAGTQDFYLRAFNSANGEEIWKARLPVGSQGGPMTYVSPKTGKQYVVITAGGARQSTDRGDYVMAYALP

SEQ ID NO: 14106 - protein, 1020 aa, Pseudomonas fluorescens
  unsure (1)..(1020): unsure at all Xaa locations
MDLSRRQFFKVAGIGLAGSSLGALGMAPTQAFAEQVRHFKLAHTHETRNTCPYCSVGCGLIMYSQGDAAKNVAQNIIHIEGDADHPVNRGTLCPKGAGLLDFIHSPGRLQYPQVRKPGSSEWTRITWDEALDRVADLMKADRDANFVEQNAQGQTVNRWLTTGFLAASAASNEAGYITHKVVRSLGMLGFDNQARVXHGPTVASLAPTYGRGAMTNTWTDIANANLILVMGGNAAEAHPCGFKWVTEAKAHNAARLIVVDPRFTRTASVADYYAPIRTGSDIAFMGGLINYLLTEDKIQHEYVRNYTDVSFIVRAGFGFEDGLFTGYDAAKRSYTDKSTWGYELGEDGFVKVDPTLQDPRCVYQLMKQHYSRYNIDLASQICGMPVDAMKKIWEEIATCSAPGKTMTILYALGWTQHSIGSQIIRSAAMVQLLLGNVGMPGGGVNALRGHSNIQGLTDLGLLSNALPGYLTLPTDAEQDYAAFIHKRTQVPLRPGQLSYWQNYSKFHVSLMKAWYGANATAENQWAYHYLPKLDIPNYDILKVFDLMGQGKVNGYMCQGFNPIAALPDKNRVMAALAKLKWLVVMDPLATETSQFWEHVGPFNDVKSADIQTEVIRLPTTCFAEEDGSLVNSSRWLQWHWKGADGPGEARTDVQIMSALFLRLRERYQAEGGKFADPLLKLSWPYKIAEEPSPEEIAKEVNGYATTDFTDATGAAIKGNSQLAGFAQLKDDGSTASGCWIFCGSWTEAGNQMARRDNNDPYGMHQHQGWAWAWPANRRILYNRASADVAGKPWDPKKRLVWWNGKAWGGTDVPDYKADVPPEAGMNPFIMNPEGVARFFAVDKMNEGPFPEHYEPFETPIGINPLHPDNKKATSNPAARIFDSVWDSLGVAKDYPYAATSYRLTEHFHFWSKHCKLNAIAQPEQFVEIGEVLAKEKGIVAGDRVRVSSKRGFIEAVAVVTKRIRPLQVNNQVVHQIGIPLHWGFTGLTRHGYLTNTLVPFLGDGNTQTPESKSFLVNVEK

SEQ ID NO: 14107 - protein, 273 aa, Pseudomonas fluorescens
PKQAQPVPGSQRKMEPYPDCGEQSYTGSGRLAGKIALITGADSGIGRAVAIAFAREGADVAVAYLNEHEDAKETARWVEQAGRQCLLLPGDIAQKAQCQALVDQTVEHFGRIDVLVNNAAFQMTHETFEEIPDDEWVMTFDVNITAIFRLCQAAIKHMGPGSSIINTSSINSDMPKPTLLAYATTKGAIANFTGGLAQMLGPREIRVNCVAPGPIWTPLIVSTMPDEEVQHFGEQTPLGRPGQPVEVAPIYVLLASDEASYITGQRYGVTGGK

SEQ ID NO: 14108 - protein, 752 aa, Pseudomonas fluorescens
GRLSYSIAVRALCEFTAKTGDLDLRFTPSPTALEGIAGHRTVASRRNDAYQSEVALEGAFGPLKVKGRADGYDPKQNCLEEVKTYRGDLSKQPANHRSLHWAQAKIYGWLMCCRLQLEQINLALVYFDIVTEKETCLVEAFSADALRQFFEQQCGLFLAWAEQEMAHREARNRAAQQLGFPHAAFRPGQRHLAESVFKAVSTGRCLMAQAPTGIGKTLGTLFPMLKAMAPQQLDKVYFLTAKTPGRKLALDAAQVLFDHSETLPLRVLEMVARDKACEHPDKACHGESCPLAQGFYDRLPAAREAASQLRLLDQAALREVAAQHAVCPYYLSQEMARWADVVVADYNYYFDFSALLFGLAQFNQWNVAVLVDESHNLVERGRQMYSATLDQATLGSVRKTAPEALKKSLQRVNREWNALHNDQLAPYQAYDKAPEKLLQALSSCTASIGDYLNDHPQGLDSGLQNFYFEMLQFGRVAELFDAHYLFDISKRDLERKRPLSQLCLRNVVPAAFIGPRLTAARSSVLFSATLSPRHYYADLLGTPADTVWIDVESPFSAEQLQVQIVSRISTRFTHRQASLEPIVELIARQFSERPGNYLAFFSSFDYLQQVAQLLAERHPHITRWQQSRGMDEGARQAFLDQFTADSQGIGFAVLGGAFGEGIDLPGARLIGAFIATLGLAQLNPVNEQMKRRMAAIFGAGYDYTYLFPGVQKVVQAAGRVIRTQQDRGVVMLIDDRFAEGRIRQLLPRWWQI

SEQ ID NO: 14109 - protein, 592 aa, Pseudomonas fluorescens
MAKAPATAPLFKALGDYKSILISVGCFTALINVLMLVPSIYMLQVYDRVLSSQNETTLAMLSLMVVGFFAFIGLLEVVRSFIVIRIGSQLERRFNLRVYQAAFERNLFKGEGNAGQSLGDLTHIRQFVTGPALFAFFDAPWFPVYLFVIYLFNVWLGVLATAGALLLIALACLNEYMTKKPLGEAAGFSQKSSQLATSHLHNAETIQAMGMLGALRKRWFQVHSRFLGLQNQASDTGAVISSLSKTLRLCLQSLVLGLGALLVIKGDMTAGMMIAGSILMGRVLSPIDQLIAVWKQWSGAKLAYRRLDALLQAFPPSDDAMALPAPKGQITFEQVSAGPPGQRAATLHMVNFNLAAGEVLGVLGASGSGKSTLARVLVGVWPALGGTVRLDGADIHRWNRDQLGPYIGYLPQDIELFSGSIAENIARFSEADPQKVVAAAQQAGVHELILRMPQGYDTQLGEDGSGLSGGQKQRVALARALYGNPSLVVLDEPNSNLDTVGEAALSSAIVQLKAQGTTVVLVTHRSSVLAQADKLLVLNDGRLQAFGPSHDVLKALSGNQPGNQPQQNEKPAQAPAGLSMSRQYQPTTRNSG

SEQ ID NO: 14110 - protein, 554 aa, Pseudomonas fluorescens
  unsure (1)..(554): unsure at all Xaa locations
TLSPFAGKPAPAELLVDIPRLVTAYYTGQPDASVSTQRVAFGTSGHRGSSFDLSFNEWHVLAISQAICLYREAQGITGPLFVGIDTHALSTPAGASALEVLAANGVTVMIAEGDEYTPTPAVSHAILCYNRGRTTGLADGIVITPSHNPPQSGGYKYNPTNGGPADTHITKWIEAKANELLANKLAGVKRISYEQALKAETTHRHDYVNTYVADLINVIDFDAIRGAKLRLGVDPLGGAGVRYWSAIAEHYRLDLDVVNKEVDSTFRFMTVDWDGQIRMDPSSSHAMQGLIGLKERFDVAFACDPDHDRHGIVTPSGGLLAPNNYLAVSIDYLFQNRPQWRADAAVGKTVVSSGLIDRVAKRLGRRLYEVPVGFKWFADGLFDGSLGFGGEESAGASFLRKDGGVWSTDKDGLIPALLAAEMTARTGRDPSQAYRALTDELGEPFSVRVDAKANPEQKALLSKLSPEQVTSTELAGEKIQSILSKAPGNDQAIGGLKVMTENGWFAARPSGTEDIYKIYAESFIGDDHLKQLVAEAQMLVDGAISTQXIQATEK

SEQ ID NO: 14111 - protein, 337 aa, Pseudomonas fluorescens
MSRTIRFHKFGPAEVLKCEEHAAAQPGPGEVQVRVEAIGISWYDTLWRQNLASSQARLPSGLGHEMAGVVTAIGDGVEDLAVGDKVASFPAESPNDYPVYGELIVLPRTALTRYPDVLSPIEASVHYTPLLIAYFGYVDLARVKPGQFALVTDASHCAGPSFVQLGKALGVRVIAATKTAEEREYLLSLGAEKVIVTEEEDLLMRINKITDNRGVDVVFDGLGGPQMSLLGDVLAPRGSLVLYGLQGGNQTPFPACAAFQKNIQFFVHCIGNFTGKPELGIIQDHVALQRALRDINQLTADRVLLPLKTRVFPFNEFVEAHRYMDECPCRERVALQI

SEQ ID NO: 14112 - protein, 1034 aa, Pseudomonas fluorescens
  unsure (1)..(1034): unsure at all Xaa locations
VGDVCAVDDRSATRERXLQVRGQSGEGQAPDRRNTXTVRRCNXNRTVAACFTQRRRAPHHDLEHQPLSAVCGRYQRSAGLCRSADLVNLSQSYGATLAAQEASAKRLEQQAWLRNGQTQLAEQVLGQLTVNLLGRNILQFCAQYLGSAVAALYVREEHGGLKRVATYGFSREQEQQNQSIYSEEGLVGQVAQQARLIRLDSVPSDYFKVSSGLGEGLPRSVLVVPTSDDERVNGVIELGFLRPLTDRDVALLELIAGNIGTSIEAARYRQRLQEVLAETQQLNEELQVQQEELKTANEELEEQSRILKESQAHLETQQVELEQTNEQLAEQAQTLAEQRDAMDQKNTELNQAQVQLEERAEELQRSSKYKSEFLANMSHELRTPLNSSLILAKLLAENPQENLSAEQVKFAESIYSAGNDLLNLINDILDISKVEAGKLEVMPENTSVARLADGLRGMFEPLAAVKQLAFSVQLQPDAPSTLFTDRQRLEQVIKNLLSNAVKFTEHGTVSLTIAGQPDDRIAFIVRDSGIGIAADQQESIFEAFRQADGTTNRKYGGTGLGLSISRDLATLLGGSISVSSAPGQASVFTLVLPQHYREPGDAPVAPLTFSPPAAAPVMASAVAVSPLASVEIPRFNDDRDKAPFNTRCILVVEDEPNFAHILYDLAHELGYQCLVAHGADEGYDLAKEFVPDAILLDMRLPDHSGLTVLQRLKEHAGTRHIPVHVISVEDRVEAAMHMGAIGYAVKPTTREELKDVFARLEAKLTQKVKRVLLVEDDDLQRESIARLIGDDDIEITAVGLAQDALELLRTTIFDCMVIDLKLPDMLGNDLLKRMSTEDICSFPPVIVYTGRNLTRDEEADLRKYSRSIIIKGARSPERLLDEVTLFLHKVESQLSHERQKMLKTARSRDKVFEGRKVLLVDDDVRNIFALTSALETKGAVVVIGRNGREAIEKLNEVEDIDLVLMDVMMPEMDGFEATMEIRKDPRWRKLPIIAVTAKAMKDDQERCLQAGANDYLAKPIDLDRLFSLIRVWLP

SEQ ID NO: 14113 - protein, 498 aa, Pseudomonas fluorescens
MHKQQLFLGIDCGTQGTKAIILDATSGQVLGQGAAAHTMISGANGRREQDTAQWLEAFTLGTRRALLAANVDGQSILGIGVSGQQHGLVLLDDQGQVLRPAKLWCDTETTPENDQLLAHLGGEQGSLERLGVVIAPGYTVSKLLWTKEQHPNVFSRIARVLLPHDYLNFWLTGRACSEYGDASGTGYFNVRTRQWDLQLLRDIDASGRLQSALPELIDAHQAVGTILPAIAEQLGINPNAVVSSGGGDNMMGAIGTGNIQPGAITMSLGSSGTVYAYAEAPKVSPDASVATFCSSSGGWLPLICTMNLTNATGAIRELFNLDLDAFNALVAQTPIGAEGVSMLPFLNGERVPPLPHATGSLHGLTIDNLTQANLCRAAVEGTTFGLRYGLDLLRQNGLQSRSICLIGGGSKSAVWRQIVADIMNTPVICTEQSEAAALGAAIQAAWCKSWSNGHEDTLADLCQRCVKLDLNSETLPVAANVAAFQQAYERYRLHVATL

SEQ ID NO: 14114 - protein, 311 aa, Pseudomonas fluorescens
MYLVCGEALFDFFSEDDAGGQASKVNFKAIAGGSPFNVAVGLRRLGVDSALFGGLSTDYLGRRLQQVLQDEGVHPDYLVDFAAPTTLAMVAVGANGSPHYSFRGEGCADRQLSLAHLPALGPEVRGLHFGSFSLVVQPIADTLLALVQRESGKRLISLDPNVRLNPEPNIDLWRERIATLVPLADLIKVSDEDLSLLYPEQDPARVIEGWLQHRCQVVFLTRGGEGATVFSRVHGSWSVPASSVKIADTVGAGDTFQAALITWLTEHELDSVEGVQHLSREQIDGMLRFAVQAAALTCSKTGPDLPYRHQL

SEQ ID NO: 14115 - protein, 496 aa, Pseudomonas fluorescens
  unsure (1)..(496): unsure at all Xaa locations
PTTLFLFGAHGDLVKRLLMPALYNLSRDGLLDDGLRIVGVDHNAITDEAFAQKLEDFIRTEVAAKVGKGDQMLDPALWAKLAKGISYVQGDFLDDSTYSALAAKIADSGTGNAVFYLATAPRFFSEVVRRLGSAGLLEETAEAFRRVVIEKPFGSDLQTAEALNACLLKVMSEKQIYRIDHYLGKETVQNILVSRFSNSLFEAFWNNHYIDHVQITAAETVGVETRGSFYEHTGALRDMVPNHLFQLLAMVAMEPPAAFGADAVRGEKAKVVGAIRPWTTEEARENSVRGQYSAGEVAGKPVSGYRDENNVSPDSTTETYVALKVMIDNWRWVGVPFYLRTGKRMSVRDTEIVICFKPAPYAQFRDTEVDELQPTYLRIQIQPNEGMWFDLLAKRPGPALNMANIELGFAYKDFFEMQPSTGYETLIYDCLTGDQTLFQRADNIENGWRAVQPFLDAWQQDASVQTYAAGEDGPKAADDLLTRDGRVWHGLGXVSR

SEQ ID NO: 14116 - protein, 324 aa, Pseudomonas fluorescens
MQLGIIGLGRMGGNIARRLMLNGHTTVVYDRNTAFVDTLAAEGSTGVADLPALVAGLAKPRAVWVMLPAGAPTEDTIETLSHLLEAGDTIIDGGNTNYKDDIRRAKTLAEKGLHYIDVGTSGGVWGLERGYCMMIGGDAETVKRLDPLFAALAPGMGDIPRTKDRKSDDHRAEHGYIHAGPAGAGHFVKMIHNGIEYGMMAAFAEGFDILKTKSSELLPEDQRFDLNVADIAEVWRRGSVVSSWLLDLTADALAVDPKLDGFSGSVADSGEGQWTIEAAMEQKVPVPVLSNSLFSRYRSRGQGTFGDKILSAQRFGFGGHVETP

SEQ ID NO: 14117 - protein, 272 aa, Pseudomonas fluorescens
ADVAVSGVPFDTATSNRPGARFGPRGIRAASTGIAWERHWPWAFDPFDHLAVIDYGDCDFDYGSPHTIPDSIEAHAEHILSSGSAMLTFGGDHFISYPLLKAHARKHGTLSLIHFDAHSDTWPDEGGKRVDHGTMFWHAAREGLVDPARSVQIGLRTTNDDHQGFQVLDARQVHRCGCEAIIEAIRARVGDNPVYLTFDIDCLDPAFAPGTGTPVCGGLSTVQALEILGGLRGINLVGMDVVEVAPAYDHADVTSLAAATLAMEMLCLYAAR

SEQ ID NO: 14118 - protein, 328 aa, Pseudomonas fluorescens
VSLDELTQLLETIFTRHGTSAEVARTLATNCANAERDGAHSHGVFRIPGYVSTLNSGWVNGKAVPKVEDVASGFVSVDAGNGFAQPALAAARPLLVEKARSAGIAVLAIRNSHHFAALWPDVEPFADEGLVALSVVNSMTCVVPHGADRPLFGTNPIAFAAPRADGAPIVFDLATSAIAHGDVQIAARKGEKLPAGMGVDSLGQPTCDPKAILEGGALLPFGGHKGSALSMMVELLAAALTGGNFSFEFDWKNHPGAKTPWTGQLLIVIDPSKTAGQSFAERSQELVRQMHGVGLKRLPGDRRHLQRTKSLVKGIELDQQTLSQLREL

SEQ ID NO: 14119 - protein, 467 aa, Pseudomonas fluorescens
KVLFVTSEIADLVKTGGLGDVSAALPRAMAHLHDVRVLIPGYPQVMNSENPIHIIGELGGHAALPPCKIGRMDMPDGLVIYVLICPELYARDGGPYGANNGRDWPDNHIRFARLGLAAADIAANLAQIHWCPDLVHAHDWPAGLAPAYMHWRGQRTPTLFTIHNLAYQGVTSLGSCPELGIPAHALQQEGMEFYGKMSFLKAGMAYSSHITTVSATYAQEITTPDFGCGLDGFLAAKTQQGLLSGIPNGIDESWDAATDPHLFAPFAIGDWEGKAINAAHVRELFGLKDSEGPLFAVVSRLVYQKGLDLTEAVSEYIVQNGGQIAIIGRGEPEEEQAMRELALRFPGQIGVRIGFNETDARRMFAGSDFLLMPSRYEPCGLSQMYAQRFGSLPVARNTGGLADTIENGVTGFLFNESTADSYREALSRAFKVFAFPELLNAMRCRAMAAPFNWCKAVEPYAELYEKL

SEQ ID NO: 14120 - protein, 700 aa, Pseudomonas fluorescens
PSRIREGLPFPLGATWDGLGVNFALFSANATRVELCIFDDAGEVELERIELPEYTDEIFHGYLPDAHPGLIYGYRVYGPYDPANGHRFNHNKLLIDPYAKQLVGELKWSEALFGYTIGHPDADLSFDERDSAPFVPKCKVIDPAHTWGHDHRVSVPWDKTIIYETHVRGISMRHPSVPENVRGTFAGLMVDDVLEHIRKLGVSTVELLPIHAFVNDQHLLHKGMTNYWGYNSIAFFAPDPRYLASGKIAEFKEMVAHLHDANLEVILDVVYNHTAEGNEQGPTLSMRGIDNASYYRLMPDDKRFYINDSGTGNTLDLSHPCVLQMVTDSLRYWASEMHVDGFRFDLATILGRYHDGFDERHSFLVACRQDPVLRQVKMIAEPWDCGPGGYQVGNFPPGWVEWNDKFRDTVRAFWKGDDGQLADFASRMTASGEMFNQRGRRPYSSVNFVTAHDGFTLNDLVSYNDKHNEANDENNQDGSNNNLSWNHGVEGPTDDPEINALRHRQMRNFFATLLLSQGTPMIVAGDEFARTQDGNNNAYCQDSEIGWVNWDLSEDGKTLLKFVKRLIKLRLAYPILRRGRFLVGEYNEDIGVKDVTWLAPDATEMTTEHWHDAQNRCMGMLLDGRAQETGIRRKGGDATLLLVVNAHHDIVNFTLPEVPEGSFWTCMIDTNQPSIRGQERFEFGHEYSVTGRSLLLFELQ

SEQ ID NO: 14121 - protein, 721 aa, Pseudomonas fluorescens
DIDALVRAEHHDPFSILGPHGDGAGGQFIRAYLPGALSVSVVDKNSGEELGPLEATETPGLFVGHFEGSRPYLLRTRWAGGEQVAEDPYSFGQLLGEMDLYLFAEGNHRDLSSCLGAQLKTVDGVDGVRFAVWAPNARRVSVVGDFNVWDGRRHPMRLRHPSGVWELFIPRLQAGELYKYEILGAHGILPLKADPMALATSLPPDTASKVASPLQIDWQDQDWMSGRRERQQHNAPLSIYELHAGSWQCELDDLGEVARQYTWPELAERLIPYVKELGFTHIELMPIMEHPFGGSWGYQLLSQFAPSARYGTPEQFGEFVNACHQAGIGVILDWVPAHFPTDTHGLAQFDGTALYEYGNPLEGFHQDWDTLIYNLGRTEVHGYMLASALHWLKHFHIDGLRVDAVASMLYRDYSRKAGEWVPNRHGGRENLEAIDFLRHLNDVVALEAPGALVIAEESTAWPGVSQSTQQGGLGFAYKWNMGWMHDSLHYIQQDPVYRAHHHNELSFGLVYAWSERFILPISHDEVVHGKHSLIDKMPGDRWQKFANLRAYLSFMWTHPGKKLLFMGCEFGQWREWNHDQQLDWYLLQYSEHKGVQKLVSDLNRLYREEPALHEQDDAPQGFQWLIGDDAINSVYAWLRWSKDGTPVLVVANFTPVPRQSYRVGVPFAGRWKELLNSDADTYAGSNYGNGGGAFTEEVASHGQALSLELNLPPLAVLILKP

SEQ ID NO: 14122 - protein, 245 aa, Pseudomonas fluorescens
VIVITGGGRGIGAATALLAAEQGYRICINYQTDEQAAHHVLDQVRERGATAIAVRADVSIEDEVIALFNRVDSELGRVTALVNNAGTVGHKSRVDEMSEFRILKIMKTNVLAPILCAKHAILRMSPKHGGQGGSIVNVSSVAARLGSPNEYVDYAASKGALDTFTIGLSKEVAGEGIRVNAVRPGYIYTDFHALSGDPDRVSKLESAIPMARGGRPDEVAEAIVWLLSDKASYATGTFVDLGGGR

SEQ ID NO: 14123 - protein, 554 aa, Pseudomonas fluorescens
MYEYDDYDRALVFERVAQFRDQVERFMAGELSEEEFLPLRLQNGLYMQKHAYMLRVAIPYGTLSAEQMRTLASIARDYDRGYGHFTTRQNMQFNWIELHEVPDILERLAQVNMHAIQTSGNCVRNITTEAFAGVAADELIDPRPLAEILRQWSTINPEFLFLPRKFKIAICSAKQDRAAIMMHDIGLYLYPGRDGQMLLRVIVGGGLGRTPILGLQIRDGLPWQHLLSYVEAVLRVYNRHGRRDNKYKARIKILVKALGIEAFAKEVEEEWQHLKDGPAQLTEDEYQRVASAFVPPSYRTLAGTDLDFGTHLAENPAFARWVARNVQPHKVPGYTSVVLSTKPGLAAPPGDVTDAQMQAVADWSERFGFGEIRIAHEQNIVLPDVPKSELFALWQQAKEQGLGAANVGLLTDIIACPGGDFCALANAKSIPIAQAIQARFDNLDYLHDLGDISLNISGCMNACGHHHIGNIGILGVDKNGSEWYQITLGGAQGKNSALGKVIGPSFSAAEVPQVIERIIGTFVRYREAEEQFVETVARIGLEPFKERVYPKALE

SEQ ID NO: 14124 - protein, 112 aa, Agrobacterium tumefaciens
EMNPRVSRSSALASKATGFPIAKVAAKLAIGYTLDELENDITGGATPASFEPSIDYRVTKIPRFAFEKFPGALAILTTDMKSVGEVMAIGRTFAESLQKALRGMETGLTGLD

SEQ ID NO: 14125 - protein, 243 aa, Agrobacterium tumefaciens
MKRNRKVKILATLGPASSEEAMIEKLHLAGADLFRINMSHASHDVMRTLIQRIRSVESRNGRPIGILADLQGPKLRVGKFAETKVDLVPGQTFTLDNNDTPGDNTRVFLPHPEILEAVKPGHRLLIDDGKLHLRAEKSDGKSIVTTVVSGTRISDRKGISLPDTLLGVGVLTDKDRVDLDAVLETNEVDWVALSFVQRPEDLAEVRKISRGRVGLMSKIEKPQAVERIEEIIELSDALMVARG

SEQ ID NO: 14126 - protein, 41 aa, Agrobacterium tumefaciens
LAIAHRLSTIAALDRLIVMDQGLIVEEGSHAELVAQGGLYS

SEQ ID NO: 14127 - protein, 290 aa, Agrobacterium tumefaciens
  unsure (1)..(290): unsure at all Xaa locations
ALAGLQIPIRXDNAHGAARILEIDVRXIVHRMGEGQVAVVAGFQGIGPDNRIATLGRGGSDTSAVAIAAAVKADRCDIYTDVDGVYTTDPRIEPKARRMKKIAFEEMLEMASLGAKVLQVRSVELAMVHKVRTFVRSSFEDPDAPGMGDLINPPGTLICDEDEIVEQEVVTGIAYAKDEAQISLRRVADRPGVSAAIFGPLAEAHINVDMIVQNISEDGSRTDMTFTVPSGDVAKALRVLDENKGQIGFDVAQNETGLAKVSVIGIGMRSHAGVARSAFKALAEEDINIR

SEQ ID NO: 14128 - protein, 147 aa, Agrobacterium tumefaciens
CLLPHGYEGQGPEHSSARLERWLQMCAEDNMQVANVTTPANYFHILRRQMKRDFRQPLILMTPKSLLRHKRATSSLAELAGESSFHRLLWDDAEVIKDGPIKLQKDAKIRRVVMCTGKVYYDLLEEREKRGIDDVYLLRVEQLYPFP

SEQ ID NO: 14129 - protein, 277 aa, Agrobacterium tumefaciens
EFASFYRTMGVDVTVVEIMSQVMPVEDAEISAFAKKQLEKQGIKIHLETKVSKVEKAANSVTATLEKKDGSSEKIIAERMISAVGVVANVEGIGLEAAGVKTDRGFIIIDGYGKTNVPGIYAIGDVAGPPLLAHKAEHEAVICVEKIAGLPNVHPMDKLKIPGCTYCNPQVASVGLTEAKAKEQGRDIRIGRFSCAANGKAVALGEDQGMVKTIFDKKTGELLGAHMVGAEVTELIQGFVVAMNLETTEEDLMHTIFPHPTISESMKESVLDAYGRV

SEQ ID NO: 14130 - protein, 211 aa, Agrobacterium tumefaciens
MAQMSSKVALVVGGAKGIGLAIAERLSEEGAKVFITSRRSEDAEKAATAIGHGAIGIAADAAIPEDMVATVEKVRKAHGRIDALVLNAGLSEPAQIAEITPEHFDRHFDVNVRGMVFGFQAALPAMTEGGSVVLVGSIADSGGYASYGTYAATKAAVRSYARTCDGRARIRRIRVNVVAPGPTDTEMMAAVQPDMRAAIVAPIPMGPMARP

SEQ ID NO: 14131 - protein, 450 aa, Agrobacterium tumefaciens
ENGGIILFIDEMHTLVGAGKAMAPMDASNLLKPALARGELHCVGATTLDEYRKHVEKDPALARRFQPVLVDEPNVEDTISILRGLKEKYEQHHKVRISDSALVAAATLSNRYITDRFLPDKAIDLMDEAASRLRMQVDSKPEELDELDRRIIQLKIEREALKQETDQSSVDRLRKLEDELADTEEKADALTARWQAEKQKLGHAADLKKRLDEARNELAIAQRNGQFQRAGELTYGIIPGLEKELAAAEARDSSGAGSMVQEVVTPDNIAHVVSRWTGIPVDKMLEGQREKLLRMEDELAKSVVGQGEAVQAVSKAVRRSRAGLQDPNRPIGSFIFLGPTGVGKTELTKSLARFLFDDETAMVRLDMSEYMEKHSVARLIGAPPGYVGYEEGGALTEAVRRRTYHVELFDEIEQAHADVFNVLLHVLDDGSLTDGQSRTVDFKNTIIIMT

SEQ ID NO: 14132 - protein, 247 aa, Agrobacterium tumefaciens
FSLENRTAIITGSGRGLGFEIAKGFAEAGAHVWLTGRNAETLQQAVDTLRKAGGKADYAAFDIADTAAGSALVRRIMDEAGHLDILVNNVGARDRRPLAEFTDDDVLELIRTDLTSSISLSRDAAEAMNANGYGRIITITSILGHIVRPGDAIYPVAKQGLTGLMRAIAVEYGARGITSNAIAPGMFATETNAALAENPDMVAFAKLRVPLERWGRPDEIAGAALFLASDAASFVNGHILTVDGGMS

SEQ ID NO: 14133 - protein, 450 aa, Agrobacterium tumefaciens
PKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPIQAPSCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKL

SEQ ID NO: 14134 - protein, 185 aa, Agrobacterium tumefaciens
GREEEIAILFCDLRNFTTLSEAKLPYDVVFLLNRYFTIVGQAVEQADGHLDKFIGDGAMALFGLGEDTDRACRNAMKAAATILRDIAILNEGLEKQFAVRLEVVVGIHSGPSIVGVMGYGAAKTLTAIGDTVNVASRLESKAKEFGAAIVVSEPAIIQAGQDIADLRSENIAIRGRNSQMKVYLL

SEQ ID NO: 14135 - protein, 228 aa, Agrobacterium tumefaciens
IMRGLRTVRHLCKICEDILAVCPNAVMLQYVNPMAINTWAIAEKYPTIRQVGLCHSVQGTAMELAHDLDIPYEEIRYRSAGINHMAFFLEFEHRQPDGSYRNLYPDLVRGYREGRAPKPGWNPRCPNKVRYEMLTRLGYFVTESSEHFAEYTPYFIKEGRDDLIEKFGIPLDEYPKRCIEQIERWKGQAAAYRSAEKIEVKQSKEYAFSIINSVWTGEPSVIYGNQRN

SEQ ID NO: 14136 - protein, 339 aa, Agrobacterium tumefaciens
  unsure (1)..(339): unsure at all Xaa locations
FKQHSGLEAEGYRIAFSNEAVTVEYSAAAGLQYGLTVLAQLLHGARIDPKFRFPASGTISDAPRYSWRGCHLDVSRQFYPTDDVLRLIDILAWLRMNRFHWHLTDDEAWRLEIKAYPXLTTVGATRGPDGPLLPQLGNGAEPVSGYYTQDNVRLVVAHAAALNVEIVPEVDIPGHSTAALVAYPELTDGQEAPDSYRSGQGYPNNALNPAIEPTYEFLGMIFDEMAELVPSPVIHIGGDEVADGSRLAASLANALLDKEGLDGTLSMQSYAMKRIHGMLHERGRQLAGWDEGYHGGSVHPAGTLLMAWQKPLVGLEPARPGFGRVMTPGHVYYLDMVQD

SEQ ID NO: 14137 - protein, 238 aa, Agrobacterium tumefaciens
MKNPFSLEGRKALVTGANTGLGQAIAVGLAAAGAEVVCAARRAPDETLDIIAKDGGNASALLIDFADPLAAKDSFTDAGFDILVNNAGIIRRADSVEFSELDWDEVMDVNLKALFFTTQAFAKELLAKGRSGKVVNIASLLSFQGGIRVPSYTAAKHGVAGLTKLLANEWAAKGINVNAIAPGYIETNNTEALRADAARNKAILERIPAGRWGHSEDIAGAAVFLSSAAADYVHGAIL

SEQ ID NO: 14138 - protein, 137 aa, Agrobacterium tumefaciens
MNAIVSIRNLTKSYANGFQALKGVSLDIKEGEILALLGPNGAGKTTLISIVCGLVNPGEGSVLVGGHNVVKDFRQTRALIGLVPQELTTDMFETVWNTVSFSRGLHGQKKNPALIESILKSLSLWDKKDNMLRELFG

SEQ ID NO: 14139 - protein, 208 aa, Agrobacterium tumefaciens
DLSGRRAVITGGARGIGRAIADGFLEVGADVVCIDRGWESSDLPADNRQIVTADLSDRSDLKRGFDEAVERLGGQIDVLVNNAGIWDDTPSLHMELEMWDRIIEVNLTAAFALSRHAARLMLPRGRGRIINIGSIRSLRGGHNAAAYAASKGGIALLTQTLSNEWAPSGLRVNAIAPGAMVTVLTEKLRHDPEVVTRFIERIPARRLG

SEQ ID NO: 14140 - protein, 323 aa, Agrobacterium tumefaciens
MDTGDRADFQRNLLDGMQAMTRENRWRDVTGRVAAYDAAAEKIETVEVERPNLYATRAFSLSNWRLIAANWLSSNVLSYSLAFIGFVVAARFCHLRNAAHDGAASMKSGISKIAGIVCLSAMMLFAGLSLSRAASIPTDAWAAYKGAFLDPGGRIIDTGNSNISHSEGQGYGMWLAVLADNLSDFELIWSFTRTELLVRDDGLSAWKWDPRTRPHVTDINNATDGDILIAYALALAAGQWNRQDYAEASAAIASVILKKTVVQRGGRTLLLPAASGFWRGRSGRWGRWSIRPYLIFEAFPVLNLVAPSPLWKAVADDGVAQIG

SEQ ID NO: 14141 - protein, 407 aa, Agrobacterium tumefaciens
FVPKSGRLAQDQADARSMMTGRIVDSYTNISTIKLFSHAGREERYAREGMNVFLGTVHRQMRKISGFNILIDLNNAVVLFSTATLGLYFWMQGSVTAGSVAIAISLAMRVNGMSQWIMWEVTSLFENIGTVYDGMSMMTKPHDIVDVPKAPELAAPQGAIHYDNVRFHYGKNKGVIDGLTLDIKPGEKVGLVGRSGAGKTTLMNLLLRFYDLEGGRITIDGQDISKVSQDSLRELIGVVTQDTSLLHRSIRDNIAYGHPEATDEQVIAAAKRANAWDFIETLVDMHGRQGLDAQVGERGVKLSGGQRQRIAIARVFLKNAPILVLDEATSALDSEVEAAIQENLFSLMEGKTVIAIAHRLSTLTEMDRLIILDKGRIVEAGSHAELAAMGGIYADLWRRQSGGFIAD

SEQ ID NO: 14142 - protein, 243 aa, Agrobacterium tumefaciens
LITGATSGLKKATARRFVKEGWKVIGTGRRAERLEALAAELGQAFHGIAFDITDEDATEKALAALPDGFRDIDILVNNAGLALGTAPAPQVALKDWQTMVDTNITGLLNITHHLLPTLIKQKGIVVNLSSVAAHYPYLGGNVYGGTKAFLRQFSLGLRSDLHGKGVRVTSIEPGMCETEFTLVRTGGNQEASDNLYKGVNPITADDIANTIYWVASQPKHININSLELMPVNQSFAGFQVYRE

SEQ ID NO: 14143 - protein, 259 aa, Agrobacterium tumefaciens
MVELALPKNSQISEGKVWPKPDGAKNVREYRIYRWNPDDGQNPRIDTYYIDVDDCGPMVLDALLYIKNNIDPTLTLRRSCREGICGSCAMNIDGTNTLACTKGMEEIKGTVKVYPLPHMPVVKDLVPDLSNFYAQHRSIEPWLKTVSPTPAKEWKQSHEDRLKLDGLYECILCACCSTSCPSYWWNGDRYLGPAVLLQAYRWLIDSRDEATGERLDNLEDPYRLYRCHTIMNCAQACPKGLNPAKAIAEIKKMMVERCV

SEQ ID NO: 14144 - protein, 411 aa, Agrobacterium tumefaciens
  unsure (1)..(411): unsure at all Xaa locations
LHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTXTVLADVTDDMLIAREETFGPVAAILPFDDEAEVIPRANATEMGLA

SEQ ID NO: 14145 - protein, 244 aa, Agrobacterium tumefaciens
MSQAKLLCDTMSTLAESPVWDERRQVLFWCDILGKTVRSAALEPGQYREWPFPHTVSSLGLRENGDLVVACGMDIVILDPDSGRTRLLHSIPAPEGIPCRLNDGRVGPDGAFWVGTMHNVPLSEMKPYGELWRITATSAKRMQTGLTCPNGLAFSPDGSIMWQSDSVQKWIRRRNFYRVNGLFDEGVLVAQMTEETGRPDGGCLDSSGTYYSAGVSAGMLNVFAEDGGKQTAAIKMPGAGTRQC

SEQ ID NO: 14146 - protein, 363 aa, Agrobacterium tumefaciens
SARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLK

SEQ ID NO: 14147 - protein, 430 aa, Agrobacterium tumefaciens
VRWQSYMHVARQSLTFFQNDFSGRIVTKVWSGGQAAGDLVTSLMESVWFVGIYSVSMLFLIGGLDWRLAVLVVVWVAIFSLLARYFVPRIRHHSKETAEAASMLSGRMVDAYSNIQTLRLFGRDDANDRYMRQGFDIFQTSTMKFTRFITGVRASMALLSGVMITSMAALCIDLWLSGKISSGAVAFTLALVLRLNFLLGRLMTQFNGIMRNFGTVQNAAELISQPIGLVDAPDAAVLEVKKPSIRFENVSFHYGRANGVIDNLNLEIRAGEKVGIVGRSGAGKSTLVNLLLRFYDVEKGRILIDGQDIARVSQESLRAHIGMVTQDTSLLHRSIRDNIMFGRTDATEAQLIEATRRAKADDFITRLEDQRGRTGFDAHVGERGVKLSGGQRQRIAIARVMLKDAPILVLDEATSALDSEVEAAIQSKLD

SEQ ID NO: 14148 - protein, 185 aa, Agrobacterium tumefaciens
MDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWHIIRHELADEETFMNVAKARVKQMLRPAAGLSIIQDLVDLWKEPRPRPTLKEIDGYRYAMLFASQNH

SEQ ID NO: 14149 - protein, 341 aa, Agrobacterium tumefaciens
DALTFDDVLLQPGHSEVMPGQTNIATRIARDIDLNLPILSSAMDTVTEGRLAIAMAQAGGIGVIHRNLTPIEQAEEVRQVKKFESGMVVNPVTIGPDATLAEAQALMKAHGISGIPVVENGGAGGHKNGRLVGILTNRDVRFASDPQQKIYELMTRENLVTVKESSVDQQEARRLLHKHRIEKLLVVDGKGNCVGLITVKDIEKSQLNPNATKDAQGRLRAAAAISVARADAIERAERLIDAGVDLLVVDTAHGHSQRVLDAVAQVKKMSNSVRIIAGNVAPRDGTKALIDAGADAVKVGIGPGSICTTRIVAGVGVPQLAAVMAAVEAASLADIPVIADG

SEQ ID NO: 14150 - protein, 328 aa, Agrobacterium tumefaciens
PWNSPLMLLTGTLAPCLAIGNTVVIKPSEHATASTLALAELIVEAGFPAGVVNVVTGGGAVTGEALTRHNGIAKFVFTGSTATGRRIAANAAANLVPCQMELGGKSPHVVFSDVDIEKTVNGVVSGVFAAAGQTCVAGSRCFVEANIYDRFIEALVERTRNIKLGDPMDDATDIGPLALESQLSKLEGYVASGVREGSRIAIGGKRPQSEELSRGWYFEPTVMADATNDMSFMRHELFGPMVGVMPFSSEEEMISLANDTNYGLASGIWTQNIDRAMRFANQIDAGTVWINTYRSAAYMSANGGFKESGYGRRGGFDVMREFSRAKNV

SEQ ID NO: 14151 - protein, 361 aa, Agrobacterium tumefaciens
  unsure (1)..(361): unsure at all Xaa locations
VIPSNRRGTMAMALRQPAXVVLSMAPWNAPVILGVRSIATPLACGNTVVMKTSELCPRTHALIIEAVASAGLPKGVLNAISNAPDDAAKIVETLIAHPAVRRVNFTGSTRVGRVIAETAGRYLKPALLELGGKAPFIVLDDADIDAAVAAAAFGAYMNQGQICMSTERIIVLDSIADTFVEAFAKKAASLTAGDPREGKTPLGSLVSAEAASRIRVLVDDAVSKGARRVAGGGGDGTMLDAIAVDGVTPAMRLYSEESFGPVVSIIRAGSIDEAVSIANESEFGLSAAVFGRDQARALSVAARIESGICHVNGPTVHDEAQLPFGGVKASGYGRFGGTAGIAEFTELRWVTLQDGPLHYPI

SEQ ID NO: 14152 - protein, 119 aa, Agrobacterium tumefaciens
  unsure (1)..(119): unsure at all Xaa locations
LMFRITKEFHFSASHQLKSLPSDHQCNRLHGHNYIVEVELSGEELNEHGFVRDYHELAPLKRYIDDHFDHRHLNDVLSHDQVTAECLTKHFYDWCKPSLTQTSPVRVSETTKTWTXHRP

SEQ ID NO: 14153 - protein, 377 aa, Agrobacterium tumefaciens
  unsure (1)..(377): unsure at all Xaa locations
MILNEAQQQIRDMARDFARERLSPGAAARDRESRFPKDELKEMGELGFLGMLVSEDYGGSETGAVAYALALEEIAAGDGACSTIMSVHNSVGCVPILIFGTEEQKQRFLPKLAPVEWIGGSALTDPQAGSDASNLKTRARRDGDRYVLDGAKQFITSGKNDDVIIVFAVTDAAAGKKGITAFIVPTDTPGYEVIRVEEKLGLHSSDTCQIAFTEMAVPVDLRLGEEGQGYRIALANLEGGRIGIAAQAVGMAQAAFEAARDYARERKAFGQAIIEHQAVAFRLADMATRITAARQLVLHAAALKEAGEPCLSEASMAKLFASEMAERVCSDAIQIHGGYGYMADYPVERIYRDVRICQIYEGTSDVQRMVIARNLXG

SEQ ID NO: 14154 - protein, 98 aa, Agrobacterium tumefaciens
MPEGRATLQPETVRSFRLRVEYRYLNRLRSACISVHIGRSRDRRAMVLSLSGIKKSYQTAEGNIPVLNGVDLSLEAGESLALTGESGSGKSTLLHLAG

SEQ ID NO: 14155 - protein, 484 aa, Agrobacterium tumefaciens
  unsure (1)..(484): unsure at all Xaa locations
MTTSGVRVRIAPSPTGEPHVGTAYIALFNYLFAKKHGGEFILRIEDTDATRSTLEYEQKVLEALRWTGLTWSEGPDVGGPYGPYRQSERKPMYWPYAEELLEKGHAFRCFCTPERLEQMREAQRAAGKPPKYDGLCLHLKAEEVTTRVAAGEANVVRMKIPTEGSCDFHDGVYGDVSIPWDSVDMQVLIKADGMPTYHMANVIDDHLMKITHVARGEEWLASVPKHILLYRYFGWDQPTFMHLSLMRNADKSKLSKRKNPTSISYYSALGYLPEALMNFLGLFFIQIAEGEELLTMEELAAKFDPEALSKAGAIFDIQKLDWLNGRWLREKLTPEDFIARTLEWAMENSRLTEGLKLAQSRISKLGELPNLAGFLVSSDVGLTPASFAGLKSKPEEIHEILTTVAADLEKMPDWNVEAIEAELRDIAERTGKKLRVVTPPLFVAVSGSSRXLPLFDSMALLGRSVVRQRLKVAIAVVATMVGSG

SEQ ID NO: 14156 - protein, 270 aa, Agrobacterium tumefaciens
NMRALRFHAAKDLRIEDIAEPKRPGPGQVLVRNRFVGICGTDLHEYSYGPIFIPTEPHPFTGAHGPQILGHEFGGVVEAIGDGVTSVNVGDRVSIQPLIMPRSGDYFADRGLFHLSTQLALVGLSWDGGGMAEAALVNEYNVQKIPDEMTDEEAALVEPSAVAVYACDRGGVTAGNSVLVTGAGPIGMLTLLAARAAGATQLFVSDLNDARLELARNVIRDVITINPKRDNVGDVVRSATEGKVGCDVAIECVGNEHALKACVDAVRKQG

SEQ ID NO: 14157 - protein, 329 aa, Agrobacterium tumefaciens
  unsure (1)..(329): unsure at all Xaa locations
GGRRHVTDATNASGTLIYNIEDNAWDDELLSILNIPRAMLPEVLDCAADFGVTDKALLGAEIPILGVAGDQQAAVIGNACFEPGMMKSTYGTGCFALLNTGTDRVASTNRLLTTIAYRLDGVTTYALEGSIFIAGAAVQWLRDELGFISVASEVSALAEKADPKQRVYLVPAFTGLGAPYWDAEARGAIFGLTRGTGPAEFARAALESVAYQTFDLLDAMRKDWAGDNGKTVLRVDGGMVASDWTMQRLADILAAPVDRPVFLETTILGAAWLAASRAGIWPDRKAFADHWRRDRRFSPDMEESERKNAIAGWRDSVGRCLSKRDNXGA

SEQ ID NO: 14158 - protein, 331 aa, Agrobacterium tumefaciens
DCVVFGGTGDLAERKLLPALYHRQVEGQFTEPTRIIGASRSVMTHEEYRKFAQDALKEHLKAGEYDDAQVTLFLNRLFYVPVDAKSGNGWDVLEKLVDEGKERIRAFYLAVAPGIFGDIADKIREHKLITRSTRIVVEKPIGRDLASAQELNDTIGHVFKEEQIFRIDHYLGKETVQNLMALRFANALYEPLWNSAHIDHVQITVAEAVGLEGRAGYYDKAGALRDMVQNHILQLLCLVAMEPPASMKSEAVRDEKLKVLRSLKPIDTSNVEKLTVRGQYRAGASAGGPVKGYLEELEGGVSNTETFVAIKAEIANWRWAGVPFYFRTGKR

SEQ ID NO: 14159 - protein, 250 aa, Agrobacterium tumefaciens
GIFSGQVVVVTGGSTGIGFSVAKLFLEGGASTVYVTGRNSANLDAAVAKLGKGAIGFVSDVAKLSDLEQLKSRLEADGRKVDVLVANAGIAENNDLGETHEALYDRIFDINVKGVFYTVQTLLPVLRDGGSIVLTGSIVGNKGMERLSAYNASKAAVRSFARSFANDLKGRGIRVNTVSPGVTRTPIMENGLKMDDEKIAGFKAYLKDAAPIGRMADPDEIAEAVLFLASSKASYITGVELSVDGGLAQI

SEQ ID NO: 14160 - protein, 487 aa, Agrobacterium tumefaciens
  unsure (1)..(487): unsure at all Xaa locations
RLHRELELAARRKALEEDKPLLAAEXGGRQTASGAIAMLDKALTLSHTTXRNFVTDRIRYGQMLWWRLTMALKDVVAGKRNEEGIASALAVLKQQLGDKLQTGQAFREQHGHTTTYLTLQAPDGVVFAESADDVKAVVKACAQYKVPVIPFGTGSSLEGQVNAPNGGICIDFSRMNRIIEVNAEDLDVTVEPGVTREDLNVYLRDTGLFFPIDPGANASIGGMASTRASGTNAVRYGTMKDNVLAVTAVVANGEEIRTARRARKSSAGYDLTRLFVGAEGTLGVITSVTLRLQGIPEKITGGVCTFDSIKAACDAVIMTIQMGVPVARIELLDEVQVRACNAYSGLNYAEKPTLFVEFHGTEETAALQSQQFAEIAAECGSVDFRWTGDAAERNKLWKARHDAYWASRALAPHLDGLSTDVCVPISRLADCVVETQRDIAENGFLAPIVGHAGDGNFHVLILFDGKDAESVAKTEAFVARLNRRAIA

SEQ ID NO: 14161 - protein, 337 aa, Agrobacterium tumefaciens
MQADYVIVGSGSAGSAIAYRLSEDGRYSVIVIEAGGSDFGPFIQMPAALAWPMSMKRYNWGYLSEPEPNLDNRRITAPRGKVIGGSSSINGLVYVRGHAEDFNRWEELGAQGWAYADVLPYFKRMEHSHGGEEGWRGTDGPLHVQRGPVSNPLFHAFIQAGAQAGFELTDDYNGSKQEGFGLMEQTIHNGRRWSAANAYLKPALKRGNVTLVNGFARKVIIENGRAVGVEIERRGRVETVKANREVIVSASSFNSPKLLMLSGIGPAAHLKDMGIEVKADRPGVGANLQDHMEFYFQQVSTKPVSLYSWLPWFWQGVAGAQWLLSKGGLGASNQFEA

SEQ ID NO: 14162 - protein, 241 aa, Agrobacterium tumefaciens
MPKRQDIKSILIIGAGPIVIGQACEFDYSGTQACKALKEEGYRVILVNSNPATIMTDPGLADATYVEPITPEVVAKIIAKERPDALLPTMGGQTALNTALSLKRMGVLDRYNVEMIGAKPEAIDMAEDRALFREAMARIGLETPKSMLANATEIKDADRKTHEAARTELKAKLSGAELDKALDNLENQWNLGETDRKQRYISHAMAIAAQAIDVVGLPAIIRPSFTMGGTGGGIAYNRSEF

SEQ ID NO: 14163 - protein, 296 aa, Agrobacterium tumefaciens
  unsure (1)..(296): unsure at all Xaa locations
KAFVAIVTCFNDDETINYEATRAQVRRQVTAGNNIMCAGTNGDFTALTHSEKIRILEEVVDEVGGKVDVIVNAGMPATFETLQLAKEFDRIGVKGIAVITPFFIACTQDGLIRHFSTVADEVNTPVYLYDIPARTQNHIEPETARKLATHGNIAGIKDSGGAQETLEAYLQVSKEVDGFEVYSGPDHLVLWALQNGAAGCISGLGNAMPDVLAGIVNGFNSGDITYAERQQSVYTAFRTDLYAHGFPPAMVKRALYLQDPSVGASRQPALLPDAEQDQKIEEPLRKYGLLVTKAXQ

SEQ ID NO: 14164 - protein, 367 aa, Agrobacterium tumefaciens
  unsure (1)..(367): unsure at all Xaa locations
MRILAVTAEMFPFVKTGGLADATSALPQALERKGADVRTLLPLYRGLTPLVRGRKPVLVANILEQPVSVYYVVSDGHKLLLLEAASLFDRDGHPYGVKGEPFADNDLRFAVLSKVAAEIALGAIDGWQPDVVHVHDWHAALTCVYLADSTPSVASVLTLHNLAFQGQYPLERAGMLGLPSHLCTVDCLEYYDDMSFLKGGLTTASAVTTVSPTYAREILTPEMGMGMHGVLARRRGDLRGIVNGVDHDVWNPATEPNTLADFTDAAATSRSLNIYALLQALRLAPTQGPXFGVVSRLTWQKGIDLLPHVVPLIILRKGTLIVPEEXDTALEDSLQALAKRYPELVCAHIGYDERLAHMIQAGSDFII

SEQ ID NO: 14165 - protein, 290 aa, Agrobacterium tumefaciens
NIAAGAARLGLNSAVITRVGDEHMGRFIREQLVREGVDVRGVKTDPERLTALVLLGIRDQNQFPLIFYRENCADMALSEDDIDPAFIADAGCICATGTHLSHPNTEAAVLKALKLARENGAKTALDIDYRPNLWGVAGHGDGESRFVESQKVTAKLQSTLHLFDLIVGTEEEFHIAGGSTDTLTALNAVRKVSNATLVCKRGPMGASVFTGDIPDSLDDGETGEGFPIEVFNVLGAGDGFMAGLFRGWLRGEDWPTTLKYANACGAFAVSRHGCTPAYPSWEELQYFFKA

SEQ ID NO: 14166 - protein, 213 aa, Agrobacterium tumefaciens
  unsure (1)..(213): unsure at all Xaa locations
ESEIQARLLAQALPFMQKYENKTIVVKYGGHAMGDSTLGKAFAEDIALLKQSGINPIVVHGGGPQIGAMLSKMGIESKFEGGLRVTDAKTVEIVEMVLAGSINKEIVALINQTGEWAIGLCGKDGNMVFAEKAKKTVIDPDSNIERVLDLGFVGEVPPPDRTLIDMLAKSEMIPVIAPVAPGRDGATYNINADTFAGAIXGAFYATAPLLLTD

SEQ ID NO: 14167 - protein, 316 aa, Agrobacterium tumefaciens
SKLEQLRAITTVVADTGDIEAVARLKPVDCTTNPTIVLKALGTPAFADAVKEAVAWGRKQGGQSDAVVAAVADRLAISVGAALAGLVPGRVSTEVDADLSFDTQASITKARHIIASYKERGIERERILIKLASTWEGIKAAEVLQSEGIDCNLTLLFSQAQAIACAEAKAFLISPFVGRILDWYKKSTGETYTAETDPGVVSVRSIYNYYKANGIGTVVMGASFRNVGEIEALAGCDRLTISPALLEELDKDNGKLERKLSPDNVKAEALQSLDEKAFRWAMNEDAMATEKLSEGIRLFAKDLVTLREMVRKELTA

SEQ ID NO: 14168 - protein, 224 aa, Agrobacterium tumefaciens
IIAEIDGTIRLGRDYKNKRRVMIEPAEDGVEPVEYLIPKGKPFHLQEGDYIEKGEYILDGNPAPHDILAIKGVEALASYLVNEIQEVYRLQGVVINDKHIEVIVRQMLQKVEITDAGDSQYIVGDNVDRIEMEDMNDRLIEEGKKPAYGEPVLLGITKASLQTPSFISAASFQETTKVLTEAAIAGKTDTLQGLKENVIVGRLIPAGTGGTMTQIRRIATSRDD

SEQ ID NO: 14169 - protein, 169 aa, Agrobacterium tumefaciens
LLEAMRHGVLNGGKRLRPFLVIESVALLGGDAEAGLHVGAALECLHCYSLVHDDLPAMDDDDLRRGQPTVHRKFDEATAILAGDSLLTLAFDIIASDDNPLAAERKAALVISLARAAGIGGMAGGQALDLAAEKKAPDEDGIITLQAMKTGALLRFACEAGAIIGGSNQ

SEQ ID NO: 14170 - protein, 213 aa, Agrobacterium tumefaciens
VASQNKAEAAQNAGRFTDEIVAFTVKGRKADIVIDADEHIRHGASLETMAKLRPAFDKEGTVTAGNASGLNDGAAATLLMSEQQAAKRGIKPLARIASWATAGVDPQIMGTGPIPASRKALAKAGWSINDIGLVEANEAFAAQSCAVVRELGLNPDIVNVNGGAIAIGHPIGASGARVLNTLIFEMRRRNVSRGLATLCIGGGMGVAMCIEAL

SEQ ID NO: 14171 - protein, 568 aa, Agrobacterium tumefaciens
CPVMHGGNTASGKSVTEWWPNALNLDILHQHDTKTNPLGTSFNYREALKTLDVEALKADLRALMTDSQEWGPADWGSYVGILARVTWHAAGSYRVTDGRGGANTGNQRFAPLNSWPDNVNTDKGRRLLGPHHAHYGNKISWADLIALAGTIAYDVAGLKTFGFAFGREDIWAPEKDTYWGDEKEWLAPSDGRYGDVSKPETLENPLAAVQMGLIYVNPEGVNGKSDPLATAAQMRETFARMGMDDEETVALTAGGHTIGKSHGNGSAANLSPDPEAAGPEYQGLGWINTKGRGIGRDTVVSGIEGAWTSEPTKWDNGFFDMLFKHEWTLTHSPAGASQWAPITIAEEDKPVDVEDASIRTIPMMTDADMALKVDPIYREISLKFKDDQDHFSDVFARAWFKLTHRDMGPKSRYVGPDVPAEDLIWQDPIPAGSTSYDVAAVKAKIAASGLSVADLVSTAWDSARTFRGSDKRGGANGARIRLAPQKDWEGNEPARLSRVLSVLEPIARETGASIADVIVLAGNYGVEQAAKAAGFDIAVPFAAGRGDASAEQTDADRFAPLEPLADGF

SEQ ID NO: 14172 - protein, 352 aa, Agrobacterium tumefaciens
  unsure (1)..(352): unsure at all Xaa locations
SKEIDRNDRFPRQLWPQMGELGLHGITVSEEFGGADMGYLAHCVAMEEISRASASIGLSYGAHSNLCINQIHRWGTDEQKHRYLPKLVSGDHVGSLAMSETEAGSDVVSMRLKAERKGDRYVLNGAKMWITNGHEADTLVVYAKTDMSAGARGITAFLIEKGFKGFRPAQKLDKLGMRGSPTSELVFXDCEVPEENILGRLNDGVTVLMSGLDYERAVLAAGPVGIMQAAIDLVLPYVRERKQFGKAIGEFQLVQGKLADIYSAMNASRAYVYAVARACDNGRITRQDAAGAILFAAERATQVALDAIQLLGGSGYVNESPAGRLLRDAKLYEIGAGTSEIRRMLIGRELVK

SEQ ID NO: 14173 - protein, 409 aa, Agrobacterium tumefaciens; identical to SEQ ID NO: 11639

SEQ ID NO: 14174 - protein, 212 aa, Agrobacterium tumefaciens
KKIRKAVFPVAGLGTRFLPATKAVPKEMLTVVDKPVIQYVVDEAAEAGIEHFVFVTGRGKAVIEDYFDIQFELEQMLRERNKNAELTLLAGLLPKAGTASFTRQQVPLGLGHAVWCARDIVGDEPFAVLLPDMIMHSQKSCLKGMVELYDQTQGNVIAVQECAPDQTHKYGIVGVGNAVGEGFKITEMVEKPAKGTAPSNFYINGRYILQPE

SEQ ID NO: 14175 - protein, 416 aa, Agrobacterium tumefaciens
DINLAAFGRKELDIAETEMPGLMSCRKEFGESKPLKGARITGSLHMTIQTGVLIETLKELGAEIRWASCNIFSTQDHAAAAIAAAGIPVFAVKGESLTEYWEYTDKIFQWTDGGLSNMILDDGGDATMYILLGARAEAGEDVLSNPGSEEEEILFAQINKRLKASPGWFTKQRDALKGVTEETTTGVHRLYDLAKKGLLPFPAINVNDSVTKSKFDNKYGCKESLVDGIRRATDVMMAGKVAVVCGYGDVGKGSAASLQGAGARVKVTEIDPICALQAAMDGFEVVRLEDVVSSADIFITTTGNKDVIRIEHMREMKDMAIVGNIGHFDNEIQVASLRNLKWTNIKPQVDMIEFPKGNRIILLSEGRLLNLGNATGHPSFVMSASFTNQVLGQIELFTKPGEYKNEVYVLPKHLDE

SEQ ID NO: 14176 - protein, 133 aa, Agrobacterium tumefaciens
EEIIAAAKAANAHDFIMNMPDGYDSQLGENGSGLSGGQRQRVAIARAMLRDADILILDEATSALDSESEALVRDALERLTLNKTSIVIAHRLSTINRADKIVVMDNGQVVEQGSRRELLATDGLYKRLHSIQF

SEQ ID NO: 14177 - protein, 350 aa, Agrobacterium tumefaciens; identical to SEQ ID NO: 11426

SEQ ID NO: 14178 - protein, 327 aa, Agrobacterium tumefaciens
IRAAIGTPNADRLRMVAQAMRMGMSEEEVHENSKIDPWFIAQLKAIVDMEARIREHGLPQDAENLRMLKAMGFSDARLASLTSKRPKEVAELRNSLNVRPVFKRIDTCAAEFASPTAYMYSTYETPFVGAARSEAQVSDRKKVVILGGGPNRIGQGIEFDYCCCHAAFALKDAGFEAIMINCNPETVSTDYDTSDRLYFEPLTAEDVIEIMRAEQEKGELVGVIVQFGGQTPLKLAEALEKNGIPILGTAPDMIDLAEDRDRFQKLLMKLDLAQPNNGIAYSVEQARLVASEIGFPLVVRPSYVLGGRAMQIIHSEGQLQTYLLDTV

SEQ ID NO: 14179 - protein, 300 aa, Agrobacterium tumefaciens
VRNDWHNAVSPIVPSHDIAGVVSRAVGSRSRRFKVGEPVGVGCFVDSCVGCATRDVDNEQYMPGLVQTYNSVERDGKSATQGGYSDHIVVREDYVLSIPDNLPLDASAPLLCAGITLYSPLQHWNAGPGKKVAIVGMGGLGHMGVKIGSAMGADITVLSQTLSKKEDGLKLGAKEYYATSDASTFEKLAGTFDLILCTVSAEIDWNAYLNLLKVNGTMVLLGVPEHAIPVHAFSVIPARRSLAGSMIGSIKETQEMLDFCGKHDIVSEIETIGIKDVNEAYERVLKSDVRYRFVIDMASL

SEQ ID NO: 14180 - protein, 349 aa, Agrobacterium tumefaciens
  unsure (1)..(349): unsure at all Xaa locations
LQMSDKKFRVGIIGADTHASWAGASHVPALASQAHLTLAAVATRREESARAAAEAFGAELWFADPYAMISDKTIDVITVAVKVPAHKNLVMAALHAGKAVYCEAPLGATLAETNEMAAAVGSLHTAIGLQGRHNPAVRRAAELVASGKLGRLMSARVGATTFGYGPQSPSMYDYFNKAASGASFMTITAGHVLDVIEAVLGNITEVDARTELLWPEIEIVDTGETSQREIPDHLDLIAKTASGAPVSVQVLAGVPADEASVVFEIPCSRGWLKLTGNHLAGVQVGDILLSSSVEFAAPDRPVANGVGPTAAEFWSGAAINVXEVYASLGRDLRNGTYTTPGFDHARHNS

SEQ ID NO: 14181 - protein, 238 aa, Agrobacterium tumefaciens
ALKTPNGQKVSIMLEELLAAGHKGADYDAWLIKIGEGDQFGSGFVGVNPNSKIPALMDHSTPEPTRVFESGSILVYLAEKFGAFLPKEGNARTQALNWLFWQMGSAPFLGGGFGHFYAYAPIKIKYAIDRYAMEVKRQLDVLDRHLAENRYLAGDQYTIADMAVWPWYGKIALGQAYGDAGAFLEADGYKNLMRWTLEIGERPAVKRGVIVNKTSGDPSEQLHERHDASDFDTKTQDK

SEQ ID NO: 14182 - protein, 210 aa, Agrobacterium tumefaciens
  unsure (1)..(210): unsure at all Xaa locations
MTVKVAINGFGRIGRNVLRAIVESGRTDIEVVAINDLGPVETNAHLLRYDSIHGKFPADVKVEGDTIIVGGGKPIKVTAVRDPATLPHKELGVDIALECTGIFTARDKAAAHLTAGAKRVIVSAPADGADLTVVFGVNDDQLTKDHIIIDIAFCTINXLVPDWKVLDDVIVIHHVYMTTIHCYTDNQTALDTMHKDVYRSRAEHLSMIRT

SEQ ID NO: 14183 - protein, 449 aa, Agrobacterium tumefaciens
LAKLPVFWGLEGKRVVLTGGSDGAAWKAELLLACGAQLDLYCEESGLSESLATLVAKSPMLTWHDRCWDADIFKGAELALADCEAEEEAGRFYHAARAAGVPVNVIDKPEFCQFQFGSIVNRSPVVVSISTDGAAPILAQAIRRRIETLLPLSLKDWGALAQTIRERVNLRLAPGAARRSFWEKFVDRAFTERLDEGSEERLLKDVATRTGLAESGRGFVTLVGAGPGDAELLTLKAVRALQAADVILFDDLVSAEVLELARREAKRMLVGKRGGRESCKQEDINDMMIRFAKAGRRVVRLKSGDPMIFGRAGEEIAALEAENIPVEVVPGITAASAMASRLGVSLTHRDHAQSVRFVTGHSRQGKLPENIDWQSLSNPSVTTVFYMGGRTAADIQSCLLAHGMPASTPVVVMISVSRVNEQRWCGSLAQLVAAVERLGVNEPVLIGVG

SEQ ID NO: 14184 - protein, 370 aa, Agrobacterium tumefaciens
YPTAVKLGRGRIKELAEACKTLGIRKPLLVTDRGLANMAITAHALDVLEEAGLGRAIFADVDPNPNEINMEAGVKAYRDGGHDGVVAFGGGSGLDLGKMIAFMAGQTRPVWDFEDIGDWWTRADASKIAPIVAVPTTAGTGSEVGRASVITNSQTHVKKIIFHPKLLPGVVICDPELTVGMPKVITAGTGMDAFAHCLEAYSSPFFHPMSAGVALEGLRLVKEFLPRAYKDGTDIEARTNMMAAAAMGAVAFQKGLGAIHSLSHPIGAVYNTHHGMTNAVVMPAVLRFNRPAIEDKIARAAAYLGISGGFDGFYDYVLDLRRELGVPENLTAMGIKPDRIDELAAEAIKDPSCGGNPVPMTLENTKALFE

SEQ ID NO: 14185 - protein, 318 aa, Agrobacterium tumefaciens
  unsure (1)..(318): unsure at all Xaa locations
RLSRNGAPVSSLPTGLRQPQSRVTPMSGSXRRCASVPIRHSRKPHCSARFPNGLSAGFGTRGLPVTLSTACASGATAIQLGVEAIRQGRTERALTVATDGSVSAEALIRFSLLSALSTQNDPPEKASKPFSKDRDGFVIAEGAATLVLESLEAAVARGAKVLGIIKGAGEKADSFHRTRSSPDGGPAIATIRAALADAGVAESDIGYINAHGTSTPENDKMEYGSMLAVFGEGLKNIPLSSNKSMIGHTLTAAGAVEAVFSLQTMLTGTLPPTINYNNPDPTITLDVVPNVKRDAQVGAVLSNSFGFGGQNASLVMTR

SEQ ID NO: 14186 - protein, 171 aa, Agrobacterium tumefaciens
MDIRLVGAPLQIGAGQLGCEMGPSAYRVAGLAHALEELGHRVVDTGNVMPAPLREFCHPNPAVHHLAETVAWTEALTEAAYRESADAVPIFLGGDHAISAGTVAGMARRVAETGRPFFVLWLDAHTDYHTLETTRSGNLHGTPVAYFSGRDGFSGYFPPLSHARAERNIGM

SEQ ID NO: 14187 - protein, 337 aa, Agrobacterium tumefaciens
GSMHDRQWPTRFPVLDLKAGLSTEPQEVAETVACGQTPVLSVKNLVTRFPIRSGLWARQTGAVHAVENVSFDLFQGETLSLVGESGCGKSTTGRSIMRLVEPSSGDVSLDGYDVMRLDTVGLRNMRKSVQMIFQDPFSSLNPRMTVGTAISEPFIKHRLGSTKQAKEKTADLLEKVGLSADMANRYPHEFSGGQRQRIAIARALALDPKVIVADESVSALDVSIKAQVCNLLLDLQQSLNLAFLFISHDMAVVERVSHRVAVMYLGEIVEIGPRAAVFDNPQHPYTKKLMAAVPVPDPARRGMRRGISNDELKSPIRTMSYEAPTRHYRTVSPGHLV

SEQ ID NO: 14188 - protein, 755 aa, Agrobacterium tumefaciens
  unsure (1)..(755): unsure at all Xaa locations
ATPMMEQYIEIKANNPGSLLFYRMGDFYELFFDDAVEASRALGITLTKRGQHMGHDIPMCGVPVHAADDYLQKLILRGYRVAVCEQIEDPAEAKKRGSKSVVKRDVVRLVTPGTLTEEXLLSPTESNYLMALARIRGSAEAQFALAWIDISTGVFRLAETTLTRLLADIWRIDPRELIVADSLFHDEELRPVFDVLGRVAVPQPAILFDSAVAEGRIARYFNVSTLDGFGTFSRVEMAAAAAAVAYVEKTQIAERPPLGAPERESAASTLFIDPATRANLELVKTLSGDRDGSLLHALNRTVTGGGARLLAERLMSPLTDPERINARLDAVAYLIDDVSLCDGLRDALKHVADMPRALSRLALERGGPRDLGAIRQGLVSAEKIAVILDGGLLPDELAKALRDLKALPGALEAMLGSMLADDLPLLKRDGGFLREGANPELDEVRALRDQSRRVIAGLQLQYADETGIKSLKIKHNNVLGYFIEVTAGNADVMMATDEAKARFIHSQTMAGAMRFTTTELADLESRIXNAAGEALTMELEAFERMVEAVVQQAEAIKAGALALAVIDVASSLAYLATEQAYCRPIVDAFMTFSIKGGRHPXCEQALRRQSAGPFIANNCDLSAVNGGKNGAIWLLTGPTMGGKSTFLRQNALIAILAQIGSFVPAEAAHIGVVDRLFSRVGASDDLARGRSTFMVEMVETAAILNQATDRSLVILDEIGRGTATFDGLSIAWAAVEHLHEVNXCXXLXXXHXHXL

SEQ ID NO: 14189 - protein, 223 aa, Agrobacterium tumefaciens
LEDSWKHVLSGEFASPYMQKLKEFLLAEKTAGKRIFPKGAEYFRALDLTPLDEVKVVILGQDPYHGLGQAHGLCFSVQPGVRIPPSLVNIYKELQSDLGIRPVKHGFLESWAKQGVLLLNSVLTVEEARAASHQGQGWEKFTDAVIRAVNDECDHVVFLLWGSYAQKKAAFVDQRKHLVLRSPHPSPLSAHNGFFGNGHFSKANAFLVSHGRDPIDWQLPDVV

SEQ ID NO: 14190 - protein, 357 aa, Agrobacterium tumefaciens
LAVSLPSTVPFVGPEAIERSRGLKVEARIGANESGFGPAPSVLLAMRDAAAETWMYSDPENFELKKALAIHHGVARGNIAIGSGVDGLLGEIARLIVEPGTPVVTSFGGYPTFNYHVNGSGGKLVTTPYVDDHENLDGLLDLVIRENAPLVYFANPDNPMGSWWEASEVVAFSRALPETALLILDEAYCETGPISAVPAIDALIGQPNILRMRTFSKAYGLAGARVGYAIGTLGNVEAFDKIRNHFGMARISVAGALAALKDQAYLHEVVGKISDARDRISAIARNNGLSPLPSATNFVTIDCHRDGAYARAIVDGLMDHGVFIRMPGVAPLNRCIRVSAGTADKLDLFEQALPKVL

SEQ ID NO: 14191 - protein, 353 aa, Agrobacterium tumefaciens
IAPAIAQALEKRGYKDLTPVQQAMLAPELANKDALVSAQTGSGKTVAFGIALATTLLSENTRFGQASAPLALAIAPTRELAMQVKRELEWLYEFAGVSIASCVGGMDIRNERRALERGAHIVVGTPGRLCDHIKRNALDLSSIRAVVLDEADEMLDLGFREDLEFILEESPDDRRTLMFSATVPRSIAKLAESYQKNAVRIATASEQKQHVDIEYRALLVSPSDRENAIINALRFYEARNAIVFCSTRAAVNHLTARLNNRGFSVVALSGELTQNERTHALQAMRDGRARVCVATDVAARGIDLPGLELVIHADLPTNSETLLHRSGRTGRAGQKGVSAIVVPVSQRRKAERL

SEQ ID NO: 14192 - protein, 344 aa, Agrobacterium tumefaciens
HRIALIPGDGIGQSVTDAAWQVLNAVAKTSGFVLEGTEFPWSCAFYKETGAMMPKDGIETLRGFDAIMLGAVGWPAEVPDSVSLHGLLLPIRKAFVQYANIRPHRLLSGVQGPLKADGFDILCIRENTEGEYSGAGGRVHQGTEDEVAVETSIFTRKGVERILRFGFEQAQKRRGKLASITKSNAQKYSMVFWDEVTHKLAAEYPDVEVSSYHIDAMAARMVMAPESLDVVVASNLFGDILTDLGAAIQGGLGFAASANINPDRSAPSMFEPVHGSAPDIAHLGIANPIAAIWSGAMMFEHLGEKDAAAKIMAALETATGRGIGTVPGKDKTDTITAAVLAALA

SEQ ID NO: 14193 - protein, 283 aa, Agrobacterium tumefaciens
IINIGRTHTQDATPLTLGQEFSGYAAQVASAIANIELTLPALSKLAQGGTAVGTGLNAPVGFAEKVAEEISEITGLSFVTAPNKFEALASHDSMVFSHGAINAAAAALFKIANDIRFLGSGPRAGLGELSLPENEPGSSIMPGKVNPTQSEALTQVCAHIFGNNAALSFAGSQGHFELNVYNPMMAYNFLQSVQLLGDAAVSFTDNCVVGIEAREDNIRKGVENSLMLVTALNGKLGYDICAKIAKTAHKNGTTLREEAVGGGYLTNEEFDQYVRPENMIGPK

SEQ ID NO: 14194 - protein, 406 aa, Agrobacterium tumefaciens
VNVTRLSSGLTVVTERMPHLESVALGVWIKSGSRNETTAEHGIAHLLEHMAFKGTARRTARQIAEEIENVGGEVNAATSTETTSYYARVLKDHVPLAVDILADILTESLFDEDELEREKNVILQEIGAATDTPDDVIFDNFSGVAYRDQTIGRAILGTPDTVQSFTSGEIRHYLARNYTTDRIFVVAAGAVDHESFVKQVEERFASLPLVPAAPPVMEKAIYTGGEIRETRDLMDAQVLLGFEGKAYHARDFYCSQILANILGGGMSSRLFQEVREARGLCYSVYAFHWGFSDTGIFGVHAATGGNDLPELIPVIVDELRKSSETIHQDEINRARAQIRAQLLMGQESPAARAGQIARQMMLYGRPIPNEEMMTRLEDITRERLTDLAGRLFFDTVPTLSAIGPLE

SEQ ID NO: 14195 - protein, 327 aa, Agrobacterium tumefaciens; identical to SEQ ID NO: 11774
  unsure (1)..(327): unsure at all Xaa locations

SEQ ID NO: 14196 - protein, 240 aa, Agrobacterium tumefaciens; identical to SEQ ID NO: 11757

SEQ ID NO: 14197 - protein, 442 aa, Agrobacterium tumefaciens
VERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYAARGRWTRLL

SEQ ID NO: 14198 - protein, 304 aa, Agrobacterium tumefaciens
CQILGAPVQSGASQPGCLMGPDAFRTAGLTQVLTELGWAVTDLGDATPTVEPELSHPNSAVKNLDALVGWTRSLSQKALEMARSCDLPVFLGGDHSMSAGTVSGVAQRTAELGKEQFVLWLDAHTDLHTLHTTASGNLHGTPVAYYTGQSGFEGLPPLAAPVNPRNVSMMGIRSVDPEERRRVAEIGVQVADMRVLDNQGVVRPLEAFLDRVSKVSGRLHVSLDVDFLDPAIAPAVGTTVPGGATFREAHLIMEMLHDSGLVTSLDLAELNPFLDERGRTARLITDLASSLFGRRVFDRVTTAF

SEQ ID NO: 14199 - protein, 314 aa, Agrobacterium tumefaciens
MAKIKVANPVVDLDGDEMTRIIWQLIKDKLILPYLDLDIEYYDLSVENRDATNDQVTVDAAHAIKKHGVGIKCATITPDEQRVEEFGLKQMWKSPNGTIRNILGGVIFREPIICKNVPRLVPGWTKPIVVGRHAFGDQYKATDFKFPGKGKLTIKFVGEDGTVIEKDVFDAPSAGVALAMYNLDESIREFARASMMYGLMRKWPVYLSTKNTILKAYDGRFKDIFEEVYQTEFKAKFDEVGITYEHRLIDDMVASALKWSGGYVWACKNYDGDVQSDTVAQGFGSLGLMTSVLLSPDGRTVEAESAHGTVTRHY

SEQ ID NO: 14200 - protein, 74 aa, Agrobacterium tumefaciens
HTGAREAGTIGFATLRGGSVIGEHSVIFAGEGERVELSHYAGDRSIFARGAITAAVWAFDKKPGFYSMLDVLGL

SEQ ID NO: 14201 - protein, 257 aa, Agrobacterium tumefaciens
GIMQGKRGLIMGVASNHSIAWGISKAPRPQGAELAFTYQGEALGKRVKPLAAELGSDFIVPCDVEDIASVDALFATIREKWGALDFVVHAIGFSDKNELKGLYANTTRENFSRTMVISCFSFTEIAKRAAELMTNGGSMLTLTYNGSQRVIPNYNVMGVAKAALEASVRYLAADYGPRDIRVNAISAGPVRTLAGAGISDARAIYAWNQKNAPLRRTADIDDIGGSALYLLSSLSRGVTGECHYVDCGYNITSTPTL

SEQ ID NO: 14202 - protein, 273 aa, Agrobacterium tumefaciens
MSRFTTTDGTRLFYKDWGAGQPILFAHGWPLSSDAWDQQMLFFSQNGFRVIAHDRRSHGRSDQTFDGNNMDQYADDLAELINALDLSDLILVGHSTGGGEVSHYVGRHGTARVAKVVLVGAVPPVMLKTVDNPNGTPMEVFDSIRENTAKNRSQFFFDLTVPFYGFNREGVATNDGMRENFRRIGLQGGVKGQYDCIREFSEVDYTRDLKSIDRPTLIIHGDDDQIVPIDASAHRAADLVADATLKIYSGGSHGLAETEADRFNADVLAFIHG

SEQ ID NO: 14203 - protein, 274 aa, Agrobacterium tumefaciens
  unsure (1)..(274): unsure at all Xaa locations
KIMKFSIAEAEDLVSSIFERNGVLPQNARSVAKALVASEAAGQGGHGFRRIPVYVRQARVGKVDGQARPVVRRVKPGVLSIDANHGYAYPAIDCALEELPEMARQQGIALAAIHRSHHAGVMALTVERFAEMGLVALMFANAPASMAPWGGHTPLYGTNPIAFAAPIGGADPLVIDLALSKVARGKIMAARQXXXXXXXDWALDRNGRPTTDPEEAIAGTMVPAGEAKGAALALMVEIMAAAVTGGNFAFQASSLLDDKGAPPSLGHTIIAIDP

SEQ ID NO: 14204 - protein, 411 aa, Agrobacterium tumefaciens
RSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 14205 - protein, 138 aa, Agrobacterium tumefaciens; identical to SEQ ID NO: 11703

SEQ ID NO: 14206 - protein, 98 aa, Agrobacterium tumefaciens; identical to SEQ ID NO: 11759

SEQ ID NO: 14207 - protein, 318 aa, Agrobacterium tumefaciens
MKAAVYDQAGPPDVLTYRDVADPIVGPDDVLIAVEAISIEGGDLINRRSTPPPGRPWIVGYAASGRVVGAGANVRDRKVGDRVTAFDMQGSHAELWAVPAIRTWLLPSGVDAASAAALPISFGTAHHCLFARGGLLRNQTVLVQAAAGGVGLAGVQLAAQAGATVIAVSSGESRLQRISSLGADHVVDRSMGNVVEAVRQNTGGKGVDLVIDPVGVTLSASLTLLAPEGRLVFVGNAGGGSLTIDLWPAMQSNQTLLGVFMGPLLERPQVRATVDEMLQMLDRREIRVMIEKTFPLSEAAAAHDFAENAKPLGRVIME

SEQ ID NO: 14208 - protein, 554 aa, Agrobacterium tumefaciens
HFGRLCLQGSALAETIDLDGRLLHPEIAGRRAAWDEALDLVASRFSDAIAEHGPDSVAFYVSGQLLTEDYYLANKLMKGFIGSANIDTNSRLCMSSSVAGHRRAFGADTVPGTYEDMELADLVILTGSNLAWCHPVLYQRLAAAKAARPGMKVVVIDPRRTMSADIADMHLAIRPDGDVALFTGLLAHLFASSAIDRGYVENHTAGFEAATQAASEHSLREIAEATGLTIAELIPFYELFERTEKTVTCYSQGVNQSESGTDKVNAIINCHLATGRIGRPGMGPFSLTGQPNAMGGREVGGLANMLAAHMSIENADDRDRVQRFWASPAIAQKPGLKAVDMFRAVADGRIKALWIMATNPVVSMPDAGAVEVTIKACPFVVVSDVMANTDTARHAHVLLPSLGWGEKDGTVTNSERRISRQRSFLDAPGEAKADWWQMAEVARRMGFDAAFAYQQPSEIFAEHAALSGFENAGRRDFDIGGIERDSYETMAPVQWPKAGAGEAEVTRFFANGRFYHADGKARFIATALPETDRTSADYPLTLNTGRIRDQWHTM

SEQ ID NO: 14209 - protein, 452 aa, Agrobacterium tumefaciens
LPKPAEETPLIAAQGVRLLHETGVPQDAVQLLPGDAKTGAALVGSPLTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDQLSVDVGPVITAEAKGIIEKHIDGMRSLGHRIEQIALAGETGKGTFVPPTIIEMKSLADLKREVFGPVLHVIRFKRDHLDRLIDEINATGYGLTFGLHTRLDDTIQHVLSRVAAGNLYVNRNIIGAVVGVQPFGGRGLSGTGPKAGGPLYLGRMTEKAPKIDRIASQQDQAAVDLARWLDENGQTVAAEAARQAAALSGLGFETELAGPVGERNVYALHPRGKILLVPATEQGLYRQLAAALSTGNSVVIDNASGLEKAIYGLPASVTSRIVWADDWEKSAPFAGALVEGDAERVVAINRKI

SEQ ID NO: 14210 - protein, 258 aa, Agrobacterium tumefaciens
QNTFLITGASDGIGAVYSDRLAGRGHDLILVARRAEKLKALAAQLEKDHGIAVEVLSADLSSAEDLEKVEVRLREDQRITGLVNNAGIAGEGAITALDPAYVTTMINLNILAVTRLAAAIAPRLAAAGKGTIINMTSVTALMPAAFTAVYPATKAFVLAFTEALQAQLSPSGVRVQAVLPGITRTAIWEEERLDAIPAAMVMDVHDMVDAALAGLDLGEALTIPSLPDTVDLENFLAARAALRPNLSHALAASRYRAG

SEQ ID NO: 14211 - protein, 248 aa, Agrobacterium tumefaciens
RLQNKIAVVTGATSGIGLATAKLFAVEGARVYITGRRKDALDKAVAEIGHGAVGVQADSASNENLDKLFAQVKAEQGRLDALVVNAGGGSMLPLGQITEEQIDHTFGRNVKAVIFTVQKALPLMGKGASIVLTGSTAGTEGTAAFSVYSASKAAVRNLARSWALDLKGTGIRVNVVSPGATRTPGLVELAGDDKEQQQGLLDYLASRIPLGRVGESEEIAKATLFLASDDASFVNGAELFADGGQAQV

SEQ ID NO: 14212 - protein, 524 aa, Agrobacterium tumefaciens
ENLTLFQVYTRALRYLTVHKWRVAVVVIANVILAAITIAEPVLFGRIIDAISSGTNVTPILILWAGFGVFNTVAYVAVAREADRLAHGRRATLLTEAFGRIISMPLSWHHLRGTSNALHTLLRASETLFGLWLEFMRTHLATFVALVLLIPTAMAMDLRLSFVLIGLGIVYWFIGKWVMGRTKDGQASVEEHYHSVFAHVSDSISNVSVLHSYNRIEAETKALKSFTEKLLSAQYPVLDWWAFASALNRTASTVSMMIILVIGTVLVKNGELRVGDVIAFIGFANLLIGRLDQMRQFVTQIFEARAKLEDFFVLEDAVKEREEPGDARELSNVSGTVEFRNINFGFANTKQGVHDVSFTAKAGETVAIVGPTGAGKTTLINLLQRVYDPDSGQILIDGTDISTVTKNSLRNSIATVFQDAGLLNRSIRENIRLGRETATDAEVVEAAAAAAATDFIDSRINGYLTQVGERGNRLSGGERQRIAIARAILKNAPILVLDEATSALDVETEARVKAAVDALRKNRT

SEQ ID NO: 14213 - protein, 633 aa, Agrobacterium tumefaciens
MAKVIGIDLGTTNSCVAVMDGKDTKVIENAEGARTTPSMVAFSDDGERLVGQPAKRQAVTNPTNTLFAVKRLIGRRYEDPTVEKDKALVPFEIVKGDNGDAWVKAQDKNYSPSQISAMILQKMKETAESYLGEKVEKAVITVPAYFNDAQRQATKDAGRIAGLDVLRIINEPTAAALAYGLDKKEGKTIAVYDLGGGTFDISVLEIGDGVFEVKSTNGDTFLGGEDFDMRLVEYLAGEFKKDQGIDLKNDKLALQRLKEAAEKAKIELSSSQQTEINLPFITADASGPKHLTLKLTRAKFESLVDDLVQRTVAPCKAALKDAGVTAAEIDEVVLVGGMSRMPKVQEVVKQLFGKEPHKGVNPDEVVAMGAAIQAGVLQGDVKDVLLLDVTPLSLGIETLGGVFTRLIDRNTTIPTKKSQTFSTAEDNQSAVTIRVSQGEREMAQDNKLLGQFDLVGLPPSPRGVPQIEVTFDIDANGIVQVSAKDKGTGKEQQIRIQASGGLSDADIEKMVKDAEANAEADKKRRAGVEAKNQAESLIHSTEKSVKEYGDKVSETDRKAIEDAIASLKTAVEAAEPDADDIQAKTQTLMEVSMKLGQAIYEAQQAEAGDASAEGKDDVVDADYEEIKDDKKSA

SEQ ID NO: 14214 - protein, 251 aa, Agrobacterium tumefaciens
LFDLSGQVALVTGAGSGIGQRIAMGLAQSGANVALLDRRTDDGLAQTADFIARAGRKSIQIAADVTSKQALTDAVARTQAELGALSLAVNAAGIANANPAEEMEESQFQTMMDINLKGVFLSCQAEANAMLKNGRGAIVNIASMSGVIVNRGLMQCHYNASKAGVIHMSKSMAMEWVGRGIRVNTISPGYTATPMNTRPEMVHQTKLFEEQTPMQRMAGAPPMVGPAIFLLSDAASFVTGVDLLVDGGFCC

SEQ ID NO: 14215 - protein, 251 aa, Agrobacterium tumefaciens
VTGGNKGIGYGIARRFAEEGAKVAIASVDKDTHDAAKKLADETGTVTHGVILDVRDAAAVRDAYGAAEDAIGALSISVQNAGVITISKIEDLTQEQWDLNLDVNTKGAFLCCQEAIRRFRASGTKGRLVNTASGQARQGFIYTPHYAASKFGVIGLTQSLAKELAPEGITVNAICPGIIHTEMWDYNDRVWGQMLGEYKPGELMAEWVRNIPMRRAGTPAEVAALVAFLASEDAAYITAQTINVDGGLIMS

SEQ ID NO: 14216 - protein, 888 aa, Agrobacterium tumefaciens
  unsure (1)..(888): unsure at all Xaa locations
CTTPVAAGLVVHTQTERLKQIRKGVMELYISDHPLDCLTCAANGDCELQDMAGAVALRDVRYGYEGDNHVKSRTGGGDINARWMPKDESNPYFTYDPSKCIVCSRCVRACEEVQGTFALTIEGRGFESRVSPGAHEAFLDSDCVSCGACVQACPTATLTEKSVIEIGQPEHSMVTTCAYCGVGCSFKAEMRGEELVRMVPWKDGQANRGHSCVKGRFAYGYATHRDRILNPMIRENIGDPWREVSWDAAFAYVASXFRRIQGKYGRESIGGITSSRCTNEETFLVQKLVRAGFGNNNVDTCARVCHSPTGYGLGQAFGTSAGTQNFDSVEQSDVVLVIGANPTDGHPVFGSRLKKRLRQGAKLIVIDPRRIDLVRTPHVEAAFHLPLLPGTNVAVLTALAHVIVTEGLFNEAFIRERCDWSEFEDWAAFVAEPQHSPEETERFTGVPAEDLVVRPAFMPPAVMARSIYGLGVTEHSQGSTTVMAIANLAMVTGNIGRPGVGVNPLRGQNNVQGSCDMESFPHELPGYRHISDDATRDVFEKLWGVKLNNEPGLRIPNMLDAAVDGSFKGIYIQGEDILQSDPDTKHVSAGLAAMECVVVHDLFLNETANYAHVFLPGSTFLEKDGTFTNAERRINRVRKVMSPKNGYADWEVTQKLAQAMGLTWNYTHPSEIMDEIAATTPSFASVSYAYLEEKGSVQWPCNEKFPEGSPIMHVDGFVRGKGKFIRTEYVATDERTGPRFPLLLTTGRILSQYNVGAQTRRTENVVWHEEDRLEIHPHDAEQRGVKDGDWIKLVSRSGDTTLRALITDRVAPGVVYTTFHHPGTQANVITTDFSDWATNCPEYKVTAVQVSPSNGPTEWQEEYDALARQSRRIAGKLEAAEXSGAGPV

SEQ ID NO: 14217 - protein, 219 aa, Agrobacterium tumefaciens
MKVFAGNSNRHLAEAICKYLNVPLGNATVKRFADQEIFVEISENVRGEDVFIVQSTSFPANDHLMELLIMIDAMRRSSAKRITAVLPYFGYARQDRKAGPRTPISAKLVANLITEAGADRVLTLDLHAGQIQGFFDIPTDNLFAAPILARDVKDHYDTNNVMVVSPDVGGVVRARALSKRLDCLLAIVDKRRDRPGESEVMNVIGDVSGKDCILIDDII

SEQ ID NO: 14218 - protein, 467 aa, Agrobacterium tumefaciens
MTIDIKNIAEMDRNAVLHPFTQLKDFASGKLGEPTIVETGKGIRIQDAHGKQLIDGFAGLYCVNVGYGRTEVAEAISRQAYRLAYYHSYAAHTTDELAILSDRLVRMAPGKMSKVFYGMSGSDANETQAKLVWYYNNLRGKPQKKKIISRERGYHGCSVVAGSMTGMSFYHDHMDLPRVGILHTGVPHHYWGAEAGETELEFSKRRAAELEALILREGPDTIGAFIAEPVLGTGGITPPPEGYWPAIQEVLKKYDVLLIADEVITGFGRTGSMFGSQHYGIEPDLITVAKGLTSAYFPLSGAIVGEKVYTVMEDGADRVGAFSHGYTYSGHPIGAAAANAVLDIVEKEDLPGNAQAVGSYFQEQLPAKFAQLPIVGEVRGVGLMGAIEFVADREKKTRFAPHLTVGARVSKAARNGGLIARAMPHGDILGFAPPLVTTKAEVDEIIAIAEAAVRTVMDDLVQAGEKI

SEQ ID NO: 14219 - protein, 284 aa, Agrobacterium tumefaciens
RDRIIADLKDILPEDCLVHEPRELVPFETDAFVSYRRLPLAVALPKTTEEVAAVMRYCHRYGIPVVPRGAGTSLSGGAIPQEDAVVIGLSKMSAILDLDFYNRTARVQAGVTNLSISDAAGAEGFFYAPDPSSQLACTIGGNIGMNSGGAHCLKYGVTTNNLLGVKMVLVDGTVLELGGNHLDAAGYDLLALVCGSEGQLGIVTEATVRLIARPEGARPVLFGFQTSEEAGSCVADIIGAGIIPVAIEFMDKPAIEICEAFAKAGYPLDVGALLIIEVEGSEAE

SEQ ID NO: 14220 - protein, 78 aa, Agrobacterium tumefaciens; identical to SEQ ID NO: 11724

SEQ ID NO: 14221 - protein, 362 aa, Agrobacterium tumefaciens
LAMRRVVITGTGMVSPLGCGTEVTWERLLAGQNGARLVTEFEVEDLPAKIACRIPVGDGSNGTFNADDWMEPKEQRKVDPFILYGMAAADMALADANWHPETDDDQIATGVLIGSGIGGLEGIVEAGYTLRDKGPRRISPFFIPGRLINLVSGQVSIRHKLRGPNHSVVTACSTGSHAIGDAARLIALGDAEVMVAGGAESPVCRISLAGFAACKALSTQHNDDPQKASRPYDRDRDGFVMGEGAGIVVLEELEHAKARGAKIYAEVVGYGLSGDAFHITAPSEDGDGAYRCMSMALKRAGLTPDDIDYINAHGTSTMADTIELGAVERLVGESAPKISMSSTKSATGHLLGAAGAIQAIFA

SEQ ID NO: 14222 - protein, 244 aa, Agrobacterium tumefaciens; identical to SEQ ID NO: 11507

SEQ ID NO: 14223 - protein, 296 aa, Agrobacterium tumefaciens; identical to SEQ ID NO: 11669

SEQ ID NO: 14224 - protein, 613 aa, Agrobacterium tumefaciens
VAYLDKLNEQQRKAVEHGVGLADGETAGPLLIIAGAGSGKTNTLAHRVAHLIVNGADPRRILLMTFSRRAASEMSRRVERICKQVIGANSAIMTDALAWSGTFHGIGARLLRIYAEQIGLNIDFTIHDREDSADLMNLVRHELGFSKTESRFPTKGTCLAIYSRAVNSQTPLKDILRQHYPWVADWQSELKELFAAYVEAKQIQNVLDYDDLLLYWAQMVSDPILADDIGNRFDHVMVDEYQDTNRLQASVLMAMKPGGRGLTVVGDDAQSIYSFRAATVRNILDFPACFNPAADIITLDRNYRSTQPILAAANGVIDLARERFTKNLWTERQSLERPKLVTVKDETEQANFIIDQILANRETGTTLKQQAVLFRTSSHSGPLEVELTRRNIPFVKFGGLKFLDSAHVKDMLAVLRFAQNPRDRVAGFRLLQMLPGIGPKKAGNILDTIAPDPEPLLALAEIPPPPKTGDDWTAFTQLLVGLRRGPNGWPGEIGLARLWYEPHLERIHEDADTRKADLQQLEQIAGGYPSRERFLTELTLDPPDATSDQAGVPLLDEDYLSLSTIHSAKGQEWRSVFILNVVDGCIPSDLGVGTSQELEEERRLLYVAMTRAK

SEQ ID NO: 14225 - protein, 471 aa, Agrobacterium tumefaciens
FIGGRLIPAQNGIDMHRPSDGVEYAGCPRANAALVDEAVQTAKAALKSSNWGGVRPRERTKILQRWADLIEQEAETLAKIEALSSTRPVGQLIAGDIAVTAEQIRFFAEFADKEGGDLVPTDDASLGMIMTEPYGVVGAITPWNFPVSMAGWKLGPALAAGNAVVLKPSEMTPFSSIFMAELAIKAGLPAGLINVVLGDGPVTGNAITGHPEISKVSFTGSTAAGAAIMANVARTGIKPMTLELGGKSPQLVFADADIEKAAAAIAGNILSNAGQACVAGSRIIVEESAADALSAAIIARMKTVKPGPTWDEATQYSPIISEVQRQRIDGIVQAAVAHGGECLTGGAIMDGPGYFYQPTLIANVDQTSPAVTEEIFGPVLTLQTFRTEEEALALADHPTYGLAAGLFSRDVSRVLRLSRAIQAGTIWVNRYGRSRDHILPTGGYKRSGIGKDLGRDAYLANRKSKSVLIGL

SEQ ID NO: 14226 - protein, 415 aa, Agrobacterium tumefaciens
KARVSVHRDFRIGRIDDRLYSAFIEHMGRAIYGGIYEPGHPQADANGFRKDVLKFVQDLKIPAIRYPGGNFVSAYRWEDGIGPRDQRPIRLDLAWRSKETNQIGINEFADWAQMAGIEMMLAVNLGSRGLDDARNFLEYVNFPGGTALSDLRRSHGTEKPHGVKMWCLGNEMDGPWQIGHKTAVEYGRLANETAKAFKGFDPTIEAIVCGSSNDGMPTYPEWEREVLEECYENVDHISLHKYFGNNSRDTLNYFGKIEETGRYIQTIAGVIDYVKAKKRAKNDVSICFDEWNVWYHIREDDGKRIKSWDWPEAPALLEETYNFEDALFVAGLLNEFIRRSDRVRIACIAQLVNVIAPIRAEKNGPAWRQTIYYPYQFASLYGRGVALNGAVDCPTYDCNAADDVKYLDVAGVYDE

SEQ ID NO: 14227 - protein, 267 aa, Agrobacterium tumefaciens; identical to SEQ ID NO: 11713

SEQ ID NO: 14228 - protein, 305 aa, Agrobacterium tumefaciens
KIFIDGEHGTTGLQIRTRLAGRRDIELLSIPETERRNAAMREDLLNNADISILCLRMNASKEAVSMVAGNNNVRIIDTSTAYRVHQDWAYGFAEMDRDQGEKVRSARFVANPGCYPTGAIGLIRPLRASGILPDGYPVSVNAVSGYTGGGKQMIAQMEDQSRDDAISANNFLYGLTLKHKHVPEMTIHGQLDRAPLFAPSVGRFPQGMIVQVPLFAADLAEGTTIETIHAALTAHYAGQDIVSVVPLAESKGISRIDAEELAGKDTMKLFVFGTPGGEHINLVALLDNLGKGASGAAVQNMELML

SEQ ID NO: 14229 - protein, 246 aa, Agrobacterium tumefaciens
ITTWNINSVRLRMPIVEQFLVRYKPDILCLQETKCPNGEFPMKPLKALGYEHVIIHGQKGYHGVAIASKIPLTEDHRQDYCGIGDARHISAIFQVGSRRVRLHNFYVPAGGDEPDRSINPKFGHKLDFIEEMKALRADGVPGTSSILVGDLNIAPLENDVWSHKQLLKIVSHTPVETEGMLDIMKKGNWLDLMRLNVPETEKIYTWWSYRAKDWEAANRGRRLDHIWSSQDLGSSLEKIEILREAR

SEQ ID NO: 14230 - protein, 295 aa, Agrobacterium tumefaciens; identical to SEQ ID NO: 11782

SEQ ID NO: 14231 - protein, 285 aa, Agrobacterium tumefaciens
  unsure (1)..(285): unsure at all Xaa locations
DPRSQYPRPPFSTPTQEMPGLVTNMTPFPDHGEKSYKGTGKLAXRKALITGGDSGIGRAVAIAFAREGADVAISYLPEEESDAEEVVALIEAEGRVAVALPGDITDEAWCRELVEKAVSDLNGLDILVINAARQQYREDIEELSTDDFDRTMKTNLYALHWIAQAAVPYLKPGASVITTASIQAYEPSAILLDYATTKAGIVAYTKALAKQLIEKGVRANAVAPGPFWTVLQPSGGQPDEKVKNFGKDSDFGRPGQPVELAPVYVLLASQDASFINGEVYGVTGG

SEQ ID NO: 14232 - protein, 215 aa, Agrobacterium tumefaciens; identical to SEQ ID NO: 11661

SEQ ID NO: 14233 - protein, 292 aa, Agrobacterium tumefaciens; identical to SEQ ID NO: 11433

SEQ ID NO: 14234 - protein, 140 aa, Agrobacterium tumefaciens; identical to SEQ ID NO: 11722

SEQ ID NO: 14235 - protein, 163 aa, Agrobacterium tumefaciens; identical to SEQ ID NO: 11802
  unsure (1)..(163): unsure at all Xaa locations

SEQ ID NO: 14236 - protein, 255 aa, Agrobacterium tumefaciens
RIPEDDVRRILPEALKLGFRHVDTAQIYKNEGAVGEVIAQSGISRHDIFLTTKVWVDRYRHDDFLASVDESLAKLKTDYFDLLLLHWPKSDVPLAERMGALNAVRKAGKARNIGISNFNVALTEEAVKLSDTPLATNQIEYHPYLDQTKVISAARKHGMSVTAYYLMADGKVPNDPVLKDIGAKHGKTAAQVTLRWAVQQPDIVALSKTATESRLKENFDIFDFALSEEEMQAIHALAKPNGRIVSPGHLAPDWD

SEQ ID NO: 14237 - protein, 635 aa, Agrobacterium tumefaciens
EKAERLTGMPQTPLLDRVNFPSDLKEIDDRDLPELARELRDEMIDAVSKTGGHLGAGLGVVELTIAIHKVFNTPEDRLIFDVGHQCYPHKILTGRRDRIRTLRQEDGLSGFTRRAESEYDDFGAGHSSTSISAGLGMAVAAGLDGSDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDEKIIGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILQIGKGRIIKEGTKVALLSFGTRLAECLAAAEDLDAAGLSTTVADARFAKPLDLDLIRQLAAHHEVLVTIEEGSVGGFGAHVLHFMASAGLLDHGPKVRTLTLPDQWVEQAKPETMYANAGLDRAGIVSTVFNALGQ

SEQ ID NO: 14238 - protein, 474 aa, Agrobacterium tumefaciens
MAKLKVDGKEIEVPDHFTLLQACEEAGAEVPRFCFHERLSVAGNCRMCLIEVKGGPPKPAASCAMGVRDVRGGPNGELPEVFTNTPMVKKAREGVMEFLLINHPLDCPICDQGGECDLQDQAMAFGIAGSRYAENKRAVEDKYIGPLVKTVMNRCIHCTRCVRFTTEVAGIAELGLIGRGEDAEITTYLEQAMTSELQGNVVDLCPVGALTSKPFAFTARPWELNKTETIDVMDALGSAIRVDTRGREVMRVMPRVNEAINEEWISDKSRFIWDGLKTQRLDRPYVRKDGRLQPATWGEAFGAIKQAVAATSGSKIGAIAGDLSSVEEMFALKSLLASLGSANVDCRQDGAALDPSLGRASYIFNSTIEGIEHADALLIVGSNPRFEAAVLNARIRKRWRRGGFPIGVIGEAGELRYNYEYLGSGAETLSDLANGSHSFIDKLKSAKNPLIIIGQGALARADGAAVLAAAAKLA

SEQ ID NO: 14239 - protein, 405 aa, Agrobacterium tumefaciens
  unsure (1)..(405): unsure at all Xaa locations
MTNVVVVGSQWGDEGKGKIVDWLSERADVVVRYQGGHNAGHTLVIDGISYKLSLLPSGVVRSGKLAVIGNGVVVDPHALIAEIGRLEVQGVKVTPENLRIADNATLILSLHRELDGMREDAASNSGTKIGTTRRGIGPAYEDKVGRRAIRVMDLADMEALSAKVDRILTHHNALRPGFGATEVSHETIMEELGSIAERILPFSETVWLLLDKKRRAGARILFEGAQVLDAXXVHGTYPYVTSSNTVVGQAAAGSGMGPGSLGYILGITKAYTTRVGEGPFPTELHDEIGQFLGEKGHEFGTVTGRKRRCGWFDAALVRQSVATNGITGIALTKLDVLDGLDELKICVGYKLDGQEIDHLPASQGAQARVEPIYVTLEGWKESTVGARKWADLPAQAIKYSVRSKS

SEQ ID NO: 14240 - protein, 180 aa, Agrobacterium tumefaciens; identical to SEQ ID NO: 11435

SEQ ID NO: 14241 - protein, 298 aa, Agrobacterium tumefaciens
LMTTFDIRQALHGISGVPVTAYDADGEISFDITAEAYARVARAGIHNIVAAGNTGEFYALTPAEILTVYEAAIKGVDGIAPVTAAIGRSQREAIAMARTAKELGASAVMSHQPVDPFAAPQSQIAYFLGLAEDSALPLVAYVRADGFAVDDMVRLSSHPNVAGIKFATTDIMLLSRAIAASDADGALYICGLAESWAPAFAAVGARGFTSGLVNVAPHFSMQVHEALMAGDFDSARKIVEKIELFERLRTATETAPMVTVVKEAMEIMGLAVGPVRAPGLVRLDAPDRALLENLLASW

SEQ ID NO: 14242 - protein, 262 aa, Agrobacterium tumefaciens
RVGESPTWDERTGDLWFVDILAPAIFCLSPSGKLQRFDMPAQIGCLGLCQSNLIVAALKTGVHLLNPQNGELELLCDPDEGRADSRLNDGKVGPDGHFWVGTRDEADVPTGNARLYRVSSSGHVERFIDGDMLTSNGLAWSPDETRMYHSDSSGLLLQVFDFDVQTGRLGPAKRLHDFQPDEGRPDGAATDSEGCYWSAGVQAGRLNRFTPDGELFEIYKMPFKGPTMPCFGGPELKTLYVTSLVTDTNGVATSGTLVAFDA

SEQ ID NO: 14243 - protein, 483 aa, Agrobacterium tumefaciens
VVAQLLAKYTREGLGHREAMLKMLNHVTGAYALVVMFQDDPGTLLSARSGPPLAVGYGRGEMFLGSDAIALSPFTNEITYLVDGDCAIVTRDGAEIIDFSGKPVKRERQISQATAFVVDKGNHRHFMEKEIYEQPEVISHALSHYVDFATRTVKDADKAIDFASLSGLAISACGTAYLSGLIGKYWFERYARLPVEIDVASEFRYREIPLVPTQAALFISQSGETADTLAALRYCQQEGLKIGAVVNTRESTMARESDAIFPILAGPEIGVASTKAFTCQLAVLASLAVAAGKARGTLKPGEEKQLVQQLIEMPRIMSKVLNVIQPQIEALSRDLSRFKDVLYLGRGTSFPLALEGALKLKEISYIHAEGYAAGELKHGPIALIDENMPVIVIAPHDRFFEKTVSNMQEVAARGGRIIFITDEKGAAASKLETMATITLPNVDELIAPMVFSLPIQLLAYHTAVFMGTDVDQPRNLAKSVTVE

SEQ ID NO: 14244 - protein, 287 aa, Agrobacterium tumefaciens; identical to SEQ ID NO: 11576

SEQ ID NO: 14245 - protein, 408 aa, Agrobacterium tumefaciens
TEIRVPTLGESVSEATVGTWFKKVGDTVKADEPLVELETDKVTVEVPAPASGVLTEIVAQNGETVGLDALLGQIAEGAAGAATSAPAAKPAAPAAAPAPAAAVAAAPGGSAMPPAPAAGKLLAENNLSADQVDGSGKRGQVLKGDVLAAVAKGVSAPAAAPAPVAAPRPVSAEQDQVREERVKMTRLRQTIARRLKDAQNTAAMLTTYNEVDMSAVMDLRNRYKDVFEKKHGVKLGFMGFFTKAVTHALKELPAVNAEIDGTDIIYKNYCHVGMAVGTDKGLVVPVIRDADQLSIAGVEKELGRLAKAARDGSLGMADMQGGTFTITNGGVYGSLMSSPILNAPQSGILGMHKIQERPVAIGGQVVIRPMMYLALSYDHRIVDGKEAVTFLVRVKESLEDPERLVLDL

SEQ ID NO: 14246 - protein, 206 aa, Agrobacterium tumefaciens; identical to SEQ ID NO: 11796

SEQ ID NO: 14247 - protein, 263 aa, Agrobacterium tumefaciens
MSERKGMTVLNGKTVTPPPIWLMRQAGRYLPEYRETRMSAGSFLDLCYNPELASEVTFQPIRRSGLDAAILFSDILVIPDALHRNVSFSEGKGPAMDPIDISGIEKLDASDVMAHLSPVFETVSRLRTSLPDETTLLGFCGAPWTVATYMIAGHGTPDQAPARLFGYQEPAAMEKLLALLAEVSADYLVAQIDAGADAVQIFDSWAGVLGEKEFEEYAIKPVARIIASVRARRPSAKIIAFAKGAGYLLRDYRRKTGANAIGL

SEQ ID NO: 14248 - protein, 188 aa, Agrobacterium tumefaciens; identical to SEQ ID NO: 11747

SEQ ID NO: 14249 - protein, 614 aa, Agrobacterium tumefaciens
SHQIAIDGMTCASCVGRVEKAIARVPGVLKASVNLATERADISFSGPPDVPAVIAAVRHAGYGVEEKTVELDIEGMTWASCVGRVEKALKAVSGVSDASVNLATERAAIRVAGNAASAATLAEAIKRAGYQAKEIVADKAGDAEQDRRAADMRSLKISLAVAVVLTLPVFVLEMGSHLVPAIHDFVMETVGMRKSWYLQFVLTTLVLFGPGLRFFKKGIPALMRLAPDMNSLVVLGTAAAWGFSVVATFLPEILPRGTANVYYEAAAVIVTLILLGRFLEARAKGRTSEAIKRLVGLQAKSARVLRDGETIDVPLQDVRTGDVIVVRPGEKVPVDGLVLNGSSYVDESMITGEPVPVTKTEGSEVVGGTVNRNGSFTFRATKVGSDTLIAQIIRMVEEAQADKLPIQALVDKVTNWFVPAVMLAALVTFAVWFVFGPDPALTFALVNAVAVLIIACPCAMGLATPTSIMVGTGRAAEMGVLFRRGDALQTLRDADVIAVDKTGTLTLGKPKLVHFNTTQGFDADEVLRLVASLENRSEHPIAEAIVEAAKHGGLTLAEAEAFEATPGFGVAATVDGRRVEAGADRFMVKLGYDVGAFATDAERMGREGQSPLYA

SEQ ID NO: 14250 - protein, 257 aa, Agrobacterium tumefaciens
  unsure (1)..(257): unsure at all Xaa locations
MTKFKLEYIWLDGYKPVANLRGKTQIKEFDEFPTLEQLPLWGFDGSSTQQAEGHSSDCVLKPVAIYPDPARTNGALVMCEVMMPDGVTPHASNSRATILEDEDAWFGFEQEYFFYQDGRPLGFPEQGYPAPQGPYYTGVGFKNVGSVAREIVEEHLDLCLEAGINHEGINAEVAKGQWEFQVFGKGSKRPSDQIXIARHWLLRLXXQSGMHVKFQYESLCNPASNGSGMHCSLSTXFMHXVGGKDYFKALMSALCEN

SEQ ID NO: 14251 - protein, 241 aa, Agrobacterium tumefaciens
PLNGKIALVTGGSRSIGASIAQRLAADGAQVAFTYRGSPAKAEEVAVAIEKTGARALAIAADAADPDAIRAAVAATVDKFGGLDILVNNAGIAFAGPIDEIAFDDYQAMLAINVTGVFVATQEAVRHMKDGGRIIHIGSSITKYAGVPGLSAYGLTKGAVAGFNRSLAHDLGPRGITVNTVHPGPTDTDMNPVDGEFAAMQISRIAAGRYGKPREIANVVAFLASPEASFVTGADIRADGG

SEQ ID NO: 14252 - protein, 145 aa, Agrobacterium tumefaciens
  unsure (1)..(145): unsure at all Xaa locations
ILNGPNLNLLGQRQPEIYGYETLADVEADCRAIAEAAGHELFFAQSNREYELIDWIHEARRQAAGIVINPGAFTHTSVAILDALNAFEAPVIEVHISNIHKREVFRHHSYVSTRAEGVIAGLGIEGYGVALRHLINLFSRSSXYA

SEQ ID NO: 14253 - protein, 658 aa, Agrobacterium tumefaciens; identical to SEQ ID NO: 11561

SEQ ID NO: 14254 - protein, 566 aa, Agrobacterium tumefaciens
DRHLKTHGERTAILWEGDNPYIDKKITYNQLYDYVCRLANVLKKHGVKKGDRVTIYMPMIPEAAYAMLACARIGAVHSVVFGGFSPEALAGRIVDCESTFVITCDEGVRGGKPIPLKENTDKAIDIAAKQYVIVNKVLVVRRTGGKTGWAPGRDIWYHQEIATVKPDCPPVKMRAEDPLFILYTSGSTGKPKGVLHTTGGYLVYTSMTHEYVFDYKDGEVFWCTADVGWVTGHSYIVYGPLANCATTLMFEGVPNFPDQGRFWEVIDKHKVNIFYTAPTALRSLMGAGDQFVQRSSRESLRLLGTVGEPINPEAWEWYYHVVGEDKSPIVDTWWQTETGGILISPLPGATDLKPGSATRPFFGVQPQLVDAEGNVLEGPADGNLCIIDSWPGQSRSVYGDHQRFVDTYFSTYKGKYFTGDGCRRDEDGYYWITGRVDDVLNVSGHRLGTAEVESALVSHHQVSEAAVVGYPHPIKGQGIYCYVTLMAGQSGDYALREELVKHVRNEIGPVATPDKIQFAPGLPKTRSGKIMRRILRKIAEDDSVALGDTSTAADPAVVEDLIANRQ

SEQ ID NO: 14255 - protein, 582 aa, Agrobacterium tumefaciens
VALALARGDEQLARDLMDEIISGRFQPATPTFLNAGKKSRGELVSCFLLRVEDNMESIGRSINSALQLSKRGGGVALSLTNIREFGAPIKQIENQSSGVIPVMKLLEDSFSYANQLGARQGAGAVYLHAHHPDIMRFLDTKRENADEKIRIKTLSLGVVIPDITFELARNNEDMYLFSPYDVERVYGVPLTEISVTEKYHEMVADSRIRKKKIKAREFFQVIAEIQFESGYPYIMFEDTVNRANPVAGRISMSNLCSEILQVSEASEFNADLSYSHMGKDISCNLGSLNIASAMDSADFGKTIETSIRALTAVSDMSHISSVPSVEKGNDASHAIGLGQMNLHGYLARERIFYGSEEGIDFTNIYFYTVTYHAIRASNRLAVERGQSFKGFENSKYASGDYFDKYTDREWLPATEKVRDLFEKAGIAIPTQEDWTALKQDVMASGLYNQNLQAVPPTGSISYINHSTSSIHPIVSKIEIRKEGKIGRVYYPASYLSNDNLEYYQDAYEIGPEKIIDTYAAATQHVDQGLSLTLFFRDTATTRDINRAQIYAWRRGIKTIYYIRLRQMALEGTQVQGCVSCTL

SEQ ID NO: 14256 - protein, 250 aa, Agrobacterium tumefaciens; identical to SEQ ID NO: 11672

SEQ ID NO: 14257 - protein, 388 aa, Agrobacterium tumefaciens
MSKAQIVGWAHSPFGKSALENTEQLMASVVAPAIDHAGVDVSDIDGIFVGVMNNGFSKQDFQGALVAMGDERLAYTPAVRFENACSTGSAALYSAMDFIEAGRGRIALVVGAEKMTALPTADVGEILLSACYRAEEANIPGGFAGQFGRIAQAYFQRYGDRSEELAMIAAKNHANGAVNPYAHMRKDFGFDFCNTASDKNPYVAGPLRRTDCSLISDGAAAIILADEETAATLNRAIGFRGRKHVNDIMALTRRDPLAFEGARRAWAGSLELAGATLDDLSFVETHDCFTIAELIEYEAMGLAKPGEGYRVVQDGTALKTGRLPINPSGGLKSKGHPVGATGVSMHVMAAMQLMGEAGDMQIPNSSLAGVFNMGGTAVANYVSIMERV

SEQ ID NO: 14258 - protein, 127 aa, Agrobacterium tumefaciens; identical to SEQ ID NO: 11679

SEQ ID NO: 14259 - protein, 306 aa, Agrobacterium tumefaciens
  unsure (1)..(306): unsure at all Xaa locations
AYTYVDHSYDVIVVGAGGAGLRATLGMAEQGFRTACITKVFPTRSHTVAAQGGIAASLTNMTPDCWQWHLYDTVKGSDWLGDVDAMQYLAMEAPKAVYELEHYGVPFSRNAEGKIYQRPFGGHMQNYGEGPPVQRTCAAADRTGHAILHTLYGQSLRNNAEFFIEYFALDLIMAPDGRCTGVVAWNLDDGTIHRFSAKMVVLATGGYGRAYFSATSAHTCTGDGGGMIARAGLPLQNMEFVQFHPACILGAACFIIEGARGEFSSLVNSQVERFTQRYAPXLNILASRDGVYSCVRMIIRQAVGAG

SEQ ID NO: 14260 - protein, 484 aa, Agrobacterium tumefaciens
  unsure (1)..(484): unsure at all Xaa locations
MIKLKNAALLRDACLVNGRWLKAADGKTIAVENPANSMIIGHVPSLSADEVKAAVESAGKAFSEWSRRSAKDRAAILRRWFDLMVANADDLGALMTGEQGKPVAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVXMVESLSVGEGTEPGVLIGPLINQDPVAKLEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 14261 - protein, 274 aa, Agrobacterium tumefaciens
MTINPFEFRTVPSMQVAWGGAHRLGEILSGRFQARKALLITDAGLIKAGLIKPIADALAASGFNVTIFDKVVADPPEHIVADCVESARQIGVDIVIGLGGGSSLDIAKLVAVLLVSDQTLADMYGIGNVKGSRLPLVLVPTTAGTGSEVTNISIITTGETTKMGVVSPQLYADFVLLDAELTVGLPQVHTAATGIDAMVHAIEAYTSKHKKNPLSDALAREALRLLGANLIAACRNGADRKAREGMLLGATLAGQAFANSPVAAVHALAYPLGG

SEQ ID NO: 14262 - protein, 295 aa, Agrobacterium tumefaciens; identical to SEQ ID NO: 11673

SEQ ID NO: 14263 - protein, 302 aa, Agrobacterium tumefaciens; identical to SEQ ID NO: 11708

SEQ ID NO: 14264 - protein, 248 aa, Agrobacterium tumefaciens
LKGKTVIIAGGAKNLGGLIARDFAAQGAGAIAIHYNSAASRADADATVAAVKAAGAEAIALQADLTTAGAVEKLFADAVAAIGRPDIAINTVGKVLKKPILETSEAEYDEMTAVNAKSAFFFLQQAGRHVSDNGKICTLVTSLLGAFTPFYASYAGTKAPVEHFTRAAAKEFGERGISVTAIGPGPMDTPFFYGQETPEAQGYHKTAAALSAFSKTGLTDIEDIVPYIRFLVTDGWWMTGQTILVNGG

SEQ ID NO: 14265 - protein, 545 aa, Agrobacterium tumefaciens
QNDFLRLYTHDMTTDARNGKVDPVIGRDDELRQLVDILTRRRQNNPILVGEAGVGKTAVAEALALEIASGNVPEKLRNVCLLNLDISLLQAGAGVKGEFERRLHGVIDAVKRSAEPVILFIDEAHGLVGAGGAAGQGDAANILKPALARGEVRTVAATTWSEYKKYFEKDAALTRRFQPVHVREPDEATAIRMLRGVADTFVSHHNVTVRDEAIVAAVQLSARYMPARQLPDKAVSLLDTAAAAVSLARQTLPERLRAMESERHLLSDELNWLLREPQDEDMQNRIQSIRDELERLEAGIDDLRGRYDAEMAELAALSEEQPAETGASNVSHLRPATEMRPANAERLVPTVVDREAIAAVVSRWTGIPLGKLLADQIESARTLDVRMRQRVVGQDAAITRIADAMRTARAGLSDPRRPPAVFFLVGMSGTGKTETALSLADLLYGGNSHLTTINMSEFKEEHKVSLLLGSPPGYVGFGEGGVLTEAVRRRPFGVLLLDEIDKAHPGVQDIFYQVFDKGVLRDGEGRDVDFKNTTIFMTANTGSEL

SEQ ID NO: 14266 - protein, 382 aa, Agrobacterium tumefaciens
  unsure (1)..(382): unsure at all Xaa locations
YMHNFLTSQPXLNLHNPECQEELLNITRFWLKRGVDGFRLDTINFYFHDLELRDNPALAPERRNASTAPAVNPYNFQEHLYDKNRPENIAFLKRFRAVLDEFPDIAAVGEVGDSQRGLEIVGEYTSGDDKMQMCYAFEFLAPDALTPQRVADVQADFARAAPEGWACWAFSNHDVVRHVSRWGEHVEDKDAFAKLLSALLMTQRGSVCIYEGEELGLTEADIAFEDLQDPYGSSSGRNSKGRDGCRTPMVWDAGHAQAGFSTSDKIWLPIPAEHKQRAVSAQAGQRGVGAGALPPLLAFRKQHPAFAKGGIEFQPLEGDVLSYTRKLGNETILCLFNLSATPANATLPKGNWEVLEGHGFASGLEGTSVELPAWGAFFARYA

SEQ ID NO: 14267 - protein, 276 aa, Agrobacterium tumefaciens
MALKSFNPTTPSQRQLVIVDRASLYKGKPVKALTQGLSSKGGRNNQGRITVRFQGGGHKRTYRLVDFKRRKFDVEGTVERLEYDPNRTAFIALVTYTDGEQAYILAPQRLAAGDKVIASDKAVDVKPGNTMPLQYIPVGSIIHNVEMKPGKGGQIARSAGTYVQLVGRDAGMAILRLNSGEQRLVHGSCLASIGAVSNSDHGNINDGKAGRSRWRGKRPHVRGVVMNPVDHPHGGGEGRTSGGRHPVTPWGKPTKGKRTRSNKSTDKFIMRSRHQR

SEQ ID NO: 14268 - protein, 425 aa, Agrobacterium tumefaciens; identical to SEQ ID NO: 11641

SEQ ID NO: 14269 - protein, 480 aa, Agrobacterium tumefaciens
TPKPVVLTILDGWGLNEDTSSNAPVLANTPTMDRLFATCPNATLTTFGPNVGLPTGQMGNSEVGHTNIGAGRIVAMDLGQIDLAIEDGSFFRNAAMLDFAATVKAAGGVAHLMCVVSDGGVHGHILHGQAAVKLMVSHGLKVVVHAITDGRDVAPQSAEDFVAALVASLPQGASIGTVIGRYYAMDRDNRWERVEKAYDAMVLGKGEHARDAVSAVAQSYANKVTDEFILPTVIDGYEGFKAGDGLFCLNFRADRAREILLAIGADDFDGFAREKPVLSALLGMVEYSTRHSDFMTTAYPKRDIVNTLGAWVAKQGLTQFRLAETEKYPHVTFFLNGGKEEPEVGEDRFMPKSPKVATYDLQPEMSAAEVTEKFVEVIGKGYDLIVTNYANPDMVGHTGDLQAAIKACEAVDRGLGAVVAALEKVGGAMLVIADHGNCETMVDPVTGGPHTAHTTNPVPVILFGGPEGAKVHDGILADVA

SEQ ID NO: 14270 - protein, 418 aa, Agrobacterium tumefaciens; identical to SEQ ID NO: 11712

SEQ ID NO: 14271 - protein, 532 aa, Agrobacterium tumefaciens
VRNMSFDIAPRETVAIVCESGSGKSVTSLSIMRLLDRKTSRIEGKVMLGGRDLLALPEEEMRKVRGKDISMILQEPMTSLNPIFPIGKQIAEALTVHQDISSSAAKAEVIRLLEKVRIPNAASRFGDYPHQFSGGMRQRVMITMALASKPKLLIADEPTTALDVTIQGQILDLIKQLQEEEGMSVLFITHDMGVVAEVADRTIVMFRGDVVETGTTDDIFHRGQHPYTRALLSAVPKLGSMRSRLLPARFPIIDIKTGESPPVVETKDTVSGGKTPILSVKDLTTRFDIRSGLFGRKSGAVHAVEKVSFDLAEGETLSLVGESGCGKSTTGRSITRLIEPTSGNVTLDGYEVLKLDRTTLRTMRRSVQMVFQDPFASLDPRMSVGTAIMEPFMEHRLGQKAQAREKAADLLEKVGLSPDMMKRFPHEFSGGQRQRIAIARSLMLDPKVIVADEAVSALDVSIKAQVCNLLLDLQQSLNLAFLFISHDMAVVERVSHRVAVMYLGEIVEIGPRAAVFDNPQHPYTKKLMSAVP

SEQ ID NO: 14272 - protein, 410 aa, Agrobacterium tumefaciens
  unsure (1)..(410): unsure at all Xaa locations
AERVAKRQATFGASSVLFYEQPIEMVSAQGAYLYDAGGRKYLDVYNNVPSVGHCHPRVVEAIARQVGELNIHTRYLNRVVEAYTENLLSKFPAGLSNVVLTCTGSESNDLALRIARIGTGAEGFIVTEAAYHGNTALVTEVSPSSLRKRKPAAFVAIIPAPAARDGMSVASNFAASVEQAINELNSRGIKFAALIVDTIFSSDGIYADPAGFLKEAVDVVHRAGGLLIADEVQPGFGRTGGSLWGFERHGVTPDIVTMGKPMGNGFPMGGVVTRLDLLQRFCEETGYFNTLGGNPVAAAAGHAVLRVINQXGLIERSATVGGYFKQSLQALQSRHSEIGDVRGAGLFIGLDFVDPATGEPDSTRATHAINQLRHNSILIGAAGKYGATLKIRPPLCFSNEDVDLFTGTLD

SEQ ID NO: 14273 - protein, 246 aa, Agrobacterium tumefaciens
LKSLQGKTVIVTGASRGIGKGIALRFGEAGLNVLVVSRSQVDADRVASEIGVNGSGFAADVSTEEGCKAMVDAAVTRYGGVNVLCANAGIFPAAKLGEMSAADFDHVISTNLKSTFLSVSAVLPAMTSAGAGRIIITSSITGPITGYPGWSHYGASKAGQLGFMRTAAIELAPKNITVNAVMPGNIMTEGLEGNGPDYIATMEASVPLRRLGMPADIANAALFFASEEAAYITGQSIVVDGGQILP

SEQ ID NO: 14274 - protein, 272 aa, Agrobacterium tumefaciens
FVKNKDGVEIYFKDWGPKDAQPIVFHHGWPLSSDDWDAQMLFFVQNGYRVVAHDRRGHGRSQQVSDGHDMDHYAADASAVAEHLDLRNAVHIGHSTGGGEVARYVAKFGQPQGRVAKAVLVSAVPPLMLKTPSNPGGLPIEVFDSFRKGVAENRAQFFLDVPAGPFYGFNRPDAKIYPGVIRNWWRQGMMGSAKAHYDGVKAFSETDQTEDLKAITVPTLVLHGDDDQVVPIADSAELSVKLLKNGTLKVYKGYPHGMLTTHADVINPDLLA

SEQ ID NO: 14275 - protein, 551 aa, Agrobacterium tumefaciens
MYRYDEFDHAFVEGRVAQFRDQVERRLSGELAEDAFKPLRLMNGVYLQLHAYMLRVAIPYGTLNSQQMRMLAHIARKYDRGYGHFTTRQNIQYNWPRLSDTPDILSELASVEMHALQTSGNCIRNVTADHFAGAAADEVADPRPYAEILRQWSSVHPEFSFLPRKFKIAVTGAERDRAAIQVHDIGLHLKKNDKGEIGFAVYVGGGQGRTPMIAKKIRDFLPEEDLLSYTTAVMRVYNLHGRRDNKYKARIKILVHETGAEELARQVEVEFAELKNTELKLPDADIAAITAYFAPPALKDRPEGWESLARWKRADEGFARFVEQNVAPHKHPDYGMVTISLKPIGGIPGDATDEQMELVADIAAEYAFDEIRISHEQNIILPHVALADLEPVYRALVGAGLATANAGLITDIIACPGLDYCALANARSIPVAQEISTRFGAPERQAEIGELKIKISGCINACGHHHVGHIGLLGVEKKGAELYQITLGGSGDENTSIGEIIGPGFEPEKVTDAVETIVDTYLGLRLSKEETFLEAYRRVGPQPFKDALYGS

SEQ ID NO: 14276 - protein, 256 aa, Agrobacterium tumefaciens; identical to SEQ ID NO: 11666

SEQ ID NO: 14277 - protein, 311 aa, Agrobacterium tumefaciens; identical to SEQ ID NO: 11667

SEQ ID NO: 14278 - protein, 244 aa, Agrobacterium tumefaciens
NDPTHQFLVQPIIPIEIGGVDFSFTNASLFMVATVAAASGFLYFATSNRGLIPTRMQSVAEMSYEFIASMLREGAGKKGMVFFPFVFSLFMFVLTANLLGMFPYFFTVTSQIIVTFALACLVIGTVIVYGFYKHGLHFFGIFAPSGVPKALLPLVASIEMISFLSRPISLSVRLFANMLAGHITLKVFAGFVASMGALGALGVGGAVLPLIMTVAMTALEFLVAFLQAYVFAVLTCMYLNDAVH

SEQ ID NO: 14279 - protein, 260 aa, Agrobacterium tumefaciens
RGVLMICHGLVEHAGRYRRFADVMAKQGFEVYAHDHRGHGRTKAADAPLGRFAWKDGAEKVVSDVMAIRVMVGERHPGLPVILFGHSMGGLVALNAAVNHPDAFDGLSIWNSNLNPGVMGRIAQVVLRLEKMLKGSDVPSAILPKATFRAWNAKMPEKRTHADWLSHDKAAVDAYVEDPLCQFEASVSLWQDVFDLSYRAPKLIERLPKTLPLLLVSGDQDAATNDGREIVWLAERFRHAGFSHVEHTIYKGMRHETLNE

SEQ ID NO: 14280 - protein, 307 aa, Agrobacterium tumefaciens
MLAIFCDTPGQLTAKDLPNPVRGEGEVLVRIRRIGVCGTDLHIFTGNQPYLSYPRIMGHELSGTVEEAPAGSHLSAGDVVTIIPYMSCGKCNACLKGKSNCCRNIGVLGVHRDGGMVEYLSVPQQFVLKAEGLSLDQAAMTEFLAIGAHAVRRGAVEKGQKVLIVGAGPIGMAVAVFAVLDGTEVTMIDGRTDRLDFCKDHLGVAHTVALGDGDKDRLSDITGGNFFDAVFDATGNPKAMERGFSFVGHGGSYVLVSIVASDISFNDPEFHKRETTLLGSRNATADDFELLLRALREGKVPEALITH

SEQ ID NO: 14281 - protein, 298 aa, Agrobacterium tumefaciens; identical to SEQ ID NO: 11397

SEQ ID NO: 14282 - protein, 256 aa, Agrobacterium tumefaciens
VKLATYNVNGINGRLEVLLRWLAEAKPDVVCLQELKAPNDKFPRREIERAGYGAIWRGQKSWNGVAILARDQEPRETRRGLPGDPDDSHSRYIEAAIDGIVIGCLYLPNGNPAPGPKFDYKLRWFERLYSYAAELFELDVPVALVGDFNVMPTDLDVYKPERWRDDALFRPEVRAAYAELIAMGWTDAVRLLHPEERIYTFWKYFRNAFARDAGLRIDHFLLSPSLRERLQTCGVDKFARAWEHTSDHAPVWIELD

SEQ ID NO: 14283 - protein, 373 aa, Agrobacterium tumefaciens
RILDFIKTRRPEGPCLVVDLDVVRDNFNAFRHSLPNSAIYYAVKANPAPEILKLLASLGSNFDCASVAEIQMALDAGATSDRISFGNTIKKERDVARAHALGIDLFAVDSHEEVEKVARAAPGARVFCRVLTDGEGAEWPLSRKFGCVPQMAVDVLVYAHQMGLESYGVSFHVGSQMMNLDAWDAALADAKRVFASLAKQGIHLQMVNMGGGFPTKYLRDVPAAEEYGQAIDTALRKHFGNQIPKTIIEPGRGMVGNAGVIKAEVVLVSKKSDNDNHRWVFLDIGKFGGLAETMDEAIRYPIRTERDQDEMQPCVLAGPTCDSADVLYEKNMYPLPVSLTIGDEVLIEGTGAYTTTYSAVAFNGFEPLKAYVI

SEQ ID NO: 14284 - protein, 279 aa, Agrobacterium tumefaciens
KFYIDGKWVLPSGSDKVAVINPATELEFAEIALGNDEHVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTR

SEQ ID NO: 14285 - protein, 230 aa, Agrobacterium tumefaciens
MTAITDIIAREILDSRGNPTVEVDVYLEDGSMGRAAVPSGASTGAHEAVELRDGGKRYLGKGVEKAVEAVNTEIFDAIGGFDAENQIQIDQMMIALDGTPNKSRLGANAILGVSLAIAKAAAEASGLPLYRYVGGPNAHLLPVPMMNIINGGAHADNPIDFQEFMILPVGAENILEAVRMGSEVFHTLKKELSAQGHNTNVGDEGGFAPGLESAPAALDFIMKSIEKAGY

SEQ ID NO: 14286 - protein, 473 aa, Agrobacterium tumefaciens; identical to SEQ ID NO: 11694

SEQ ID NO: 14287 - protein, 347 aa, Agrobacterium tumefaciens; identical to SEQ ID NO: 11695

SEQ ID NO: 14288 - protein, 294 aa, Agrobacterium tumefaciens
  unsure (1)..(294): unsure at all Xaa locations
FTGHGGKQLRYAIFRATRSIARGTVVLLHGRNECIEKYFETVADLTAMGFWVATFDTRGQGGSERLLKKPGVGHVRRFSDYQRDISLFLEQVVLPDTRLPFFMIAHSTGALAALAAAPGLSNRIDRLALCSPFIELDSQQSVPRSVIRLVATALSLVGLGRVQLGRDQRERDFDGNPLTSDARRFARNLTLHRQFPELFIGAPTARWVYEALKTMGRVTRQDHLTNITVPTLILAPMLDTITPYKAQEELSRNFRAAQLLPITGARHELLHERDVFRKQALAAIDAFFAPEXWP

SEQ ID NO: 14289 - protein, 225 aa, Agrobacterium tumefaciens; identical to SEQ ID NO: 11674

SEQ ID NO: 14290 - protein, 403 aa, Agrobacterium tumefaciens; identical to SEQ ID NO: 11431

SEQ ID NO: 14291 - protein, 261 aa, Agrobacterium tumefaciens; identical to SEQ ID NO: 11750

SEQ ID NO: 14292 - protein, 351 aa, Agrobacterium tumefaciens; identical to SEQ ID NO: 11621

SEQ ID NO: 14293 - protein, 418 aa, Agrobacterium tumefaciens
FGYIDGVLHAENVPVPEIAKAVGTPFYVYSTATLERHYKVFSGAFADVDAMVCYAMKANSNQAVLKTLAKLGAGIDVVSGGELRRALAAGVPASRIMFSGVGKTVAEMDYALEAGIYCFNIESEPELEVLNLRAVKAGKRAHVSFRINPDVDARTHAKISTGKKENKFGISYERARAVYAHAATLPGIEVTGIDMHIGSQITELQPFEDAFRLLRELVEVLRTDGHAISHVDIGGGLGIPYRDDNNPPPLPDAYAHIVKNELKSLNCKIVTEPGRLIVGNAGILVTEVIYVKDGGDKTFVIVDGAMNDLIRPTLYEAYHGIRPVVQPSENAPRIKADIVGPVCETGDYLALDREMAAPQPGDLIAVSSAGAYGAVQAGTYNSRLLVPEVLVKGDRFHVIRPRGTYEELIALDSVPAWL

SEQ ID NO: 14294 - protein, 453 aa, Agrobacterium tumefaciens
QKSSNQMWGGRFASGPSAIMEEINASIGFDKKLYAQDIRGSIAHATMLAEKGIISQEDKEKIVHGLNTILSEIEAGTFEFSRKLEDIHMNIEARLATLIGTAAGRLHTARSRNDQVALDFRLWVKEELQKTEGMLTALIAAFLDRAEENADTVMPGFTHLQTAQPVTFGHHCMAYVEMFGRDRARVRHAIEHLDESPIGAAALAGTGYPIDRHMTAKALGFREPTRNSIDTVSDRDFALEFLSIASICATHLSRLAEEIVIWSTPQFGFIRLSDAFSTGSSIMPQKKNPDAAELVRAKTGRINGSLVALLTVMKGLPLAYSKDMQEDKEQVFDSAESLELAIAAMTGMIRDLEVRKDRMRAAAGSGYSTATDLADWLVREAGLPFRDAHHVTGNAVALAEKKGCDLADLSLEELQAIHPDITNGIFDVLSVEASVASRTSFGGTAPSEVRKQI

SEQ ID NO: 14295 - protein, 288 aa, Agrobacterium tumefaciens
KNIGVIGAGQMGCGIAHVSAIAGYRVHIYDLSKEGIEAGLATINGNLARQVTNNKLSDDARKQALALISGSTDVNDLAPMDIVIEAATENEEIKRKIYAQVCPVLKPEALLATNTSSLSITRLASATDRPEQFMGIHFMNPVPVMKLVELVRGIATNEKPFDAAKAYVRTLEKAITVAEDFPAFIVNRILLPMINEAIYTLYEGRGSVEAIDTAMRLGANTRMGPLQLADFIGLDTCLSIMQVLHDGLSDSKYRPCPLLVKYVEAGWLGRKSGRGFYDYRGETPVPTR

SEQ ID NO: 14296 - protein, 527 aa, Agrobacterium tumefaciens
LVGVDVGTGSARAGVFDVAGKLLATAKRPISMHREDGGIAEQSSAEVWQAVCDSVRDSVSRAGIDPAEVTGIGFDATCSLVVRGPGDVTLPVGAADHPERDIIVWMDHRAVEQAERINAGKHAVLKYVGGRISPEMQTPKLLWLSENRPDIYARAEHFFDLTDFLTWKASGALDRSACTVTCKWTYLAHENRWDAEYFTKIGLGDLAEQGFRRIGESVVHPGTALGNGLTEEAAKAMGLVAGTAVAAGLIDAHAGGVGTVAAGGDASRCLGYVFGTSSCTMTTTTEPAFVPGVWGPYYSAMVPGAWLNEGGQSAAGAAIDYLVQLHPAFAEAKALADKDGKALPVWLADRALSLAASASAAVKLAEDFHMVPEFLGNRAPFADPHARAIIAGYGMETGVDSLVALYVAGLLGLGYGLRQIIETQARNGAPVETISVSGGAGAHPLARQLLADATGLPVELTECEEPVLLGSAMLGAVAAGTYPDLMAAMPAMSRIDSSAMPDPDFQKIHQARYDAFLALQNAARAIR

SEQ ID NO: 14297 - protein, 238 aa, Agrobacterium tumefaciens; identical to SEQ ID NO: 11484

SEQ ID NO: 14298 - protein, 237 aa, Agrobacterium tumefaciens; identical to SEQ ID NO: 11721

SEQ ID NO: 14299 - protein, 226 aa, Agrobacterium tumefaciens; identical to SEQ ID NO: 11705

SEQ ID NO: 14300 - protein, 903 aa, Agrobacterium tumefaciens
LKISKILVANRSEIAIRVFRAANELGIKTVAIWAEEDKLSLHRFKADESYQVGRGPHLAKDMGPIESYLSIEEVIRVAKLSGADAIHPGYGLLSESPEFVEACNKAGITFIGPTPDTMRQLGNKVAARNLAISVDVPVVPATNPLPDDIAEVERMAEEIGYPVMLKASWGGGGRGMRAIRKKEDLAREVTEAKREAKAAFGKDEVYLEKLVERARHVESQILGDTHGNVVHLFERDCSIQRRNQKVVERAPAPYLSEAQRQELAAYSLKIAAATNYIGAGTVEYLMDADTGKFYFIEVNPRIQVEHTVTEVVTGIDIVKAQIHILEGAAIGTAESGVPKQEDIRLNGHALQCRITTEDPEHNFIPYYGRITAYRSASGFGIRLDGGTSYTGAVITRYYDPLLVKVTAWAPEPDEAISRMDRALREFRIRGVATNLTFLEAIIGHDSFRNNTYTTRFIDSTPELFAQVKRQDRATKLLTYLADVTVNGHPETKGRAKPADKAAKPIVPYIDAPTPDGTKQLLDKLGPKGFADWMRNEKRVLVTDTTMRDGHQSLLATRVRTHDIARVASVYSKALPQLLSLECWGGATFDVSMRFLTEDPWERLSLIREGAPNLLLQMLLRGANGVGYKNYPDNVVKYFVRQAARGGVDLFRVFDCLNWVENMRVSMDAIAEENKLCEATICYTGDLLNSARPKYDLKYYTNLAVELEKAGAHIIAVKDMAGLLKPAAAKVLFKALREATGLPIHFHTHDTSGISAATVLAAVDAGVDAVDAAMDAFSGNTSQPCLGSIVEALSGSERDTGLDTEWIRRISFYWEAVRNQYAAFESDLKGPASEVYLHEMPGGQFTNLKEQARSLGLESRWHEVAQAYADANRMFGDIVKVTPSSKVVGDMALMMVSQDLTVAD

SEQ ID NO: 14301 - protein, 392 aa, Agrobacterium tumefaciens
GAVKPPVFLTSTFVFKSAEDGRDFFDYVSGRKEPPAGKGAGLVYSRFNHPNSEIVEDRLAVYERTESCALFSSGMSAISTTLFAFVRPGDTVLHSQPVYGGTETLLAKTFHNFGVSAVGFADGVSEASVMAAAETAMAKGRVSVILIETPANPTNSIVDVAMMRRVADVIGEKQGHRPIIACDNTLLGPVFQQPIEHGADISLYSLTKYVGGHSDLIAGAALGRKDVMKQVKALRGAIGTQLDPHSCWMLGRSLETLQIRMERANSNAKIVAEFLKAHPKVEKIHYLPFSDPASAVGKVFAAQCSGAGSTFSFDIVGGQPASFKFLNALTIFKLAVSLGGTESLASHPATMTHSGVPADVRQRIGVLDSTIRLSIGIEHPDDLIADLTLALD

SEQ ID NO: 14302 - protein, 312 aa, Agrobacterium tumefaciens
MALATRASGGADRRKPVRARAATGLHLVSCHKTQLLGFSIRNAASWTIHPQGCEDLTAAGLTIIAPHDSPNTDGFNPESCRNVMISGVRFSVGDDCIAVKAGKRGPDGEDDHLAETRGISVRHCLMQRGHGGLVIGSEMSGGVHDVTVEDCDMIGTDRGLRLKTRRGRGGMVGNITMRRVLLDGVQTALSANAHYHCDADGHDDWVQSRNPAPVNDGTPFVDGITVEDVEIRNLAHAAGVFLGLPEAPSATSLSATSPSSRHDPSAVATPPIMADRVRPMRHEAIVFEQADVVCDDPALLNDAPVSISSYFD

SEQ ID NO: 14303 - protein, 480 aa, Agrobacterium tumefaciens
  unsure (1)..(480): unsure at all Xaa locations
MNVLSVSSEIYPLIKTGGLADVVGALPIALEAHGVRTRTLIPGYPAVKAAVTDPVKCFEFTDLLGEKADLLEVQHERLDLLILDAPAYYERSGGPYLGQTGKDYPDNWKRFAALSLAAARIGAGVLPGWRPDMVHAHDWQAAMTPVYMRYAETPEIPSLLTIHNIAFQGQFGANIFSKLALPAHAFGMEGIEYYNDVSFLKGGLQTATALSTVSPSYAEEILTAEFGMGLEGVIGSRAHVLHGIVNGIYCYVWNTGTDHLIHDNYXARHPKNSALNKKAVAEHFRIDDDGSPLXCVISRLTWQKGIHLMAEAVDEIVSIERRLVVMGAGDVALEGALLAAASRHHXRVGVAIGYNEPLSHLMQAGCDAIIIPSRFEPCGLTQLYALRYGCIPVVARTGGLADTVIDANHAALASKAATGVQFSPVTLDGLKQAIRRTVRYYHDPKLWTQMQKLGMKSDVSWEKSAGLYAALYSQLISKGH

SEQ ID NO: 14304 - protein, 542 aa, Agrobacterium tumefaciens
MIKTIKTTPYQDQKPGTSGLRKKVPVFAQENYAENFIQSIFDALEGFEGQTLVIGGDGRYYNREVIQKAIKMAAAAGFGKVLVGQGGILSTPAASNVIRKYKAFGGIVLSASHNPGGPTEDFGIKYNIGNGGPAPEKITDAIYARSKVIDSYKISDAADIDLDKIGSFKVDELTVDVIDPVADYAALMEELFDFGAIRSLIAGGFKVVVDSMSAVTGPYAVEILEKRLGAPKGSVRNATPLPDFGGHHPDPNLVHAKELYDDVMSPEGPDFGAASDGDGDRNMVVGKGMFVTPSDSLAIIAANAKLAPGYAAGISGIARSMPTSAAADRVAEKLGLGMYETPTGWKFFGNLMDAGKVTICGEESFGTGSNHVREKDGLWAVLYWLNIVAARKESVKDIVTKHWAEYGRNYYSRHDYEEVDSDAANTLVAILREKLATLPGTSYGNLKVAAADDFAYHDPVDQSVSKNQGIRILFEGGSRIVLRLSGTGTAGATLRLYVERYEPDAARHGIETQSALADLISVADTIAGIKAHTGRSEPTVIT

SEQ ID NO: 14305 - protein, 889 aa, Agrobacterium tumefaciens
SARQRLASDPASSAWVSANAGSGKTHVLTQRVIRLLLAGCRPSAILCLTYTKAAASEMSSRVFDRLAEWATLPDSDLKDRITTIEGKVPDRIKLAEARRLFAKALETPGGLKIQTIHAFCEALLHQFPLEANVAGHFSVLDDRAATTLLAEARRSLLTAVSTEDDAELVQALAYVLDLADESGLEALLSAIIANRSALRSFLHEAKQSGGLDVRLRQEMQIAAGETEETAAEAFWPLPGLSGLVLDTYLTLADEVGGSRVIEVAYALREAKRQPDPVRRMELIEAALLTAKGEKKSDAYVINKGMQKSAPDLVDALTLARDHVVACRNRYRLVRMLVATKSALVLAERLIGDFEDLKKQRSQLDFEDLIERAANLLNRDTAGAWVHYKLDQGIDHILVDEAQDTSPVQWSIIQSLAADFFNGESARMGRRTLFAVGDEKQSIYSFQGARPERFSQERDETKRRVDQVEQAFHRIRLPLSFRSTEDVLAAVDQVFSDPKNASGLSADNEPVEHRSNRAGHPGTVEVWDMVAPETTEDEEDWTAPFDALRESAPATIVARRIAARIADMIGNQTIIEKGVERAVEPGDILVLVRKRAAFVNALTRELKRRKNIPVAGADRLRLTDHIAVQDLLALGRFVVLPEDDLSLAALLKSPLFNLTEDDVFEIAATRSEAESVWQRLQVLSGEETSRLSIVTDKLRHFISLSKTATVHDFFAAVLTLHDGRKKFLGRLGNEASDVLDEFLSFALDHERTGLPGLQAFLSVLETDSPEVKREQDKDRGEVRIMTVHASKGLEAPVVFVVDGGSKAFNHSHVPKLRFVEGDGDAFPVWLPGSGFSNHLIRSDEERLKTAAEDEYRRLLYVAMTRAADHLVVCGYRGQKENPECWHAIVK

SEQ ID NO: 14306 - protein, 302 aa, Agrobacterium tumefaciens
KKILVLGGAHIDRRGMIETETAPGASNPGSWMEEAGGGGFNAARNLSRLGFEVRIIAPRGGDVTGEVVAEAARQAGVEDTPFTFLDRRTPSYTAILERDGNLVIALADMDLYKLFTPRRLKVRAVREAIIASDFLLCDANLPEDTLTALGLIARACEKPLAAIAISPAKAVKLKAALGDIDILFMNEAEARALTGETAENVRDWPNILRKAGLSGGVVTRGASEVVAFNGTEKAILHPPLIREVKDVTGAGDAMASGYLAAIAEGKTIREALRQGAAAAAITVQSSFATFQDLSKDSVEAML

SEQ ID NO: 14307 - protein, 443 aa, Agrobacterium tumefaciens; identical to SEQ ID NO: 11734

SEQ ID NO: 14308 - protein, 166 aa, Agrobacterium tumefaciens
VTIIVAVSENGVIGRDLDMPWKLSTDLKRFKAMTMGKPLIMGRKTFLSVGERPLPGRPHIIVSRNADYRPEGVDVVSSLDEAVKLAKTKAVELGVDEVFVAGGGEIYRQAMPFADQLSVTHVAVKLDGDTFFPEIDPAVFEKTEEKAASAGEKDNYPVLFTTYVRR

SEQ ID NO: 14309 - protein, 290 aa, Agrobacterium tumefaciens; identical to SEQ ID NO: 11565

SEQ ID NO: 14310 - protein, 239 aa, Agrobacterium tumefaciens
DFNGRTVVITAAGQGIGRATAERFISLGARVIATDINEQALSTLKGAETRVLNVLDGDGVEDFAADIGHADVLFNCAGFVHSGTILDCEEKDWDFSFDLNAKAMYRTCRAFLPGMLEKGKGAIVNMSSVASSVKGVPNRFAYTASKAAVVGLTKAIAADFVTKGIRCNAICPGTVDSPSLHDRLRATGNYEQALADIIARQSMGHIATPEEIAALVTYLASDEAGLTTGQIHVIDGGWT

SEQ ID NO: 14311 - protein, 169 aa, Agrobacterium tumefaciens
DALDVARALIGAEFRVGKAGGIIVETEAYHPDDPASHAFNGQTPRNRAMFGPAGHLYVYRSYGIHWCANFVCAPGSAVLLRAIEPLTGIDMMKLRRGTDKLKLLCSGPGKLCQAMAITGEMDGAPLNAPPFLLRLPKEAAAISTGRRIGISRAVDYPWRFGLEGSAFVS

SEQ ID NO: 14312 - protein, 250 aa, Agrobacterium tumefaciens
KVALVTGAGSGIGRAAALHLAAAGFSVGLLGRTESELQTVAAEIEAASGSSRLLLADVSDEAAMRHAVATLVDDFGRLDVVVANAGVNGVWAPIDELKPSDWDDTIRINLRGTYLTVHASVPHLKAAGGGSIVIVSSINGTRTFTSPGATAYSVTKAGQLAMAQQLALELGRHRIRVNAVCPGEIETAINENTDIRGRERTEVPVRFPAGDIPVTGGVAGTSEDVAELIGFLASDASRHITGTPVWIDGG

SEQ ID NO: 14313 - protein, 397 aa, Agrobacterium tumefaciens
FDISENDLLIGGLSVRDIVAETGTPCFLYDNSAMRQAYRDLETALSGFADIYYSVKANPLPAIISLFREEGAGAEIASVGEYRAAVKAGVAPDNIIFAGPGKSMAELREVIEGGIGEIHIESAEEIARIEAINRPVKASIRINPVPDAQAGAMRMGGKATAFGFDEEELENVLKLFANVRHIDLVGIHIYGGTQILDADMLVSQWRHAIALAGRMAQMLGKPLETIDLGGGLGIPYFAGETSLDLAKVAAAIPDLKALLKAHPLIADAHVIVEPGRFLAGPGGLYVVEVNSVKTSRGTTFVVTDGGMHHHLAASGNLGQIVKRNYPIVAPAMMQAAHDETATIVGPLCTPLDTLARNATLPKLNAGDLLAILQSGAYGASASPGGFLSHTVAKEVLV

SEQ ID NO: 14314 - protein, 266 aa, Agrobacterium tumefaciens
VPALGLGTWNMGETRSSADDEIESIRKAIDLGMTLVDTAEMYADGRSEEVVGTAIAGRRDEVFLVSKVYPWNASARGTAEACERSLARLGTDHIDLYLLHWRGEHPLGETVAAFERLKSDGKIGNWGVSNFDTDDMEELFTVPEGKNCAANQVLYNLSRRGPEFSLLPWCQEHGVPLMAYSPIEQGRILKNHELIRIAKAYQATPAQLALAFLLDRDGVIAIPKSASVSRIVENRGATDLEITEEDWTALDAAFPPPTRKTSLEML

SEQ ID NO: 14315 - protein, 335 aa, Agrobacterium tumefaciens; identical to SEQ ID NO: 11660

SEQ ID NO: 14316 - protein, 200 aa, Agrobacterium tumefaciens
DVTSDADAQAAIKVAASAKGGLRILVNCAGIGTAGRILGREGPQPLGDFEQVIRVNLIGTFNMMRLAAAHMAEREQDEGQDSRQDNGVIVNTASVAAFEGQIGQAAYAASKGGIVSLALPAARELARFRIRVNTVAPGIFLTPLLQGLPQEVQESLAGQIPHPSRLGDPAEFADTVRFLIENDYMNGEVIRLDGAIRMQP

SEQ ID NO: 14317 - protein, 416 aa, Agrobacterium tumefaciens; identical to SEQ ID NO: 11699

SEQ ID NO: 14318 - protein, 291 aa, Agrobacterium tumefaciens
DVHYYTHGKIGHFVVNAPMVLGHEASGTVIETGSDVTHLKIGDRVCMEPGIPDPTSRASKLGIYNVDPAVRFWATPPIHGCLTPEVIHPAAFTYKLPDNVSFAEGAMVEPFAIGMQAALRARIQPGDIAVVTGAGPIGMMVALAALAGGCAKVIVADLAQPKLDIIAAYDGIETINIRERNLAEAVSAATDGWGCDIVFECSGAAPAILGMAKLARPGGAIVLVGMPVDPVPVDIVGLQAKELRVETVFRYANVYDRAVALIASGKVDLKPLISATIPFEDSIAGFDRAVE

SEQ ID NO: 14319 - protein, 405 aa, Agrobacterium tumefaciens
  unsure (1)..(405): unsure at all Xaa locations
EXSGQQIRRHTVSERAAFHWQDPFLLEDQLTDDERMIRDSAEAFGKSELLPRISEAYLSETTEPELFRLMGRTGLLGVTLPEEYGAANASYVAYGLVAREVERIDSGYRSMMSVQSSLVIHPIFAYGSDEQKKKYLPGLVSGELIGCFGLTEPDAGSDPGGMKTRAEKIEGGYRLRGSKMWISNAPIADVFVVWAKSEAHDNEIRGFVLEKGMKGLSAPKIGGKLSLRASITGEIVMDGVEVGEDALLPNVSGLKGPFGCLNRARYGISWGVMGAAEDCWFRSRQYGLDRKQFGKPLSGTQLYQNKLADMQTEIALGLQASLRVARLMDEHKMAPEIISIVKRNNCGKGLNIGRQARDMHGGNGIQIAYHVMRHAQNLETVNTYEGTHDVHALILGRAQTGIQAF

SEQ ID NO: 14320 - protein, 553 aa, Agrobacterium tumefaciens
DPLGPYPQKLNERLLHWCRSAPERTWMADRQGREPWRRVSYAEALDKIRRIGQFLLDHDLSVERPLLVLSENSIEHALMVLAAQHVGIASAAITPAYATSADLTKLADIRGQITPGMVFAEDATPFRRALGEVFDDGTPLVGLRNLPEDRSNTFHFETLLETEPTEAVDRAFDAVGPDTVAKFLFTSGTTGSPKAVIQTQRMLCSNQEMIADCYGYFREEPPVVVDWAPWNHTAAGNKVFNLVLYNGGTYYIDRGKPSPAQIGQTLDNLRDISPTWYFNVPAGHEMLVQAMRKDEALCRSFFRDLKMLMYAGAGMAQHTWDALTELSMATVGHAVLMGAGLGSTETAPFSLFCTEPQDKPGNIGIPAQGVTMKLVPFDGRYELRLKGPNITPGYWRNGELTAAAFDEEGFYRIGDTVKLAVADDPRRGFYFDGRMAENFKLQTGTWVAVGPLRAQLVNMFAGLIRDAVITGENRAELGALVVPFIPALRELVRGSQHLSDAEIIRHPSVRAQIVAKLSAHQKQASGSASRVMRILVMEDALRFEKGEVTDKGS

SEQ ID NO: 14321 - protein, 420 aa, Agrobacterium tumefaciens
  unsure (1)..(420): unsure at all Xaa locations
WKQMRRIVVTGMGAVSPLGANVDISWSRLLAGQSGIRRLTDDVVGDLPAKVGGVVPSLAEDPERGFDPDRIIAPKDQRKVDRFIIFALAAAEEALVQANWKPVSNEDRLRTATIIASGIGGFPAITEAVRTVDQRGVRRLSPFTIPSFLVNLAAGQVSIRHGFKGPLGAPVTACAAGVQAIGDAARLIRSNEADIAVCGGTEACMNIVSLGGFAAARSLSTGFNETPTKASRPFDTARDGFVMGEGAGVLVIEALSHALARGATPIAELVGYGTTADAHHITSGPEDGSGARRAMEIAIAQAGIAPHEIGHLNAHATSTPVGDLGEIRAIKSVFGQRKSVAVSGTKSATGHLLGAAGGLEAIFTILALKNRIAPPTLNLNAPDTELDGIDFVANLTRSLDAEYAISNGXGFGGVNASVLF

SEQ ID NO: 14322 - protein, 548 aa, Agrobacterium tumefaciens; identical to SEQ ID NO: 11578

SEQ ID NO: 14323 - protein, 546 aa, Agrobacterium tumefaciens
MARQEANEQFQITSFLDGANAAYIEQLYARYEEDPSSVSPEWQSFFKALSDNPEDVKKAAKGASWKRANWPIPANGELVSALDGNWATVEKAIEKKVQAKAEAKSADTGKPVSEAEVLQGTRDSVRAIMMIRAYRMRGHLHAKLDPLGIASAVEDYNELSPKSYGFEESDYDRKIFIDNVLGLEYATVREMVEILERTYCSTLGVEFMHMSNPEEKGWIQERIEGPDKGVDFTPEGKKAILSKLVEAEGYEQFLDVRFKGTKRFGLDGGESLIPALEQIIKRGGQDGLEEVVLGMAHRGRLNVLTNVMGKPHRAVFHEFKGGSFKPDDVEGSGDVKYHLGASSDREFDGNKVHLSLTANPSHLEIVNPVVMGKARAKQDQLAKTWDGDIIPLSERAKVLPLLLHGDAAFAGQGVVAEILGLSGLRGHRVAGTMHFIINNQIGFTTNPAFSRSSPYPSDVAKMIEAPIFHVNGDDPEAVVYAAKVATEYRMKFHKPVVIDMFCYRRFGHNEGDEPAFTQPKMYKVIRGHKTVARIYADRLIREGLIT

SEQ ID NO: 14324 - protein, 299 aa, Agrobacterium tumefaciens; identical to SEQ ID NO: 11439

SEQ ID NO: 14325 - protein, 395 aa, Agrobacterium tumefaciens; identical to SEQ ID NO: 11440

SEQ ID NO: 14326 - protein, 197 aa, Agrobacterium tumefaciens
DAMVWALQKFSGLPKNKVVGMAGVLDSARFRLFLAEEFNVSVQDVTAFVLGGHGDTMVPLARYSTVGGVPLTDLVKMGWLTAERLEQIIQRTRDGGAEIVGLLKTGSAYYAPAASAIEMAESYLKDKKRVLPAAAHLSGQYGVDDMYVGVPTIIGAGGIERVIEIELNKEEEAAFQKSVGAVAGLCEACINIAPSLK

SEQ ID NO: 14327 - protein, 536 aa, Agrobacterium tumefaciens
  unsure (1)..(536): unsure at all Xaa locations
MNELGVHNPANGVAELGLGEASRVFYNLNESELYEHAIRNGEAELTIDGALRAVTGQHTGRSPKDKFVVRDASTENTIWWDNNKPLSPENFELLRQDMLAHAAGKTLYVQDLIGGADEENALPTRVVTELAWHSLFIRNLLIRPKRETLSGFSQKLTIINLPSFKADPARHGVRSETVIACDLTNGLVLIGGTSYAGENKKSVFTVLNYLVSAKGVMPMHCSANVGPXGDSAVFFGLSGTGKTTLSADPARTLIGDDEHGWGEHGIFNFEGGCYAKAIKLSSEAEPEIYAATNRFGTVLENVVLDESRVPDFNDNSLTENTRSAYPLHFIPNASETGIAGHPKTIIMLTADAFGGLPPIARLTPEQAMYHFLSGYTAKVAGTEKGVTEPEATFSTCFGAPFMPRHPAEYGNLLRELIGKHGVDCWLVNTGWTGGAYGIGKRMPIKATRALLTAALTGDLKNAQFRTDANFGFAVPLSLDGVDGAILDPRSTWADGAAYDAQAKKLVSMFVSNFTKFEDHVDSKVRDAAPGLLLAAE

SEQ ID NO: 14328 - protein, 441 aa, Agrobacterium tumefaciens
WPVPLLERLLPRHMQIVYAINANTLLFARKEKKMADQQIRSISLIDEGGERRVRMGNLAFIGSHSINGVSALHTELMKETVFADLHSLYPERINNKTNGITPRRWLMQCNPGLTGLIREAIGDDFLDDAEKLIALDRFADDAGFREKFAEVKRLNKVRLANTVAQRMGIRVDPSAMFDIQIKRIHEYKRQLLNLIETVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGADNIVIFGMTAEEVSRARAEGHNPRAIIEGSAELSQALSSIASGVFSPDDRSRFSALMDGIYNSDWFMVAADFDAYADAQRKVDAIWSDQDSWNTKAVRNTARMGWFSSDRTIRQYATEIWRA

SEQ ID NO: 14329 - protein, 451 aa, Agrobacterium tumefaciens
MKEYDAIFIGAGQAGPFLAARMAAMGRKVVLIERKFLGGTCVNAGCMPTKTLVASAKTAQVARRASEFGVRIDGEPVVDMKAVAARARKVTLDARSGLASWFDSLETMDVVYGHARFVGAKVVSVGGSLYTAPQIFINVGARPHIPDVPGLANVPYLTSTSVIALEELPKHLVVLGGSYIGLEFAQMYRRFDAQVTVIERGQYLASREDEDISQAIADILTRDGIKVLLSHKIVSVTTDSAEITVRTDQGDVRGSHVLVAVGRQPNTDDLGLDQAGVETDRRGYITVDERLQTNVEGIWALGDCNGRGAFTHTSYNDFEIAAANLLDGGDRKVSDRILGYGLYIDPPLGRVGMTERQAKEAGHRIKVATRPMNRVGRAVEKGETLGLMKLVTEADTDRVLGAAFLGVGGDEAVYGVLDAMNLGATTEKLRWAVPIHPTVGELVPTLISDLK

SEQ ID NO: 14330 - protein, 812 aa, Agrobacterium tumefaciens
  unsure (1)..(812): unsure at all Xaa locations
MSLTRKPLASHHRIVIKIGSALLVDRKSGLKKDWLDAICEDIAALKKNGADVQVVSSGAIALGRTVLGLPSGALKLEESQAAAAVGQIALARAWSESLSRHEIVAGQILLTLSDTEERRRYLNARATINQLLKIGAIPIINENDTVATTEIRYGDNDRLAARVATMTGADLLVLLSDIDGLYTAPPHLDPDAKFLETIADITPEIEAMAGGAASELSRGGMRTKIDAGKIATAAGCGMIIASGKTLNPLKAIENGARSSWFHPPARRXRPARPGLPGNCSRPAKSMWMPGPKRRFMLGKACFPPVCGRXRAISDAAMPLPSSASKAVKWRAVLRVTMHRKRAXSSATSPTRSRRSSVMSDGRRXSIATTLXXLALPSKXNMQRRMRSMPEQAVKQSHDIDALMMTIGAQAKAASRPLSIAGTDQKNRALLAMASAIEASKEAILAANRKDLAAAESAGLAASFVDRLTLNDARIAGIAEGIRSVAALADPVGEVIAAWDRPNGLKIERVRTPLGVIGVIYESRPNVTADAGALCLKAGNAVILRGGSDSQHSSRAIHACLVQGLRIAGLPENAIQLVPVTDRAAVGALLSGLKGTVDVIVPRGGKSLVARVQSEARVPVFAHLEGICHIYVDKSADLDMAKAIVVNAKMRRTGICGAAETLLVDASAVSSHLEPVVKALLDAGCEVRGSQPVRNVVEGLEAATEEDWRTEYLDAIISVAVVDGISGAIEHIGTYSSNHTEAVIAEDPDVVARFFNELDSAILLHNASTQFADGGEFGMGAEIGIATGKMHARGPVGVEQLTSFKYRVHGTGQ

SEQ ID NO: 14331 - protein, 194 aa, Agrobacterium tumefaciens; identical to SEQ ID NO: 11469

SEQ ID NO: 14332 - protein, 260 aa, Agrobacterium tumefaciens; identical to SEQ ID NO: 11468
  unsure (1)..(260): unsure at all Xaa locations

SEQ ID NO: 14333 - protein, 209 aa, Agrobacterium tumefaciens
  unsure (1)..(209): unsure at all Xaa locations
MAVVIDGKAKAASVTEAVRKSAEALEAEKGVKPGLAVVIVGNDPASHAYVNSKSKMAKQCGFNSIQHTLPEETTQAALLKLVGELNTDASIHGILVQLPLPKHFNSDEIIQSILPEKDVDGLSVLNAGKLATGDLATGLISCTPAGAMLLVRGIHGDDLSGLNAVVIGRSNLFGKPMGQLLLNANATVTMAHSRTXDLVTVCKTXDILV

SEQ ID NO: 14334 - protein, 384 aa, Agrobacterium tumefaciens; identical to SEQ ID NO: 11777

SEQ ID NO: 14335 - protein, 230 aa, Agrobacterium tumefaciens
KHFLDLSAVGPQDLRTILDDARARKVATKAGTAEKPLAGKMLAMIFEKPSTRTRVSFDVGMRQLGGETLFLSGTEMQLGRAETIGDTAKVLSRYVDAIMIRTTDHSRLLELAEHATVPVINGLTDDTHPCQIMADIMTFEEHRGPVKGKTIAWTGDGNNVLHSFVEGSARFGYRMTMAVPMGSEPHDKFMNWARNNGGEIALYHDADKAVAGADCVVTDTWVSMNQEHKA

SEQ ID NO: 14336 - protein, 355 aa, Agrobacterium tumefaciens
VHVPLGERAYDILIGPGLIGRAGGEISARLKGRRAAIITDEHVAPLYLEGLMDGLQTDGIEAVSLTLPAGEKTKSFEHLVTVCDAVLSARVERNDAVIALGGGVIGDLAGFAAGIVRRGVRFVQIPTSLLSQVDSSVGGKTGINTRHGKNLVGVFHQPDLVLADTAVLDTLSPREFRAGYAEVVKYGLIDKPDFFFWLEKNWDDIRTGGPARIEAIATSCQAKADVVVADEKENGVRALLNLGHTFGHALEAATNYDSKRLVHGEGVAIGMVLAHQFSARLNLASPDDAARVEAHLKAVGLPTTMKDIPGELPPVETLMAAIAQDKKVKGGKLTFILTHGIGQSFVADDVASSEV

SEQ ID NO: 14337 - protein, 234 aa, Agrobacterium tumefaciens
  unsure (1)..(234): unsure at all Xaa locations
MIEAAYQHHGLTWRYINLEVSPENLKDAVAGARAMGWAGFNCSIPHKVAVIQHLDGLGESAEIIGAVNTIVRRGDRLIGENTDGKGFVKALRDVIDPKDKKVVLFGAGGAARAVCVEVALAGAAHITVVNRNRERGETVARLIDEKTPATATFAAWEDAFAIPEETDIVIHATSVGLYPDIDGLPDIDLKTLRPSMVVPHVIHHLTXTGLIPCARDDQSATMADGHSMLVNHCV

SEQ ID NO: 14338 - protein, 264 aa, Agrobacterium tumefaciens; identical to SEQ ID NO: 11489

SEQ ID NO: 14339 - protein, 430 aa, Agrobacterium tumefaciens; identical to SEQ ID NO: 11682

SEQ ID NO: 14340 - protein, 465 aa, Agrobacterium tumefaciens
TKFKTFALTSQALGLNRERPMLSNSLIELDRAHLVHPVSSFRGHEKLGVRVLKSASGATVTDMTGHQLIDGFAGLWCVNAGYGHDSIVEAAAKQMRELPYATAYFYIGIDPTIRLASELADRAPGDLNHVYFTLGGSDAVDSTIRFIRYYWHAKGQPQRDQFISIEQGYHGSTTAGSGLTALPAFHAGFGVPYDWQHKIPSHYAYRNPAGSDPAAIIASSLQILKDKIEAIGPDRVAAFYAEPIQGSGGVLVPPPGWIKAMRELCSSYGILFVADEVITGFGRTGPLFACADEDIVPDFITAAKGLTSGYVPMGAVFMADHVYDTIADFAGEAAIGHGYTYSAHPVSAAVGLEVLKLYEGGLLENGRRAGQRLMAGLEGLRNHPLVGDVRGRGMLAAIELVTDKDKKTPLPAAAALARKGFDRAWENGLIVRAFANGILGYAPPLCCTDGEIDAIVERTLKTLDQ

SEQ ID NO: 14341 - protein, 302 aa, Agrobacterium tumefaciens
LAAITVPFLAYLGAGDHALIVDSVYFPTRRFCNTMLKKLGVEVEYYDPAIGAGIEALIRPNTKLVHLEAPGSNTFEIQDVRLITDIAHRHDCVVTMDNTWATPLYFKPLDFGVDVSIHAATKYPSGHSDVLMGFVSANEKYWKALYQANTNLGICVTPDDAYQILRGMRTMGIRLEHHQKSALDIAQWLEGRDDVVRVLHPALPSFAGHELWKRDFKGASGVFSFVLKAEEGKYKQTASAFLDALTFFGLGYSWGGYESLAVSVSLVDRTIAKGPSEGPVIRLQIGLEDVADLKKDLEAGFS

SEQ ID NO: 14342 - protein, 569 aa, Agrobacterium tumefaciens; identical to SEQ ID NO: 11630
  unsure (1)..(569): unsure at all Xaa locations

SEQ ID NO: 14343 - protein, 245 aa, Agrobacterium tumefaciens; identical to SEQ ID NO: 11725

SEQ ID NO: 14344 - protein, 309 aa, Agrobacterium tumefaciens; identical to SEQ ID NO: 11726

SEQ ID NO: 14345 - protein, 346 aa, Agrobacterium tumefaciens; identical to SEQ ID NO: 11727

SEQ ID NO: 14346 - protein, 204 aa, Agrobacterium tumefaciens; identical to SEQ ID NO: 11540

SEQ ID NO: 14347 - protein, 335 aa, Agrobacterium tumefaciens; identical to SEQ ID NO: 11684

SEQ ID NO: 14348 - protein, 184 aa, Agrobacterium tumefaciens
QKVAMLTAGGLAPCLSSAVGGLIERYSDIAPEIDIIAYRSGYQGVLLGERIEITKDMREKAHLLHRYGGSPIGNSRVKLTNAADCAKRGLVKEGDNPLRVAAERLAADGITILHTIGGDDTNTTAADLAAYLGANGYDLTVVGLPKTVDNDVVPIKQSLGAWTAAEVGAAFFDNVSNEQSAAPK

SEQ ID NO: 14349 - protein, 574 aa, Agrobacterium tumefaciens
MKKVLIANRGEIAVRIIRACRDYGLQSVAVYADPDQDALFVRLADEAYALEGVRPAETYLDISKLIAIAKRAGADAVHPGYGFLSERAEFAQAVIDAGLIWIGPDPDVIEALGDKVMARRIATGVGAPLVAGSDGPVSSAAEVTAFAEQHGLPVAIKAAHGGGGRGLKVAWKMEEIAELYESAVREATVAFGRGECFLERFLDRPRHIEAQVIADKHGNVLVLGTRDCSLQRRNQKLIEEAPAPFLSDEQRQKIHDAAKAICAAAGYSGAGHVEFLLGVDGTISFLEVNTPPQVEHPVTEETTGIDLVIEQFRIAEGHKLRVLETPEPRGHSMEFRINAEDPGRGFLPTPGLISVFDAPSGPGIRMDSGVISGSSIPGVFDSLMAKLIVTGVDRDQVLRRARRALREFRIEGIATVLPFHRAAIETEDFIGTDGFKVHTRWIETDFAAMPDAMERPAPADDPSITRTYLEIDGKRVSVGLPSILLSSLGTVSGGNASAPSAAVEKKEGEMTAPVSGTLQSFKVKDGETVSEGDLLAVMEAMKMETQIVATRAGKVRLIVKEGDYLQAGATLIDI

SEQ ID NO: 14350 - protein, 394 aa, Agrobacterium tumefaciens
MSNKWRPATQLVHGGTLRSPYGETSEAIYLTQGFVYENSEAAEARFKGETDGFIYARYASPTNDMFEKRMCLLEGAEDARALASGMAAVTAAIMCQLRAGDHIVAARALFGSCRWVVETLAPKYGIECTLIDGRDLDNWEKAIQPNTKLFFLESPTNPTLEVVDIAGVAKLANQIGAKVVVDNVFATPLFQKPLELGAHIVVYSATKHIDGQGRCLGGVILSDKKWIEEELQDYFRHTGPAMSPFNAWTLLKGIETLPLRVKQQTENAAKIADFLADSGKVAKVIYPGRADHPQADIIARQMSGGSTLVAFELKGGKDAAFKLQNALEIVKISNNLGDAKSLITHPGTTTHKNLSDEARAELGISGGTLRLSCGIEDTDDLLEDLAKGLAAVSA

SEQ ID NO: 14351 - protein, 319 aa, Agrobacterium tumefaciens
RMRRNRKADWTRRLVQENRLTVDDLIWPVFIVPGSNIVEPIPAMPGVNRMSVDRLVEAAKEAADLGIPAIATFPNIEMELRDETGSNALEANNLINQATIAVKKAVPNIGMITDVALDPFTSHGHDGILRGDEIVNDETVEQVVTAAILQAEAGSDIISPSEMMDGRIGAIRRGLDAAGHQNVGIMAYATKFSSGYYGPYREAISTAGLLKGDKNSYYISPANGMEAIRDAALDVEEGADMLMVKPGLPYLDICWRLKENFGLPTFAYQVSGEYTQIKAAAMNGWIDGERVMMETLLCFKRAGCDGILTYFAIEAARKL

SEQ ID NO: 14352 - protein, 250 aa, Agrobacterium tumefaciens; identical to SEQ ID NO: 11676

SEQ ID NO: 14353 - protein, 436 aa, Agrobacterium tumefaciens; identical to SEQ ID NO: 11459

SEQ ID NO: 14354 - protein, 715 aa, Agrobacterium tumefaciens
ETDADGIALVTWDMPEKSMNVFTAEVLEELNAIVDATVADGAVKGVVFTSGKSSFSGGADLSMLKSMFALYNDEKAKSPDAAAAKLFELVGRMTGLFRKIETNGKPWVSAINGTCMGGAFELSLACHGRVASSAKSLKIALPEVKVGIFPGAGGTQRVSRLTDAQSALQMMTTGQSLTGARAKAMGLVHQVVEPDQLVATAKQMIKDGLKPVAPWDEKGFKAPGGGIWTPAAAQLWPAAPAILRRESAGNYPAALAILKCVYEGLQLPFDTALKVEQRYFTEILRSKEAFGMIRSLFISMQELNKGARRPAGQPKTEFKKVGVVGAGFMGAAVAYVTAAAGIPVTLVDRDQDAADKGKGHCEESVKAAIGKGRLTQEEGKALLDLVTPTSDYATLADADLVIEAVFEDRDVKKAVIEAVEAVLPEGAIFASNTSTLPMTGLAKNSKRPADFIGIHFFSPVEKMMLTEVILGKETGDKALAVALDYVAKIRKTPIVVNDTRGFFVNRCVLRYMAESYDMLIEGVPAAMIENAAKFAGMPVGPLALNDEVAIDLSYKILKATVADLGEKAVDPRHMELVKKLVEGDGRFGRKNAKGFYDYPPKPAKKSLWPGLKDLYPQQKPEDVDMDVLKQRFLVTVALEAARTVEEGIVTDPREADVGSILGFGFAPYTGGALSYIDGMGVKNFVALAEKLSEAYGPRFQPTPLLKDMAAKGETF

SEQ ID NO: 14355 - protein, 401 aa, Agrobacterium tumefaciens
  unsure (1)..(401): unsure at all Xaa locations
TDVYIYDHVRTPRGRGKKDGSLHEVPSVRLAAKTLEAIRDRNGLDTSAVDDIIMGCVDPVMDAGAVIPKAAAFEAGYSNRAPGMQISRFCASGLDAINFAAGKVKAGSDDIVIAGGVESMSRVGMGMSGGAWYMDPSVNFPALFMPQGVXADLIATKYGFSRDDVDAYAVESQKRAAHAWENGYFNKSVIPVKDQNGLTILDRDEHMRPGTDMQALASLNPSFQMPGEMGGFEAVGIMAHPEVERINYVHHAGNSSGIVDGAAAVLVGSKAGGEAMGVKPRARIKAFANIGSDPALMLTGPVDVTEKLLKKTGMSIADIDLFELNEAFAAVVLRYMQAFDISHDRMNVNGGAIAMGHPLGATGAMILGTVLDELERRDLNTALVTLCIGAGMGTATVIERV

SEQ ID NO: 14356 - protein, 512 aa, Agrobacterium tumefaciens
QNLVAVDVGTASARAGIFDPAGRLLARSIHPILMQRPRENHAEHDSTDIWNAVCIAVKAALADAGVLPQSIAAIGFDATCSLVIRDERGEPVSVSTTDDDRFDTIVWLDHRAIGEADRLTASGHRVLDFAGNSVSPEMQMPKLMWLKTHMPQSWSRMSFAFDLADFLTWKATGSAQRSNCTQTAKWNFLAQEHPGWQADYLAFAGLDDLKERAGLPETTVMPGGAIGPLSPEAAAELGLDTGCQVAAGMIDAYAGALGALGGCLAEDVGKHVALIAGTSSCLVAMSTQPMPGRSLWGPYWQAVLPGHWLVEGGQSATGALLDHIVRMHAAGGEPDTALHARIVARVTELRELEGEAFADRLHVLPDFHGNRSPLADPHAVGVVSGLTLDTSFDSLCRLYWRTAIAIALGARHVLDAMERFGYAVETLHVTGGHVKNPLLMELYADVTGKRIVVPATADAVLLGTAMTAATAGGVHASLAAAGAAMYPGNAEISGNPALAAHYERDYRRFLAM

SEQ ID NO: 14357 - protein, 243 aa, Agrobacterium tumefaciens
SMSELAGKRALVTGASRGIGAAIAIALAEKGADVAITYERAADRAAQVVATIEGKGRKALAIQADSMDPEAVKRSVDQAAQALGGLDILVNNAAIAIYKDVADFTVAEIDALFAVNARSPILASQAAMPYLGKGGRIVTIGSAGAERIVGPSTVYSMTKSALQSFTRGLARELGPRDITVNLIQPGSTNTEMNPAEGEFGDFQRALIPLGRYGEPEDVAAAVAFLASGAARQITGTILTVDGG

SEQ ID NO: 14358 - protein, 289 aa, Agrobacterium tumefaciens
LKFEGIYTPAITPLGHDGEIDRDAFAAVLESLMEARVHGIIIGGSTGEYYAQTAQERFDLAAYARQVIGTRLPLVVGTGATRTEDSIEYAKAAKEIGADAILVSSPPYALPTERENAVHALAVDRAANLPIMLYNYPARMGVVMGEEYFSRVGKSKNVVAIKESSGDMGNLHLLARKFPQIALSCGWDDQALEFFAWGAKSWVCAGSNFLPREHVALYEACVVEKNFDKGRAIMTAMLPLMDFLECGKFVQSIKHGCEIIGLRAGSVRAPLRPLNSDEKRTLQTVVTTL

SEQ ID NO: 14359 - protein, 488 aa, Agrobacterium tumefaciens
AEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVLRCVLPRNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKSMLLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDV

SEQ ID NO: 14360 - protein, 284 aa, Agrobacterium tumefaciens
DSNEVLVDCQNVWKIFGARASTAVKAVARGGLSKKQVLEDFDCVVGVCDASLQVHRGEIFCIMGLSGSGKSTLIRLLNRLIEPSLGKITVKGKDIARLNAAELRELRARPIAMVFQSVALLPYRTVLENCRFSLEVRGVAKDERNRIARAALEKVGLADSPAPYPHELSGGMQQRVGLARALAADPEIILMDEPFSALDPLIRRQLQDEFRQLKKSLVKSAVFITHDLEEAIRIGDRIAIMKDGVIVQVGTAQEIVTKPADDYVSDFVAGISRIHLVKAHTVMQ

SEQ ID NO: 14361 - protein, 224 aa, Agrobacterium tumefaciens
ISAVLITGASTGIGATYAERFARRGHDLVLVARDMARMEALASRLSQETGVRIDILPADLTQATDLVKVETRLRDDERIGILVNNAGTAIGGTFVDQSVDDMTRLVALNATALVRLAGAIAPRLAKAGEGAIVNIGSVVGLAPEFGMTVYGATKAFVLFLSQGLAHELGPKGVYVQAVLPATTRTEIWDHVGADVNTLNNVMEVGDLVDAALVGFDRREPVTIP

SEQ ID NO: 14362 - protein, 606 aa, Agrobacterium tumefaciens
  unsure (1)..(606): unsure at all Xaa locations
LKEIAAHKKTDAALQDAKETAEAANRAKSRYVVGLSHELRTPLNAVLGYAQILERDETIPAPRQSAIKVIRRSADHLSGLIDGLLDISKIEAGRLQVYSNEINIKDFLDQVVDMFRPQAQAKGLEFRHERTAALPQYVRTDEKRLRQILVNLLSNAIKFTDEGSVTFDVAYRSQVASFTVSDTGRGIAEKDLARIYEPFQRGEAESVRPMPGLGLGLTITRLLTNTLGGEISVSSEKDNGSTFRVRLMLSAVHRPSTAPAPEKTIRSYSGPRRTIVVVDDNEDHRELMRQVLSPLDFVVLTAQSGPECLTLIEGVKPDLFLIDISMPGMTGWQLVTKLREAGQTAPLIMLSANIGDGAVAGAGDDNHNDAIAKPVDIRHLCDRLAVHLGLKWIYETDLPSAPVTQPPAQVVHPGAIHIKDLQRLGEIGYIRGIEAKLADLARNTDNLPFTQELGTYVQAFDLAGYRPFSQAVXRQRQGRRRGMSGQVAAAPRDLVLLVDDSPDALGFLTDALEQSGFSALIATSGQAALNIAERITPDIILLDAVMPVMDGFETCRRLKANAAVAQVPVIFMTGLTETEHVVRALESGGVDYLTKPINIDELRARI

SEQ ID NO: 14363 - protein, 391 aa, Agrobacterium tumefaciens
AIVAMLLVAGTTSLSAWIMRDIVNSVYLKQGFDVVLEIAFAVAAIFIVKGLATFVQSYYLSKAGNSIVAEQQRKIYDRLLKQGVSFFQNLPSSELLVRVTYNAQAARSVIDTIVTSFVRDLFSLLGLIIVMFAQNFLLSAISMIIGPVAIFSVRLVLRRVRKIMEAELASLGEIVNVVQETSIGVRVIKAFSLEKLMRQRMNKAVSDVEHRANGIAKLEAATSPIMETLSGLAIAVVIAVSGYTVLEKGGSPGDLMAFITALLLAYEPAKRLARMRVQIEGGMIGVRMMFEVLDAPLTLAEKKDAQPLPKASGNVELKNVSFEYVANQPVLKDVSVLFEGGKMTALVGPSGSGKSTIINLMMRLYDPQSGSVEINGMDLRDVSFASLREHV

SEQ ID NO: 14364 - protein, 251 aa, Agrobacterium tumefaciens
MRIVMIGSGYVGLVSGACFADFGHDVVCVDKMPEKIEALKSGHIPIFEPGLETIVANNAKAGRLSFTTDLSAAVANADVVFIAVGTPSRRGDGHADLGYVYAAAKEIAHALDGFTVIVTKSTVPVGTGDEVERIIREENPSADFAVVSNPEFLREGAAIEDFKRPDRIVVGLSDERARPVMTEVYRPLYLNQSPLIFTTRRDSELIKYAANAFLAMKITFINEMADLCEKVGANVQDVSRGIGLDGRIGSK

SEQ ID NO: 14365 - protein, 499 aa, Agrobacterium tumefaciens
  unsure (1)..(499): unsure at all Xaa locations
DVKQEAAALLDKMGVARDLYTGGDMASFSPVTGEQIASLRTVSVEGVAAVVDKADAAFRTWRNVPAPRRGELIRLLGEELRAFKTDLGRLVSLEAGKIPSEGLGEVQEMIDICDFAVGLSRQLYGLTIATERPGHRMMETWHPLGVVGVISAFNFPVAVWSWNAALALVCGNSVVWKPSEKTPLTALAVQGIFERAAARFGDAPEGLSQLLIGDRAVGEAMVDYPKVPLVSATGSTRMGRDVGPRLAKRFARAILELGGNNAGIVCPSADLDMALRAIAFGAMGTAGQRCTTLRRLFVHDSVYEELVPRLKKAYASVSVGNPLESSALVGPLVDKAGLDGMQKAIEAAKSAXGVVHDGDRVDTGAADAYYVKPALVEMPKQVGPVLEETFAPILYVMKYSDLDQAIDAHNAVAAGLSSSIFTRDIQESERFLSSEGSDCGIANVNIGTSGAEIGGAFGGEKETGGGRESGSDSWKAYMRRATNTINYSKALPLAQGVSF

SEQ ID NO: 14366 - protein, 252 aa, Agrobacterium tumefaciens; identical to SEQ ID NO: 11406

SEQ ID NO: 14367 - protein, 430 aa, Agrobacterium tumefaciens; identical to SEQ ID NO: 11405

SEQ ID NO: 14368 - protein, 557 aa, Agrobacterium tumefaciens
VSVAKRWLASYPRGVPSEIPASANASLIDLLEKSCKQFADRKAFSSMGKSLTYRELDADTRAVAAWLQSRGLEKGDRVAVMMPNILQNPVAVYGILRAGMVVVNVNPLYTPRELEHQLKDSGAKALFVLENFAHVAQQAVPKTAVRHVVVAAMGDLLGLKGHIVNLVVRKVKKLVPAHAIPGSISFKAMLKEGQGVSLKPVGLTAQDIAFLQYTGGTTGVSKGAVLTHANLLANKAQISLWLDAAFNGRKDRPEVLNFICALPLYHIFALTVNSLMGIALGGHNLLIANPRDIPGFVKELSHYQPHIFPGLTTLFNALMNNEEFRKLDLSSLIFVLGGGMAVQRPVAERWVSVVGCPITEGYGLSETSPVATVNRLDAAEFSGTIGLPISSTEIDIRDEDGNSLPTGEVGEICIRGPQVMAGYWQRPDETAKAITADGFFRSGDMGFMDERGYTKIVDRKKDMILVSGFNVYPNEVEEVAASHPGVLECAAIGVPDEHSGETVKLFVVKKDQSLTEAELKAFCAKNLTNYKRPKIIEFRTDLPKSNVGKILRRELRN

SEQ ID NO: 14369 - protein, 516 aa, Agrobacterium tumefaciens
  unsure (1)..(516): unsure at all Xaa locations
DLRAAFAADDQRFSRFSVKFDDLLMDYSKCAVNEEIVTLLEQLAREGGVEAKREEMFSGKAINFTEDRAVLHTALRNRSNTPVLVDDKDVMPDVNGVLAAMGKFADAIRSGSLKGATGKKITDVVNIGIGGSDLGPVMATLALAPFHDGPRAHFVSNIDGAHIADTLKLLDPETSLFIIASKTFTTIETMTNAATARRFIAEKLGEGAVKHHFAAVSTALDKVAAFGIESERASSVSWDLVGRTYSIWSAIGLPLMIAIGPDNFGKFLDGAHAMDRHFREAPIRENLPMLLGLIGFYNRNVLDYPTRAILPYDQRLSRLPAYLQQLDMESNGKGATIDGTPDECQSGPVDXCEPGTNGQHAFYQLIHQGTSVIPAEFMIAANGFEPELRHQHQLLIANCLAQSEALMKGRTLAEAKAQLTSKGMEDSQADFIAPHRVFTGNRPSITFVYDKLTPFALGRLIALYEHRVFVEGVLFRINSFDQWGVELGKELATGLLPVVEGKESAAGHDSSTQGLV

SEQ ID NO: 14370 - protein, 306 aa, Agrobacterium tumefaciens
  unsure (1)..(306): unsure at all Xaa locations
MILCCGEALIDMLPRQTTLGEAAFAPYACGAVFNTAIALGRLGVPSAFLTVLSDDMMGDILRETLRASKVDFSYCATLSRPTTIAFVKLVDGHATYAFSDENTAGRMITEAELPALGADCEALHFGAISLIPEPSGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKSFGAWRESRCGHCLAGWRKSAFRAXN

SEQ ID NO: 14371 - protein, 208 aa, Agrobacterium tumefaciens
LVLVGAGNMGGAMLSGWLKKGVPGSKVIVIDPRPSDAMRTTIAEAGATHSESVPEGVKAGILFAAVNPDMMDAILPSLKPLLGPETVVVSIAAGTTIATFVSHFGAVAAVRAMPNTPAMVGRGVTGAYANDLVTAELKTCVDGLLKVSGPVEWVEAESDIDAVTAVSGSGPAYVFYLVECMAEAGRKAGLPADVAMRLARETVAGAGE

SEQ ID NO: 14372 - protein, 391 aa, Agrobacterium tumefaciens; identical to SEQ ID NO: 11445

SEQ ID NO: 14373 - protein, 176 aa, Agrobacterium tumefaciens
MPVVRGKNIEPLYTAEQIAERNRDMAKHIAGGPTKDLLVIAVLKGSFIFAADLIRALHDSGLAPEVEFITLSSYGAGTVSQGVRIVKDIDSDVKDRDVLLIDDILESGRTLRFAKELLYERGARNVTIAVLLDKKVKRKEDLEADYVGFECPDYFVVGYGMDVAYAFRELPFVGVV

SEQ ID NO: 14374 - protein, 787 aa, Agrobacterium tumefaciens
  unsure (1)..(787): unsure at all Xaa locations
VIIAAGLFFAIGGWQLVALGGSPYFIIAGLSLIVSGLLILLRKPAGALLFGLVFILTGVWAVWEAGLHFWPLISRLLAIGVGATVVALSYPLLRRAAGKTPAYGSSFAVAAVLAIASGAGFAGMFVAHPTVAFNGEPAALTPVKPETEQKNWEHYGNTSGGSRFVALDEITRDNSRTSKSPGPTTPADTPISPGANGAEDQQTPLQVGDTVFLCTPHNNVIALDADTGTEKWKAEINSKSSVWMRCRGLAYFDAKAPLKQPTAPGSTPVTAAVVAEGALCQRRILMNTINAELIALDADTGAFCPDFGTNGRVDLKIGMGDAPDPQYVLTSAPTLAGTTVVVGGRIADNVQVDMPGGVMRGFDWSRASFAGFLTPHPDITKLPPPGQTYTRSTPNVWASMSYDPDLNTVFMPVGSPSVDLYGATRTPLDHKYGASMLALDATTGREKWVYQTVHNDLWDFDVPMQPSFVDFPKADGTSVPALVFGTKAGQLYVLDRATGQPLTKVEEVSVKAANIPNEPYAPTQPRSVGMPQIGAQTLTEADMWGATPFDQLLCRIAFKGMRYEGLYTAPGTDLSLAFPGSLGGMNWGRSVDDPTTNTIFVNDMRLGLWIEMKEAAPTKAVASGGESVNTGMGVXPIXGTGVGXNXNLFXXALXIPCQAPPYGTMTAIDMKTQQIKWQVPVGTVEDTGPLGIKMGLPIPIGMPTLGGTLATQGGLVFIAGTQDYYLRAFDTATGKEVWKARLPVGSQGGPMSYKSPKTGKQYVVISAGGARQSPDRGDYVIAYALPN

SEQ ID NO: 14375 - protein, 244 aa, Agrobacterium tumefaciens
LKSKRALITGGTSGIGLETARQFISEGARVAVTGTNPETLDAARRELGPSALVIKADAADVDGQKVVAETIREAFGGLDVVFINAGVALLKPLEAWDEKGFDRVFNINVKGPYFLLQALLPILANPASIVLNTSVNAHIGMPNSSVYAASKAALQSFIRTLSGELIARGIRLNAVSPGPISTPLYGKLGFTETDLKNVAESIQNLVPAGRFGEPSEIAKAVVFLASDEAAYTVGSEIMIDGGMG

SEQ ID NO: 14376 - protein, 313 aa, Agrobacterium tumefaciens; identical to SEQ ID NO: 11799

SEQ ID NO: 14377 - protein, 586 aa, Agrobacterium tumefaciens
  unsure (1)..(586): unsure at all Xaa locations
YSAPVDDIAFTLKHVAGLEDALSQGVLGDLSEDLVDAILEEAGRFATGEVAPLADIGDRQGAKLADGKVTTPDGWADLYRRWAEAGWNSLTAPEEFGGQNLPHMLNVAALEMWNSGSMAXALAPTLTMGAVEAIVTHGSNDLKRMCLGKLVSGEWTGTMNLTEPHAGSDLGVLKTRAERNGDGTYRIFGQKIFITWGEHDAADNIIHLVLARLPDAPTGTRGISLFLVPKFLPDENGAPGSRNDLFCHSLEHKLGIHGSPTCTMIFGDGKFGDEKGALGWLIGEENKGLACMFTMMNNARLAVGMQGVAICEAATQKAIEYAKERTQGKAPGWQGSGMSPIIEHPDIARTLLTMKALTQGSRAISFSCAHAIDMAHATEDASQRAHWQERAALLTPIAKSFSTDAGVDVASMGIQVHGGMGFIEETGAARYLRDARIAPIYEGTNGIQAIDLVLRKLPLSESAQVRGFISELREIPARTAESNRDDLGETARYLEASLNDLETTTDWLLSRIKAGETETALAGATAYQRLFGLALTGAYLAKGALVSVDDGRSGHRAALCRFTAENLLAETAALKDRVISRPPSLA

SEQ ID NO: 14378 - protein, 411 aa, Agrobacterium tumefaciens
AAFLTTKREVSEDVNATVRDIINDVRHRGDAALAHYSQKFDGIDFTRVSMRVTADEIDAAFSAVDRAVIEALELAARRIEKHHARQMPKDDIYEDDIGVGLGSRWTAIEAVGLYVPGGTASYPSSVLMNAVPAKVAGVERIVMVVPANGGAVNPAVLAAARIAGVEEIYRIGGAQAVAALAYGTETIAPVAKIVGPGNAYVAAAKRQVFGTVGIDMIAGPSEVLVIADKDNDPDWLAADLLAQAEHDRGAQSILITDNADLGKAVGAAVERQLKLLSRSETAAASWADFGAIILVEKLTDAIPLANRIAAEHLELAVDDPDALMAHIRNAGAIFVGRHTPEVIGDYVGGSNHVLPTARSARFSSGLSVLDFVKRTSILRLGPEQLRQLAPAAITLAHSEGLDAHARSVSIR

SEQ ID NO: 14379 - protein, 410 aa, Agrobacterium tumefaciens; identical to SEQ ID NO: 11762

SEQ ID NO: 14380 - protein, 186 aa, Agrobacterium tumefaciens; identical to SEQ ID NO: 11573

SEQ ID NO: 14381 - protein, 376 aa, Agrobacterium tumefaciens
  unsure (1)..(376): unsure at all Xaa locations
VKAAILREMNMSRPYATSRPLAIEXIELAPPGPGEVLVRIRAAGLCHSDLSVNNGDRPRPMPMALGHEAAGVVEALGEGVRDLEPGDHVVMVFMPSCGHCLPCAEGRPALCEPGAAANAAGRLLGGATRLNYHGEVVHHHLGVSAFAEYAVVSRNSLVKIDRDLPFVEAALFGCAVLTGVGAVVNTARVRTGSTAVVIGLGGVGLAAVLGARAAGASKIVAVDLSQEKLALASELGATAIVNGRDEDAVEQVRELTSGGADYAFEMAGSIRALENAFRMTKRGGTTVTAGLPPPGAALPLNVVQLVGEERTLKGSYIGTCVPLRDIPRFIALYRDGRLPVNRLLSGRLKLEDINEGFDRLHDGSAVRQVIEFXNRL

SEQ ID NO: 14382 - protein, 282 aa, Agrobacterium tumefaciens; identical to SEQ ID NO: 11531

SEQ ID NO: 14383 - protein, 192 aa, Agrobacterium tumefaciens; identical to SEQ ID NO: 11749

SEQ ID NO: 14384 - protein, 310 aa, Agrobacterium tumefaciens
SAAAAVGCSEGEIFLASTGVIGEPLDASKFAGVLGDMNVRAEADFWQEAAKAIMTTDTYPKVSTRTAEIGGVIVTINGISKGAGMIAPDMATMLSFVVTDADIEPAALQSLLSAGVGPTFNSVTVDSDTSTSDTLMLFATGAAAEDGQVKVTSADDERLSSFRAALNDLPEGGALQVVRDGEGARKMVEVTVTGAGNDAAAKKIALSIANSPLVKTAVAGEDANWGRVVMAVGKSGEMADRDRLAIWFGGVRVAVNGERDPDYSEAETTAVMRLEDITVKVDIGLGQGTATVWTCDLTKEYVAINGDYRS

SEQ ID NO: 14385 - protein, 339 aa, Agrobacterium tumefaciens; identical to SEQ ID NO: 11590

SEQ ID NO: 14386 - protein, 248 aa, Agrobacterium tumefaciens
NLFDLSGRRALITGSSQGIGFALAQGLSEAGAQVVLNGRDEAKLKAAAAGIKGARTLAFDATDHGAVREAIDRFEAEVGAIDILVNNAGMQHRTPLEDFPADAFERLLQTNIASVFHVGQATARHMISRGRGKIINIASVQTALARPGIAPYTATKGAVGNLTKGMATDWAKYGLQCNAIAPGYFDTPLNAALVADETFSAWLEKRTPAGRWGKVEELVGACIFLSSDASSFVNGHILYVDGGITASL

SEQ ID NO: 14387 - protein, 341 aa, Agrobacterium tumefaciens
  unsure (1)..(341): unsure at all Xaa locations
VAHGAKDVRIEDRPEEKPGPGEVRLRLARGGICGSDLHYYNHGGFGAVRLREPMVLGHEVSAVIEELGEGVEGLKIGGLVAVSPSRPCRTCRFCQEGLHNQCLNMRFYGSAMPFPHIQGAFREILVADALQCVPADGLSAGEAAMAEPLAVTLHATRRAGDLLGKRVLVTGCGPIGILSILAARRAGAAEIVATDLSDFTLGKAREAGADRVINSKDEPDALAAYGANKGTFDILYECSGAAVALAGGITALRPRGIIVQLGLGGDMSLPMMAITAKELDLRGSFRFHEEFATGVELMRKGLIDVKPFITQTVDLADAISAFEFASDRSRAMKVQIAFSXA

SEQ ID NO: 14388 - protein, 518 aa, Agrobacterium tumefaciens
RSVALLHVLPALLWLPQAGLLAFSVGKIADGEPMMAIVPAAVAVLILGLLKAWLEKVAARLSFRAARAALSQRRFEALQAVAKVSPLDLSRTASGEAAGIVAEAAEALVPYLSRFQPARMKATIVPLVFVLAILPFSWIAALVLLLAMPTIPLFMALIGWQAKAASEKQLAETGNINAFLLDRLRGLETIRTLKAVDLTAARLDADAQNLKKRTMAVLRIAFLSSAVLELFAAIGVAMTAVYIGFHLLGFLDFGAWGEKLTLAEGLFILLLAPAFFEPLRELSAVWHDRAAGEASLNALATLTAGGAAIVGEGADVVRAPSSTPGLLEMENLSFAYPNAPPVIRNFNLTVQQGERVAILGASGCGKSTILSLIAGLAEAGEGVIRIGGVTLDDATADGLRGTIGWVSQKPFFFAASMKANIGFGRLAVSEAMVEEVLHRTGLDGLTQARRHLQIGDGGNGISGGEAVRLAIARAFADPATQLVLADEPTAHLDRETAALVTDNLLQLAKGRTLIVATH

SEQ ID NO: 14389 - protein, 265 aa, Agrobacterium tumefaciens; identical to SEQ ID NO: 11701

SEQ ID NO: 14390 - protein, 338 aa, Agrobacterium tumefaciens; identical to SEQ ID NO: 11700

SEQ ID NO: 14391 - protein, 668 aa, Agrobacterium tumefaciens
MSCCAPGTEGSLELGEPLNPPSSEELLLASRDLGQGLRQTDLSVPGVYCGACITTIETALGRLGQVERARVNLSSKRVAVVWKEEVNGVRTDPADIARAILATGYRIHLFASGQDASYALRSQLIRAVALCGFASANIMLLSVSVWSGADAATRDMFHWISAMIAAPALIYGGRFFYQSAWNALKHGRTNMDVPIALAITLSYAVSLWETIHHGEHAWFDATVSLLFFLLIGRTLDHIMRDKARSAIAGLARLSPRGATVIDADGVRDYRPLADIEPGMSIAIAAGDRVAVDAVVVCGSSDLDMSIVNGESAPRRVVAGDSLQAGTLNLTGSLVARVTASAKDSFLSEVIGLMEAAEGGRARYRRIADRAASYYSPVVHLLALVTFLGWGIFGGDWKQAMLIAIAVLIITCPCALGLAVPVVQVVAAGRLFRRGIMVKEGSAMERLSEIDTVLFDKTGTLTVGKPRLVETADVKPAIMAIAAGLAAHSRHPLSKALHAAYNGALPAYEAVREIPGSGVEAETEAGTYRLGNRRFACPDETRINNGDARSEVVLSLDGRHLASFGFEDNPRAGAIAALRSLSVRGLAQEIVSGDRAAAVSAMAQRLGIGNWRADLSPKDKAARCAALAGEGHRVLMVGDGINDAPALAAAHVSMAPATAADIGRQPADF

SEQ ID NO: 14392 - protein, 210 aa, Agrobacterium tumefaciens; identical to SEQ ID NO: 11465

SEQ ID NO: 14393 - protein, 342 aa, Agrobacterium tumefaciens
VSSTLVIASPITARFVDRMKLPGKVALFDAIPGEPEISTLDAALAAARVAKPDVVIGLGGGSVMDVAKLVAALWDGEQTLADVAGPNKVAGRRTRLAQIATTAGTGSEAGIRSLITDPIKGNKIAVESPHLIADLAVLDPELTYSVPPTVTAATGVDAMAHCVEAFTSKRSHPMIDGFARMGFHLVGKFLGRAVRDGSDREAREGLMLASYYGGICLGPVNTAAGHAIAYPLGTLLHLPHGLANAIVFPHVLAFNQPVVSAKTAEVAEALGLGAGLSQTQLQDSARGFCSDLGIEMSLAKHGAAEADLSRYAADAHAIRRLMDNNPADMSVDDVLDVYKASF

SEQ ID NO: 14394 - protein, 248 aa, Agrobacterium tumefaciens; identical to SEQ ID NO: 11514

SEQ ID NO: 14395 - protein, 444 aa, Agrobacterium tumefaciens
MLSSSNTPLTGPNDRQTSIAFFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVALARVEGAYHGAYDWAEAGQHASSNTPCAAYPGMPASVIDDVVLLQFNCPPHLRQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMPYGAAASLSTPMTDNDMGDIVSVFDDFLVNLDRHAWEAA

SEQ ID NO: 14396 - protein, 489 aa, Agrobacterium tumefaciens; identical to SEQ ID NO: 11416
  unsure (1)..(489): unsure at all Xaa locations

SEQ ID NO: 14397 - protein, 575 aa, Agrobacterium tumefaciens
LGFVFNHWSHRKALVGFIIVLVVASTLAEVMVPVFSGRIVDAIAGDNGGANAGDGALRAFVIVVALGFTSVVLRWFIFNGIIRLTLKTMADVTNNGFHKVQRFSTDWHANSFAGSTVRKITRGMWALDSLNDLLLVALLPSIVMLVGATVVLGSYWPVMGLIVGLGSLIYIGVTVGLSMGYVSPPARLANAWDTRLAGALSDAIRCNAVVKAFGAETREDTRLGHVLVKWDNRTRRTCKCGTLNGTIQSFMMVSMQAGILGTGLIMWQKGLATAGDITFVLAMFFVLQGYLRDVGQDIRNLQRAVNDMEELVLLDKMPLGVEDRPDAKRINIGKGEIVFDHVTFQYGAHATPLYEDFSVTIKPGERVGLVGHSGSGKTTFVKLIQRLYDIKAGAIRIDGQNIADVTQASLRGQIAIVQQEPILFHRTLAENIAYGRPDASRREIEQAAKQASAHDFIMSLPKGYETMVGERGVKLSGGERQRVAIARAFLADAPVLILDEATSSLDSESEVQIQQAMERLMDGRTTLVIAHRLSTVRALDRLLVFDKGRIVEEGDHQALIRLHDGIYRRLFERQA

SEQ ID NO: 14398 - protein, 319 aa, Agrobacterium tumefaciens
GKGLLAADESTGTIKKRFDSINLESTETARRDYREMLFRSDDAMKKYISGVILYEETLFQKAADGTPFVDIIKAAGSLPGIKVDIGAKPMAFHPHEFITEGLDGLYERLRKYHEAGARFAKWRGVITIGEQRPSWGSIKANSQSLARYAALCQQADIVPIVEPEVLMDGEPGTHDIDRCAEVTQWVLQTVFADLFDARVNLEGMILKPNMIIDGKNARKASVEEVAEKTVKVLKATVPTAVPGIAFLSGGQSSEEATAHLSAMNAGYDLPWSLTYSYGRALQDTALKTWGGKSENVAAGQRAFTHRAAMNSLAAKGNWK

SEQ ID NO: 14399 - protein, 394 aa, Agrobacterium tumefaciens; identical to SEQ ID NO: 11609

SEQ ID NO: 14400 - protein, 230 aa, Agrobacterium tumefaciens; identical to SEQ ID NO: 11786

SEQ ID NO: 14401 - protein, 256 aa, Agrobacterium tumefaciens
PEAPSGRRALITGASSGLGIEFAELLAAQKMNLVLAARRKEPMEKLAEDLRRRHGVDILVEPIDLAAPGAAARLKDSLNERAIQIDILVNNAGYGLQGEFLKTPIERTTDMIQLNITALTELSYVFGRDMAARGSGEILLIASLLAFQPVPTYAAYAATKSYVLSFGEALHDELRTQGVVVTSLCPGHTETGFDAAAGAQVSPMLRLLTMKPRPVAEAGLEALAKGKASVIAGFMNKVVAFSTRLTPRSMQRASMR

SEQ ID NO: 14402 - protein, 568 aa, Agrobacterium tumefaciens
GERFVSSSFSQRPLGGVIMADNHYDAIVVGSGISGGWAAKELTQKGLKVLMLERGRNIEHVTDYQNADKEAWDYPHRNRATQEMKAKYPVLSRDYLLEEATLGMWADEQETPYVEEKRFDWFRGYHVGGRSLLWGRQTYRWSQTDFEANAKDGIAVDWPIRYEDVSPWYDYVERFAGISGSREGLDILPDGEFLPPIPLNFVEQDVASRLKKAFKGTRHLINSRCANITQELPDQERTPCQFRNKCRLGCPFGGYFSTQASTLPAAVATGNLTLRPFSIVKEILYDKDKKKARGVEIIDAETNLTYEYTADIIFLNASTLNSTWVLMNSATDVWEGGLGSSSGELGHNVMDHHFRMGATGQVDGFEDFYFKGRRPAGFYIPRFRNTGDDKRKYLRGFGYQGSASRSRWEREIAELNIGADYKDTLTEPGGWTIGMTAFGEMLPYHDNRVKLDHDKKDKWGLPVLSMNVEMKQNELDMREDMVNDAVEMFEAVGIKNVKPSRGTYAPGMGIHEMGTARMGRDPKTSVLNGNNQVWDAPNVFVTDGACMTSASCVNPSLTYMALTARAAE

SEQ ID NO: 14403 - protein, 637 aa, Agrobacterium tumefaciens
LSTGNIAPLSKAQVSALSTTQFAAMSTDQIKALTSDQVAGLSSAQVATLSSDELALFSTDEIKAIGANAVAGLSAAALAALTTDNAAALTKTQIAGLSSTQLNALTSANLATFSADEIKAISTKALAGLDVTKLSTGNIAALTKTQAASLSSTQFAAMSTDQIKALTSEQVAGLSSAQVATLSSDELALFSTDEISAFSANAVAGLSTAALAALTTGNATALTKTQIAGLSSTQLNALTSGSIATFSADEVKAISTKALAGLDVTKLSTGNVAALSKAQVSALSTTQFAAMSTDQIKALTSEQVAGLSSAQVATLSSDELALFSTDEIKAIGANAVAGLSAAALAALTTDNASALTKTQIAGMSSTQINALTSANLATFSADEIKAITTKALGGLDVTKLSTGNIAALTKAQVTSLSSTQFAALSTDQIKALTSEQVSGLNSAQVATLSSDELALFTTDEIKSIAANAVAGLSAAALAALTTDNASALTKTQIASLSSTQLNALTSANLATFTADEIKAVTTKALAGLDVTKLSTGNVAALSKAQVSALSTTQFAAMSTDQIKALTSDQVAGLTSAQVATLSSDELALFSTDEIKAIGANAIAGLSTAAIGGLSSAQAGALSAQQMKVMNDAQVEAV

SEQ ID NO: 14404 - protein, 664 aa, Agrobacterium tumefaciens
  unsure (1)..(664): unsure at all Xaa locations
PDMTSIIASLNVNQIRYLSTEAVAAWTTEDVASLSTTQIKALSSDQIAALDVEDVKILNSQQLSAISQGAIVGLTLDQLNILDQYAIKSLSASQVSALTTTQFHALTTDQAEALTSSQVRVLSSAQLAALSAEDIATFSTADMAAITAKAMPGLGTEVIAGLTPDQIAALNISAIASLTTEQIAILSPQQAEALTPAQVRVLSSLQLAALGTDDIATFSAADIAAITGKAITGLSIEAIAELTSDRVAALNASAIAGLTTEQIEALSTAQIAALTTAQIAALKTTHVAALSTSQVEALSPLQVQSLTASQLAVLSAEDIATFSTADIAAITGTAMPRLSTEAIGTLTLDQIAALTTAQLNALSSAQFQALSAGQVEALSATHIAALSTGVIASLTADQIEAFSTRQVEALSAAQVKLLNSAQIAALSPDDIATFSTADIAAIAGKAISGLSTGAIAALTTAQIAALTTGAIASLTDDQIEALSTSQVAALSPTQVKSLSSTQLAALSVEDLATFSSADLAAITGKAMSGLNTDVIAALTAAQIAAFGASAIAGLTSDQVEALSGSQVSLLSTTQIKALSSTQVAALGSDVAALSTSQTAVLSAASIKGLTPEQIAILRPDQFSALTTAQIAALSSGQITAMGASNIASLSMAQIAXISTSSMTG

SEQ ID NO: 14405 - protein, 240 aa, Agrobacterium tumefaciens
ITGGASGIGFSTAQLLMARGWQPWLLDLKREALDIACEKLGIDLWRGIVCDVADEASIEMAFAALTANGADHAVDLVAVVNSAGIGIDKLSVDTSVEEFRRIVDVNLVGSFAVARAAARYWLERDVAGSIVNISSVSGMCGNRGRSAYGASKGGVNLLTMVMANELGQSGIRVNAIAPGPVDTPLTQAVHTENVRDQWHSRVPMHRYGRTDEIASAVAFLVSDDASYINGQVLAVDGGFI

SEQ ID NO: 14406 - protein, 655 aa, Agrobacterium tumefaciens
KILIANRGEIACRIIRTAASMGIRTVAVYSDADRDAMHVALADEAIAIGPAPARASYLDGEKIIAAAKASGAEAIHPGYGFLSENAGFAEACASAGLVFIGPPPEAIRAMGGKSEAKALMATAGVPIVPGYHGDEQAEKRLASEADKIGYPVLLKASAGGGGKGMRVVRQKHDFAAELAGAKREALAAFGNDRMLIEKYLERPRHVEVQVFADGHGNCVSLFERDCSIQRRHQKVIEEAPAPGLPDDLRQRMYDAATAAARAIDYRGAGTIEFLLDPSGFYFMEMNTRLQVEHPVTEYITGLDLVEWQLRVANGEALPKDWADLRINGHAIEARIYAEDPAHDFLPSIGTISHLVFPDEGPHLRIDSGIRAGDAITVHYDPMIAKLIVWDHDRPAAVRRLKVALEKLAICGVTSNATFLARLAGLETFAAADLDTGFIARNEADLFAPQAVGDNEIALAALGFLLSRKNASTNPQAQADPHSPWNTANAFRLNAPARETLHFTMQNRPIDLGVAHEADSFSLEMGGHTIRAYGDLSDNGRFRATINDRTWKGYFFAESDSYALFLHGEHYRISQPDPVDIADSSGHTGGLEAPMPGVIRAVLSQSGAAVETGDALVVMEAMKMEHTIRAPAKGIVTAVNCAEGDMVVAGAVLVDF

SEQ ID NO: 14407 - protein, 273 aa, Agrobacterium tumefaciens
RFAPSPNGPLHLGHALSAFLNHDMAQDNGGRFLLRIEDIDQTRCTPELEQAIYDDLDWLGLDWEKPVRRQSDHFDAYRVSLDRLIDAGLAYPAFLSRGETKTIVRAFEADGGLWPRDPDGAPLYPSMDRERPDAERAALLASGRHHAWRLDMEKAIRAVGSSLFWQESGDGETGRIEALPGLWGDVVLSRSDAPSSYHLSVVVDDALQGITHVVRGMDLFHATAIHRLLQHLLDLPQPTYHHHRLLLGADGRKLSKSEGSTGLSTLRAEGAGP

SEQ ID NO: 14408 - protein, 268 aa, Agrobacterium tumefaciens
IIITGCSSGIGAYCAGALQRDGWRVFATVRRIVDMAALENQGIETLIMDYTKPETIAALVDTVAARTGGRIDALFNNGAYGQPGAVEDLPVEALRAQFETNVFGWHDLTRRVIPFMRKRGSGRIVHCSSILGLVPYRYRGAYTASKFAIEGLGVTLRMELQGSGIHVSLIEPGPITSKFTATALAHVKDKIDLENSAHAAEYKRQLARMDGSGPVNRHKLGPEAVYAVLKHALTAARPKPHYPVTVPAKQGLLLKRLLPAGLFYRLLR

SEQ ID NO: 14409 - protein, 505 aa, Agrobacterium tumefaciens; identical to SEQ ID NO: 11616

SEQ ID NO: 14410 - protein, 256 aa, Agrobacterium tumefaciens
RTVIVTGSTSGIGLGIAQRFAREGANIVLNGFGDDDEIEKLRLLLEAESGGRVLYHPADMTKPDEIADLIQSSHEKLGSVDVLINNAGIQHIAPIEEFPTEKWDWIIAINLTSSFHTMRAAIPLMKKAGKGRIINISSAHGLVASPFKSAYVAAKHGIMGLTKTAALELAQTGVTVNAICPGYVLTPLVEKQIPEMAKVRGISEAAVKNDVMLELQATKQFVTVDDVAAAAIFLASDAASNITGTHISVDGGWTAQ

SEQ ID NO: 14411 - protein, 304 aa, Agrobacterium tumefaciens
QTKPFRIGTRGSPLALAQAYETRSRLMAAHGLPEEMFEIVVLSTKGDRITDRALSEIGGKGLFTEELENQLLSGELDIAVHSSKDMPTVLPEGLHLSAFLPREDMRDAFIGRTAPKLLELPQGAVVGSASLRRQALIRRLRPDLNVIVFRGLVDTRLRKLEEGQADATLLAFAGLKRLGKDNVPTEILDPKEFPPAPAQGAIGVESRIGDARMDKLLAPINDRPTYDAVTCERAFLAALDGSCRTPIAGYATCEGDNLHFSGLILTPDGQTSHGVEISGNRRDALILGKKAGEEVRAKAGSNFF

SEQ ID NO: 14412 - protein, 480 aa, Agrobacterium tumefaciens; identical to SEQ ID NO: 11788

SEQ ID NO: 14413 - protein, 393 aa, Agrobacterium tumefaciens; identical to SEQ ID NO: 11731

SEQ ID NO: 14414 - protein, 400 aa, Agrobacterium tumefaciens; identical to SEQ ID NO: 11569

SEQ ID NO: 14415 - protein, 103 aa, Agrobacterium tumefaciens
SGMKLVVVGAAGRMGQALIRLIHQTPGVQLHAAVAREGSAFVGRDAGEIAGLGPIGIEITSDPLQAFLHAEGVIDFTSPATSITFAGLAAQARIVHVVGTTGL

SEQ ID NO: 14416 - protein, 447 aa, Agrobacterium tumefaciens
LVVFGATGDLAYKMIFPSLYAMVKRGALQTPIIGVAFDDWPREQLIARARDAVANHLDKIDEAVFEKFAAQLTYVSGDYRNEATFEKLRTALGGHQHPLYYLAIPPSLFETVVTGLNRTGIAASARLMVEKPFGRDLASAEALNEALHAVFAEDAIFRIDHFLGKEAIQNLLYFRFANAFLEPVWNRDHVESVQITMAEDFGIRGRGKFYDEVGCIRDVIQNHLINVLLLLAMEPPATSASDDLVDEKVQILKAMPPLTRDDVVRGQFRGYLDEPGVASASNRETFAAARFRVATWRWNGVPFFIRSGKNLPAHATEVVVRFKRPPIALFGDVETTPANYVRFRLGPDIAIGIGARRKAAGDGMRGEAVELGAVDDGIGDMAPYERLIGDAMAGERQLFTRQDAAELAWKIVEPILDDPAVPPVYEVGSWGPAEMAGFGPPGGWVDP

SEQ ID NO: 14417 - protein, 398 aa, Agrobacterium tumefaciens
GAVVASLSIPWGASKGDDDLGGYHLIWPRDLVEAAGGFLAAGDHDEALAILDYLRQVQQPSGRWPQNLWLDGKPYWPGVQMDECAFPILLADMLHRHGHLDHAARADYMPMIRSAAAYILANGPTTGEDRWEEDAGYSPFTLAVEIAALLAAADLLDMEGDAAEATHLRQTADCWNEQIERWTFAGDQTMCAQLGISGHYVRIASPGTTDAVQLSGMTPILNQTPDRAFLPTSDVISPDALALVRFGLRAPDDPHILATVKAIDHCLRAELPQGPVWYRYTGDGYGEHADGTAFDGTGQGRPWPLLTGERAHYELAAGRRGAAEALLTTMEKSAGQSGLFPEQVWDQPDLPDRELFYGSPSGSAMPLVWAHAEHIKLLRSLADGSVFDMPPQGVERYI

SEQ ID NO: 14418 - protein, 583 aa, Agrobacterium tumefaciens
YMWPEGRWDLKMRVIWATVFLIVAKLVLIAVPYFFKWATDALNGKLDMAGLVPAFLLGAVALVIAYNLTRLIQVGLNQLRDSLFASVGQHAVRQLAYRTFVHMHRLSLRFHLERKTGGLSRVIERGTKGIETIVRFTILNTAPTFIEFLLTAIIFWASYGFSYVLVTVVTVWAYIWFTVRASNWRIGIRRAMNDSDTDANTKAIDSLLNFETVKYFGNEEMEARRFDVAMERYEKSAISIWTSLGWLNFGQGVIFGIGSTIMMVMSALAVQRGEQTIGDFVFVNALLLQLSVPLNFIGFVYREIRQGLTDIEQMFDLLEVEAEVTDRPDAKPLAAGPGAISFRDVHFAYDPERPILKGVSFDVPAGKTVAIVGPSGAGKSTISRLLYRFYDIQEGAVTIDGQDIRDVTQKSLRSMIGMVPQDTVLFNDTLAYNIRYGRPSATDEELKAAADAAQISAFIGKLPDGYATMVGERGLKLSGGEKQRVAIARTILKAPPILILDEATSALDTHTEQEIQSALDIVSKNRTTLVIAHRLSTVIHADEIIVLKEGLIAERGTHASLMAHDGLYASMWSRQREAIRAEE

SEQ ID NO: 14419 - protein, 261 aa, Agrobacterium tumefaciens; identical to SEQ ID NO: 11764

SEQ ID NO: 14420 - protein, 336 aa, Agrobacterium tumefaciens
MKAAVVRAFGKPLTIEEVPIPDPGPGEILINYKATGVCHTDLHAATGDWPVKPNPPFIPGHEGAGYVAKIGAGVTGIKEGDRAGTPWLYTACGCCIPCRTGWETLCPSQKNSGYSVNGSFAEYGLADPKFVGRLPDNLDFGPAAPVLCAGVTVYKGLKETEVRPGEWVVISGIGGLGHMAVQYAKAMGMHVVAADIFDDKLALAKKLGADVVVNGRAPDAVEQVQKATGGVHGALVTAVSPKAMEQAYGFLRSKGTMALVGLPPGFISIPVFDTVLKRITVRGSIVGTRQDLEEALTFAGEGKVAAHFSWDKLENINDIFHRMEEGKIDGRIVVDL

SEQ ID NO: 14421 - protein, 211 aa, Agrobacterium tumefaciens
MKLYYMPAACSLSPHIVANELELDIEFVRVNFKDHKTEGGQDYYDINPNGYIPALDVGNGAMLFEGPAIVQYMADLKPQSGLAPANGTFERYKLQEMLSFLSTEIHKGFIPLLYAKQAGAYLETATPKLEKRYAWIDNLLASQRFLMGENFTVADAYLFALTSWGQASWLKSYYGADIHFDDLLNLRGWYERVKERDAVKQSILEEGLSLS

SEQ ID NO: 14422 - protein, 243 aa, Agrobacterium tumefaciens; identical to SEQ ID NO: 11491

SEQ ID NO: 14423 - protein, 443 aa, Agrobacterium tumefaciens
FDTVLIANRGEIAARIQRACHELGLKTVAICSEADRGASYVQTADSFLCIGPSAAGKSYLNKDAILLAARLTSSGAIHPGYGFLSENTAFSDAVEKAGLVFIGPGASSIATMGDKIAAKRAMIAAAVPCVPGPDTALPDDPAAVESIAQEIGYPVIVKAAGGGGGRGLRVVPDAGSLHEAIPTTREEARQAFGSPALYMEKFLQHPRHIEIQVLCDTHGHAVWLGHRDCSMQRRHQKVVEEAPAPGISPDVIRSVGQACVEACQQIGYRGVGTFEFLYENGAFYFIEMNTRLQVEHPVTEMTSGIDIVQAQIRAAQGEELVLRQQDVKCEGHAFECRINAEDPQTFLPSAGVVTGLAWPQGQGIRVDTHIHGGYRVSPYYDSLVAKLIVHAPTRSEAMAKMREALAGTSIEGISTNLPFLRALFEDDAFVCGETDIHYLEKWL

SEQ ID NO: 14424 - protein, 471 aa, Agrobacterium tumefaciens
QCYIDGRFEDGEASFSSLDPATGQPWAEMPESREADIGRVVEAAHRALYEDTVWSKLTATQRGKLLYRLADLVAENAKTLAELETRDTGKIIRETSAQIAYVADYYRYYAGLADKIEGAYLPIDKPDMDVWLRREPVGVVSAIVPWNSQLFLAAVNIGPALAAGCTIVVKASEDGPAPLLEFARLVHEAGFPAGVVNVVTGFGASCGNALTTHPKVAHIAFTGGPETARHIVRNSAENLASTSLELGGKSPILVFADADLESAANAQVAGIFAATGQSCVAGSRLIIEKSVKDRFLQILAAKAEAIRIGSPLDMATEVGPLATERQRKHIVSLVSASVDAGAKVVTGGEPVEGEGYFYRPTILDCDGIRSPSLEKEFFGPVLSVVSFETEAEAISLANDTVYGLASGVFTQNLTRAHRLMKAIRAGIVWVNTYRAVSPIAPFGGFGLSGDGREGGLAAALDYTRTKTIWLR

SEQ ID NO: 14425 - protein, 373 aa, Agrobacterium tumefaciens
LIGGASLFRSPAVVKSLGVHRPLLVCDTVLHKRGHSDALLQALAEEGIEAAVFSDVVEDPTDISIATLVKRISDGGHDSLVALGGGSAMDTAKAGAIVATSGEDLRALKVPRIVDFAVMPVIAIPTTAGTGSEVTRAAVVTDTAASEKMLILGTAALPVAAIIDYELTLTCPYRVTVDTGIDALTHALEALVNRNGNAHSEALALSALKLIGANLEKVADNPDDRDAREAMMLGATHAGLAVSNTSTALIHGLSRPVGAFFHVPHGMSNAMVLPLVTQFSLNSALPHYAAAARALGSAAATDSDQVSGAKLVEAFLGLNRRLKVPTPQEFGIDRSRYLDLVPEMVRQGLASGTPANNPRVPTVAEMTRLYELA

SEQ ID NO: 14426 - protein, 273 aa, Agrobacterium tumefaciens; identical to SEQ ID NO: 11715

SEQ ID NO: 14427 - protein, 416 aa, Agrobacterium tumefaciens
SYHFRPPFGWMNDPNGFGRFEGRPHLFYQHYSHGLRWNTMHWGHAVSSDYLRWRHLPIFLFPSEDLTTRPDKRGGAYSGSTIPLVEGSGIRVFFTEQVQDRIPEQQIQLTATSSDLIMAGQADVILAHRPDGQGLTPDFRDPYVFRGPDGLWKMLLGSQSDGGGVILLYETLDPTAASGWTYVGKLWVETRYKTTAIECPCLLPLDGPANARSTRWVLIYGLMHSEDPETGRKNLTMADVGWFDGKVFTKEFGQELDFGTDNYAFQAFLDGDSIIGIGWLANWADANPEIDFPTSMTLPRRIHYANGELLTPPIGAAESLRSHILDRTRLAAGERVTFINGAVEILIELASSDAAFELALDHPTVTLGLVSDETGLWIRHEDGRDGASPHYIAKGARAASRIRIFLDYGSIEVFAN

SEQ ID NO: 14428 - protein, 641 aa, Agrobacterium tumefaciens
LWVPPRERLEHSALFAFAAKTAPLHGLAADDYAGLLRWSIDAPDEFYDALWDELAIIGTRGEAAFKAGATIRDAEFYPGARLNYAENLLRDADERLAIIAYRDDGTRREISRRKLYDEVSRMVQALVHAGVKEGDRVGAIVTHDIEAIVSYLAVSAIGAIWSSCSPDFGPAGASDRLSQIDPKILIAVPEYGYAGKRIDVGPTIRAVAESARPEKIVLIGDSVAESLADLGCLTLADFVAPYAAGEIAFNRLPVKAPLAILYSSGTTGKPKCITHSGGGLLLQHMKEQKLQCDIRQGERFFYFTTCGWMMWNWQVSGLALGATLVTYDGNPGYPNTARLIDLIDAEGIATFGTSAKFIDACLKAGLQPRESHDLSSLRTILSTGSPLIPQSFDYIYRDWRADLHLASISGGTDICACFLGGNPLQSVHRGELQGAMLGMDIDTLDDEGRSVRGVAAELVCRNAHLSMPVKFWGDEDGSRYQAAYFDRFPGIWAHGDFAELRPSGGYVIHGRSDTTLNPGGVRIGTAEIYRQVETVPDVEEAIAVGQDIDGDQRVILFIRMKEGAVLTEELEKTIRSRIRLGATPRHVPARIIAVSAIPRTRSGKISEIAVRETIHGRPVKNTDALANPESLELFRNLPQLK

SEQ ID NO: 14429 - protein, 256 aa, Agrobacterium tumefaciens; identical to SEQ ID NO: 11385

SEQ ID NO: 14430 - protein, 783 aa, Agrobacterium tumefaciens
SGVSFMAVTVTAVILTLIGLALFGFGSQLVMLGGSFYYLLSGLAFLLTAVLLFKSNRAALHVYAVFIVATLAWAVWEVGFDWWQLGPRGGVIILIGLWLLVPWVRKPLGFSSPTGLSYSPNAWPLVLSVLASFAVAGYSMAQDPHDQAGSLPQEIASAAPVYGGEVPDGDWHQYGRTPYGQRYSPLTQVNVDNVSQLKEAWRYQTGDVKLPDDVGETTYQVTPLKIGNTLYICTPHNWAIAIDAATGKEKWKYDPNVGLNPDRQHQTCRGVSYYAEPNAAAGTACAQRVYLPTSDARLIALDAATGQVCTSFADQGVLHLEQGMKYNPAGYYYSTSPPVIAAGKIIIGGAVNDNYSTQEQSGVIRAFDVNSGALIWNWDSGNPQKTEPIAAGETYTTNSPNSWSVLSYDEGLGLVYVPLGNQVPDQLGMGRSENVEKYSSSIVALDINTGKDRWVRQTVHHDLWDMDVPAQPVLLDITKDGQTVPALVGPTKQGDIYVLDRRTGEPLLPITEEPAPTGAIPEDFTSPTQPTSALSFKPEPLQEKNMWGVSMFDQLACRIRFHQLNYKGRYTPPSLNGSIIYPGNFGTFNWGSVAVDPERQVMFGMPTYLAFTSQLVPRADIPPKGQDEKGSEQGLNRNDGAPYGVFMGPFLGPLKIPCQAPPWGYVAGADLRTGDVAYKHKNGTVYDMTPLPLPFKVGVPGIGGPMITKGGVAFLGAAVDNYLRAYDLTTGKELWEARLPAGGQATPMTYSLENGKQYVVMVAGGHGSVGTKPGDYVIAYTLP

SEQ ID NO: 14431 - protein, 573 aa, Agrobacterium tumefaciens; identical to SEQ ID NO: 11795

SEQ ID NO: 14432 - protein, 321 aa, Agrobacterium tumefaciens
TRSSRMAGFGHAVPARCVDNAEIEASLGLEAGWIERRTGIRSRYWAEAGDTLSGLAERAGRMALEDAKINADDIALTLLATSTPDHLLPPSAPLLAHRLGLTRSGAIDLAGACSGFLYALTLADGFVRTYGRAVLVVAANILSRRINPAERASAVLFADAAGAVVLTPCPEVKRGVLSADLVADGSGYDLIQIAAGGSSQPFSAGMIAEDALMTMRDGREVFSRAVALMTNTSQRVLHEAELTAADISRFVPHQANARMSDAVCGNLGIEREKTVRTIGSFGNSSAATIPLSLSITNAERPLAGGETPLLPAAGAGMTGGA

SEQ ID NO: 14433 - protein, 400 aa, Agrobacterium tumefaciens
VWHPFTQHGLEPPMKRVVSADGAFLVDEDGNRLFDAISSWWVITHGHRHPAIMAAIRAATETLDQVIFAEFSHEPAETLARGLIELAPAGLSHVFYSDSGSPPVKVALKMALGYFHNCGEKRDRIVVMEHGYHGDTIGTMSTGERGVFNAAYEPLLFGVDRLAFPEVGSEQCTLDMFEAYCRSGRVAALLVEPLVLGAGGMKVYAANVLAGLKQIAESHGCLVIADEVMTGWGRTGTVFACEQAAISPDILCTSKGLTGGSLPLAATLCSAQIFDAHFSTDRRKTFFHSSSYTANPIACAAAVANLQVWRDEPILQRIGQVQQTLGDHIRRFADDGRFANIRQAGTIAALDLVVPAGGYLSEAGPRMRQLFRRRGFLIRPLGNVLYLMPPYCSTADDLTR

SEQ ID NO: 14434 - protein, 345 aa, Agrobacterium tumefaciens
REGIDFTSNDYLGLAEAPRLKAAIAHAIGKGVPVGAGGSRLLRGNHPEHEALESEAAAFFGAEKAIYFGSGFAANVALFSTLPLRDDIVLHDALIHASVHDGIAAGKAKAVAVPHNEVEAFQREIIRWRQAGGSGRPWIAVESLYSMDGDCAPLAALADLAERHGGFLVVDEAHATGVFGPGGRGLAAQLEGRSNVLALHTCGKALGASGALLSLPAVLADYLVNRARGFIYSTAPSPLMAAAVREALRIVADEPSRRSRLAELVGFAGEELQSQLGVTPSGSQILPVMIGDNARSLKIAARLSQGGFDVRAIRPPTVPEGTGRLRIAITLNVDESQIAAMVGLL

SEQ ID NO: 14435 - protein, 430 aa, Agrobacterium tumefaciens; identical to SEQ ID NO: 11785
  unsure (1)..(430): unsure at all Xaa locations

SEQ ID NO: 14436 - protein, 370 aa, Agrobacterium tumefaciens
ITVEEAKTAETELEVVEGMQFDRGYLSPYFVTNPEKMVADLEDAYILLHEKKLSNLQAMLPVLEAVVQTGKPLVIIAEDVEGEALATLVVNKLRGGLKIAAVKAPGFGDRRKAMLEDIAILTGGTVISEDLGIKLESVTLDMLGKSKKVSISKENTTIVDGAGQKSDIEGRVAQIKAQIEETTSDYDREKLQERLAKLAGGVAVIRVGGSTEVEVKEKKDRIDDALNATRAAVQEGIVPGGGVALLRSSTKITVKGVNDDQEAGINIVRKALQSLVRQIAENAGDEASIVVGKILDKNEDNYGSNAQTGEYGDLIALGIVDPVKVVRTALQNAASVASLLITTEAMIAELPKKESAMPQMPGGGMGGMDF

SEQ ID NO: 14437 - protein, 342 aa, Agrobacterium tumefaciens; identical to SEQ ID NO: 11687

SEQ ID NO: 14438 - protein, 438 aa, Agrobacterium tumefaciens; identical to SEQ ID NO: 11577

SEQ ID NO: 14439 - protein, 242 aa, Agrobacterium tumefaciens
FTNRTIVVAGAGRDIGRACAIRFAQEGANVVLTYNGAAEGAATAVAEIEKLGRSALAIKADLTNAAEVEAAISAAADKFGEIHGLVHVADGLIARKTIAEMDEAFWHQVLDVNLTSLFLTAKTALPKMAKGGAIVTFSSQAGRDGGGPGALAYATSKGAVMTFTRGLAKEVGPKIRVNAVCPGMISTTFHDTFTKPEVRERVAGATSLKREGSSEDVAGLVAFLASDDAAYVTGACYDINGG

SEQ ID NO: 14440 - protein, 469 aa, Agrobacterium tumefaciens
  unsure (1)..(469): unsure at all Xaa locations
ELSEHDIGELRFSLKNRLGEALLLTSQEDMLRYCRDWHGDVTSSAVAVIRPRSTKEVSDTVIACAELGLAIIPQGGNTGLVLGGIPDAPKHQVVLSLERMNAIRTIDSDDFSAVVEAGCILSEFKDAVQDKGMFFPLSLGAQGSCRIGGNVSTNAGGINVLRYGMTRELVLGLEVVLPDGTIWNGLSTLRKDNRGIDLKQLFIGAEGTLGIITAVAVKLYPNPEHVETALLGLNSLDDAIKLYRRARRECCDLMSAFEFMPPVAFTLAIEAIPDLKMPIAGDYPAYVLMEISGSGLVDTADLMGRFLEGVMEDGLVLDGVIASSRAQAQSLWLFREGMNEGQALRGSHMRTDISVPLSKLAAFVAQAEAELAEKLPECLAVXYGHVGDGNVHLNVLPPNGATLEEREAFIYKSKTLVNEVLDRYVGSISAEHGIGRLKRSDFESRLSDVQRRMITGLKNAFDPDLRMNP

SEQ ID NO: 14441 - protein, 878 aa, Agrobacterium tumefaciens
MHILATTSSSLDDLIEPVDLNQPRSDVVVLSFSASDLAGLERAWGKAGETLPSLSAANLSELRHPMSVDLWIEKTAEHARVILIRILGGAERWRYGVDQLAILARRRGIKLLLLPGECSERDEKLEAASTVDKPMLASVLSFFREGGRENMGRLAAGLSVLAGGGEWPDIKADPLPKAGFYRPDLGVVGQDEACAGFPAGASVLPILFYRSMLLAEDAAPVDALFQALSARGFAPLPIFVSGLKDGEAIRFLETVLPALQPAAIIAATAFASHTDDRGETLFDRLGVPVFQAVMATTRRVGWVENARGLNPSDLAMHVVLPELDGRILTGAISFKQARTDGGVSLVNVPEADRIEQVANRIAAFLRLKSAPPRDRRIVILMPDYPGAAPGRTGYAVGLDVPQSVLEMLRDLAEAGYAVEDIPETARALLDRIESQEATVDLSTYRDFFAGLTETASSSMNATWGAAEQDDAFADGAFHFRVARFGQVFVALAPDRGRNEDRRVDYHDPALPPRHALVAFGAWMQSVVATHAIVHVGAHGTLEWLPGKTVALSRDCFPEIVTGPLPVVYPFIVSNPGEAAVAKRRIAAVTIGHVPPVLVNAGLSPEQLALEQLVDEYAQADGLDRRRRDRLAKLIVEKALETGLAAEAGVGAKDDADAALSRIDAFLCDLKDFAIKDGQHVFGRSPEGEADPLRLQSAKAEKAALLAALDGRHIAPGPSGAPARGRLDVLPTGRNLYAADPRTMPTPTAFDLGRMAGEEVLRHHLQSHGDWPKHLVFDLWGSASLRNGGEDVAQALHLMGARPIHDPATGRVTGIEVLPPASLGRPRVDVTFRISGLFRDMFPALIALLDAAAKAVARRDEAPAHNPLRKSGSAGHIPR

SEQ ID NO: 14442 - protein, 325 aa, Agrobacterium tumefaciens
HGGNLGKARLMFRQAPEPWIDLSTGINPHSYPHSPIPASAFARLPEPGAAEELKQLAAAHFGAPSAQHVTLSPGTQMLMPLLAQIAINRGAQSGAVLSPAYAEHARTARMAGLTVTEVENIGDLSAYGYAVVVNPNNPDGRITDREALLALAGTIGRKGGLLVVDEAFIETGGAESLAVATNGEALVVLRSFGKFYGMAGVRLGFAIAHPEIAAELEARLGPWAVSGPALHIATEALADREWQSSMRLRLAEEARRMNELLEKAGLKIAGGTSLFTLVRDERSRALFGHLGRRGILVRIFDERPDDMRFGLPGSEADWQRVEEAL

SEQ ID NO: 14443 - protein, 305 aa, Agrobacterium tumefaciens; identical to SEQ ID NO: 11533
  unsure (1)..(305): unsure at all Xaa locations

SEQ ID NO: 14444 - protein, 401 aa, Agrobacterium tumefaciens; identical to SEQ ID NO: 11471

SEQ ID NO: 14445 - protein, 468 aa, Agrobacterium tumefaciens
SSDILDRFTAIVGEKNAVRDLAEMAPRLVENRGLYRGASPLLLKPGSVEEVAAILKLASETGTPIVPQTGNTGLVGGQTPRADGTDIILSLERMNRIRDIDPVANIIVADAGCILDDIHKAASSVERMFPLSLGSQGSCRIGGNLATNAGGTAVLAYGNMRQLCLGLEVVLPTGEIWNGLRRLKKDNTGYDLRDLFIGSEGTLGVITGAVLKLFPKPLGHQVAFAGLASTEDALKLFEMASNLCGTALTGFELMPRIGVEFTARHIPGVRDPLGQPHDWYALIDISTSDSAETADTMMQSLLERGFEAGLVEDAVIASSEAQRQALWHMRESMSDAQKPEGGSIKHDVSVPVSKIPEFMTTAEKAVLAAIPGARICAFGHLGDGNIHYNISQPVGADKAEFLGRWRDMNEIVHGIVLSLGGSISAEHGIGQLKRDELAAIRPGIEMELMHRIKHAFDPAGIMNPGKVL

SEQ ID NO: 14446 - protein, 102 aa, Agrobacterium tumefaciens
FLKKLEVKTPSLSQTVGNLSGGNQQKISVAKWLAADVKLLIVDEPSVGIDIKTKAYLHDLLRELADNGTAILVITSDMPEMVALADRIVVMDQYRVKGIVEN

SEQ ID NO: 14447 - protein, 183 aa, Agrobacterium tumefaciens
TLWQAQFGDFANGAQVVFDHCMCSGERKWLRMSGLVCLLPHGYEGQGPEHSSARLERWLQMCAEDNMQVANVTTPANYFHILRRQMKRDFRKPLILMTPKSLLRHKRATSSLAELAGESSFHRLLWDDAEVIKDGPIKLQKDAKIRRVVMCTGKVYYDLLEEREKRGIDDVYLLRVEQLYPFP

SEQ ID NO: 14448 - protein, 56 aa, Agrobacterium tumefaciens
PLLGVRDLSVRYHSRSGEAVAVENLSFDIAAGEAVALVGESGCGKSTTALALSNLL

SEQ ID NO: 14449 - protein, 438 aa, Agrobacterium tumefaciens
ENGGIILFIDEMHTLVGAGKADGAMDASNLLKPALARGELHCVGATTLDEYRKHVEKDPALARRFQPVLVDEPNVEDTISILRGLKEKYEQHHKVRISDSALVAAATLSNRYITDRFLPDKAIDLMDEAASRLRMQVDSKPEELDELDRRIIQLKIEREALKQETDQSSVDRLRKLEDELADTEEKADALTARWQAEKQKLGHAADLKKRLDEARNELAIAQRNGQFQRAGELTYGIIPGLEKELAAAEARDSSGAGSMVQEVVTPDNIAHVVSRWTGIPVDKMLEGQREKLLRMEDELAKSVVGQGEAVQAVSKAVRRSRAGLQDPNRPIGSFIFLGPTGVGKTELTKSLARFLFDDETAMVRLDMSEYMEKHSVARLIGAPPGYVGYEEGGALTEAVRRRPYQVVLFDEIEKTHPDVFNVLLQVLDDGRLTDGQGR

SEQ ID NO: 14450 - protein, 452 aa, Agrobacterium tumefaciens
LAKPAEETPLIAAQGVRLLHEAGVPQDAVQLLPGDGKTGAALVGSPLTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDQLSVDVGPVITAEAKGIIEKHIDGMRSLGHRIEQIALAGETGKGTFVPPTIIEMKSLADLKREVFGPVLHVIRFKRDHLDRLIDEINATGYGLTFGLHTRLDDTIQHVLSRVAAGNLYVNRNIIGAVVGVQPFGGRGLSGTGPKAGGPLYLGRMTEKAPKIDRIASQQDQAAVDLARWLDENGQTVAAEAARQAAALSGLGFETELAGPVGERNVYALHPRGKILLVPATEQGLYRQLAAALSTGNSVVIDNASGLEKAIYGLPASVTSRIVWADDWEKSAPFAGALVEGDAERVVAINRKI

SEQ ID NO: 14451 - protein, 240 aa, Agrobacterium tumefaciens; identical to SEQ ID NO: 11355

SEQ ID NO: 14452 - protein, 292 aa, Agrobacterium tumefaciens; identical to SEQ ID NO: 11433

SEQ ID NO: 14453 - protein, 362 aa, Agrobacterium tumefaciens
GKVTQVIGAVVDVAFEGELPPILNALETQNNGNRLVLEVAQHLGENVVRTIAMDSTEGLVRGQSVADTGAPIEVPVGLETLGRIMNVIGEPVDEAGPIVTAKKRAIHQDAPSYVEQSTEGQILVTGIKVVDLLAPYAKGGKIGLFGGAGVGKTVLIMELINNVAKAHGGYSVFAGVGERTREGNDLYHEMIESNVNKLGGGEGSKAALVYGQMNEPPGARARVALTGLTIAENFRDEGQDVLFFVDNIFRFTHAGSEVSALLGRIPSAVGYQPTLATDMGQMQERITTTEQGSITSVQAIYVPADDLTDPAPATSFAHLDATTVLSRSIAEKGIYPAVDPLDSTSRMLYPMILGEEHYEVAR

SEQ ID NO: 14454 - protein, 250 aa, Agrobacterium tumefaciens; identical to SEQ ID NO: 11672

SEQ ID NO: 14455 - protein, 210 aa, Agrobacterium tumefaciens; identical to SEQ ID NO: 14182
  unsure (1)..(210): unsure at all Xaa locations

SEQ ID NO: 14456 - protein, 478 aa, Agrobacterium tumefaciens; identical to SEQ ID NO: 11602

SEQ ID NO: 14457 - protein, 224 aa, Agrobacterium tumefaciens; identical to SEQ ID NO: 14168

SEQ ID NO: 14458 - protein, 293 aa, Agrobacterium tumefaciens
FKGSIPALITPFTDNGSVDEKAFAAHVEWQIAEGSNGLVPVGTTGESPTLSHDEHKRVVELCIEVAAKRVPVIAGAGSNNTDEAIELALHAQEAGADALLVVTPYYNKPTQKGLFAHFSAVAEAVKLPIVIYNIPPRSVVDMSPETMGALVKAHKNIIGVKDATGKLDRVSEQRISCGKDFVQLSGEDGTALGFNAHGGVGCISVTANVAPRLCSEFQAAMLAGDYAKALEYQDRLMPLHRAIFMEPGVCGTKYALSKTRGGNRRVRSPLMSTLEPATEAAIDAALKHAGLMN

SEQ ID NO: 14459 - protein, 98 aa, Agrobacterium tumefaciens; identical to SEQ ID NO: 11759

SEQ ID NO: 14460 - protein, 292 aa, Agrobacterium tumefaciens
MDIRAAEISAILKDQIKNFGNEAEVSEVGQVLSVGDGIARVYGLDNVQAGEMVEFPGGIRGMALNLEADNVGVVIFGSDRSIKEGDTVKRTGAIVDVPVGPELLGRVVDALGNPIDGKGPINAAKRSRVDVKAPGIIPRKSVHEPMSTGLKAIDALIPVGRGQRELVIGDRQTGKTAIILDTILNQKAIHDNGPDGDKLYCVYVAIGQKRSTVAQFVKVLEERGALQYSIIVAATASDPAPMQYLAPFAGCAMGEYFRDNGKHDLIGYDDLSKQAVAYRQMSLLLRRPPGRE

SEQ ID NO: 14461 - protein, 180 aa, Agrobacterium tumefaciens; identical to SEQ ID NO: 11435

SEQ ID NO: 14462 - protein, 282 aa, Agrobacterium tumefaciens
ENNIFDLFVIGGGINGCGIARDAVGRGYSVALAEKGDFASGTSSAATKLIHGGLRYLEHYEFRLVREALMEREILWAMAPHVIWPMRFILPVQKGGVRPSWMVRLGLFLYDNLGGRKLLPPTRTLDLRKDPAGKPLKPVFAKAFEYSDGWVDDARFVVLNARDAADRGATIMNRTRVVSARREGRLWLIETLDEKTGRPAMHKARMLVNAAGPWVDNVLSGVFGRNDVHNVRLVQGSHIIVRRKFSDPRAYFFQNPDNRIIFAIPYEQDFTLIGTTDRDYKG

SEQ ID NO: 14463 - protein, 459 aa, Agrobacterium tumefaciens
  unsure (1)..(459): unsure at all Xaa locations
MTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSXIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 14464 - protein, 867 aa, Agrobacterium tumefaciens
GVHTGDSITVAPALTLIDKEYQMMRNASIAVLREIGVETGGSNVQFAVNPKDGRLVVIEMNPRVSRSSALASKATGFPIAKVAAKLAIGYTLDELENDITGGATPASFEPSIDYVVTKIPRFAFEKFPGASPILTTAMKSVGEVMAIGRTFAESLQKALRGMETGLTGLDEIEIPGYEEGEGSKNAIRAAIGTPTPDRLRMVAQAMRMGMSEEEVHENSKIDPWFIAQLKAIVDMEARIREHGLPQDAENLRMLKAMGFSDARLASLTSKRPKEVAELRNSLNVRPVFKRIDTCAAEFASPTAYMIRPMRRPSSAAARSEAQVSDRKKVVILGGGPNRIGQGIEFDYCCCHAAFALKDAGFEAIMINCNPETVSTDYDTSDRLYFEPLTAEDVIEIMRAEQEKGELVGVIVQFGGQTPLKLAEALEKNGIPILGTAPDMIDLAEDRDRFQKLLMKLDLAQPNNGIAYSVEQARLVASEIGFPLVVRPSYVLGGRAMQIIHSEGQLQTYLLDTVPGLVPEDIKQRYPNDKTGQINTLLGKNPLLFDSYLTNAVEVDVDALCDGENVFVSGIMEHIEEAGIHSGDSACSLPSRSLSKETLDELERQTTALAKALKVGGLMNVQYAIKDGTIYVLEVNPRASRTVPFVAKTIGAPIAKIAARVMAGEKLDAAIAAYGEKPDPRNLKHIAVKEAVFPFARFPGVDILLGPEMRSTGEVIGLDTDFALAFAKSQLGAGVDLPRSGTVFVSVRDEDKEGVLSAIRILVESGFKVLATGGTQRFLAEQGINAEKINKVQEGRPHIEDAIRNRQVQLVINTTDSNKAISDSKSLRRATLMQKVPYYTTMAGAEAAALAIKALKAGNLEVKPLQSY

SEQ ID NO: 14465 - protein, 170 aa, Agrobacterium tumefaciens; identical to SEQ ID NO: 11789
  unsure (1)..(170): unsure at all Xaa locations

SEQ ID NO: 14466 - protein, 395 aa, Agrobacterium tumefaciens
AYKPKLLIADEPTTALDVTIQGQILDLIKQLQEEEGMSVLFITHDMGVVAEVADRTIVMFRGDVVETGTTDDIFHRGQHPYTRALLSAVPKLGSMRSRLLPARFPIIDIKTGESPPVVETKDTVSGGKTPILSVKDLTTRFDIRSGLFGRKSGAVHAVEKVSFDLAEGETLSLVGESGCGKSTTGRSITRLIEPTSGNVTLDGYEVLKLDRTTLRTMRRSVQMVFQDPFASLDPRMSVGTAIMEPFMEHRLGQKAQAREKAADLLEKVGLSPDMMKRFPHEFSGGQRQRIAIARSLMLDPKVIVADEAVSALDVSIKAQVCNLLLDLQQSLNLAFLFISHDMAVVERVSHRVAVMYLGEIVEIGPRAAVFDNPQHPYTKKLMSAVPVPDPARRQI

SEQ ID NO: 14467 - protein, 392 aa, Agrobacterium tumefaciens; identical to SEQ ID NO: 11600

SEQ ID NO: 14468 - protein, 499 aa, Agrobacterium tumefaciens; identical to SEQ ID NO: 11671

SEQ ID NO: 14469 - protein, 291 aa, Agrobacterium tumefaciens; identical to SEQ ID NO: 11589

SEQ ID NO: 14470 - protein, 273 aa, Agrobacterium tumefaciens
MALKSFNPTTPSQRQLVIVDRASLYKGKPVKALTQGLSSKGGRNNQGRITVRFQGGGHKRTYRLVDFKRRKFDVEGTVERLEYDPNRTAFIALVTYTDGEQAYILAPQRLAAGDKVIASDKAVDVKPGNTMPLQYIPVGSIIHNVEMKPGKGGQIARSAGTYVQLVGRDAGMAILRLNSGEQRLVHGSCLASIGAVSNSDHGNINDGKAGRSRWRGKRPHVRGVVMNPVDHPHGGGEGRTSGGRHPVTPWGKPTKGKRTRSNKSTDKFIMRSR

SEQ ID NO: 14471 - protein, 302 aa, Agrobacterium tumefaciens; identical to SEQ ID NO: 11708

SEQ ID NO: 14472 - protein, 342 aa, Agrobacterium tumefaciens
LAHYGDRYGRKRVFAFSILLMALSTLGMALMPTYATIGVAAPILLIILRMLQGAAIGGEVPGAWTFVAEHVPFRRVGLACGFLTSGLSFGIMLGSLIAFAINSLFTPEDVAGYAWRIPFLLGGVFGLIAVYLRRWLEETPIYMEMKKSKSLTDKLPLGLVLKHHRRGVIISALLTWVLSAAIVVTTLMTATFLQKLYGYTPTQALAGTSFGTLFLIFGVIIAGALIDRVGSGIFFMGASIFFGIATFTFYSYAGTSLETMFVLYGVMGLSVGMAGAVPYVMVRAFPASVRFSGLSFAYNVSYAVFGGLTPIGVTTALAINPMAHAWYLVFIAFLAFAIGLYL

SEQ ID NO: 14473 - protein, 290 aa, Agrobacterium tumefaciens; identical to SEQ ID NO: 11565

SEQ ID NO: 14474 - protein, 412 aa, Agrobacterium tumefaciens
  unsure (1)..(412): unsure at all Xaa locations
FDISENDLLIGGLSVRDIVAETGTPCFLYDNSAMRQAYRDLETALSGFADIYYSVKANPLPAIISLFREEGAGAEIASVGEYRAAVKAGVAPDNIIFAGPGKSMAELREVIEGGIGEIHIESAEEIARIEAINRPVKASIRINPVPDAQAGAMRMGGKATAFGFDEEELENVLKLFANVRHIDLVGIHIYGGTQILDADMLVSQWRHAIALAGRMAQMLGKPLETIDLGGGLGIPYFAGETSLDLAKVAAAIPDLKALLKAHPLIADAHVIVEPGRFLAGPGGLYVVEVNSVKTSRGTTFVVTDGGMHHHLAASGNLGQIVKRNYPIVAPAMMQAAHDETATIVGPLCTPLDTLARNATLPKLNAGDLLAILQSGAYGASASPGGFLSHTVAKEVLVEDGAFEVIGRXESCD

SEQ ID NO: 14475 - protein, 509 aa, Agrobacterium tumefaciens
TITLHPGAVTLADLAAIYWENGTAKLDRSFDAGIEKAAARIAEIAAGNAPVYGINTGFGKLASIKIDAADVATLQRNLILSHCCGVGVPLPENVVRLIMALKLVSLGRGASGVRLELVRLIEAMLEKGVIPVIPEKGSVGASGDLAPLAHMAAVMMGEGEAFYEGAPLPAGEALAKAGLTPVVLAAKEGLALINGTQTSTALALAGLFRAHRAAQAALITGALSTDAAMGSSAPFHPDIHSCAATRARSMREAALRNLLEGSEIRVSHIEGDERVQDPYCIRCQPQVDGACLDLLRQVARTLEIEANAVTDNPLVLSDNSVVSGGNFHAEPVAFAADQTALAICEIGAIAQRRVALLVDPALSYGLPAFLSKKPGLNSGLMIAEVTSAALMSENKQMAHPASVDSTPTSANQEDHVSMACHGARRLLPMTDNLFAILGIEALSAVQGVELRGPLKTSPELQKVIAVLRVVVPSLEEDRYMAPDLKAAAELIASGALVSTISGGILPKLE

SEQ ID NO: 14476 - protein, 487 aa, Agrobacterium tumefaciens
LKAQPKASHFIDGDYVEDNTGTPFESIFPATGEMIAKLHAATPAIVERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYVSTGKVDAPY

SEQ ID NO: 14477 - protein, 484 aa, Agrobacterium tumefaciens
MTTSGVRVRIAPSPTGEPHVGTAYIALFNYLFAKKHGGEFILRIEDTDATRSTLEYEQKVLEALRWTGLTWSEGPDVGGPYGPYRQSERKPMYWPYAEELLEKGHAFRCFCTPERLEQMREAQRAAGKPPKYDGLCLHLKAEEVTTRVAAGEANVVRMKIPTEGSCDFHDGVYGDVSIPWDSVDMQVLIKADGMPTYHMANVIDDHLMKITHVARGEEWLASVPKHILLYRYFGWDQPTFMHLSLMRNADKSKLSKRKNPTSISYYSALGYLPEALMNFLGLFFIQIAEGEELLTMEELAAKFDPEALSKAGAIFDIQKLDWLNGRWLREKLTPEDFIARTLEWAMENSRLTEGLKLAQSRISKLGELPNLAGFLVSSDVGLTPASFAGLKSKPEEIHEILTTVAADLEKMPDWNVEAIEAELRDIAERTGKKLRVVTPPLFVAVSGSSRSLPLFDSMALLGRSVVRQRLKVAIAVVATMVGSG

SEQ ID NO: 14478 - protein, 243 aa, Agrobacterium tumefaciens
SLQGKTVIVTGASRGIGKGIALRFGEAGLNVLVVSRSQVDADRVASEIGVNGSGFAADVSTEEGCKAMVDAAVTRYGGVNVLCANAGIFPAAKLGEMSAADFDHVISTNLKSTFLSVSAVLPAMTSAGAGRIIITSSITGPITGYPGWSHYGASKAGQLGFMRTAAIELAPKNITVNAVMPGNIMTEGLEGNGPDYIATMEASVPLRRLGMPADIANAALFFASEEAAYITGQSIVVDGGQIL

SEQ ID NO: 14479 - protein, 410 aa, Agrobacterium tumefaciens
AERVAKRQATFGASSVLFYEQPIEMVSAQGAYLYDAGGRKYLDVYNNVPSVGHCHPRVVEAIARQVGELNIHTRYLNRVVEAYTENLLSKFPAGLSNVVLTCTGSESNDLALRIARIGTGAEGFIVTEAAYHGNTALVTEVSPSSLRKRKPAAFVAIIPAPAARDGMSVASNFAASVEQAINELNSRGIKFAALIVDTIFSSDGIYADPAGFLKEAVDVVHRAGGLLIADEVQPGFGRTGGSLWGFERHGVTPDIVTMGKPMGNGFPMGGVVTRPDLLQRFCEETGYFNTFGGNPVAAAAGHAVLRVIEEEGLIERSATVGGYFKQSLQALQSRHSEIGDVRGAGLFIGLDFVDPATGEPDSTRATHAINQLRHNSILIGAAGKYGATLKIRPPLCFSNEDVDLFTGTLD

SEQ ID NO: 14480 - protein, 245 aa, Agrobacterium tumefaciens
NPFSLEGRKALVTGANTGLGQAIAVGLAAAGAEVVCAARRAPDETLDIIAKDGGNASALLIDFADPLAAKDSFTDAGFDILVNNAGIIRRADSVEFSELDWDEVMDVNLKALFFTTQAFAKELLAKGRSGKVVNIASLLSFQGGIRVPSYTAAKHGVAGLTKLLANEWAAKGINVNAIAPGYIETNNTEALRADAARNKAILERIPAGRWGHSEDIAGAAVFLSSAAADYVHGAILNVDGGWLAR

SEQ ID NO: 14481 - protein, 294 aa, Agrobacterium tumefaciens
PEQIKTALGSGLLSFPVTHFDAEGRFAADSYREHVEWLAGYKAPVLFAAGGTGEFFSLKPDEIPTIVAAAKEVAGETAIVSGCGYGTEIAVDIARSVEKVGADGILLLPHYLIDAPQEGLYAHIKKVCQSVGIGVMVYNRDNSVLQADTLARLCDECPNLVGFKDGTGDIGLVRQITAKMGDRLMYLGGMPTAELFAEAYLGAGFTTYSSAVFNFVPGLANEFYAALRAGERATCERILVDFFYPFMAIRNRAKGYAVSAVKAGVRLQGFNAGPVRAPLKDLTNEEIGMLEALI

SEQ ID NO: 14482 - protein, 373 aa, Agrobacterium tumefaciens; identical to SEQ ID NO: 14283

SEQ ID NO: 14483 - protein, 324 aa, Agrobacterium tumefaciens
DGAEIFKALRDAASERILILDGAMGTQIQGLGFDEDHFRGDRFIGCACHQKGNNDLLILTQPDAIEEIHYRYAMAGADILETNTFSSTRIAQADYEMENAVYDLNREGAAIVRRAAQRAEREDGRRRFVAGAIGPTNRTASISPDVNNPGYRAVSFDDLRIAYGEQIDGLIDGGADIILIETIFDTLNAKAAIFACEERFEAKGIRLPVMISGTITDLSGRTLSGQTPSAFWNSVRHANPFTIGLNCALGADAMRPHLQELSDVADTFVCAYPNAGLPNEFGQYDETPEMMARQVEGFVRDGLVNIVGGCWGSTPEHIRAIAEA

SEQ ID NO: 14484 - protein, 687 aa, Agrobacterium tumefaciens; identical to SEQ ID NO: 11709

SEQ ID NO: 14485 - protein, 172 aa, Agrobacterium tumefaciens; identical to SEQ ID NO: 11751

SEQ ID NO: 14486 - protein, 261 aa, Agrobacterium tumefaciens; identical to SEQ ID NO: 11750

SEQ ID NO: 14487 - protein, 192 aa, Agrobacterium tumefaciens; identical to SEQ ID NO: 11749

SEQ ID NO: 14488 - protein, 259 aa, Agrobacterium tumefaciens
MVELALPKNSQISEGKVWPKPDGAKNVREYRIYRWNPDDGQNPRIDTYYIDVDDCGPMVLDALLYIKNNIDPTLTLRRSCREGICGSCAMNIDGTNTLACTKGMEEIKGTVKVYPLPHMPVVKDLVPDLSNFYAQHRSIEPWLKTVSPTPAKEWKQSHEDRLKLDGLYECILCACCSTSCPSYWWNGDRYLGPAVLLQAYRWLIDSRDEATGERLDNLEDPFRLYRCHTIMNCAQACPKGLNPAKAIAEIKKMMVERRV

SEQ ID NO: 14489 - protein, 320 aa, Agrobacterium tumefaciens
MARKKIALIGSGMIGGTLAHLASLKELGDIVLFDIADGIPQGKGLDIAQSGPVEGFNAKLSGASDYAAIEGADVCIVTAGVARKPGMSRDDLLGINLKVMEQVGAGIKKYAPNAFVICITNPLDAMVWALQKFSGLPKNKVVGMAGVLDSARFRLFLAEEFNVSVQDVTAFVLGGHGDTMVPLARYSTVGGVPLTDLVKMGWLTAERLEQIIQRTRDGGAEIVGLLKTGSAYYAPAASAIEMAESYLKDKKRVLPAAAHLSGQYGVDDMYVGVPTIIGAGGIERVIEIELNKEEEAAFQKSVGAVAGLCEACINIAPSLK

SEQ ID NO: 14490 - protein, 395 aa, Agrobacterium tumefaciens; identical to SEQ ID NO: 11440

SEQ ID NO: 14491 - protein, 299 aa, Agrobacterium tumefaciens; identical to SEQ ID NO: 11439

SEQ ID NO: 14492 - protein, 712 aa, Agrobacterium tumefaciens
MARQEANEQFQITSFLDGANAAYIEQLYARYEEDPSSVSPEWQSFFKALSDNPEDVKKAAKGASWKRANWPIPANGELVSALDGNWATVEKAIEKKVQAKAEAKSADTGKPVSEAEVLQATRDSVRAIMMIRAYRMRGHLHAKLDPLGIASAVEDYNELSPKSYGFEESDYDRKIFIDNVLGLEYATVREMVEILERTYCSTLGVEFMHMSNPEEKGWIQERIEGPDKGVDFTPEGKKAILSKLVEAEGYEQFLDVRFKGTKRFGLDGGESLIPALEQIIKRGGQDGLEEVVLGMAHRGRLNVLTNVMGKPHRAVFHEFKGGSFKPDDVEGSGDVKYHLGASSDREFDGNKVHLSLTANPSHLEIVNPVVMGKARAKQDQLAKTWDGDIIPLSERAKVLPLLLHGDAAFAGQGVVAEILGLSGLRGHRVAGTMHFIINNQIGFTTNPAFSRSSPYPSDVAKMIEAPIFHVNGDDPEAVVYAAKVATEYRMKFHKPVVIDMFCYRRFGHNEGDEPAFTQPKMYKVIRGHKTVARIYADRLIAEGLITEGDFEKVKADWRAHLEQEFEAGQSYKPNKADWLDGQWSGLRAADNADEQRRGKTGVPMKQLKEIGKKLSTIPEGFTAHRTIQRFMENRSQMIETGEGIDWAMAEALAFGSLVVDGHKIRLSGQDCERGTFSQRHSVLYDQETEERYIPLANLAPTQARYEVINSML

SEQ ID NO: 14493 - protein, 324 aa, Agrobacterium tumefaciens
MNGAGEINASRHRKENELKTCQILGAPVQSGASQPGCLMGPDAFRTAGLTQVLTELGWAVTDLGDATPTVEPELSHPNSAVKNLDALVGWTRSLSQKALEMARSCDLPVFLGGDHSMSAGTVSGVAQRTAELGKEQFVLWLDAHTDLHTLHTTASGNLHGTPVAYYTGQSGFEGLPPLAAPVNPRNVSMMGIRSVDPEERRRVAEIGVQVADMRVLDQQGVVRPLEAFLDRVSKVSGRLHVSLDVDFLDPAIAPAVGTTVPGGATFREAHLIMEMLHDSGLVTSLDLAELNPFLDERGRTARLITDLASSLFGRRVFDRVTTAF

SEQ ID NO: 14494 - protein, 430 aa, Agrobacterium tumefaciens; identical to SEQ ID NO: 11682

SEQ ID NO: 14495 - protein, 411 aa, Agrobacterium tumefaciens; identical to SEQ ID NO: 14378

SEQ ID NO: 14496 - protein, 408 aa, Agrobacterium tumefaciens; identical to SEQ ID NO: 14245

SEQ ID NO: 14497 - protein, 465 aa, Agrobacterium tumefaciens
  unsure (1)..(465): unsure at all Xaa locations
DVVVIGTGPGGYVCAVKAAQLGLKVAVIEKRATYGGTCLNVGCIPSKALLHASETFAHVAHGVDTLGIEVAAPKLNLEKMMGHKDGVVKANVDGVAFLFKKNKIDAFQGTGKVVSAGKVSVTNDKGETQEIEAKNIVIATGSDVAGIPGVKVDIDETVIVSSTGAIALSKVPEKLIVVGGGVIGLELGSVWSRLGAKVTVVEYLDNILGGMDGEVSKQSQRLLAKQGLDFKLGAKVTAVEKTAAGAKVVFEPVKGGAAETLEADVVLISTGRKPYTEGLGLAEAGVVLDSRGRVEIDGHYKTNVDGIYAIGDVVXGPMLARKSHDEGVALAEILAGQRGHVNYDVIPAVVYTQPEIASVGNTEEELKAAGVAYKVGKFPFTANGRARAMQVTDGFVKILADKETDRVLGGHIVGFGAGEMIHEITVLMEFGGSSEDLGRTCHAHPTMSEAVKEAALATFFKPIHM

SEQ ID NO: 14498 - protein, 134 aa, Agrobacterium tumefaciens
ILNGPNLNLLGQRQPEIYGYETLADVEADCRAIAEAAGHELFFAQSNREYELIDWIHEARGKSAGIVINPGAFTHTSVAILDALNAFEAPVIEVHISNIHKREVFRHHSYVSTRAEGVIAGLGIEGYGVALRHL

SEQ ID NO: 14499 - protein, 274 aa, Agrobacterium tumefaciens
VGLIGADIQLSKSPALHMREGAAHGLDYSYELVDVTARKLPQSSLPALLDELEARGFAGTNITHPFKQAVIPHLHELSDDARMLGAVNTVVFRDGRRIGHNTDWYGFYESFVRGLPDAKRDRALLVGRRWRRRCVAHAALKLDIIRLDIFDRDFPRAERLADELNARFGEGRAFAVKDPADSLPFADGLIHATPMGMPAHPGMPVAAELIEQKHWVADIVYMPLVTELLATAASKGCRTLPGGGMTVFQAVGAFRLFCGREPDAKRMTAHFTEL

SEQ ID NO: 14500 - protein, 244 aa, Agrobacterium tumefaciens; identical to SEQ ID NO: 11507

SEQ ID NO: 14501 - protein, 279 aa, Agrobacterium tumefaciens; identical to SEQ ID NO: 11506

SEQ ID NO: 14502 - protein, 242 aa, Agrobacterium tumefaciens
RTAIITGSGRGLGFEIAKGFAEAGAHVWLTGRNAETLQQAVDTLRKAGGKADYAAFDIADTAAGSALVRRIMDEAGHLDILVNNVGARDRRPLAEFTDDDVLELIRTDLTSSISLSRDAAEAMNANGYGRIITITSILGHIVRPGDAIYPVAKQGLTGLMRAIAVEYGARGITSNAIAPGMFATETNAALAENPDMVAFAKLRVPLERWGRPDEIAGAALFLASDAASFVNGHILTVDGGMS

SEQ ID NO: 14503 - protein, 490 aa, Agrobacterium tumefaciens
MSSQIIPVEPFDCVVFGGTGDLAERKLLPALYHRQVEGQFTEPTRIIGASRSVMTHEEYRKFAQDALKEHLKAGEYDDAQVTLFLNRLFYVPVDAKSGNGWDVLKKLLDEGKERIRAFYLAVAPGIFGDIADKIREHKLITRSTRIVVEKPIGRDLASAQELNDTIGHVFKEEQIFRIDHYLGKETVQNLMALRFANALYEPLWNSAHIDHVQITVAEAVGLEGRAGYYDKAGALRDMVQNHILQLLCLVAMEPPASMKSEAVRDEKLKVLRSLKPIDTSNVEKLTVRGQYRAGASAGGPVKGYLEELEGGVSNTETFVAIKAEIANWRWAGVPFYIRTGKRLATRVSEIVVTFKQIPHSIFDDAAGKIEANKLVIRLQPDEGVKQSLLIKDPGPGGMRLRQVSLDMSFAEAFNVRSPDAYERLLMDTIRSNQTLFMRRDEVEAAWDWIDPILKSWEELGQSVQGYTAGTWGPSGSIALIERDGRTWHDA

SEQ ID NO: 14504 - protein, 816 aa, Agrobacterium tumefaciens; identical to SEQ ID NO: 11470

SEQ ID NO: 14505 - protein, 505 aa, Agrobacterium tumefaciens
  unsure (1)..(505): unsure at all Xaa locations
FXELREXLSXEGATFTTQTDTEVVAQLLAKYTREGLGHREAMLKMLNHVTGAYALVVMFQDDPGTLLSARSGPPLAVGYGRGEMFLGSDAIALSPFTNEITYLVDGDCAIVTRDGAEIIDFSGKPVKRERQISQATAFVVDKGNHRHFMEKEIYEQPEVISHALSHYVDFATRTVKDADKAIDFASLSGLAISACGTAYLSGLIGKYWFERYARLPVEIDVASEFRYREIPLVPTQAALFISQSGETADTLAALRYCQQEGLKIGAVVNTRESTMARESDAIFPILAGPEIGVASTKAFTCQLAVLASLAVAAGKARGTLKPGEEKQLVQQLIEMPRIMSKVLNVIQPQIEALSRDLSRFKDVLYLGRGTSFPLALEGALKLKEISYIHAEGYAAGELKHGPIALIDENMPVIVIAPHDRFFEKTVSNMQEVAARGGRIIFITDEKGAAASKLETMATITLPNVDELIAPMVFSLPIQLLAYHTAVFMGTDVDQPRNLAKSVTVE

SEQ ID NO: 14506 - protein, 276 aa, Agrobacterium tumefaciens
SFVKNKDGVEIYFKDWGPKDAQPIVFHHGWPLSSDDWDAQMLFFVQNGYRVVAHDRRGHGRSQQVSDGHDMDHYAADASAVAEHLDLRNAVHIGHSTGGGEVARYVAKFGQPQGRVAKAVLVSAVPPLMLKTPSNPGGLPIEVFDSFRKGVAENRAQFFLDVPAGPFYGFNRPDAKIYPGVIRNWWRQGMMGSAKAHYDGVKAFSETDQTEDLKAITVPTLVLHGDDDQVVPIADSAELSVKLLKNGTLKVYKGYPHGMLTTHADVINPDLLAFVK

SEQ ID NO: 14507 - protein, 551 aa, Agrobacterium tumefaciens; identical to SEQ ID NO: 11690

SEQ ID NO: 14508 - protein, 471 aa, Agrobacterium tumefaciens; identical to SEQ ID NO: 11691
  unsure (1)..(471): unsure at all Xaa locations

SEQ ID NO: 14509 - protein, 245 aa, Agrobacterium tumefaciens
TILITGATSGFGQATARRFVKEGWKVIGTGRRAERLEALAAELGQAFHGIAFDITDEDATEKALAALPDGFRDIDILVNNAGLALGTAPAPQVALKDWQTMVDTNITGLLNITHHLLPTLIKQKGIVVNLSSVAAHYPYLGGNVYGGTKAFLRQFSLGLRSDLHGKGVRVTSIEPGMCETEFTLVRTGGNQEASDNLYKGVNPITADDIANTIYWVASQPKHININSLELMPVNQSFAGFQVYRE

SEQ ID NO: 14510 - protein, 548 aa, Agrobacterium tumefaciens; identical to SEQ ID NO: 11578

SEQ ID NO: 14511 - protein, 335 aa, Agrobacterium tumefaciens; identical to SEQ ID NO: 11527

SEQ ID NO: 14512 - protein, 237 aa, Agrobacterium tumefaciens; identical to SEQ ID NO: 11741

SEQ ID NO: 14513 - protein, 383 aa, Agrobacterium tumefaciens
ATQLVHGGTLRSPYGETSEAIYLTQGFVYENSEAAEARFKGETDGFIYARYASPTNDMFEKRMCLLEGAEDARALASGMAAVTAAIMCQLRAGDHIVAARALFGSCRWVVETLAPKYGIECTLIDGRDLDNWEKAIQPNTKLFFLESPTNPTLEVVDIAGVAKLANQIGAKVVVDNVFATPLFQKPLELGAHIVVYSATKHIDGQGRCLGGVILSDKKWIEEELQDYFRHTGPAMSPFNAWTLLKGIETLPLRVKQQTENAAKIADFLADSGKVAKVIYPGRADHPQADIIARQMSGGSTLVAFELKGGKDAAFKLQNALEIVKISNNLGDAKSLITHPGTTTHKNLSDEARAELGISGGTLRLSCGIEDTDDLLEDLAKGLA

SEQ ID NO: 14514 - protein, 299 aa, Agrobacterium tumefaciens; identical to SEQ ID NO: 11776

SEQ ID NO: 14515 - protein, 384 aa, Agrobacterium tumefaciens; identical to SEQ ID NO: 11777

SEQ ID NO: 14516 - protein, 268 aa, Agrobacterium tumefaciens
MPKRQDIKSILIIGAGPIVIGQACEFDYSGTQACKALKEEGYRVILVNSNPATIMTDPGLADATYVEPITPEVVAKIIAKERPDALLPTMGGQTALNTALSLKRMGVLDRYNVEMIGAKPEAIDMAEDRALFREAMARIGLETPKSMLANATEIKDADRKTHEAARTELKAKLSGAELDKALDNLENQWNLGETDRKQRYISHAMAIAAQAIDVVGLPAIIRPSFTMGGTGGGIAYNRSEFFEIIGGGLDASPTTEVLIEESVLGWKD

SEQ ID NO: 14517 - protein, 210 aa, Agrobacterium tumefaciens; identical to SEQ ID NO: 11465

SEQ ID NO: 14518 - protein, 877 aa, Agrobacterium tumefaciens
ETKTTCPYCGVGCGVIATVNDSGVVSVKGDPDHPANFGRLCSKGSALAETIDLDGRLLHPEIAGRRAAWDEALDLVASRFSDAIAEHGPDSVAFYVSGQLLTEDYYLANKLMKGFIGSANIDTNSRLCMSSSVAGHRRAFGADTVPGTYEDMELADLVILTGSNLAWCHPVLYQRLAAAKAARPGMKVVVIDPRRTMSADIADMHLAIRPDGDVALFTGLLAHLFASSAIDRGYVENHTAGFEAATQAASEHSLPEIAEATGLTIAELIPFYELFERTEKTVTCYSQGVNQSESGTDKVNAIINCHLATGRIGRPGMGPFSLTGQPNAMGGREVGGLANMLAAHMSIENADDRDRVQRFWASPAIAQKPGLKAVDMFRAVADGRIKALWIMATNPVVSMPDAGAVEVTIKACPFVVVSDVMANTDTARHAHVLLPSLGWGEKDGTVTNSERRISRQRSFLDAPGEAKADWWQMAEVARRMGFDAAFAYQQPSEIFAEHAALSGFENAGRRDFDIGGIERDSYETMAPVQWPKAGAGEAEVTRFFANGRFYHADGKARFIATALPETDRTSADYPLTLNTGRIRDQWHTMTRTGKSARLTAHIAEPFAEIHPRDAQALGIKSADLVELESPHGKVLLRALVSERQARGSVFAPMHWNDQFASRARIDVVVAPVTDPHSGQPASKNVGVRVTRFEASAYGFAICRSRPDAPDCAYWAVAKAEGGYRMELAFAEAPEDWTLWARRVFGIDVRIEPLGYSDRQTGDLRLAFFDGDTLLAALFIAREPVAVARNWAISQLSERHEDLRMRFALVAGRPGAGRADPGATVCSCFNVGVNQITAAIREGCHSVEAIGNALNAGTNCGSCRAEIRGIIDGCLKTA

SEQ ID NO: 14519 - protein, 449 aa, Agrobacterium tumefaciens; identical to SEQ ID NO: 14183

SEQ ID NO: 14520 - protein, 281 aa, Agrobacterium tumefaciens
MSDEAIHDIFVIGGGINGCGIARDAVGRGYSVALAEMNDFASGTSSAATKLIHGGLRYLEHYEFRLVREALMEREVLWAMAPHIIWPMRFVLPFQKGGVRPAWLVRLGLFLYDHLGGRKLLPATRSLDLRRDPAGKPLKPIFARAFEYSDGWVDDARLVVLNARDAADRGAVILNRTQVVSARREGAFWRVETKNAAGESKTYRARMLVNAAGPWVDKVLAATFGKNNVHNVRLVQGSHIIVRKKFADPRAYFFQNPDGRIIFAIPYEQDFTLIGTTDRDY

SEQ ID NO: 14521 - protein, 630 aa, Agrobacterium tumefaciens
MAKVIGIDLGTTNSCVAVMDGKDTKVIENAEGARTTPSMVAFSDDGERLVGQPAKRQAVTNPTNTLFAVKRLIGRRYEDPTVEKDKALVPFEIVKGDNGDAWVKAQDKNYSPSQISAMILQKMKETAESYLGEKVEKAVITVPAYFNDAQRQATKDAGRIAGLDVLRIINEPTAAALAYGLDKKEGKTIGVYDLGGGTFDISVLEIGDGVFEVKSTNGDTFLGGEDFDMRLVEYLAGEFKKDQGIDLKNDKLALQRLKEAAEKAKIELSSSQQTEINLPFITADASGPKHLTLKLTRAKFESLVDDLVQRTVAPCKAALKDAGVTAAEIDEVVLVGGMSRMPKVQEVVKQLFGKEPHKGVNPDEVVAMGAAIQAGVLQGDVKDVLLLDVTPLSLGIETLGGVFTRLIDRNTTIPTKKSQTFSTAEDNQSAVTIRVSQGEREMAQDNKLLGQFDLVGLPPSPRGVPQIEVTFDIDANGIVQVSAKDKGTGKEQQIRIQASGGLSDADIEKMVKDAEANAEADKKRRAGVEAKNQAESLIHSTEKSVKEYGDKVSETDRKAIEDAIASLKTAVEAAEPDADDIQAKTQTLMEVSMKLGQAIYEAQQAEAGDASAEGKDDVVDADYEEIKDDK

SEQ ID NO: 14522 - protein, 206 aa, Agrobacterium tumefaciens; identical to SEQ ID NO: 11796

SEQ ID NO: 14523 - protein, 338 aa, Agrobacterium tumefaciens; identical to SEQ ID NO: 11463

SEQ ID NO: 14524 - protein, 270 aa, Agrobacterium tumefaciens
VVGYPIKHSRSPIIHSYWLKKFGIAGSYTAVEVSPDDFPKFIATLKEGKPGAAVGGNATIPHKEAAYRLADHPDALAEELGAANTIWMEEGKLHATNTDGYGFVSNLDERHPGWDKTQRAVVFGAGGASRAVIQSLRDRDVAEIHVVNRTVERARELADRFGPRVFSHPQAALQEVMHGAGLFVNTTSLGMNGTEAPHLDFSHLAANAVVTDIVYVPLKTPILNMAQEQGIATVDGLGMLLHQAKPGFRRWFGRIPEVDETLRSLIIADM

SEQ ID NO: 14525 - protein, 266 aa, Agrobacterium tumefaciens; identical to SEQ ID NO: 14314

SEQ ID NO: 14526 - protein, 552 aa, Agrobacterium tumefaciens
SMTASVTSALTPNKDWWRGAVIYQIYPRSYQDSNGDGIGDLKGITDRLHHIAGLGADAIWISPFFTSPMKDFGYDVSNYVDVDPMFGTLADFDGLIAEAHRLGIRVMIDLVLSHTSDQHPWFVESRASRNNPKSDWYVWSEAKPDGTPPNNWLSIFGGSGWQWDPTRMQYYMHNFLTSQPDLNLHNPEVQEELLNITRFWLKRGVDGFRLDTINFYFHDLELRDNPALAPERRNASTAPAVNPYNFQEHLYDKNRPENIAFLKRFRAVLDEFPDIAAVGEVGDSQRGLEIVGEYTSGDDKMQMCYAFEFLAPDALTPQRVADVQADFARAAPEGWACWAFSNHDVVRHVSRWGEHVEDKDAFAKLLSALLMTQRGSVCIYEGEELGLTEADIAFEDLQDPMASSSGREFKGRDGCRTPMVWDAGHAQAGFSTSDKIWLPIPAEHKQRAVSRPAGQRGVGAGALPRFLAFRKQHPAFAKGGIEFQPLEGDVLSYTRKLGNETILCLFNLSATPANATLPKGNWEVLEGHGFASGLEGTSVELPAWGAFFARYA

SEQ ID NO: 14527 - protein, 443 aa, Agrobacterium tumefaciens; identical to SEQ ID NO: 11613

SEQ ID NO: 14528 - protein, 380 aa, Agrobacterium tumefaciens; identical to SEQ ID NO: 11614

SEQ ID NO: 14529 - protein, 573 aa, Agrobacterium tumefaciens; identical to SEQ ID NO: 11795

SEQ ID NO: 14530 - protein, 257 aa, Agrobacterium tumefaciens; identical to SEQ ID NO: 11794

SEQ ID NO: 14531 - protein, 491 aa, Agrobacterium tumefaciens
IADGEPMMAIVPAAVAVLILGLLKAWLEKVAARLSFRAARAALSQRRFEALQAVAKVSPLDLSRTASGEAAGIVAEAAEALVPYLSRFQPARMKATIVPLVFVLAILPFSWIAALVLLLAMPTIPLFMALIGWQAKAASEKQLAETGNINAFLLDRLRGLETIRTLKAVDLTAARLDADAQNLKKRTMAVLRIAFLSSAVLELFAAIGVAMTAVYIGFHLLGFLDFGAWGEKLTLAEGLFILLLAPAFFEPLRELSAVWHDRAAGEASLNALATLTAGGAAIVGEGADVVRAPSSTPGLLEMENLSFAYPNAPPVIRNFNLTVQQGERVAILGASGCGKSTILSLIAGLAEAGEGVIRIGGVTLDDATADGLRGTIGWVSQKPFFFAASMKANIGFGRLAVSEAMVEEVLHRTGLDGLTQARRHLQIGDGGNGISGGEAVRLAIARAFADPATQLVLADEPTAHLDRETAALVTDNLLQLAKGRTLIVATH

SEQ ID NO: 14532 - protein, 325 aa, Agrobacterium tumefaciens; identical to SEQ ID NO: 11379

SEQ ID NO: 14533 - protein, 241 aa, Agrobacterium tumefaciens; identical to SEQ ID NO: 11378

SEQ ID NO: 14534 - protein, 539 aa, Agrobacterium tumefaciens; identical to SEQ ID NO: 11597

SEQ ID NO: 14535 - protein, 489 aa, Agrobacterium tumefaciens; identical to SEQ ID NO: 11598

SEQ ID NO: 14536 - protein, 368 aa, Agrobacterium tumefaciens; identical to SEQ ID NO: 11664

SEQ ID NO: 14537 - protein, 135 aa, Agrobacterium tumefaciens
IIVINGPNLNMLGKREPGIYGGKTLKDIENDCVNAGADLGFSVEFRQSNHEGVLVDWLHEAGERAAGVVINPGAYSHTSIALHDAIRAISTPVVEVHISNIHAREEFRHKSMVSPAAKGMICGFGPYGYVMALHA

SEQ ID NO: 14538 - protein, 226 aa, Agrobacterium tumefaciens; identical to SEQ ID NO: 11705

SEQ ID NO: 14539 - protein, 176 aa, Agrobacterium tumefaciens; identical to SEQ ID NO: 14373

SEQ ID NO: 14540 - protein, 418 aa, Agrobacterium tumefaciens; identical to SEQ ID NO: 14293

SEQ ID NO: 14541 - protein, 448 aa, Agrobacterium tumefaciens
QMWGGRFASGPSAIMEEINASIGFDKKLYAQDIRGSIAHATMLAEKGIISQEDKEKIVHGLNTILSEIEAGTFEFSRKLEDIHMNIEARLATLIGTAAGRLHTARSRNDQVALDFRLWVKEELQKTEGMLTALIAAFLDRAEENADTVMPGFTHLQTAQPVTFGHHCMAYVEMFGRDRARVRHAIEHLDESPIGAAALAGTGYPIDRHMTAKALGFREPTRNSIDTVSDRDFALEFLSIASICATHLSRLAEEIVIWSTPQFGFIRLSDAFSTGSSIMPQKKNPDAAELVRAKTGRINGSLVALLTVMKGLPLAYSKDMQEDKEQVFDSAESLELAIAAMTGMIRDLEVRKDRMRAAAGSGYSTATDLADWLVREAGLPFRDAHHVTGNAVALAEKKGCDLADLSLEELQAIHPDITNGIFDVLSVEASVASRTSFGGTAPSEVRKQI

SEQ ID NO: 14542 - protein, 277 aa, Agrobacterium tumefaciens
IGVIGAGQMGCGIAHVSAIAGYRVHIYDLSKEGIEAGLATINGNLARQVTNNKLSDDARKQALALISGSTDVNDLAPMDIVIEAATENEEIKRKIYAQVCPVLKPEALLATNTSSLSITRLASATDRPEQFMGIHFMNPVPVMKLVELVRGIATNEKTFDAAKAYVRTLEKAITVAEDFPAFIVNRILLPMINEAIYTLYEGVGSVEAIDTAMRLGANHPMGPLQLADFIGLDTCLSIMQVLHDGLSDSKYRPCPLLVKYVEAGWLGRKSGRGFYDY

SEQ ID NO: 14543 - protein, 592 aa, Agrobacterium tumefaciens
ISPDSTSTRCSASWKRNEDRNVPTFSPSLEKALHQALTFANERHHEYATLEHLLLALIDDADAAAVMAACNVDLDALRKTVSDYVDNELTNLVTGYDEDSKPTSGFQRVIQRAVIHVQSSGREEVTGANVLVAIFAERESHAAYFLQEQEMTRYDAVNYISHGIGKRPGTSQTRAPRGADEPESESKPSRGNPEEDGSSAKKQQDALKAYCVNLNDKARNGKIDPLIGRHDEVNRTIQILCRRSKNNPLYVGDPGVGKTAIAEGLAKRIVEGKVPEALANDTIFSLDMGTLLAGTRYRGDFEERLKQVVKELEEFPGAVLFIDEIHTVIGAGATSGGAMDASNLLKPALSSGAIRCIGSTTYKEYRQFFEKDRALVRRFQKIDVNEPSIDDAIAIMKGLKPYFEDYHHLRYSNEAIKAAVELSARYISDRKLPDKAIDVIDETGAAQMLLPASKRRKLITEREIEATIATMARIPPKTVSKDDEMVLANLEKELRSVVYGQDIAIEALATAIKLARAGLREPNKPIGSYVFSGPTGVGKTEVAKQLAASLGVEMLRFDMSEYMERHTVSRLLGAPPGYVGFDQGGLLTDGVD

SEQ ID NO: 14544 - protein, 273 aa, Agrobacterium tumefaciens; identical to SEQ ID NO: 14407

SEQ ID NO: 14545 - protein, 268 aa, Agrobacterium tumefaciens; identical to SEQ ID NO: 14408

SEQ ID NO: 14546 - protein, 835 aa, Agrobacterium tumefaciens; identical to SEQ ID NO: 11580

SEQ ID NO: 14547 - protein, 489 aa, Agrobacterium tumefaciens
  unsure (1)..(489): unsure at all Xaa locations
VAAGHAKQPFYKHLYFQVLVAIIAGIALGHFYPTFGEQLKPLGGRASCVSSRLIIGPVIFLTVATGIAGMNDMKKVGRVAGAAHIYFLGFSTARLIVGLIVANTGAAGAGMNIDPATLDAKAVATYADKAHEQTITGFLMNIIPTTIVGAFASGDILQVLFFSVLFGIALGIVGEKGKPVTDFMHAMMYPIFKLVAILMKAAPIGAFGAMAFTIGKYGISSVTNLAMLIGTFYITSALFVFVVLGAVCRYNGFSIVALIRYIKEELLLVLGTSSSEAALPGLMSKMEKAGCKRSVVGLVIPTGYSFNLDGTNIYMTLAALFIAQATGIHLSFGEQILLLLVAMLSSKGAAGITGAGFITLAATLSVVPSVPVAGMALILGIDRFMSECRALTNFVGNAVATIVVARWEGELDQEQLARVLSGKEEFTSIADVDALPASVQPAEXYDLPRSCLFRFVRQARMKAGVSCGCVGLSSFRPXTKTVFIGPAML

SEQ ID NO: 14548 - protein, 403 aa, Agrobacterium tumefaciens; identical to SEQ ID NO: 11658

SEQ ID NO: 14549 - protein, 395 aa, Agrobacterium tumefaciens; identical to SEQ ID NO: 11657

SEQ ID NO: 14550 - protein, 465 aa, Agrobacterium tumefaciens
TKFKTFALTSQALGLNRERPMLSNSLIELDRAHLVHPVSSFRGHEKLGVRVLKSASGATVTDMTGHQLIDGFAGLWCVNAGYGHDSIVEAAAKQMRELPYATAYFDIGSEPAIRLASELADRAPGDLNHVYFTLGGSDAVDSTIRFIRYYWHAKGQPQRDQFISIEQGYHGSTTAGSGLTALPAFHAGFGVPYDWQHKIPSHYAYRNPAGSDPAAIIASSLQILKDKIEAIGPDRVAAFYAEPIQGSGGVLVPPPGWIKAMRELCSSYGILFVADEVITGFGRTGPLFACADEDIVPDFITAAKGLTSGYVPMGAVFMADHVYDTIADFAGEAAIGHGYTYSAHPVSAAVGLEVLKLYEGGLLENGRRAGQRLMAGLEGLRNHPLVGDVRGRGMLAAIELVTDKDKKTPLPAAAAPARKVFDRAWENGLIVRAFANGILGYAPPLCCTDGEIDAIVERTLKTLDQ

SEQ ID NO: 14551 - protein, 215 aa, Agrobacterium tumefaciens; identical to SEQ ID NO: 11661

SEQ ID NO: 14552 - protein, 335 aa, Agrobacterium tumefaciens; identical to SEQ ID NO: 11660

SEQ ID NO: 14553 - protein, 329 aa, Agrobacterium tumefaciens
MKFSIAEAEDLVSSIFERNGVLPQNARSVAKALVASEAAGQGGHGFRRIPVYVRQARVGKVDGQARPVVRRVKPGVLSIDANHGYAYPAIDCALEELPEMARQQGIALAAIHRSHHAGVMALTVERFAEMGLVALMFANAPASMAPWGGHTPLYGTNPIAFAAPIGGADPLVIDLALSKVARGKIMAARRRGETIPGDWALDRNGRPTTDPEEAIAGTMVPAGEAKGAALALMVEIMAAAVTGGNFAFQASSLLDDKGAPPSLGHTIIAIDPVSSGGAAFTERLALIAGEIEKQENVRLPGRRSQGIRKQALESGIAIESDILAEIQSL

SEQ ID NO: 14554 - protein, 307 aa, Agrobacterium tumefaciens; identical to SEQ ID NO: 11662

SEQ ID NO: 14555 - protein, 332 aa, Agrobacterium tumefaciens
NLLKKLDLITIGRSSVDLYGSQVGGRLEDMASFAKYIGGSPTNIAAGAARLGLNSAVITRVGDEHMGRFIREQLVREGVDVRGVKTDPERLTALVLLGIRDQNQFPLIFYRENCADMALSEDDIDPAFIADAGCICATGTHLSHPNTEAAVLKALKLARENGAKTALDIDYRPNLWGVAGHGDGESRFVESQKVTAKLQSTLHLFDLIVGTEEEFHIAGGSTDTLTALNAVRKVSNATLVCKRGPMGASVFTGDIPDSLDDGETGEGFPIEVFNVLGAGDGFMAGLFRGWLRGEDWPTTLKYANACGAFAVSRHGCTPAYPSWEELQYFFKA

SEQ ID NO: 14556 - protein, 443 aa, Agrobacterium tumefaciens; identical to SEQ ID NO: 11734

SEQ ID NO: 14557 - protein, 344 aa, Agrobacterium tumefaciens; identical to SEQ ID NO: 11733

SEQ ID NO: 14558 - protein, 654 aa, Agrobacterium tumefaciens; identical to SEQ ID NO: 11423

SEQ ID NO: 14559 - protein, 288 aa, Agrobacterium tumefaciens
KKIRKAVFPVAGLGTRFLPATKAVPKEMLTVVDKPVIQYVVDEAAEAGIEHFVFVTGRGKAVIEDYFDIQFELEQMLRERNKNAELTLLAGLLPKAGTASFTRQQVPLGLGHAVWCARDIVGDEPFAVLLPDMIMHSQKSCLKGMVELYDQTQGNVIAVQECAPDQTHKYGIVGVGNAVGEGFKITEMVEKPAKGTAPSNFYINGRYILQPEIFDILENQERGAGNEIQLTDGMLTLAKSQEFSGYTSFRGQTFDCGAKDGFILANVAFALERGDIRPAIEEPIKALI

SEQ ID NO: 14560 - protein, 475 aa, Agrobacterium tumefaciens; identical to SEQ ID NO: 11633

SEQ ID NO: 14561 - protein, 277 aa, Agrobacterium tumefaciens; identical to SEQ ID NO: 11634

SEQ ID NO: 14562 - protein, 242 aa, Agrobacterium tumefaciens; identical to SEQ ID NO: 11357

SEQ ID NO: 14563 - protein, 401 aa, Agrobacterium tumefaciens; identical to SEQ ID NO: 11471

SEQ ID NO: 14564 - protein, 475 aa, Agrobacterium tumefaciens
LFIDGRFVEPRSGKFVDSYDPTTGEAWYQFAEGGADDVDLAISSAQRAFRDPSWRRMTQTARGKLVRRLADLVLEHAEDLALLETRDNGKLIKEMRAQMRAIPDSYLYFAGMADKLQGDTIPVNKLDQLNFNMREPLGVIGMVTPWNSPLMLLTGTLAPCLAIGNTVVIKPSEHATASTLALAELIVEAGFPAGVVNVVTGGGAVTGEALTRHNGIAKFVFTGSTATGRRIAANAAANLVPCQMELGGKSPHVVFSDVDIEKTVNGVVSGVFAAAGQTCVAGSRCFVEANIYDRFIEALVERTRNIKLGDPMDDATDIGPLALESQLSKLEGYVASGVREGSRIAIGGKRPQSEELSRGWYFEPTVMADATNDMSFMRHELFGPMVGVMPFSSEEEMISLANDTNYGLASGIWTQNIDRAMRFANQIDAGTVWINTYRSAAYMSANGGFKESGYGRRGGFDVMREFSRAKNVVID

SEQ ID NO: 14565 - protein, 477 aa, Agrobacterium tumefaciens
YILAIDQGTTSTRSMVFDRDMRVIGVGQREFPQHFPASGWVEHDAEDIWKSVLETIRLALADAGIAASDIAAIGITNQRETTVLWDRNTGEAVHRAVVWQDRRAAPVCEDLKRRGLEPLFSKKTGLLLDPYFSGTKLKWLLDSVSGLREKAVKGEICFGTVDSFLIYRLTGGRRHVTDATNASRTLIYNIEDNAWDDELLSILNIPRAMLPEVLDCAADFGVTDKALLGAEIPILGVAGDQQAAVIGNACFEPGMMKSTYGTGCFALLNTGTDRVASTNRLLTTIAYRLDGVTTYALEGSIFIAGAAVQWLRDELGFISVASEVSALAEKADPKQRVYLVPAFTGLGAPYWDAEARGAIFGLTRGTGPAEFARAALESVAYQTFDLLDAMRKDWAGDNGKTVLRVDGGMVASDWTMQRLADILAAPVDRPVFLETTILGAAWLAASRAGIWPDRKAFADHWRRDRRFSPDMEESERK

SEQ ID NO: 14566 - protein, 294 aa, Agrobacterium tumefaciens; identical to SEQ ID NO: 14288
  unsure (1)..(294): unsure at all Xaa locations

SEQ ID NO: 14567 - protein, 253 aa, Agrobacterium tumefaciens; identical to SEQ ID NO: 11801

SEQ ID NO: 14568 - protein, 701 aa, Agrobacterium tumefaciens
LDYHALNAMLNLYDENGKIQLDKDRLAARQYFLQHVNQNTVFFHNLREKLDYLVTEGYYEQEVLDQYSFNFVRDLYDEAYSRKFRFPTFLGAFKYYTSYTLKTFDGKRYLERYEDRVCMVALALARGDEQLARDLMDEIISGRFQPATPTFLNAGKKSRGELVSCFLLRVEDNMESIGRSINSALQLSKRGGGVALSLTNIREFGAPIKQIENQSSGVIPVMKLLEDSFSYANQLGARQGAGAVYLHAHHPDIMRFLDTKRENADEKIRIKTLSLGVVIPDITFELARNNEDMYLFSPYDVERVYGVPLTEISVTEKYHEMVADSRIRKKKIKAREFFQVIAEIQFESGYPYIMFEDTVNRANPVAGRISMSNLCSEILQVSEASEFNADLSYSHMGKDISCNLGSLNIASAMDSADFGKTIETSIRALTAVSDMSHISSVPSVEKGNDASHAIGLGQMNLHGYLARERIFYGSEEGIDFTNIYFYTVTYHAIRASNRLAVERGQSFKGFENSKYASGDYFDKYTDREWLPATEKVRDLFEKAGIAIPTQEDWTALKQDVMASGLYNQNLQAVPPTGSISYINHSTSSIHPIVSKIEIRKEGKIGRVYYPASYLSNDNLEYYQDAYEIGPEKIIDTYAAATQHVDQGLSLTLFFRDTATTRDINRAQIYAWRRGIKTIYYIRLRQMALEGTQVQGCVSCTL

SEQ ID NO: 14569 - protein, 313 aa, Agrobacterium tumefaciens; identical to SEQ ID NO: 11799

SEQ ID NO: 14570 - protein, 658 aa, Agrobacterium tumefaciens; identical to SEQ ID NO: 11561

SEQ ID NO: 14571 - protein, 258 aa, Agrobacterium tumefaciens
MDFGISGKRALVLASSRGLGLGIATALAKEGANVLLVGRSGEKLAENCKAINALGKGKADWVWGDLADDNFVESMVQAVEDKLGGIDILVNNTGGPTPGLAQEMTVDKLDTFFQSMVLRVITLTNALLPQMKEQGFGRILTVASSGVFEPIPNLALSNTLRGALVGWSKTLSSEVASFGITSNLLLPGRIHTDRIDELDGANAKRLGKSIEEVREASVKGIPAGRLGTVEEFAAAGAFLCSVPASYITGTMLRVDGGA

SEQ ID NO: 14572 - protein, 500 aa, Agrobacterium tumefaciens; identical to SEQ ID NO: 11758

SEQ ID NO: 14573 - protein, 240 aa, Agrobacterium tumefaciens; identical to SEQ ID NO: 11757

SEQ ID NO: 14574 - protein, 304 aa, Agrobacterium tumefaciens; identical to SEQ ID NO: 14411

SEQ ID NO: 14575 - protein, 306 aa, Agrobacterium tumefaciens
  unsure (1)..(306): unsure at all Xaa locations
AYTYVDHSYDVIVVGAGGAGLRATLGMAEQGFRTACITKVFPTRSHTVAAQGGIAASLTNMTPDCWQWHLYDTVKGSDWLGDVDAMQYLAMEAPKAVYELEHYGVPFSRNAEGKIYQRPFGGHMQNYGEGPPVQRTCAAADRTGHAILHTLYGQSLRNNAEFFIEYFALDLIMAPDGRCTGVVAWNLDDGTIHRFSAKMVVLATGGYGRAYFSATSAHTCTGDGGGMIARAGLPLQDMEFVQFHPTGILGAACFIIEGARGEFSSLVNSQVERFTQRYAPXLNILASRDGVYSCVRMIIRQAVGAG

SEQ ID NO: 14576 - protein, 356 aa, Agrobacterium tumefaciens
RTLIDNERYQKWYQESVEDPEKFWDKHGRRIDWFKPYTKVKNTSFKGRVPIKWFEDGLTNVSYNCIDRHLKTHGERTAIIWEGDNPYIDKKITYNQLYDYVCRLANVLKKHGVKKGDRVTIYMPMIPEAAYAMLACARIGAVHSVVFGGFSPEALAGRIVDCESTFVITCDEGVRGGKPIPLKENTDKAIDIAAKQYVIVNKVLVVRRTGGKTGWAPGRDIWYHQEIATVKPDCPPVKMRAEDPLFILYTSGSTGKPKGVLHTTGGYLVYTSMTHEYVFDYKDGEVFWCTADVGWVTGHSYIVYGPLANCATTLMFEGVPNFPDQGRFWEVIDKHKVNIFYTAPTALRSLMGAGDQ

SEQ ID NO: 14577 - protein, 256 aa, Agrobacterium tumefaciens; identical to SEQ ID NO: 14410

SEQ ID NO: 14578 - protein, 361 aa, Agrobacterium tumefaciens
EQQSSPVAIAAALAEDFSQTAADHDKSGEFAAGNFEALFKSGLLGLVTAVKDGGWGEGMETAHAVITAIAKGDPSTALILAMHYSVHAAIRRGKWPAALSAKVLVANNREPALLNNAQAEPGVGSPAHGGLPETTARIEGDVWVVNGRKSFVTGLPGLKWAIVLAVTTEETPRLIQLLVPLDAAGIAQEKAWEATGMYATASHDLVLEDVRVPLADIVAEQPADEPLRRDEADGYNFFALLASVYHGVALSARDDLLRHLTGHAPVSLGAPLSSIPRIQEGLGQIEVLLAANRRLLLSVARDIDAGERVGTDALAVRHVVIDNAVTVTDLALELGGNRGLRRDYNLERHHRDAITARAHAP

SEQ ID NO: 14579 - protein, 265 aa, Agrobacterium tumefaciens; identical to SEQ ID NO: 11790

SEQ ID NO: 14580 - protein, 735 aa, Agrobacterium tumefaciens
  unsure (1)..(735): unsure at all Xaa locations
LKRLREMMAEHLEPQERLDQIVRQIASNMVAEVCSVYVLRSDSVLELYATEGLNKDAVHLAQLKMGQGLVGTIAASAQPLNLSDAQAHPAFRYLPETGEEIYHSFLGVPILRSGRTLGVLVVQNKASRTYREDEVEALETTAMLIAEIVASGELKKITRPGVELDLTRAVSIDGDAYGEGIGLGHVVLHDPRIVVTNLLNEDADTEIRRLADAIGSLRLSIDDMLQRRDVPTEGEHREVLETYRMFAHDQGWVRRMEEAIRNGLTAEAAVEKVQSDTKARMMRLTDPYLRERMHDFDDLANRLLRQLIGFGGHNPAQDFPLDAIVLARAMGAAELLDYPREKLRGLVLEDGAVTSHVVIVARAMGIPIIGQATGIVALAENNDPIIIDGDDGQVHLRPMSDLQRAYEEKVRLRAKRQEQFRALRNVEPITKDGQKVNLKMNAGLLVDLPQLEESGADGIGLFRTELQFMIASNMPKGEEQEAFYRSVLRQAKGKSVTFRTLDIGGDKVVSYMRGQEEENPALGWRAIRLSLDRPGLMRTQMRALLRAASGAELRMMLPMVTEVSEIRAARDLLQKEEQHLSKVRHALPKKLKFGAMLEVPSLMRQLDELMQEVDVDSVRSNDLFQFXMAGDRGDARVSDRFDNLGKPFLRILRDIVRAGEKHHTAVTLCGEMASKPLSAMALIGLGFRSVSMSPTAIGPVKAMLLGLDAANLAEELNAALDDHNSLESAREVLLR

SEQ ID NO: 14581 - protein, 422 aa, Agrobacterium tumefaciens; identical to SEQ ID NO: 11391

SEQ ID NO: 14582 - protein, 449 aa, Agrobacterium tumefaciens
GIAPAIAQALEKRGYKDLTPVQQAMLAPELANKDALVSAQTGSGKTVAFGIALATTLLSENTRFGQASAPLALAIAPTRELAMQVKRELEWLYEFAGVSIASCVGGMDIRNERRALERGAHIVVGTPGRLCDHIKRNALDLSSIRAVVLDEADEMLDLGFREDLEFILEESPDDRRTLMFSATVPRSIAKLAESYQKNAVRIATASEQKQHVDIEYRALLVSPSDRENAIINALRFYEARNAIVFCSTRAAVNHLTARLNNRGFSVVALSGELTQNERTHALQAMRDGRARVCVATDVAARGIDLPGLELVIHADLPTNSETLLHRSGRTGRAGQKGVSAIVVPVSQRRKAERLLEGAKVSAAWVRPPSVEEIVERDGARLLADPTLSEAVTDDERDFVNKLLEQHGAEKVAAAFVRLYHSGRSAPEDIFEVALDNTRQAPPRQLRNNR

SEQ ID NO: 14583 - protein, 243 aa, Agrobacterium tumefaciens; identical to SEQ ID NO: 11359

SEQ ID NO: 14584 - protein, 285 aa, Agrobacterium tumefaciens
RDRIIADLKDILPEDCLVHEPRELVPFETDAFVSYRRLPLAVALPKTTEEVAAVMRYCHRYGIPVVPRGAGTSLSGGAIPQEDAVVIGLSKMSAILDLDFYNRTARVQAGVTNLSISDAAGAEGFFYAPDPSSQLACTIGGNIGMNSGGAHCLKYGVTTNNLLGVKMVLVDGTVLELGGNHLDAAGYDLLALVCGSEGQLGIVTEATVRLIARPEGARPVLFGFETSEEAGSCVADIIGAGIIPVAIEFMDKPAIEICEAFAKAGYPLDVGALLIIEVEGSEAEM

SEQ ID NO: 14585 - protein, 241 aa, Agrobacterium tumefaciens
LENKVAIITGASSGIGRATAMLFVTQGAAVVINARGEKALQEVAADIRDAGGRVHAVAGDAGVAETHSRLADAAVGVFGGLDIAINNAGAVGAMKPLAEISPEEWDHVLNVNLTSAFLGARYQIPPMLKRGGGSIVFTSSFVGTSAGIPGMSAYGTAKAALMGLVKGITADYAINGIRANALLPGGVDTPAAGDPAQKEWAAGLHAMKRIAQPEEIAQAALFLASPMASFVAGAALFADGG

SEQ ID NO: 14586 - protein, 166 aa, Agrobacterium tumefaciens; identical to SEQ ID NO: 14308

SEQ ID NO: 14587 - protein, 450 aa, Agrobacterium tumefaciens
SALAVLKQQLGDKLQTGQAFREQHGHTTTYLTLQAPDGVVFAESADDVKAVVKACAQYKVPVIPFGTGSSLEGQVNAPNGGICIDFSRMNRIIEVNAEDLDVTVEPGVTREDLNVYLRDTGLFFPIDPGANASIGGMASTRASGTNAVRYGTMKDNVLAVTAVVANGEEIRTARRARKSSAGYDLTRLFVGAEGTLGVITSVTLRLQGIPEKITGGVCTFDSIKAACDAVIMTIQMGVPVARIELLDEVQVRACNAYSGLNYAEKPTLFVEFHGTEETAALQSQQFAEIAAECGSVDFRWTGDAAERNKLWKARHDAYWASRALAPHLDGLSTDVCVPISRLADCVVETQRDIAENGFLAPIVGHAGDGNFHVLILFDGKDAESVAKTEAFVARLNRRAIAMDGTCTGEHGIGQGKMSFLAEEAGNALDLMRAIKTSLDPDNIFNPGKLF

SEQ ID NO: 14588 - protein, 469 aa, Agrobacterium tumefaciens; identical to SEQ ID NO: 11550

SEQ ID NO: 14589 - protein, 252 aa, Agrobacterium tumefaciens
QSVFVTGGNKGIGYGIARRFAEEGAKVAIASVDKDTHDAAKKLADETGTVTHGVILDVRDAAAVRDAYGAAEDAIGALSISVQNAGVITISKIEDLTQEQWDLNLDVNTKGAFLCCQEAIRRFRASGTKGRLVNTASGQARQGFIYTPHYAASKFGVIGLTQSLAKELAPEGITVNAICPGIIHTEMWDYNDRVWGQMLGEYKPGELMAEWVRNIPMRRAGTPAEVAALVAFLASEDAAYITAQTINVDGGL

SEQ ID NO: 14590 - protein, 312 aa, Agrobacterium tumefaciens
  unsure (1)..(312): unsure at all Xaa locations
VSIRNLTKSYANGFQALKGVSLDIKEGEILALLGPNGAGKTTLISIVCGLVNPGEGSVLVGGHNVVKDFRQTRALIGLVPQELTTDMFETVWNTVSFSRGLHGQKKNPALIESILKSLSLWDKKDNMLRELSGGMKRRVLIAKALAHEPKVLFLDEPTAGVDVTLRRDMWNVVSELRAKGVTIILTTHYIEEAEEIADRVGVINGGELLLVEEKTALMKKLGRKQLFLELTQPVERLPDSLAPFALTLSDDRSTITYEIEGNGEQGRIADLLGALSAANIHFKDISTRQSSLEDIFVSLVGGQKXISKPSSP

SEQ ID NO: 14591 - protein, 302 aa, Agrobacterium tumefaciens; identical to SEQ ID NO: 11547

SEQ ID NO: 14592 - protein, 245 aa, Agrobacterium tumefaciens
LSGQVALVTGAGSGIGQRIAMGLAQSGANVALLDRRTDDGLAQTADFIARAGRKSIQIAADVTSKQALTDAVARTQAELGALSLAVNAAGIANANPAEEMEESQFQTMMDINLKGVFLSCQAEANAMLKNGRGAIVNIASMSGVIVNRGLMQCHYNASKAGVIHMSKSMAMEWVGRGIRVNTISPGYTATPMNTRPEMVHQTKLFEEQTPMQRMAGVDEMVGPAIFLLSDAASFVTGVDLLVDGG

SEQ ID NO: 14593 - protein, 346 aa, Agrobacterium tumefaciens; identical to SEQ ID NO: 11556

SEQ ID NO: 14594 - protein, 186 aa, Agrobacterium tumefaciens
SQAEAEEAVRVLLRWAGENPAREGLLDTPKRVAKAYRELFAGYELNVQDVLGTTFEEVGGYDDVVLVRDIPFFSHCEHHMVPIVGKAHVAYLPAGRVLGLSKIARVVEIFGRRLQTQENMTAQIARSIEETLKPRGVAVMIDAEHMCMSMRGVNKQGSTTLTTSFTGTFKNDPAEQVRFMTMVRNR

SEQ ID NO: 14595 - protein, 400 aa, Agrobacterium tumefaciens; identical to SEQ ID NO: 11569

SEQ ID NO: 14596 - protein, 272 aa, Agrobacterium tumefaciens; identical to SEQ ID NO: 11488

SEQ ID NO: 14597 - protein, 264 aa, Agrobacterium tumefaciens; identical to SEQ ID NO: 11489

SEQ ID NO: 14598 - protein, 376 aa, Agrobacterium tumefaciens; identical to SEQ ID NO: 14381
  unsure (1)..(376): unsure at all Xaa locations

SEQ ID NO: 14599 - protein, 348 aa, Agrobacterium tumefaciens
IKEAKIGTLRVPEAKGGPGGSIADYIEVLMILGEADSNIPHALRSHFNFTENLALAPIELEDRRHLEQVLAGKLFAGASTEQGTKRPGEITTRLSADGDRYRLNGRKWYATGTAFADFGTFSAIGDDEQPIGVLIPLDRTGITILDDWDSMGQRMTASGGVLLENVEVLPHELTTRKLGSQIGRHSSAMRQLHLAASAAGAVQGALNDGVEYVLRQARTTLHSSAETANQDPFVQKMLGEISAGAFAVKTLIREAARTLDRTAATFATGDEEVIEAALLEGSLATARTQIIASQLSLTVATNLYELGGGSATSSERNFDRHWRNIRTVYNHNPLAHKARVIGDYYLNG

SEQ ID NO: 14600 - protein, 403 aa, Agrobacterium tumefaciens; identical to SEQ ID NO: 11431

SEQ ID NO: 14601 - protein, 337 aa, Agrobacterium tumefaciens; identical to SEQ ID NO: 11430

SEQ ID NO: 14602 - protein, 195 aa, Agrobacterium tumefaciens
IHAKRAFKSMNETNLSVPATLGEQARAKLGRRNIVFVGLMGAGKSAVGRMVAQQLKVPFIDTDVEIERVSRMTISELFATYGEEEFRALETRVIKRLMRGGPKVVSTGGGAFINDTTRGHIRRGGISLWLKADLEVLWERVNKRDHRPLLKTENPKATLAALMEKRYPIYAEADVTIESRDVRKEIIATEVLTAL

SEQ ID NO: 14603 - protein, 355 aa, Agrobacterium tumefaciens; identical to SEQ ID NO: 14336

SEQ ID NO: 14604 - protein, 253 aa, Agrobacterium tumefaciens
LEIDVFLCRSDNFGVLLHDPESGATAAIDAPEEGPILRALDGHGWKLTHIFTTHHHQDHVEANLVLKDKFRCEVHGPYDEAIAIPGLDRSQADGDEFEFAGRRVQVIATPGHTAGHICYYLPDDGLLFAADTLFAMGCGRLFERPAADMWHSFQKLMALPDDTRVYFGHEYTLSNARFALTVDPDNAVLRERAARVETARQANEFTIPTTIGLEKQTNPYMRVADAGIRRHLGLEGAADADVFAEIRTRKDNF

SEQ ID NO: 14605 - protein, 351 aa, Agrobacterium tumefaciens; identical to SEQ ID NO: 11621

SEQ ID NO: 14606 - protein, 353 aa, Agrobacterium tumefaciens
MRALRFHAAKDLRIEDIAEPKRPGPGQVLVRNRFVGICGTDLHEYSYGPIFIPTEPHPFTGAHGPQILGHEFGGVVEAIGDGVTSVNVGDRVSIQPLIMPRSGDYFADRGLFHLSTQLALVGLSWDGGGMAEAALVNEYNVQKIPDEMTDEEAALVEPSAVAVYACDRGGVTAGNSVLVTGAGPIGMLTLLAARAAGATQLFVSDLNDARLELARNVIRDVITINPKRDNVGDVVRSATEGKVGCDVAIECVGNEHALKACVDAVRKQGVVVQTGLHPHENPIDWFQVTFRDLEIKGSWAYPTHYWPRVIRLIASGLLPATKIVTKRITLDTAVTEGFDALLDPAGTHLKILI

SEQ ID NO: 14607 - protein, 574 aa, Agrobacterium tumefaciens
RLCFQPLEPPKGLVGFIIVLVVASTLAEVMVPVFSGRIVDAIAGDNGGANAGDGALRAFVIVVALGFTSVVLRWFIFNGIIRLTLKTMADVTNNGFHKVQRFSTDWHANSFAGSTVRKITRGMWALDSLNDLLLVALLPSIVMLVGATVVLGSYWPVMGLIVGLGSLIYIGVTVGLSMGYVSPAARLANAWDTRLGGALADAISCNAVVKAFGAETREETRLGHVLVKWDNRTRRTWKRGTLNGTIQSFMMVSMQAGILGTGLIMWQKGLATAGDITFVLAMFFVLQGYLRDVGQDIRNLQRAVNDMEELVLLDKMPLGVEDRPDAKRINIGKGEIVFDHVTFQYGAHATPLYEDFSVTIKPGERVGLVGHSGSGKTTFVKLIQRLYDIKAGAIRIDGQNIADVTQASLRGQIAIVQQEPILFHRTLAENIAYGRPDASRREIEQAAKQASAHDFIMSLPKGYETMVGERGVKLSGGERQRVAIARAFLADAPVLILDEATSSLDSESEVQIQQAMERLMDGRTTLVIAHRLSTVRALDRLLVFDKGRIVEEGDHQALIRLHDGIYRRLFERQA

SEQ ID NO: 14608 - protein, 575 aa, Agrobacterium tumefaciens; identical to SEQ ID NO: 11591

SEQ ID NO: 14609 - protein, 310 aa, Agrobacterium tumefaciens
MKVFAGNSNRHLAEAICKYLNVPLGNATVKRFADQEIFVEISENVRGEDVFIVQSTSFPANDHLMELLIMIDAMRRSSAKRITAVLPYFGYARQDRKAGPRTPISAKLVANLITEAGADRVLTLDLHAGQIQGFFDIPTDNLFAAPILARDVKDHYDTNNVMVVSPDVGGVVRARALSKRLDCLLAIVDKRRDRPGESEVMNVIGDVSGKDCILIDDIIDSGGTLCNAAEALLKKGATSVTAYITHGVLSGGAVARVASSKLRELVITDSIQPTTGVQSAHNIRVVSTAGLLGEAINRTAQEQSVSGLFD

SEQ ID NO: 14610 - protein, 263 aa, Agrobacterium tumefaciens
LVLVGAGNMGGAMLSGWLKKGVPGSKVIVIDPRPSDAMRTTIAEAGATHSESVPEGVKAGILFVAVKPQMMDAILPSLKPLLGPETVVVSIAAGTTIATFVSHFGAVAAVRAMPNTPAMVGRGVTGAYANDLVTAELKTVVDGLLKVSGPVEWVEAESDIDAVTAVSGSGPAYVFYLVECMAEAGRKAGLPADVAMRLARETVAGAGELLHQSPEEAARLRQNVTSPGGTTAAALSVLMAEDGMQPLFDRAVAAAKTRAEELA

SEQ ID NO: 14611 - protein, 239 aa, Agrobacterium tumefaciens
DFNGRTVVITAAGQGIGRATAERFISLGARVIATDINEQALSTLKGAETRVLNVLDGDGVEDFAADIGHADVLFNCAGFVHSGTILDCEEKDWDFSFDLNAKAMYRTCRAFLPGMLEKGKGAIVNMSSVASSVKGVPNRFAYTASKAAVVGLTKAIAADFVTKGIRCNAICPGTVDSPSLHDRLRATGNYEQALADFIARQPMGRIATPEEIAALVTYLASDEAGFTTGQIHVIDGGWT

SEQ ID NO: 14612 - protein, 316 aa, Agrobacterium tumefaciens; identical to SEQ ID NO: 11477

SEQ ID NO: 14613 - protein, 512 aa, Agrobacterium tumefaciens; identical to SEQ ID NO: 14356

SEQ ID NO: 14614 - protein, 312 aa, Agrobacterium tumefaciens; identical to SEQ ID NO: 11670

SEQ ID NO: 14615 - protein, 389 aa, Agrobacterium tumefaciens
  unsure (1)..(389): unsure at all Xaa locations
PTXRLXASSDPPFTTLKLPEPXKPTSTEPEFTVPLSTXAVTLEPAPVIVIVPEAPARSPRVTPVALMAPPLLTVTFPVAPLAYPTKKVPVIAQLDPSPVTVTAEVDPPXVATXPSRLLTAPPASTVMEPLPXRPTLRSERLFTVLSAPDTRTEPLPPVFVPMMIFAASTRPPPVTASEPAPLTPTSRLLRSTVQTDPFPSTMAEPVAPATTPRCATVLSTEPPAVTLSVPLPAKPPGSEVSPPTCKSPVVHFEPSPVTVASLAEWRPIMASPLVTVAAASTTSFAAPPLPTTSESLCSEEPKRLTVTLLPSAEFRSAITVVVWLITIPPPVMVSVPTPASPTTRSDDMFQLLPPPETNAVPTVSGSFASTPLALYSELAPRTSTLPLPP

SEQ ID NO: 14616 - protein, 311 aa, Agrobacterium tumefaciens; identical to SEQ ID NO: 11667

SEQ ID NO: 14617 - protein, 256 aa, Agrobacterium tumefaciens; identical to SEQ ID NO: 11666

SEQ ID NO: 14618 - protein, 301 aa, Agrobacterium tumefaciens
VTAGEILVEIMATTVGDGFLEPQTLIGPFPSGAPAIFIDQVARCGGTAGIIAAVGDDDFGRLNIERLRRDGVDVSAITTIADRPTGSAFVRYRENGARDFVFNIAHSAASETRMTDEAQALIEKAGHVHIMGSAFAIAGIGAIILEAVKSVKARGGSVSFDPNIRKELAQGDEGRRLIDDLLAVTDLLLPSGEELQAASGLDDEEAAIEKLLAAGIGEIVLKRGANGASHFSRAHGRIDAPGLEVEEIDPTGAGDCFGATYLTCRRLGMRPGKALVYANASGAHNVTKRGPMEGAASLAEL

SEQ ID NO: 14619 - protein, 306 aa, Agrobacterium tumefaciens; identical to SEQ ID NO: 11780
  unsure (1)..(306): unsure at all Xaa locations

SEQ ID NO: 14620 - protein, 515 aa, Agrobacterium tumefaciens
  unsure (1)..(515): unsure at all Xaa locations
DLRAAFAADDQRFSRFSVKFDDLLMDYSKCAVNEEIVTLLEQLAREGGVEAKREEMFSGKAINFTEDRAVLHTALRNRSNTPVLVDDKDVMPDVNGVLAAMGKFADAIRSGSLKGATGKKITDVVNIGIGGSDLGPVMATLALAPFHDGPRAHFVSNIDGAHIADTLKLLDPETSLFIIASKTFTTIETMTNAATARRFIAEKLGEGAVKHHFAAVSTALDKVAAFGIESDRIFGFWDWVGGRYSIWSAIGLPLMIAIGPDNFGKFLDGAHAMDRHFREAPIRENLPMLLGLIGFYNRNVLDYPTRAILPYDQRLSRLPAYLQQLDMESNGKGATIDGTPDECQSGPVDXCEPGTNGQHAFYQLIHQGTSVIPAEFMIAANGFEPELRHQHQLLIANCLAQSEALMKGRTLAEAKAQLTSKGMEDSQADFIAPHRVFTGNRPSITFVYDKLTPFALGRLIALYEHRVFVEGVLFRINSFDQWGVELGKELATGLLPVVEGKESAAGHDSSTQGLV

SEQ ID NO: 14621 - protein, 560 aa, Agrobacterium tumefaciens
  unsure (1)..(560): unsure at all Xaa locations
VAKRWLASYPPGVPSEIPASANASLIDLLEKSCKQFADRKAFSSMGKSLTYRELDADTRAVAAWLQSRGLEKGDRVAVMMPNILQNPVAVYGILRAGMVVVNVNPLYTPRELEHQLKDSGAKALFVLENFAHVAQQAVPKTAVRHVVVAAMGDLLGLKGHIVNLVVRKVKKLVPAHAIPGSISFKAMLKEGQGVSLKPVGLTAQDIAFLQYTGGTTGVSKGAVLTHANLLANKAQISLWLDAAFNGRKDRPEVLNFICALPLYHIFALTVNSLMGIALGGHNLLIANPRDIPGFVKELSHYQPHIFPGLTTLFNALMNNEEFRKLDLSSLIFVLGGGMAVQRPVAERWVSVVGCPITEGYGLSETSPVATVNRLDAAEFSGTIGLPISSTEIDIRDEDGNSLPTGEVGEICIRGPQVMAGYWQRPDETAKAITADGFFRSGDMGFMDERGYTKIVDRKKDMILVSGFNVYPNEVEEVAASHPGVLECAAIGVPDEHSGETVKLFVVKKDQSLTEAELKAFCAKNLTNYKRPKIIEFRTDLPKSNVGKILRRELRNLNXTK

SEQ ID NO: 14622 - protein, 260 aa, Agrobacterium tumefaciens; identical to SEQ ID NO: 14279

SEQ ID NO: 14623 - protein, 369 aa, Agrobacterium tumefaciens
VANWSYPTAVKLGRGRIKELAEACKTLGIRKPLLVTDRGLANMAITAHALDVLEEAGLGRAIFADVDPNPNEINMEAGVKAYRDGGHDGVVAFGGGSGLDLGKMIAFMAGQTRPVWDFEDIGDWWTRADASKIAPIVAVPTTAGTGSEVGRASVITNSQTHVKKIIFHPKLLPGVVICDPELTVGMPKVITAGTGMDAFAHCLEAYSSPFFHPMSAGVALEGLRLVKEFLPRAYKDGTDIEARTNMMAAAAMGAVAFQKGLGAIHSLSHPIGAVYNTHHGMTNAVVMPAVLRFNRPAIEDKIARAAAYLGISGGFDGFYDYVLDLRRELGVPENLTAMGIKPDRIDELAAEAIKDPSCGGNPVPMTLEN

SEQ ID NO: 14624 - protein, 431 aa, Agrobacterium tumefaciens
SPIDGSVYAEREAMSLEAARAAVSTARRAQKDWARRPLEDRVQLVLKGVARLNEMVAEVVPELAHMMGRPVRYGGEFRGFNERSNYVASIAADALAPLVIEESGNFERRIEREAHGVVFVIAPWNYPYMTAINTVAPALMAGNTVVIKHAAQTLLVGERMVRAFVEAGVPEDVFINVFLDHGTTSTLISEGLFNFVNFTGSVEGGRAIERAAAGTFTGLGLELGGKDPGYVMEDADLDAAVDTLMDGGTYNSGQCCCGIERIYVNENLYDEFVEKSVAWVSNYKLGNPLEQETTLGPMANKRFAKVVRAQIADAVSKGAKALVDPKLFPADDGESAYVAPQILVNVDHSMEFMTEETFGPAIGIMKVKNDDEAIALMNDSKYGLTASLWTQDAARAARIGREIETGTVFMNRADYLDPALCWTGVKETGRG

SEQ ID NO: 14625 - protein, 325 aa, Agrobacterium tumefaciens
MTKFKLEYIWLDGYKPVANLRGKTQIKEFDEFPTLEQLPLWGFDGSSTQQAEGHSSDCVLKPVAIYPDPARTNGALVMCEVMMPDGVTPHASNSRATILEDEDAWFGFEQEYFFYQDGRPLGFPEQGYPAPQGPYYTGVGFKNVGSVAREIVEEHLDLCLEAGINHEGINAEVAKGQWEFQVFGKGSKRAADQIWIARYLLLRLCEQYGIDVEFHCKPLGDTDWNGSGMHCNFSTKFMREVGGKDYFEALMAAFAKNWQEHIDVYGPDNHLRLTGKHETAPWNKFSYGVADRGASIRVPHSFVNNGYRGYLEDRRPNSQGCPYQI

SEQ ID NO: 14626 - protein, 264 aa, Agrobacterium tumefaciens; identical to SEQ ID NO: 11740

SEQ ID NO: 14627 - protein, 256 aa, Agrobacterium tumefaciens; identical to SEQ ID NO: 14282

SEQ ID NO: 14628 - protein, 271 aa, Agrobacterium tumefaciens; identical to SEQ ID NO: 11511

SEQ ID NO: 14629 - protein, 296 aa, Agrobacterium tumefaciens
  unsure (1)..(296): unsure at all Xaa locations
KAFVAIVTCFNDDETINYEATRAQVRRQVTAGNNIMCAGTNGDFTALTHSEKIRILEEVVDEVGGKVDVIVNAGMPATFETLQLAKEFDRIGVKGIAVITPFFIACTQDGLIRHFSTVADEVNTPVYLYDIPARTQNHIEPETARKLATHGNIAGIKDSGGAQETLEAYLQVSKEVDGFEVYSGPDHLVLWALQNGAAGCISGLGNAMPDVLAGIVNGFNSGDITYAERQQSVYTAFRTDLYAHGFPPAMVKRALYLQDPSVGASRQPALLPDAEQDQKIEEILRKYGLLVTKAXQ

SEQ ID NO: 14630 - protein, 243 aa, Agrobacterium tumefaciens; identical to SEQ ID NO: 11491

SEQ ID NO: 14631 - protein, 443 aa, Agrobacterium tumefaciens
FDTVLIANRGEIAARIQRACHELGLKTVAICSEADRGASYVQTADSFLCIGPSAAGKSYLNKDAILLAARLTSSGAIHPGYGFLSENTAFSDAVEKAGLVFIGPGASSIATMGDKIAAKRAMIAAAVPCVPGPDTALPDDPAAVESIAQEIGYPVIVKAAGGGGGRGMRVVPDAGSLHEAIPTTREEARQAFGSPALYMEKFLQHPRHIEIQVLCDTHGHAVWLGHRDCSMQRRHQKVVEEAPAPGISPDVIRSVGQACVEACQQIGYRGVGTFEFLYENGAFYFIEMNTRLQVEHPVTEMTSGIDIVQAQIRAAQGEELVLRQQDVKCEGHAFECRINAEDPQTFLPSAGVVTGLAWPQGQGIRVDTHIHGGYRVSPYYDSLVAKLIVHAPTRSEAMAKMREALAGTSIEGISTNLPFLRALFEDDAFVCGETDIHYLEKWL

SEQ ID NO: 14632 - protein, 812 aa, Agrobacterium tumefaciens
  unsure (1)..(812): unsure at all Xaa locations
MSLTRKPLASHHRIVIKIGSALLVDRKSGLKKDWLDAICEDIAALKKNGADVQVVSSGAIALGRTVLGLPSGALKLEESQAAAAVGQIALARAWSESLSRHEIVAGQILLTLSDTEERRRYLNARATINQLLKIGAIPIINENDTVATTEIRYGDNDRLAARVATMTGADLLVLLSDIDGLYTAPPHLDPDAKFLETIADITPEIEAMAGGAASELSRGGMRTKIDAGKIATAAGCGMIIASGKTLNPLKAIENGARSSWFHPPARRXRPARPGLPGNCSRPAKSMWMPGPKRRFMLGKACFPPVCGRXRAISDAAMPLPSSASKAVKWRAVLRVTMQRKRAXSSATSPTRSRRSSVMSDGRRXSIATTLXXLALPSKXNMQRRMRSMPEQAVKQSHDIDALMMTIGAQAKAASRPLSIAGTDQKNRALLAMASAIEASKEAILAANRKDLAAAESAGLAASFVDRLTLNDARIAGIAEGIRSVAALADPVGEVIAAWDRPNGLKIERVRTPLGVIGVIYESRPNVTADAGALCLKAGNAVILRGGSDSQHSSRAIHACLVQGLRIAGLPENAIQLVPVTDRAAVGALLSGLKGTVDVIVPRGGKSLVARVQSEARVPVFAHLEGICHIYVDKSADLDMAKAIVVNAKMRRTGICGAAETLLVDASAVSSHLEPVVKALLDAGCEVRGSQPVRNVVEGLEAATEEDWRTEYLDAIISVAVVDGISGAIEHIGTYSSNHTEAVIAEDPDVVARFFNELDSAILLHNASTQFADGGEFGMGAEIGIATGKMHARGPVGVEQLTSFKYRVHGTGQ

SEQ ID NO: 14633 - protein, 241 aa, Agrobacterium tumefaciens; identical to SEQ ID NO: 11456

SEQ ID NO: 14634 - protein, 393 aa, Agrobacterium tumefaciens; identical to SEQ ID NO: 11455

SEQ ID NO: 14635 - protein, 263 aa, Agrobacterium tumefaciens; identical to SEQ ID NO: 11454

SEQ ID NO: 14636 - protein, 416 aa, Agrobacterium tumefaciens
RRVVITGTGMVSPLGCGTEVTWERLLAGQNGARLVTEFEVEDLPAKIACRIPVGDGSNGTFNADDWMEPKEQRKVDPFILYGMAAADMALADANWHPETDDDQIATGVLIGSGIGGLEGIVEAGYTLRDKGPRRISPFFIPGRLINLVSGQVSIRHKLRGPNHSVVTACSTGAHAIGDAARLIALGDAEVMVAGGAESPVCRISLAGFAACKALSTQHNDDPQKASRPYDRDRDGFVMGEGAGIVVLEELEHAKARGAKIYAEVVGYGLSGDAFHITAPSEDGDGAYRCMSMALKRAGLTPDDIDYINAHGTSTMADTIELGAVERLVGESAPKISMSSTKSATGHLLGAAGAIEAIFATLAIRDNIVPPTLNLDNPDVETKIDLVPHKARKRQVNVALSNSFGFGGTNASLVLRR

SEQ ID NO: 14637 - protein, 78 aa, Agrobacterium tumefaciens; identical to SEQ ID NO: 11724

SEQ ID NO: 14638 - protein, 245 aa, Agrobacterium tumefaciens; identical to SEQ ID NO: 11725

SEQ ID NO: 14639 - protein, 309 aa, Agrobacterium tumefaciens; identical to SEQ ID NO: 11726

SEQ ID NO: 14640 - protein, 347 aa, Agrobacterium tumefaciens
SMKQKLLGRTGISVSEICLGTMTWGTQNTEAEAHAQMDYAIENGVNFFDTAELYPTTPVSAETQGRTEDYIGAWFEKTGKRDQVVLATKVAGSGRDYIRGGRDIDAASIREAVDTSLTRLKTDYIDLYQIHWPNRGTYHFRGAWGFDASGQDTKRTLAEITEKLETLGELVKAGKIRAIGLSNESAWGTQKYIDIAEANGLPRVATIQNEYNLLYRSFDLDMAEVAHHEDVGLLAYSPLAAGLLTGKYQNGARPAGSRGTINKDLGGRLQPHQEAPVKAYLDLAAAHGVDPAQLAIAFCLTRPFMASAIIGATTMEQLKVDIAAVDVALSEDLLKGIAAIHRQYPMP

SEQ ID NO: 14641 - protein, 220 aa, Agrobacterium tumefaciens; identical to SEQ ID NO: 11728

SEQ ID NO: 14642 - protein, 429 aa, Agrobacterium tumefaciens; identical to SEQ ID NO: 11702

SEQ ID NO: 14643 - protein, 138 aa, Agrobacterium tumefaciens; identical to SEQ ID NO: 11703

SEQ ID NO: 14644 - protein, 339 aa, Agrobacterium tumefaciens; identical to SEQ ID NO: 11590

SEQ ID NO: 14645 - protein, 467 aa, Agrobacterium tumefaciens; identical to SEQ ID NO: 11410

SEQ ID NO: 14646 - protein, 475 aa, Agrobacterium tumefaciens
DLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNL

SEQ ID NO: 14647 - protein, 549 aa, Agrobacterium tumefaciens
VAMLLVAGTTSLSAWIMRDIVNSVYLKQGFDVVLEIAFAVAAIFIVKGLATFVQSYYLSKAGNSIVAEQQRKIYDRLLKQGVSFFQNLPSSELLVRVTYNAQAARSVIDTIVTSFVRDLFSLLGLIIVMFAQNFLLSAISMIIGPVAIFSVRLVLRRVRKIMEAELASLGEIVNVVQETSIGVRVIKAFSLEKLMRQRMNKAVSDVEHRANGIAKLEAATSPIMETLSGLAIAVVIAVSGYTVLEKGGSPGDLMAFITALLLAYEPAKRLARMRVQIEGGMIGVRMMFEVLDAPLTLAEKKDAQPLPKASGNVELKNVSFEYVANQPVLKDVSVLFEGGKMTALVGPSGSGKSTIINLMMRLYDPQSGSVEINGMDLRDVSFASLREHVSYVGQETFLFSGTVKHNISVGRDNATDEEIIAAAKAANAHDFIMNMPDGYDSKLGENGSGLSGGQRQRVAIARAMLRDADILILDEATSALDSESEALVRDALERLTLNKTSIVIAHRLSTINRADKIVVMDNGQVVEQGSRRELLATDGLYKRLHSIQF

SEQ ID NO: 14648 - protein, 391 aa, Agrobacterium tumefaciens; identical to SEQ ID NO: 11445

SEQ ID NO: 14649 - protein, 194 aa, Agrobacterium tumefaciens; identical to SEQ ID NO: 11469

SEQ ID NO: 14650 - protein, 260 aa, Agrobacterium tumefaciens; identical to SEQ ID NO: 11468
  unsure (1)..(260): unsure at all Xaa locations

SEQ ID NO: 14651 - protein, 536 aa, Agrobacterium tumefaciens
  unsure (1)..(536): unsure at all Xaa locations
MNELGVHNPANGVAELGLGEASRVFYNLNESELYEHAIRNGEAELTIDGALRAVTGQHTGRSPKDKFVVRDASTENTIWWDNNKPLSPENFELLRQDMLAHAAGKTLYVQDLIGGADEENALPTRVVTELAWHSLFIRNLLIRPKRETLSGFSQKLTIINLPSFKADPARHGVRSETVIACDLTNGLVLIGGTSYAGENKKSVFTVLNYLLPAKGVMPMHCSANVGPXGDSAVFFGLSGTGKTTLSADPARTLIGDDEHGWGEHGIFNFEGGCYAKAIKLSSEAEPEIYAATNRFGTVLENVVLDESRVPDFNDNSLTENTRSAYPLHFIPNASETGIAGHPKTIIMLTADAFGVLPPIARLTPEQAMYHFLSGYTAKVAGTEKGVTEPEATFSTCFGAPFMPRHPAEYGNLLRELIGKHGVDCWLVNTGWTGGAYGIGKRMPIKATRALLTAALTGDLKNAQFRTDANFGFAVPLSLDGVDGAILDPRSTWADGAAYDAQAKKLVSMFVSNFTKFEDHVDSKVRDAAPGLLLAAE

SEQ ID NO: 14652 - protein, 461 aa, Agrobacterium tumefaciens; identical to SEQ ID NO: 11466

SEQ ID NO: 14653 - protein, 889 aa, Agrobacterium tumefaciens; identical to SEQ ID NO: 14305

SEQ ID NO: 14654 - protein, 256 aa, Agrobacterium tumefaciens; identical to SEQ ID NO: 11655

SEQ ID NO: 14655 - protein, 169 aa, Agrobacterium tumefaciens; identical to SEQ ID NO: 14311

SEQ ID NO: 14656 - protein, 370 aa, Agrobacterium tumefaciens
ITVEEAKTAETELEVVEGMQFDRGYLSPYFVTNPEKMVADLEDAYILLHEKKLSNLQAMLPVLEAVVQTGKPLVIIAEDVEGEALATLVVNKLRGGLKIAAVKAPGFGDRRKAMLEDIAILTGGTVISEDLGIKLESVTLDMLGKSKKVSISKENTTIVDGAGQKSDIEGRVAQIKAQIEETTSDYDREKLQERLAKLAGGVAVIRVGGSTEVEVKEKKDRIDDALNATRAAVQEGIVPGGGVALLRSSTKITVKGVNDDQEAGINIVRKALQSLVRQIAENAGDEASIVVGKILDKNEDNYGYNAQTGEYGDLIALGIVDPVKVVRTALQNAASVASLLITTEAMIAELPKKESAMPQMPGGGMGGMDF

SEQ ID NO: 14657 - protein, 967 aa, Agrobacterium tumefaciens; identical to SEQ ID NO: 11413
  unsure (1)..(967): unsure at all Xaa locations

SEQ ID NO: 14658 - protein, 238 aa, Agrobacterium tumefaciens; identical to SEQ ID NO: 11484

SEQ ID NO: 14659 - protein, 527 aa, Agrobacterium tumefaciens
YLVGVDVGTGSARAGVFDVAGKLLATAKRPISMHREDGGIAEQSSAEVWQAVCDSVRDSVSRAGIDPAEVTGIGFDATCSLVVRGPGDVTLPVGAADHPERDIIVWMDHRAVEQAERINAGKHAVLKYVGGRISPEMQTPKLLWLSENRPDIYARAEHFFDLTDFLTWKASGALDRSACTVTCKWTYLAHENRWDAEYFTKIGLGDLAEQGFRRIGESVVHPGTALGNGLTEEAAKAMGLVAGTAVAAGLIDAHAGGVGTVAAGGDASRCLGYVFGTSSCTMTTTTEPAFVPGVWGPYYSAMVPGAWLNEGGQSAAGAAIDYLVQLHPAFAEAKALADKDGKALPVWLADRALSLAASASAAVKLAEDFHMVPEFLGNRAPFADPHARAIIAGYGMETGVDSLVALYVAGLLGLGYGLRQIIETQARNGAPVETISVSGGAGAHPLARQLLADATGLPVELTECEEPVLLGSAMLGAVAAGTYPDLMAAMPAMSRIDSSAMPDPDFQKIHQARYDAFLALQNAARAI

SEQ ID NO: 14660 - protein, 218 aa, Agrobacterium tumefaciens
SLQGKIAVITGAASGIGLATTEALLEQGATVVMVDWNEKALNDLAAKLGERAIPQVTNLLDADSCNAMIPEILGKVDHIDILYCNAGTYIGGDLTETTPEAIDKMLNLNVNAVMKNVQAVVPHMSERKTGDIIVTCSIAGHFPTYWEPVYSGSKWAITSFVQGMRRQMIPHGVRVAQVSPGPVVSALLADWPEENLRKAKESGSLIDASEVADAVVYM

SEQ ID NO: 14661 - protein, 336 aa, Agrobacterium tumefaciens; identical to SEQ ID NO: 11487

SEQ ID NO: 14662 - protein, 466 aa, Agrobacterium tumefaciens
MYQFDLIVVGSGPAGRRAAIQAAKLEKKVLVIEKGSRVGGVSVHTGTIPSKTLRETALNLTGWRERGFYGRAYRVKQEIDADDLRRRLLITLDHEVEVLEHQFARNRVQHIRGTASFIDANTMKVVKSDGEVMTVTATSILLTIGTRPYRPPHIPFDGQAVLDSDEILEIKELPRSMVVVGAGVIGIEYATIFSALDTQVTVVEPRETMLEFIDKEIVEDFTYQLRDRNMKLIFGQKAEKVERDESGKCLVSLSNGRVLKAETVLFAAGRVGATDTLNLSACGLEADSRGRLKVDPETFQTSVPNIYAAGDIIGFPSLASTSMEQGRIAARHAVGAPAGEPPQFFPYGIYAVPEISTCGLTEEEVVERGIPYECGIAHFRETSRGHIMGLDSGLLKMIFSLKTRRLLGVHIVGEGATELVHIGQAVLNLKGTVEYFVENTFNYPTLAEAYKIAGLDAWNRMGELKK

SEQ ID NO: 14663 - protein, 296 aa, Agrobacterium tumefaciens
MDVRAAVAIQAGKPLEVMTVQLEGPRAGEVLIEVKATGICHTDDFTLSGADPEGLFPAILGHEGAGIVVDVGPGVTSVKKGDHVIPLYTPECRECYSCTSRKTNLCTSIRATQGQGVMPDGTSRFSIGKDKIHHYMGCSTFSNFTVLPEIALAKINPDAPFDKVCYIGCGVTTGIGAVINTAKVEIGSTAIVFGLGGIGLNVLQGLRLAGADMIIGVDINNDRKAWGEKFGMTHFVNPKEVGDDIVPYLVNMTKRNGDLIGGADYTFDCTGNTKVMRQALEASHRGWGKSVIIGVA

SEQ ID NO: 14664 - protein, 279 aa, Agrobacterium tumefaciens; identical to SEQ ID NO: 11783

SEQ ID NO: 14665 - protein, 295 aa, Agrobacterium tumefaciens; identical to SEQ ID NO: 11782

SEQ ID NO: 14666 - protein, 284 aa, Agrobacterium tumefaciens; identical to SEQ ID NO: 11781

SEQ ID NO: 14667 - protein, 322 aa, Agrobacterium tumefaciens; identical to SEQ ID NO: 11717

SEQ ID NO: 14668 - protein, 410 aa, Agrobacterium tumefaciens; identical to SEQ ID NO: 11762

SEQ ID NO: 14669 - protein, 309 aa, Agrobacterium tumefaciens; identical to SEQ ID NO: 11763

SEQ ID NO: 14670 - protein, 261 aa, Agrobacterium tumefaciens; identical to SEQ ID NO: 11764

SEQ ID NO: 14671 - protein, 336 aa, Agrobacterium tumefaciens; identical to SEQ ID NO: 11765

SEQ ID NO: 14672 - protein, 186 aa, Agrobacterium tumefaciens; identical to SEQ ID NO: 11573

SEQ ID NO: 14673 - protein, 616 aa, Agrobacterium tumefaciens; identical to SEQ ID NO: 11574

SEQ ID NO: 14674 - protein, 606 aa, Agrobacterium tumefaciens; identical to SEQ ID NO: 11575

SEQ ID NO: 14675 - protein, 287 aa, Agrobacterium tumefaciens; identical to SEQ ID NO: 11576

SEQ ID NO: 14676 - protein, 438 aa, Agrobacterium tumefaciens; identical to SEQ ID NO: 11577

SEQ ID NO: 14677 - protein, 319 aa, Agrobacterium tumefaciens; identical to SEQ ID NO: 14351

SEQ ID NO: 14678 - protein, 357 aa, Agrobacterium tumefaciens; identical to SEQ ID NO: 11719

SEQ ID NO: 14679 - protein, 275 aa, Agrobacterium tumefaciens
MTTITTRDGTHIFYKDWGPKDGQPIIFSHGWPLSADTWDAQMVFFANNGFRTIAHDRRSHGRSDQVWHNNTMDQYADDLAELIEQLDLHDIILVGHSTGGGEVTRYIGRHGTARVAKIALIGAVPPLMLKTESNTIGMPIDVFDGIRKSTYDNRSQFFKDLTIPFYGYNREGAVISEGIREEFWRQGMMGGLKGQLDSIRAFSESDFHQDLKAFDKPTLVLHGDDDQIVPVGASALSTVKIVKHATLKIYEGADHGLTQTHQDRFNADLLTFINA

SEQ ID NO: 14680 - protein, 258 aa, Agrobacterium tumefaciens
QNTFLITGASDGIGAVYAERLAGRGHDLILVARRAEKLKALAAQLEKDHGIAVEVLSADLSSAEDLEKVEVRLREDQRITGLVNNAGIAGEGAITALDPAYVTTMINLNILAVTRLAAAIAPRLAAAGKGTIINMTSVTALMPAAFTAVYPATKAFVLAFTEALQAQLSPSGVRVQAVLPGITRTAIWEEERLDAIPAAMVMDVHDMVDAALAGLDLGEALTIPSLPDTVDLENFLAARAALRPNLSHALAASRYRAG

SEQ ID NO: 14681 - protein, 500 aa, Agrobacterium tumefaciens; identical to SEQ ID NO: 11642

SEQ ID NO: 14682 - protein, 425 aa, Agrobacterium tumefaciens; identical to SEQ ID NO: 11641

SEQ ID NO: 14683 - protein, 333 aa, Agrobacterium tumefaciens; identical to SEQ ID NO: 11640

SEQ ID NO: 14684 - protein, 409 aa, Agrobacterium tumefaciens; identical to SEQ ID NO: 11639

SEQ ID NO: 14685 - protein, 377 aa, Agrobacterium tumefaciens
  unsure (1)..(377): unsure at all Xaa locations
MILNEAQQQIRDMARDFARERLSPGAAARDRESRFPKDELKEMGELGFLGMLVSEDYGGSETGAVAYALALEEIAAGDGACSTIMSVHNSVGCVPILKFGTEEQKQRFLPKLAAGEGIGGFALTEPQAGSDASNLKTRARRDGDRYVLDGAKQFITSGKNGDVIIVFAVTDAAAGKKGITAFIVPTDTPGYEVIRVEEKLGLHSSDTCQIAFTEMAVPVDLRLGEEGQGYRIALANLEGGRIGIAAQAVGMAQAAFEAARDYARERKAFGQAIIEHQAVAFRLADMATRITAARQLVLHAAALKEAGEPCLSEASMAKLFASEMAERVCSDAIQIHGGYGYMADYPVERIYRDVRICQIYEGTSDVQRMVIARNLXG

SEQ ID NO: 14686 - protein, 379 aa, Agrobacterium tumefaciens
VVIVGAARTAMGGFQGEFKSVAAPDLGAAAIRAAVERAAIPVSDIDDVLMGCVLTAGQGQAPARQAAIAAGVPNSVGATTINKMCGSGMKAIMLGHDQIAAGSSSIVLAGGMESMSNAPYLLDRARNGYRLGHGKVIDHMFLDGLEDAYDKGRLMGTFAEDCAEAYQFTRAMQDDYALTSLERARRAIAEGAFQAEIAPVGDVAVDEQPGKAKPEKIPQLKPAFRDGGTVTAANSSSISDGAAALVLMRRSEAERRGRSPLATIIGQASHADAPAGYPTAPIGAIKKLFEKNGWAAKDVDLFEINEAFAVVAMAAMRDLDLPHEKVNVHGGACALGHPIGASGARIVVTLLAALQRHGLKRGVAAVCIGGGEATALGIE

SEQ ID NO: 14687 - protein, 335 aa, Agrobacterium tumefaciens
LRDSASAFADDKIAPLATEIDRNDRFPRQLWPQMGELGLHGITVSEEFGGADMGYLAHCVAMEEISRASASIGLSYGAHSNLCINQIHRWGTDEQKHRYLPKLVSGDHVGSLAMSETEAGSDVVSMRLKAERKGDRYVLNGAKMWITNGHEADTLVVYAKTDMSAGARGITAFLIEKGFKGFRPAQKLDKLGMRGSPTSELVFEDCEVPEENILGRLNDGVTVLMSGLDYERAVLAAGPVGIMQAAIDLVLPYVRERKQFGKAIGEFQLVQGKLADIYSAMNASRAYVYAVARACDNGRITRQDAAGAILFAAERATQVALDAIQLLGGSGYVNE

SEQ ID NO: 14688 - protein, 652 aa, Agrobacterium tumefaciens
KILIANRGEIACRIIRTAASMGIRTVAVYSDADRDAMHVALADEAIAIGPAPARASYLDGEKIIAAAKASGAEAIHPGYGFLSENAGFAEACASAGLVFIGPPPEAIRAMGGKSEAKALMATAGVPIVPGYHGDEQAEKRLASEADKIGYPVLLKASAGGGGKGMRVVRQKHDFAAELAGAKREALAAFGNDRMLIEKYLERPRHVEVQVFADGHGNCVSLFERDCSIQRRHQKVIEEAPAPGLPDDLRQRMYDAATAAARAIDYRGAGTIEFLLDPSGFYFMEMNTRLQVEHPVTEYITGLDLVEWQLRVANGEALPKDWADLRINGHAIEARIYAEDPAHDFLPSIGTISHLVFPDEGPHLRIDSGIRAGDAITVHYDPMIAKLIVWDHDRPAAVRRLKVALEKLAICGVTSNATFLARLAGLETFAAADLDTGFIARNEADLFAPQAVGDNEIALAALGFLLSRKNASTNPQAQADPHSPWNTANAFRLNAPARETLHFTMQNRPIDLGVAHEADSFSLEMGGHTIRAYGDLSDNGRFRATINDRTWKGYFFAESDSYALFLHGEHYRISQPDPVDIADSSGHTGGLEAPMPGVIRAVLSQSGAAVETGDALVVMEAMKMEHTIRAPAKGIVTAVNCAEGDMVVAGAVL

SEQ ID NO: 14689 - protein, 217 aa, Agrobacterium tumefaciens; identical to SEQ ID NO: 11688

SEQ ID NO: 14690 - protein, 673 aa, Agrobacterium tumefaciens
IATGDEPVLTTAQGAPVADDQNSLRIGPRGPLVVDDFHFREKIFHFDHERIPERVVHARGYGAHGYFETYDSLATHTKADLFQRAGERTPAFVRFSTVAGNKGSADLARDVRGFAVKLYTKEGNWDLVGNNIPVFFIQDAIKFPDLVHAAKQEPDRAFPQAQTAHDTFWDFISLTPESMNMVMWIMSDRTIPRSFRFMEGFGVHTFRFINAKEQSTFVKFHWKPKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPINAPKCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKL

SEQ ID NO: 14691 - protein, 250 aa, Agrobacterium tumefaciens; identical to SEQ ID NO: 11676

SEQ ID NO: 14692 - protein, 472 aa, Agrobacterium tumefaciens
RKTSKKARLMTATRTETDTFGPIEVQADRYWGAQAQRSLGNFKIGWEKQPASVVRALGIVKQAAARANMALAGLDPKVGDAIIAAAQEVIDGKLTEHFPLVVWQTGCGTQSNMNANEVISNRAIEMLGGEMGTKKPVHPNDHVNMSQSSNDTYPTAMHIACVEEIVHHLLPALKHLHTALEAKVKQFEKIIKIGRTHTQDATPLTLGQEFSGYAAQVASAIANIELTLPALSKLAQGGTAVGTGLNAPVGFAEKVAEEISEITGLSFVTAPNKFEALASHDSMVFSHGAINAAAAALFKIANDIRFLGSGPRAGLGELSLPENEPGSSIMPGKVNPTQSEALTQVCAHIFGNNAALSFAGSQGHFELNVYNPMMAYNFLQSVQLLGDAAVSFTDNCVVGIEAREDNIRKGVENSLMLVTALNGKLGYDICAKIAKTAHKNGTTLREEAVGGGYLTNEEFDQYVRPENMIGPK

SEQ ID NO: 14693 - protein, 448 aa, Agrobacterium tumefaciens; identical to SEQ ID NO: 11678

SEQ ID NO: 14694 - protein, 127 aa, Agrobacterium tumefaciens; identical to SEQ ID NO: 11679

SEQ ID NO: 14695 - protein, 411 aa, Agrobacterium tumefaciens; identical to SEQ ID NO: 11680

SEQ ID NO: 14696 - protein, 327 aa, Agrobacterium tumefaciens; identical to SEQ ID NO: 11681

SEQ ID NO: 14697 - protein, 479 aa, Agrobacterium tumefaciens
SLTLPIGHFIGGRLIPAQNGIDMHRPSDGVEYAGCPRANAALVDEAVQTAKAALKSSNWGGVRPRERTKILQRWADLIEQEAETLAKIEALSSTRPVGQLIAGDIAVTAEQIRFFAEFADKEGGDLVPTDDASLGMIMTEPYGVVGAITPWNFPVSMAGWKLGPALAAGNAVVLKPSEMTPFSSIFMAELAIKAGLPAGLINVVLGDGPVTGNAITGHPEISKVSFTGSTAAGAAIMANVARTGIKPMTLELGGKSPQLVFADADIEKAAAAIAGNILSNAGQACVAGSRIIVEESAADALSAAIIARMKTVKPGPTWDEATQYSPIISEVQRQRIDGIVQAAVAHGGECLTGGAIMDGPGYFYQPTLIANVDQTSPAVTEEIFGPVLTLQTFRTEEEALALADHPTYGLAAGLFSRDVSRVLRLSRAIQAGTIWVNRYGRSRDHILPTGGYKRSGIGKDLGRDAYLANRKSKSVLIGL

SEQ ID NO: 14698 - protein, 321 aa, Agrobacterium tumefaciens
LKTHRIALIPGDGIGQSVTDAAWQVLNAVAKTSGFVLEGTEFPWSCAFYKETGAMMPKDGIETLRGFDAIMLGAVGWPAEVPDSVSLHGLLLPIRKAFVQYANIRPHRLLSGVQGPLKADGFDILCIRENTEGEYSGAGGRVHQGTEDEVAVETSIFTRKGVERILRFGFEQAQKRRGKLASITKSNAQKYSMVFWDEVTHKLAAEYPDVEVSSYHIDAMAARMVMAPESLDVVVASNLFGDILTDLGAAIQGGLGFAASANINPDRSAPSMFEPVHGSAPDIAHLGIANPIAAIWSGAMMFEHLGEKDAAAKIMAALETA

SEQ ID NO: 14699 - protein, 788 aa, Agrobacterium tumefaciens; identical to SEQ ID NO: 11652

SEQ ID NO: 14700 - protein, 119 aa, Agrobacterium tumefaciens; identical to SEQ ID NO: 11653

SEQ ID NO: 14701 - protein, 543 aa, Agrobacterium tumefaciens
  unsure (1)..(543): unsure at all Xaa locations
YDYIVIGAGSAGCVLANRLSKDPNNRVLLLEAGGNDNYHWIHIPVGYLYCINNPRTDWCFKTAEEPGLNGRALIYPRGKVLGGCSSINGMIYMRGQARDYDVWRQLGCEGWGWSDILPYFMKSEDFYRGKSDLHSAGGEWRVEKARVRWDVLDAFQKAAGEAGIPATDDFNRGDNEGAGYFDVNQRSGWRWNTAKAFLKPALGRKNLTVLTKAHVKRLIIEECRVTAVEFHHDGVLKKMRARRETVLSAGAIGSPHILELSGVGRGDVLQAAGIDTVAEVHGVGENLQDHLQLRMVYKVSGVLTLNERASTLFGKARIGLEYALTRSGPMSMAPSQLGVFTRSSPEKETADLEYHVQPVSLDKFGDPVHTFPAITASVCNLRPESRGSVHVKGPDFAMQPEIRPNYLSTEGDRQVAIDAMRLTRRIVAQPAFSRFNPQEYRPGPSFENDNDLAKAAGDIGTTIFHPVGTLRMGSDVESVVDNRLKFRRLAGLRVADASVMPRITSGNTNSPTIMIAEKAADMILADNRXKERTDEDRRFSRAG

SEQ ID NO: 14702 - protein, 637 aa, Agrobacterium tumefaciens; identical to SEQ ID NO: 11384

SEQ ID NO: 14703 - protein, 256 aa, Agrobacterium tumefaciens; identical to SEQ ID NO: 11385

SEQ ID NO: 14704 - protein, 783 aa, Agrobacterium tumefaciens; identical to SEQ ID NO: 11386

SEQ ID NO: 14705 - protein, 434 aa, Agrobacterium tumefaciens
MRIVMIGSGYVGLVSGACFADFGHDVVCVDKMPEKIEALKSGHIPIFEPGLETIVANNAKAGRLSFTTDLSAAVANADVVFIAVGTPSRRGDGHADLGYVYAAAKEIAHALDGFTVIVTKSTVPVGTGDEVERIIREENPSADFAVVSNPEFLREGAAIEDFKRPDRIVVGLSDERARPVMTEVYRPLYLNQSPLLFTTRRASELIKYAANAFLAMKITFINEMADLCEKVGANVQDVSRGIGLDGRIGSKFLHAGPGYGGSCFPKDTLALAKTAQDYDAPVRLIETTIAVNDTRKRAMGRKVINAVGGDVRGKKIAVLGLTFKPNTDDMRDSPAIAIIQTLQDGGAKVVGYDPEGMANARHLMEDIDYAAGPYEAAEGADAVVIVTEWNQFRALDLPRLKAIMKSPVLVDLRNIYRTDEVAGHGFIYAAVGRP

SEQ ID NO: 14706 - protein, 499 aa, Agrobacterium tumefaciens; identical to SEQ ID NO: 11388

SEQ ID NO: 14707 - protein, 230 aa, Agrobacterium tumefaciens; identical to SEQ ID NO: 11786

SEQ ID NO: 14708 - protein, 327 aa, Agrobacterium tumefaciens; identical to SEQ ID NO: 11774
  unsure (1)..(327): unsure at all Xaa locations

SEQ ID NO: 14709 - protein, 401 aa, Agrobacterium tumefaciens; identical to SEQ ID NO: 11773

SEQ ID NO: 14710 - protein, 715 aa, Agrobacterium tumefaciens; identical to SEQ ID NO: 11772

SEQ ID NO: 14711 - protein, 140 aa, Agrobacterium tumefaciens; identical to SEQ ID NO: 11722

SEQ ID NO: 14712 - protein, 237 aa, Agrobacterium tumefaciens; identical to SEQ ID NO: 11721

SEQ ID NO: 14713 - protein, 705 aa, Agrobacterium tumefaciens; identical to SEQ ID NO: 11720

SEQ ID NO: 14714 - protein, 431 aa, Agrobacterium tumefaciens; identical to SEQ ID NO: 11545

SEQ ID NO: 14715 - protein, 403 aa, Agrobacterium tumefaciens; identical to SEQ ID NO: 11546

SEQ ID NO: 14716 - protein, 599 aa, Agrobacterium tumefaciens
FTFTLVNLSHEPLKDFRIVYTSLTRTVDKPVCGNAIYLRRNANFHEFAPPSGFVLEPGKSWRFTVDGLLRPARHRTDGAKSAYVSLADGTHRAVDVGDLMLDGRHSEPAPVLLPEGKLDLPFAIQPWPAEIDAEPGEGFPVALFPMEDARAEEALAVETVLSLFRRLFAVGHVPFSLAPVHEGKPLRFKQHSGLEAEGYRIAFSNEAVTVEYSAAAGLQYGLTVLAQLLHGARIDPKFRFPASGTISDAPRYSWRGCHLDVSRQFYPTDDVLRLIDILAWLRMNRFHWHLTDDEAWRLEIKAYPLLTTVGATRGPDGPLLPQLGNGAEPVSGYYTQDNVRLVVAHAAALNVEIVPEVDIPGHSTAALVAYPELTDGQEAPDSYRSVQGYPNNALNPAIEPTYEFLGKIFDEMVELFPSRLIHIGGDEVADGSWLASPLAKALMDKEGLDGTFGIQSYFMKRIQGMLHERGRQLAGWDEVSHGGGVDPAGTLLMAWQKPEVGLELARQGYDVVMTPGQAYYLDMVQDEAWQEPGASWAGTVPPSHTYAYEAVGDFPDELKERMKGVQACIWSEHFLNRAYFNHLVFPRLPAIAEAGMDAK

SEQ ID NO: 14717 - protein, 438 aa, Agrobacterium tumefaciens; identical to SEQ ID NO: 11427

SEQ ID NO: 14718 - protein, 350 aa, Agrobacterium tumefaciens; identical to SEQ ID NO: 11426

SEQ ID NO: 14719 - protein, 252 aa, Agrobacterium tumefaciens
QREGIRIMDRLKSKRALITGGTSGIGLETARQFISEGARVAVTGTNPETLDAARRELGPSALVIKADAADVDGQKVVAETIREAFGGLDVVFINAGVALLKPLEAWDEKGFDRVFNINVKGPYFLLQALLPILANPASIVLNTSVNAHIGMPNSSVYAASKAALQSFIRTLSGELIARGIRLNAVSPGPISTPLYGKLGFTETDLKNVAESIQNLVPAGRFGEPSEIAKAVVFLASDEAAYTVGSEIMIDGG

SEQ ID NO: 14720 - protein, 421 aa, Agrobacterium tumefaciens; identical to SEQ ID NO: 11502

SEQ ID NO: 14721 - protein, 317 aa, Agrobacterium tumefaciens; identical to SEQ ID NO: 11536
  unsure (1)..(317): unsure at all Xaa locations

SEQ ID NO: 14722 - protein, 473 aa, Agrobacterium tumefaciens
MTMPESMLSESKLSGWAISPKLAQLASLAGHYADPEFSVAHGGHVRTIAAGHYTVSGLSRHVRLGEFVAHRSATGIHLGEVVRVEPDICYVCPIEPGEPIGIHDTVIRKGAFRVSPDESWCGRTINALGEPIDGQGPLASGIVRRSISNNAPPSMTRKRVETPFKTGVRAIDIFSPLCLGQRLGIFAGSGVGKSTLLSMLAKADAFDKVVIALVGERGREVREFIEDTMGDNMSKSVAVVATSDESPMLRKMAPLSAVTIAEHFRDQGDNVLLIIDSVTRFAHAIREVAVASGEPPVARGYPASVFTELPRLLERAGPGAEGTGTITAIVSILVDGDNHNDPIADSTRGILDGHIVLDRSLAEEGRYPPINPLASISRLAKKAWTPDQEKLVSRLKALVHRFEETRDLRLIGGYRPGTDPDLDMAVKQVPIIYETLKQLPDEPAAQDAYADLATALRGGAQNGQPQVNPRMRG

SEQ ID NO: 14723 - protein, 237 aa, Agrobacterium tumefaciens
MAVVIDGKAKAASVTEAVRKSAEALEAEKGVKPGLAVVIVGNDPASHAYVNSKSKMAKQCGFNSIQHTLPEETTQAALLKLVGELNTDASIHGILVQLPLPKHFNSDEIIQSILPEKDVDGLSVLNAGKLATGDLATGLISCTPAGAMLLVRGIHGDDLSGLNAVVIGRSNLFGKPMGQLLLNANATVTMAHSRTKDLVSVCNTPDILVSAVGRAAMVNGDWVKPGATVIDVGISRI

SEQ ID NO: 14724 - protein, 370 aa, Agrobacterium tumefaciens
MTVRSLFLLPGDGIGPEAMTEVRKLIEYMNSAHNAGFTVSEGLVGGSAYDAHGVAISDADMEKALAADAILFGAVGGPKWDGVPYEHRPEAGLLRLRKDLELFANLRPAICYPALAAASSLKPELVEGLDILIVRELTAGVYFGEPKQIIDLGNGQKRGIDTQIYDTFEIERIASVAFELARSRDNRVCSMEKRNVMKSGVLWNQVVTETHAAKYKDVQLEHMLADAGGMQLVRKPKQFDVIVTDNLFGDMLSDVAAMLTGSLGMLPSASLGAPDAKTGKRKAMYEPVHGSAPDIAGKSIANPIAMIASFAMCLRYSFNMVDEATKLEAAIANVLDKGIRTADIMADGCRQVGTSDMGDAVLAEFKALSA

SEQ ID NO: 14725 - protein, 436 aa, Agrobacterium tumefaciens; identical to SEQ ID NO: 11459

SEQ ID NO: 14726 - protein, 1104 aa, Agrobacterium tumefaciens; identical to SEQ ID NO: 11460

SEQ ID NO: 14727 - protein, 325 aa, Agrobacterium tumefaciens; identical to SEQ ID NO: 14442

SEQ ID NO: 14728 - protein, 333 aa, Agrobacterium tumefaciens; identical to SEQ ID NO: 11462

SEQ ID NO: 14729 - protein, 333 aa, Agrobacterium tumefaciens
HPRVTFGKVGVLLVNLGTPDGTDYWPMRRYLAEFLSDKRVIEWSRLYWYPILYGIVLNKRPQKVGKAYEEIWNHERNESYLRTYTRSQGELMAAALKDFPNVVVDWAMRYGQPSIASRIDALKEQGCEKILLFPLYPQYAASTTATVNDKAFEHLMKLRWQPAIRTVPPYHDDPAYIEGLAASVKNHLATLDWEPEMLITSFHGIPQSYFKKGDPYYCHCQKTARLLREALGRTEKNFMITFQSRFGPEEWLQPYTDKTVEKLASEGIKRIAVMNPGFVSDCLETLEEIAGEAGEIFLHNGGEKFTHIPCLNDSTEGMNVLEKVVRRELQGWV

SEQ ID NO: 14730 - protein, 525 aa, Agrobacterium tumefaciens; identical to SEQ ID NO: 11605

SEQ ID NO: 14731 - protein, 469 aa, Agrobacterium tumefaciens
LMKRNRKVKILATLGPASSEEAMIEKLHLAGADLFRINMSHASHDVMRTLIQRIRSVESRNGRPIGILADLQGPKLRVGKFAETKVDLVPGQTFTLDNNDTPGDNTRVFLPHPEILEAVKPGHRLLIDDGKLHLRAEKSDGKSIVTTVVSGTRISDRKGISLPDTLLGVGVLTDKDRVDLDAVLETNEVDWVALSFVQRPEDLAEVRKISRGRVGLMSKIEKPQAVERIEEIIELSDALMVARGDLGVEMPLEAVPGIQKQLTRACRRAGKPVVVATQMLESMITAPVPTRAEVSDVATAVFEGADAIMLSAESASGDYPIEAVSTMASIASTVEQDPYYSNIIYAQRPQPEATGADAISLAARQIAETLKLAAIVTYTSSGTTGLRAARERPQVPIIALSPIIQTARRLSVVWGLHCVVTGDASDLDDMVNRACRIVVSEGFGKPGDRIIISAGVPLGTPGATNMVRI

SEQ ID NO: 14732 - protein, 590 aa, Agrobacterium tumefaciens
QKAAKQRSLKPLLGLFPYLRRYRGLMAAALFALVLSSATTLALPLAVRRIIDHGFQTPDGGMINSYFAMLLAIAVVLALASAMRYYYVMTIGERVVADLRRDVFAHLTTLSQQFFDSNRSGELTSRLTADTVQIRSAFGSSASVALRNIIMCCGAVAMMIYTSPGLSGLALLAIPFIVFPLIAFGRSVRARSRTTQDTLANSAAYASETIAASRTVQSFNAEVLANARYGASVEAAYQGARAAIGARSVLTAVAIALVFGSVVGILWYGAQNVLAGSMTAGTLGQFVLYSVIAASGLGQLSEVWGELAQAGGAAERLSELLNERSPVAEPAAPVAMPQPPRGEAEFDNVDFVYPLATGRPIVSGLSLKVAAGETVAIVGPSGAGKSTVFSLLMRFYDPQQGRITIDGVDIRNVSLADLRARLSIVPQDVAIFASSIHDNIAFGRPEATREDVRAAAIAAQADGFIERLGDGYDTQVGERGVTLSGGQRQRIAIARAILRDAPILLLDEATSALDAESETLVQKALDELMKTRTTIVIAHRLATVLKADRILVMDEGRIIEEGTHQSLIRQNGLYARLARLQFQTGPDELR

SEQ ID NO: 14733 - protein, 319 aa, Agrobacterium tumefaciens; identical to SEQ ID NO: 14398

SEQ ID NO: 14734 - protein, 394 aa, Agrobacterium tumefaciens; identical to SEQ ID NO: 11609

SEQ ID NO: 14735 - protein, 474 aa, Agrobacterium tumefaciens; identical to SEQ ID NO: 11692

SEQ ID NO: 14736 - protein, 452 aa, Agrobacterium tumefaciens; identical to SEQ ID NO: 11693

SEQ ID NO: 14737 - protein, 473 aa, Agrobacterium tumefaciens; identical to SEQ ID NO: 11694

SEQ ID NO: 14738 - protein, 347 aa, Agrobacterium tumefaciens; identical to SEQ ID NO: 11695

SEQ ID NO: 14739 - protein, 420 aa, Agrobacterium tumefaciens
MTAITDIIAREILDSRGNPTVEVDVYLEDGSMGRAAVPSGASTGAHEAVELRDGGKRYLGKGVEKAVEAVNTEIFDAIGGFDAENQIQIDQMMIALDGTPNKSRLGANAILGVSLAIAKAAAEASGLPLYRYVGGPNAHLLPVPMMNIINGGVHDHNPIDFQQFMILSVGAENIREAVRMGSEVFHTLKKELSAQGHNTNVGDEGGFAPGLESAPAALDFIMKSIEKAGYRPGEDMYVGLDCASTEFFKDGKYVLEGEGRTLEPGAMAEYLAELVNKYPIISVEDGMAEDDWEGWKTLTDLVGNKCQLVGDDLFVTNSARLRDGIKMGVANSILVKVNQIGSLSETLDAVETAHKAGYTAVMSHRSGETEDSTIADLAVATNCGQIKTGSLARSDRLAKYNQLIRIEEMLGPQAAYAGRS

SEQ ID NO: 14740 - protein, 576 aa, Agrobacterium tumefaciens; identical to SEQ ID NO: 11697

SEQ ID NO: 14741 - protein, 255 aa, Agrobacterium tumefaciens
NIEGAGALVTGAASGLGAAVARMLAARGAAVTIFDRNGEAGKKLAAEIGGKAVQGDVTSDADAQAAIKVAASAKGGLRILVNCAGIGTAGRILGREGPQPLGDFEQVIRVNLIGTFNMMRLAAAHMAEREQDEGQDSRQDNGVIVNTASVAAFEGQIGQAAYAASKGGIVSLALPAARELARFRIRVNTVAPGIFLTPLLQGLPQEVQESLAGQIPHPSRLGDPAEFADTVRFLIENDYMNGEVIRLDGAIRMQP

SEQ ID NO: 14742 - protein, 325 aa, Agrobacterium tumefaciens
VVIHAAKDLRVEDVAGQPLAADEVRVAVAVGGICGSDLHYYNHGGFGTVRVREPMALGHEFAGTVVEVGSSVSHLVPGMRVAVNPSLPCGTCRYCAQGRQNQCLDMRFMGSAMRSPHVQGGFREVVTVHSTQPVQIADGLSMGEAAMAEPLAVCLHAARQAGSLLGKTVLITGAGPIGMLSLLVARLAGAAHIVVTDVADAPLDLARRIGADEAVNILRDADMLEKYRFEKGVFDVLFEASGNQAALLPALDLLRPGGIIVQLGLGGDFTIPMNLIVAKELQLRGTFRFHEEFAQAVNMMGRGLIDVKPLISATLPFDQAREAFD

SEQ ID NO: 14743 - protein, 265 aa, Agrobacterium tumefaciens; identical to SEQ ID NO: 11701

SEQ ID NO: 14744 - protein, 881 aa, Agrobacterium tumefaciens; identical to SEQ ID NO: 11745

SEQ ID NO: 14745 - protein, 1154 aa, Agrobacterium tumefaciens
MKFNKLRVVGFKSFVEPSEFIIEPGLTGVVGPNGCGKSNLVEALRWVMGENSYKNMRASGMDDVIFSGSGNRPARNTAEVGLYLDNSDRTAPAAFNDADEIQVTRRIERENGSVYRINGKEARAKDVQLLFADASTGARSPSMVGQGRIGELINAKPQARRQLLEEAAGISGLHSRRHEAELRLRAAETNLERLEDVTAQLESQIESLKRQARQANRFKMLSADIRAREATLLHIRWVEAKEAEGEAESALNQATNIVAEKAQGQMEAAKQQGIASLKLPELREDEARVAAALQRLQIARTQLDDEANRLLRRRDELARRLSQLGEDIVREERLVADNAQILARLDEEEAELLDILSDSGRHADEMREAFEAAAVKLAESEAVFTSITAERAEAAAGRQQLERAIRDLSDRKLRLERQSQEASAEIDTIDEKLSGLPDPAERREAVEAAEIAVEDALIVAEEAEAAGCRGAFREALARGPLETAKNRLNALDTEARTITKMLATSAAANGSFTPVAEEMTVERGYEAALGAALGDDLESPLDASAPAYWGGNGNGADDPGLPQGAKPLLDYAQAPDALRRALAQIGVVADVSEARRLLPSLKAGQRLVTREGALFRWDGHIASADAPGAAALRLSQKNRLAEIEAELDEARSILEEAEDQLAAKTEDIRSSELRLSEVRDRSRLATRQLAEAREALTSAERASGDLLRRRDVVSEAQNQIGAQIDEIAVQEENARIEMEDAPDLSVLDLRLRESQLEVATDRGLLAEARARHEGVSREAESRQRRIQAIGQERSTWASRAASAADHIATLREREEEAREEIAELDIAPEEFDEKRRNLLNELQKTEDARRAAADRLAEAENLQRAADRVAATALSELAEAREKRGRAEERLVSAREKRLETEHRIRETLNTEPHMAFRLTGLGPDQPKPDIRDVERDLDRLKIERERLGAVNLRAEEEQAELSGKLEALIKERDDIIDAVRKLRAGIQSLNREGRERLIAAFDVVNSQFQRLFTHLFGGGTAELQLIESDDPLEAGLEILARPPGKKPQTMTLLSGGEQALTAMALIFAVFLTNPAPICVLDEVDAPLDDHNVERYCNLMDEMVASTETRFVIITHNPITMARMNRLFGVTMAEQGVSQLVSVDLQTAEQLREA

SEQ ID NO: 14746 - protein, 188 aa, Agrobacterium tumefaciens; identical to SEQ ID NO: 11747

SEQ ID NO: 14747 - protein, 403 aa, Agrobacterium tumefaciens; identical to SEQ ID NO: 11748

SEQ ID NO: 14748 - protein, 393 aa, Agrobacterium tumefaciens; identical to SEQ ID NO: 11731

SEQ ID NO: 14749 - protein, 216 aa, Agrobacterium tumefaciens; identical to SEQ ID NO: 11730

SEQ ID NO: 14750 - protein, 602 aa, Agrobacterium tumefaciens
MMATKKKTISADSSNPTQTLINLWPYMWPEGRWDLKMRVIWATVFLIVAKLVLIAVPYFFKWATDALNGKLDMAGLVPAFLLGAVALVIAYNLTRLIQVGLNQLRDSLFASVGQHAVRQLAYRTFVHMHRLSLRFHLERKTGGLSRVIERGTKGIETIVRFTILNTAPTFIEFLLTAIIFWASYGFSYVLVTVVTVWAYIWFTVRASNWRIGIRRAMNDSDTDANTKAIDSLLNFETVKYFGNEEMEARRFDVAMERYEKSAISIWTSLGWLNFGQGVIFGIGSTIMMVMSALAVQRGEQTIGDFVFVNALLLQLSVPLNFIGFVYREIRQGLTDIEQMFDLLEVEAEVTDRPDAKPLAAGPGAISFRDVHFAYDPERPILKGVSFDVPAGKTVAIVGPSGAGKSTISRLLYRFYDIQEGAVTIDGQDIRDVTQKSLRSMIGMVPQDTVLFNDTLAYNIRYGRPSATDEELKAAADAAQISAFIGKLPDGYATMVGERGLKLSGGEKQRVAIARTILKAPPILILDEATSALDTHTEQEIQSALDIVSKNRTTLVIAHRLSTVIHADEIIVLKEGLIAERGTHASLMAHDGLYASMWSRQRE

SEQ ID NO: 14751 - protein, 256 aa, Agrobacterium tumefaciens
PMKIATWNINGVKARIENLCQWLKDSSPDIVCLQEIKSVDEGFPRLEIEALGYHIETHGQKGFNGVALLSKVKPDEVNRGLPGDDADEQARFIEGVFSVEGGAIRVCSLYLPNGNPPDDPVKYPYKLAWMERLRRFAEDRLAMEEPLILAGDYNVIPEPFDCHDPRVWEGDALFLPKTRAAFRKLENLGFTDAARATTDAAGLYSFWDYQAGAWPKNNGIRIDHLMLSAEAADRLQSVEIEKHVRAWEKPSDHVPV

SEQ ID NO: 14752 - protein, 204 aa, Agrobacterium tumefaciens; identical to SEQ ID NO: 11540

SEQ ID NO: 14753 - protein, 405 aa, Agrobacterium tumefaciens
  unsure (1)..(405): unsure at all Xaa locations
EXSGQQIRRHTVSERAAFHWQDPFLLEDQLTDDERMIRDSAEAFGKSELLPRISEAYLSETTEPELFRLMGRTGLLGVTLPEEYGAANASYVAYGLVAREVERIDSGYRSMMSVQSSLVIHPIFAYGSDEQKKKYLPGLVSGELIGCFGLTEPDAGSDPGGMKTRAEKIEGGYRLRGSKMWISNAPIADVFVVWAKSEAHDNEIRGFVLEKGMKGLSAPKIGGKLSLRASITGEIVMDGVEVGEDALLPNVSGLKGPFGCLNRARYGISWGVMGAAEDCWFRSRQYGLDRKQFGKPLAGTQLYQKKLADMQTEIALGLQASLRVGRLMDEHKMAPEMISIVKRNNCGKALDIARQARDMHGGNGIQIEYHVMRHAQNLETVNTYEGTHDVHALILGRAQTGIQAF

SEQ ID NO: 14754 - protein, 829 aa, Agrobacterium tumefaciens
LTRRNLLKAHAAGIAAATAGIALPAAAQPVPGGVSALQIKWSKAPCRFCGTGCGVMVGVKEGKVVATHGDMQAEVNRGLNCIKGYFLSKIMYGKDRLETPLLRKKNGVYAKDGEFEPVSWDEAFDVMAQQCKRVLKEKGPTAVGMFGSGQWTIFEGYAATKLMRAGFRSNNLDPNARHCMASAAYAFMRTFGMDEPMGCYDDFEHADAFVLWGSNMAEMHPILWTRIADRRLGFDHVRVAVLSTFTHRSMDLADIPMVFKPGTDLVILNYIANHIIKTGRVNEDFVRNHTKFVRGVTDIGYGLRPDDPVEVNAANSADPTKTEAIDFETFKEFVSEYTLEKTAAMTGVEAGFLEELAELYADPKRKVMSLWTMGFNQHVRGVWANQMVYNIHLLTGKISEPGNSPFSLTGQPSACGTAREVGTFAHRLPADMTVTNPEHRKHAEEIWRIPHGIIPEKPGYHAVQQDRMLHDGKLNFYWVQVNNNVQAGPNTKNETYLGYRNPENFIVVSDAYPTITAMSADLILPAAMWVEKEGAYGNAERRTHVWHQLVEASGEARSDLWQLVEFSKRFTTDEVWPAEILDANPAYRGKTLYEVLYKDSDVGKFPLSEINADYKNQESSDFGFYLQKGLFEEYAAFGRGHGHDLAPYDAYHEVRGMRWPVVDGKETLWRYREGYDPYVKPGEGVKFYGNKDGRAVIIAVPYEPPAESPDQEFDTWLVTGRVLEHWHSGSMTMRVPELYKAFPGARCFMNADDARKRGLNQGAEIRIVSRRGEIRSRVETRGRNRMPPGVIFVPWFDASQLINKVTLDATDPISKQTDFKKCAVKIEPV

SEQ ID NO: 14755 - protein, 285 aa, Agrobacterium tumefaciens
DPRSQYPRPPFSTPTQEMPGLVTNMTPFPDHGEKSYKGTGKLAGRKALITGGDSGIGRAVAIAFAREGADVAISYLPEEESDAEEVVALIEAEGRVAVALPGDITDEAWCRELVEKAVSDLNGLDILVINAARQQYREDIEELSTDDFDRTMKTNLYALHWIAQAAVPYLKPGASVITTASIQAYEPSAILLDYATTKAGIVAYTKALAKQLIEKGVRANAVAPGPFWTVLQPSGGQPDEKVKNFGKDSDFGRPGQPVELAPVYVLLASQDASFINGEVYGVTGG

SEQ ID NO: 14756 - protein, 716 aa, Agrobacterium tumefaciens
AGKCPVMHGGNTASGKSVTEWWPNALNLDILHQHDTKTNPLGTSFNYREALKTLDVEALKADLRALMTDSQEWWPAHWGSYVGMMARVTWHAAGSYRVTDGRGGANTGNQRFAPLNSWPDNVNTDKGRRLLWPIKKKYGNKISWADLIALAGTIAYDVAGLKTFGFAFGREDIWAPEKDTYWGDEKEWLAPSDGRYGDVSKPETLENPLAAVQMGLIYVNPEGVNGKSDPLATAAQMRETFARMGMDDEETVALTAGGHTIGKSHGNGSAANLSPDPEAAGPEYQGLGWINTKGRGIGRDTVVSGIEGAWTSEPTKWDNGFFDMLFKHEWTLTHSPAGASQWAPITIAEEDKPVDVEDASIRTIPMMTDADMALKVDPIYREISLKFKDDQDHFSDVFARAWFKLTHRDMGPKSRYVGPDVPAEDLIWQDPIPAGSTSYDVAAVKAKIAASGLSVADLVSTAWDSARTFRGSDKRGGANGARIRLAPQKDWEGNEPARLSRVLSVLEPIARETGASIADVIVLAGNYGVEQAAKAAGFDIAVPFAAGRGDASAEQTDADSFAPLEPLADGFRNWVKKDYVVSPEELLLDRAQLLGLTAPELTVLIGGLRVIGANYGGAAHGVFTDKPGALTTDFFTTLTDMAYSWVPTGNNLYEIRDRKTGAARYSATRVDLVIGSNSILRAYAEVYAQDDNREKFARDFIAAWTKVMNADRFDLI

SEQ ID NO: 14757 - protein, 480 aa, Agrobacterium tumefaciens
  unsure (1)..(480): unsure at all Xaa locations
VNLFIGGDHCAAANGKRFERNNPITGDAVTSCRRRFGXRCDERADAAAAAFPKWSATTPGERRRHLLAAAEALRAAGPQIIQAMMEEIGATEAWAGFNVMLASDMLVEAASLTTHITGEVIPSNRPGTMAMALRQPAGVVLSMAPWNAPVILGVRSIATPLACGNTVVMKDLGTLPADPRPDHRSGCLAGLPKGVLNAISNAPDDAAKIVETLIAHPAVRRVNFTGSTRVGRVIAETAGRYLKPALLELGGKAPFIVLDDADIDAAVAAAAFGAYMNQGQICMSTERIIVLDSIADTFVEAFAKKAASLTAGDPREGKTPLGSLVSAEAASRIRVLVDDAVSKGARRVAGGGGDGTMLDAIAVDGVTPAMRLYSEESFGPVVSIIRAGSIDEAVSIANESEFGLSAAVFGRDQARALSVAARIESGICHVNGPTVHDEAQLPFGGVKASGYGRFGGTAGIAEFTELRWVTLQDGPLHYPI

SEQ ID NO: 14758 - protein, 501 aa, Agrobacterium tumefaciens; identical to SEQ ID NO: 11419

SEQ ID NO: 14759 - protein, 239 aa, Agrobacterium tumefaciens
FAHIGRPVALLARLGTDTFSRDIGEKMAQSGVDLQFLEHATDAGPQVTVATVVGQDRAFLTRRAGAARPSTLDAAFAWDKARHLHIAEFATLQEIPDLVSRAKASGLSVSLDPSWDAALIYDKGLLKACAGVDVFLPNLEEAEAITGRSEPEAAIRTLAEAFPIVALKGGAEGAWVSSAAGLHHRAAQKVPVIDTTGAGDAFNAGFLDAWLQRQDEQQCLKAGIAAGSLAVQAAGGAPR

SEQ ID NO: 14760 - protein, 436 aa, Agrobacterium tumefaciens; identical to SEQ ID NO: 11417

SEQ ID NO: 14761 - protein, 489 aa, Agrobacterium tumefaciens; identical to SEQ ID NO: 11416
  unsure (1)..(489): unsure at all Xaa locations

SEQ ID NO: 14762 - protein, 424 aa, Agrobacterium tumefaciens
GDVLQRPALSGATIALMDINRERLEESAIVVNKLISTLGAKAKAETYTDQKKALAGADFVEVAFQIGGYEPCTVTDFEVPRKYGLRQTIADTLGVCGIMRGLRTVPHLWKICEDILAVCPNAVMLQYVNPMAINTWAIAEKYPTIRQVGLCHSVQGTAMELAHDLDIPYEEIRYRSAGINHMAFFLEFEHRQPDGSYRNLYPDLVRGYREGRAPKPGWNPRCPNKVRYEMLTRLGYFVTESSEHFAEYTPYFIKEGRDDLIEKFGIPLDEYPKRCIEQIERWKGQAAAYRSAEKIEVKQSKEYASSIINSVWTGEPSVIYGNQRNNGCITSLPSDCAAEVPCLVDHNGVQPTFIGELPPQLAPLMRTIINVQELQVRAPMSENRAHIFHAAMMDPDTGGELDLDQIWSLVDDLLLAHRDWLPEW

SEQ ID NO: 14763 - protein, 432 aa, Agrobacterium tumefaciens; identical to SEQ ID NO: 11534

SEQ ID NO: 14764 - protein, 305 aa, Agrobacterium tumefaciens; identical to SEQ ID NO: 11533
  unsure (1)..(305): unsure at all Xaa locations

SEQ ID NO: 14765 - protein, 473 aa, Agrobacterium tumefaciens
MRILAVTAEMFPFVKTGGLADATSALPQALERKGADVRTLLPLYRGLTPLVRGRKPVLVANILEQPVSVYYVVSDGHKLLLLEAASLFDRDGHPYGVKGEPFADNDLRFAVLSKVAAEIALGAIDGWQPDVVHVHDWHAALTCVYLADSTPSVASVLTLHNLAFQGQYPLERAGMLGLPSHLCTVDCLEYYDDMSFLKGGLTTASAVTTVSPTYAREILTPEMGMGMHGVLARRRGDLRGIVNGVDHDVWNPATDPYILANFTAATATRRSLNKYALLQALGLAPTQGPVFGVVSRLTWQKGIDLLPHVVPLIIERKGRLIVHGEGDTALEDSLQALAKRYPELVCAHIGYDERLAHMIQAGSDFIIQPSQRQPCGLTQLYALRYGALPIVSRTGGLAETIIDANDAAIEAGVATGFQFEPANEDDLRAALERAISAYNDRELFRRLQTQAMQANFSWDKSAAQYMALFESLV

SEQ ID NO: 14766 - protein, 281 aa, Agrobacterium tumefaciens
TRHPTPPYPEQQQEPPGKTAEMKPIPDHGEQSYVGDGKLKGRVALITGADSGIGKAVAIAFAREGADIVISYLNEDDDARDTAKWVKEAGQGALLVPGDIKSEEHCKNLVHRAVNELGAVDILVNNAAFQRTYDDIADITAEEWDETFRTNIYAPFFLSKAAAPHMKPGSSIINTTSIQSRQPSPQLLAYASTKGAISNFTAGLAEMLAEKGIRVNAVAPGPIWTPLIPSTMPAEKAAKFGENTLIGRAGQPAELAGAYVLLASDLGSYMTGAVIPVTGGE

SEQ ID NO: 14767 - protein, 893 aa, Agrobacterium tumefaciens
LISEESRATATPMMEQYIEIKANNPGSLLFYRMGDFYELFFDDAVEASRALGITLTKRGQHMGHDIPMCGVPVHAADDYLQKLILRGYRVAVCEQIEDPAEAKKRGSKSVVKRDVVRLVTPGTLTEEKLLSPTESNYLMALARIRGSAEAQFALAWIDISTGVFRLAETTLTRLLADIWRIDPRELIVADSLFHDEELRPVFDVLGRVAVPQPAILFDSAVAEGRIARYFNVSTLDGFGTFSRVEMAAAAAAVAYVEKTQIAERPPLGAPERESAASTLFIDPATRANLELVKTLSGDRDGSLLHALNRTVTGGGARLLAERLMSPLTDPERINARLDAVAYLIDDVSLCDGLRDALKHVADMPRALSRLALERGGPRDLGAIRQGLVSAEKIAVILDGGLLPDELAKALRDLKALPGALEAMLGSMLADDLPLLKRDGGFLREGANPELDEVRALRDQSRRVIAGLQLQYADETGIKSLKIKHNNVLGYFIEVTAGNADVMMATDEAKARFIHRQTMAGAMRFTTTELADLESRIANAAAEALTMELEAFERMVEAVVQQAEAIKAGALALAVIDVASSLAYLATEQAYCRPIVDAFMTFSIKGGRHPVVEQALRRQSAGPFIANNCDLSAVNGGKNGAIWLLTGPDMGGKSTFLRQNALIAILAQIGSFVPAEAAHIGVVDRLFSRVGASDDLARGRSTFMVEMVETAAILNQATDRSLVILDEIGRGTATFDGLSIAWAAVEHLHEVNRCRGLFATHFHELTVLSEKLGRLSNATMRVKEWEGDVIFLHEVGPGAADRSYGIQVARLAGLPASVVERAREVLTKLEDADRKNPASQLIDDLPLFQIAVRREETRKAGPSKVEEALKSFNPDEMTPREALYALYALKKELG

SEQ ID NO: 14768 - protein, 430 aa, Agrobacterium tumefaciens; identical to SEQ ID NO: 11785
  unsure (1)..(430): unsure at all Xaa locations

SEQ ID NO: 14769 - protein, 680 aa, Agrobacterium tumefaciens
QNDFLRLYTHDMTTDARNGKVDPVIGRDDELRQLVDILTRRRQNNPILVGEAGVGKTAVAEALALEIASGNVPEKLRNVCLLNLDISLLQAGAGVKGEFERRLHGVIDAVKRSAEPVILFIDEAHGLVGAGGAAGQGDAANILKPALARGEVRTVAATTWSEYKKYFEKDAALTRRFQPVHVREPDEATAIRMLRGVADTFVSHHNVTVRDEAIVAAVQLSARYMPARQLPDKAVSLLDTAAAAVSLARQTLPERLRAMESERHLLSDELNWLLREPQDEDMQNRIQSIRDELERLEAGIDDLRGRYDAEMAELAALSEEQPAETGASNVSHLRPATEMRPANAERLVPTVVDREAIAAVVSRWTGIPLGKLLADQIESARTLDVRMRQRVVGQDAAITRIADAMRTARAGLSDPRRPPAVFFLVGMSGTGKTETALSLADLLYGGNSHLTTINMSEFKEEHKVSLLLGSPPGYVGFGEGGVLTEAVRRRPFGVLLLDEIDKAHPGVQDIFYQVFDKGVLRDGEGRDVDFKNTTIFMTANTGSELLSALSADPDTMPEGEALEALLMPELTKQFKPAFLGRTIILPFMPLGAEELASVVDMQIGKIRDRVLATYGTDLRLSDAARDALVARAGASEIGARAIEIMIGKDLLPPLSSFFLEKVIAGERVGKIVVDFGENGF

SEQ ID NO: 14770 - protein, 248 aa, Agrobacterium tumefaciens; identical to SEQ ID NO: 14264

SEQ ID NO: 14771 - protein, 568 aa, Agrobacterium tumefaciens; identical to SEQ ID NO: 14402

SEQ ID NO: 14772 - protein, 244 aa, Agrobacterium tumefaciens; identical to SEQ ID NO: 14278

SEQ ID NO: 14773 - protein, 468 aa, Agrobacterium tumefaciens; identical to SEQ ID NO: 14445

SEQ ID NO: 14774 - protein, 586 aa, Agrobacterium tumefaciens; identical to SEQ ID NO: 11754

SEQ ID NO: 14775 - protein, 630 aa, Agrobacterium tumefaciens
QTPLLDRVNFPSDLKEIDDRDLPELARELRDEMIDAVSKTGGHLGAGLGVVELTIAIHKVFNTPEDRLIFDVGHQCYPHKILTGRRDRIRTLRQEDGLSGFTRRAESEYDDFGAGHSSTSISAGLGMAVAAGLDGSDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDEKIIGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILQIGKGRIIKEGTKVALLSFGTRLAECLAAAEDLDAAGLSTTVADARFAKPLDLDLIRQLAAHHEVLVTIEEGSVGGFGAHVLHFMASAGLLDHGPKVRTLTLPDQWVEQAKPETMYANAGLDRAGIVSTVFNAARPASGRR

SEQ ID NO: 14776 - protein, 198 aa, Agrobacterium tumefaciens
  unsure (1)..(198): unsure at all Xaa locations
DWDQVDQNPFFCPDPEMVPVWEEYLDGIRKSGSSIGAVVEVVAEGVPAGIGAPIYAKLDQDIASSLMSINAVKGVEIGEGFASAELSGEENADQMRMGNDGKPIFLSNHAGGILGGIATGEPVIARFAIKPTSSILTERLSIDTDGNNVDVRTKGRHDPCVGIRAVPIGEAMIACTVADHYLRDRGQTADXNKGISPW

SEQ ID NO: 14777 - protein, 820 aa, Agrobacterium tumefaciens
MINNLTAADLPRPAPRSSNPEIMAAEIIERLTYRIGKDVKVAKPHDWLTATILVVRDRIIDKWMASTRKAYADNSKRVYYLSLEFLIGRLMRDAISNIGLMHEIRDALSSLGVDLDVIAGLEPDAALGNGGLGRLAACFMESMATVDIPAYGYGIRYVHGLFRQQMADGWQVELPETWLAHGNPWEFERRESSYEIGFGGSVETIGGYEDPQRFVWKPAERVIAMAYDTPVVGWRGTRVNTLRLWSAQPIDPILLAAFNAGDHIGALRESNKAESLTRVLYPADATPAGQELRLRQEFFFSSASLQDILRRHLQQYPDFTSLPDKVSIQLNDTHPAISICEMIRLLCDVHGLEFDEAWRITQGTFSYTNHTLLPEALESWPVPLLERLLPRHMQIVYAINANTLLFARKEKKMADQQIRSISLIDEGGERRVRMGNLAFIGSHSINGVSALHTELMKETVFADLHSLYPERINNKTNGITPRRWLMQCNPGLTGLIREAIGDDFLDDAEKLIALDRFADDAGFREKFAEVKRLNKVRLANTVAQRMGIRVDPSAMFDIQIKRIHEYKRQLLNLIETVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGADNIVIFGMTAEEVSRARAEGHNPRAIIEGSAELSQALSSIASGVFSPDDRSRFSALMDGIYNSDWFMVAADFDAYADAQRKVDAIWSDQDSWNTKAVRNTARMGWFSSDRTIRQYATEIWRA

SEQ ID NO: 14778 - protein, 420 aa, Agrobacterium tumefaciens; identical to SEQ ID NO: 11376

SEQ ID NO: 14779 - protein, 480 aa, Agrobacterium tumefaciens; identical to SEQ ID NO: 11375

SEQ ID NO: 14780 - protein, 542 aa, Agrobacterium tumefaciens; identical to SEQ ID NO: 14304

SEQ ID NO: 14781 - protein, 620 aa, Agrobacterium tumefaciens
  unsure (1)..(620): unsure at all Xaa locations
FPKGATRTENGVEFTVYSRHASQIDLCLFDDAGEKETARLPMMRGEDDVHRLTHENAGPGTRYGFRAHGIYAPEHGLWFDPAKLLLDPYATEIDRPFRHDPSLYAFGAETGAIMPKAILSAHDPVKRQPPRFAEGGLIYELAVKSFTQLHPYVPEDIRGTVAALAHPAILAHLKKIGVDAVELMPITAWIDERHLPPLGLSNAWGYNPVGFIALDPRLCPGGVRELRDTVAALHAEGIGVILDLVFNHTGESDIEGSILSLRGLDNLTAFRHPQGKPGVLVNDTGTGNTVACDHPYIRQLIVDSLRHFVLNAGVDGFRFDLAPVLGRTAAGFDMASETLAAMHSDPVLYDRLLIAEPWDIGPGGYQLGNFPESFLEWNDRARDDMRRFWRGDAGTTGALANALSGSSPIFSRHGRLKSRSVNFLAAHDGFTLFDLVSHERKHNEKNGENNRDGHNDNHSWNNGFEGLTDDPAIVAARLADVKALLSTLFVSRGTLMLTAGDEGGRSQQGNXNAYCQXNEISWVDWSSLVPELIDHTAFLAALRKRFGVFSESGFFSGRGDVTWLAPGGEPMTVADWERPDGQAFAMVLSTPDRETGKATELAVLINRGRDIVPFTLPGDG

SEQ ID NO: 14782 - protein, 301 aa, Agrobacterium tumefaciens; identical to SEQ ID NO: 11372

SEQ ID NO: 14783 - protein, 243 aa, Agrobacterium tumefaciens
MAQMSSKVALVVGGAKGIGLAIAERLSEEGAKVFITSRRSEDAEKAATAIGHGAIGIAADAAIPEDMVATVEKVRKAHGRIDALVLNAGLSEPAQIAEITPEHFDRHFDVNVRGMVFGFQAALPAMTEGGSVVLVGSIADSGGYASYGTYAATKAAVRSYARTWTAELASVGIRVNVVAPGPTDTEMMAAVQPDMRAAIVAPIPMGRMARPSEVAAAALFLLSDDASYIAGAELCVDGGLRQV

SEQ ID NO: 14784 - protein, 224 aa, Agrobacterium tumefaciens; identical to SEQ ID NO: 14361

SEQ ID NO: 14785 - protein, 333 aa, Agrobacterium tumefaciens
VKAFVVDKYKKKGPLRLADMPNPVIGANDVLVRIHATAINLLDSKVRDGEFKLFLPYRPPFILGHDLAGTVIRVGANVRQFKTGDEVFARPRDHRVGTFAEMIAVDAADLALKPTSLSMEQAASIPLVGLTAWQALIEVGKVKSGQKVFIQAGSGGVGTFAIQLAKHLGATVATTTSAANAELVKSLGADVVIDYKTQDFEQVLSGYDLVLNSQDAKTLEKSLNVLRPGGKLISISGPPDVAFARSLKLESAPAFCRQNAEPWCPEKGKQTRCRLLFPVHARRRSQLHEIAELIDAGTIRPVVDKVFQFAQTPDALAYVETGRARGKVVVTYA

SEQ ID NO: 14786 - protein, 378 aa, Agrobacterium tumefaciens
VNTRLTHGGNDPADCFGFVNPPIVRGSTVLFPDAETLSTEDQKYTYGTHGTPTTDALCNLVNELEGSFGTILVPSGLAAITVPFLAYLGAGDHALIVDSVYFPTRRFCNTMLKKLGVEVEYYDPAIGAGIEALIRPNTKLVHLEAPGSNTFEIQDVRLITDIAHRHDCVVTMDNTWATPLYFKPLDFGVDVSIHAATKYPSGHSDVLMGFVSANEKYWKALYQANTNLGICVTPDDAYQILRGMRTMGIRLEHHQKSALDIAQWLEGRDDVVRVLHPALPSFAGHELWKRDFKGASGVFSFVLKAEEGKYKQTASAFLDALTFFGLGYSWGGYESLAVSVSLVDRTIAKGPSEGPVIRLQIGLEDVADLKKDLEAGFS

SEQ ID NO: 14787 - protein, 335 aa, Agrobacterium tumefaciens; identical to SEQ ID NO: 11684

SEQ ID NO: 14788 - protein, 707 aa, Agrobacterium tumefaciens
RDLGQGLRQTDLSVPGVYCGACITTIETALGRLGQVERARVNLSSKRVAVVWKEEVNGVRTDPADIARAILATGYRIHLFASGQDASYALRSQLIRAVALCGFASANIMLLSVSVWSGADAATRDMFHWISAMIAAPALIYGGRFFYQSAWNALKHGRTNMDVPIALAITLSYAVSLWETIHHGEHAWFDATVSLLFFLLIGRTLDHIMRDKARSAIAGLARLSPRGATVIDADGVRDYRPLADIEPGMSIAIAAGDRVAVDAVVVCGSSDLDMSIVNGESAPRRVVAGDSLQAGTLNLTGSLVARVTASAKDSFLSEVIGLMEAAEGGRARYRRIADRAASYYSPVVHLLALVTFLGWGIFGGDWKQAMLIAIAVLIITCPCALGLAVPVVQVVAAGRLFRRGIMVKEGSAMERLSEIDTVLFDKTGTLTVGKPRLVETADVKPAIMAIAAGLAAHSRHPLSKALHAAYNGALPAYEAVREIPGSGVEAETEAGTYRLGNRRFACPDETRINNGDARSEVVLSLDGRHLASFGFEDNPRAGAIAALRSLSVRGLAQEIVSGDRAAAVSAMAQRLGIGNWRADLSPKDKAARCAALAGEGHRVLMVGDGINDAPALAAAHVSMAPATAADIGRQAADFVFMQEDLDAVPFAIETSQRAGNLIRQNFALAIGYNIIAVPIAIAGYATPMIAAIAMSTSSLIVVANALR

SEQ ID NO: 14789 - protein, 321 aa, Agrobacterium tumefaciens; identical to SEQ ID NO: 11395

SEQ ID NO: 14790 - protein, 250 aa, Agrobacterium tumefaciens
ERNMSNRLQGKIAVITGASKGLGAAIARSFAAEGASVVVNYSSSKSAAEAVVEEIIDAGGTAIAVKADMSEPAEVEELFAATNAAFGRVDILVNNAGVYDFQPLENLSIDLFRKHMELNVFGYLLAIKEAVKYMAEGGSIVNMSSTVTIFGPENASVYTASKGAIDGLTRALSNELAPRKIRVNAIKPGVVDTDGVQAGGFLHFDFGPMIMAQTPLKRLGVPEDIIPAAIFLASDESSWTTGEFFILAGG

SEQ ID NO: 14791 - protein, 495 aa, Agrobacterium tumefaciens
EIGHFINGKHVPGASGRTSNVYNPATGEVQATVALASDAELRAAVESAKAAQPKWAATNPQRRARVFFKFVELLNRDLNELAVLLSSEHGKTVEDSKGDIIRGLEVCEFVCGIPHLQKGEFTEGAGPAIDMYSIRQPVGIGAGITPFNFPGMIPMWMFAPAIACGNAFILKPSERDPSLPIRLAELMIEAGLPAGMLNVVNGDKGAVDAILTDPDIGAVSFVGSTPIARYVYGTAAMNGKRAQCFGGAKNHMIIMPDADLDQAVNALMGAGYGSAGERCMAVSVAVPVGEDTANRLVEKLIPQIESLRIGPYTDDKADMGPLVTKEAQTRVRGLIDSGVEQGAKLLVDGRDFKLQGYEDGYFVGGCLFDHVTPDMDIYKTEIFGPVLSVVRAKNYEDALELPMKHEYGNGVAIYTRDGDAARDFASRINIGMIGINVPIPVPLAYHSFGGWKASSFGDLNQHGTDSIKFWTKTKTITSRWPSGIKSGAEFVMPTM

SEQ ID NO: 14792 - protein, 267 aa, Agrobacterium tumefaciens; identical to SEQ ID NO: 11736

SEQ ID NO: 14793 - protein, 450 aa, Agrobacterium tumefaciens; identical to SEQ ID NO: 11737

SEQ ID NO: 14794 - protein, 838 aa, Agrobacterium tumefaciens; identical to SEQ ID NO: 11738

SEQ ID NO: 14795 - protein, 303 aa, Agrobacterium tumefaciens; identical to SEQ ID NO: 11371

SEQ ID NO: 14796 - protein, 549 aa, Agrobacterium tumefaciens; identical to SEQ ID NO: 11743

SEQ ID NO: 14797 - protein, 288 aa, Agrobacterium tumefaciens; identical to SEQ ID NO: 11739

SEQ ID NO: 14798 - protein, 273 aa, Agrobacterium tumefaciens; identical to SEQ ID NO: 11715

SEQ ID NO: 14799 - protein, 305 aa, Agrobacterium tumefaciens; identical to SEQ ID NO: 11714

SEQ ID NO: 14800 - protein, 267 aa, Agrobacterium tumefaciens; identical to SEQ ID NO: 11713

SEQ ID NO: 14801 - protein, 418 aa, Agrobacterium tumefaciens
FSTLAVHAGAQPDPTTGARATPIYQTTAYAFRDADHAAALFGLKEFGNIYTRIMNPTQAVLEERVAALEGGTAALAVASGHAAQLLVFHTLMQSGDNFVAARQLYGGSINQFGHAFKGFDWQVRWADAADPASFEAQINERTRAIFIESLANPGGTFVDIAAIADVAHRHGLPLIVDNTMASPYLLRPLEHGADIVLHSLTKFLGGHGNSMGGIIVDGGTFDWSATDRFPALSQPRPEYSGVLLHQTFGNFAFAIACRVLGLRDLGPAISPFNAFLILTGIETLPLRVQRHSDNALAVAKWLKAHPKVGWVHYAGLEDSDNHAIQQHYSPKGAGSVFTFGVKGGYAAGKALVEGLQLFSHLANIGDTRSLVIHPASTTHAQLTPEQQTAAGAGPDVVRLSIGIEDVKDIIADLEQSFA

SEQ ID NO: 14802 - protein, 250 aa, Agrobacterium tumefaciens; identical to SEQ ID NO: 14159

SEQ ID NO: 14803 - protein, 246 aa, Agrobacterium tumefaciens; identical to SEQ ID NO: 11617

SEQ ID NO: 14804 - protein, 505 aa, Agrobacterium tumefaciens; identical to SEQ ID NO: 11616

SEQ ID NO: 14805 - protein, 3227 aa, Agrobacterium tumefaciens
  unsure (1)..(3227): unsure at all Xaa locations
PDDTRLLHEAFFERAAESPEKIAVCAGGIELTYGQVAERALALAASLQKAGAGPNDRVAVSLPKGADQVIACLGILASGAAYVPVDPELPAERRFELVEDTAADLVIAEGGDWPQRVRVIAVPEEGGARPSPSSTTPSDLAYIIFTSGSTGKPKGVMIDHRGALNTILDINRRFAVSAEDRVFALSSLSFDLSVYDIFGPLAVGGAIVIPVREEVSDNARWMKLLLQHRVTVWNSVPALAQLLLAELPALREKPPLRMIMMSGDWIPVSLPPALKAQLPDADLISLGGATEASIWSIFHPIGEALRDWTSIPYGQPLANQRWYVLDDQGRPCPPWVTGRLFIGGIGVARGYWGRPQLTAERFIPDSFADEEEAGNGALLLYETGDLGRLRPEGLLEFLGREDFQVKVNGFRIELGEIETALLQNENVAEAVVTTMGQPPALIAYIVPDTKGSLIGKLEAKAGRSGNGGLGDAGRTVDLPTPDGLFHEAITRQSHRRFLNAPTELQKIGHLLASVRAFDISGTPLKKTLYPSAGGLYPVQTYILVQDGRVEGLSGGWYRHHPAEHRLEFLAATSQEQIAAIAGKSDDIIGQCAFLVLFTGHAAAMARSYGQKSRDFCLLEAGHMAQTMMLHAPRLDIGLCAAGGVDLTAIASALATEEDEEPLYVLAGGSIDPAWSTQWQASAQMRGETLSERLRAFLAGKLPAYMVPGEVRSMERLPLSANGKVDRQALPAPGGRARQTVAPATENESALLAIWHELLSSDSAGVEDNFFEAGGDSLTIMQLLSRIRQEFSVHLTLAQLFGATTVKAQSELLGSLSPSLPDEAETGISPIVAPTSVNDLSDDDVDKMLEQLLSGQKDQXTXTQWIFPDXPRRKSGSFCSAXWLDSRHPEKKNFRLSHAQERIWFVEQMQPGTGAYSIPVAIRLEGPLDRDRLRICFDIVVQRHESLRTVFEVQDGEPFQVIVSQTTADFSFHEPGDDEAARDVAIGRFAQEPFNLSQGPLFRVGLFSVAPDEHTLVMVIHHIISDYASLQILIDEVYRLYSAAEAPAIGQLPALDIQYRDYAEWQRNGTAALSGQIDYWREQLRDAPLLLQLPFDFARPVTQSFQGARHKFRLGPALSSAVKDLAKSRKLTTFMVLLAAYQILLARLSRSDDICIGTTASNRNRAQTRNLIGLFVNNLVLRTRLQPNDTFDTLLDRVRDTTLEALSNQDVPFEQVVDALNVERDIGHNALFQSTFVLHNASGAAFDLGDIKVTPIALDSGASRFDLSLDMHEGRGNEGFSGVFEFNTELFLPETVSRFSAYFLRLLGGLVSNPGGRIAEIDLLDKTEHAAIATANRTTIAFPLRDFASLLEETAQVRGSSVAVRCGDRQYSHGDLNEAANRVASGLRDRIGNSKPHPRIAICLPRSENLVIAILAVLKLGGHYVPLDPGHPAERRALILEDCKPDIILISEGEDTAYPCGCMAIEPLLRATGSFGNPHRETLPDDLAYIIYTSGSTGRPKGVPIRQKSLVNLLTSMARRPGMSAEDRFLAVTTPAFDIATLELLMPLMVGGLLIIAEADDIYDDMALSELIRNHSATMMQATPATWRLMADADWKAPAGFRMLCGGEALEPGLARRLLAAGGELWNLYGPTETTIWSTCTRICAEHLELPALPVGEPIANTQLHLLDDALMPVPAGVVGELYIGGEGLSPGYFNRDDLTSRAFVEGPAAGSNGGGERSRLYRTGDLMRRSAAGHLLYVGRADFQVKLRGFRIELSEIEAILAAQPSIEQAVVALFQDEEGSGTLVAYCRRGTSPVDEDALRAALASQLPSYMLPAAYVWMDRFPLNANGKIDRKRLERPKQIVSSTAYTAPLEGTEQIVAAIWRELLGAEKIGRDDNFFTVGGHSLLATRMLARLRASFAIDLPLRTFFERPRLADFAGAVDALVAMTERRPEAVSSALSKREHTGPTPLSHAQNRQWALAQLEPDSPLYNIPFALKIRGALDFEILSHALELTAQRQDTLRSRFVSVDGKPFVETDPEMIFKIVPEEIGDRELEAALLDCARRPFDLAVAPLLRIHAFRTGPQDHVLLFLLHHIIGDALSAEILLNDVATFYASLSKKEAPPNGALPLQYSDFAIWQREQDTTNEVDYWRRTLAGAPPLLELPTDFVRPAIQGFSGESIRFSLNADLLARLRQLCDQQGATLFMGMLTAFSTLLQRVSGMRDIVIGTPVSERFHPDLENVIGMFANTLAIRLQTQGGENFNEALKAARDTALSAFANQTAPFEKVVDALSLPRTWSHNPLFQAMLVSTVETRRGAISLAGMEWDRLALPDTSSRVDLTLFIHETAEELSCRLEYRSDLFRRATMESLGEALVALLEKIVERPELPLDRQSLVSGNHQKRLRQWNETDAEFQPQRRCLHDFVTASAETSPQAIAVTDQDRSLSYAELDWRADRLASGLVAAGIGRGKRVGIRLERSVELVVAILAVLRTGAAYVPLDPRYPADRIEFIAADADLALILVTTENDISTIGQNFRCMTPGMVENLAGGAVPTPVTSGADLAYLIYTSGSTGRPKGVAIEHRNAVAFMQWCMHAFTKDQLSGVLASTSICFDLSIFEIFATLAAGGRIFMVDDLFAFPSAPFAGEVTLVNTVPTPMSELLKLGPLPQNVKTVCLAGEPLPRELVARIYANDQVECLYNLYGPSEDTTYSTVAPVPPSGEWFGIGVPIANTRAYVLDGEMNEVPVGVPGELFLSGSGLARGYWNRPGQTAERFLPNPFADCSQHRVMYQTGDIVRRRDDGGLDYMGRADRQLKLNGFRIEPGEIEAVLLQQEGVHEAVAGLWRDAANHPRLAMWIAGDPALEITKLVATLRQRLPEHFIPVLATRLDALPRLPNGKLDRSALPDPAAYGERATETASLLNDQEDVLAQIWQGLLGCGDIRRNDNFFSLGGDSILAIQLVSQARQKGLKMTPRDVFLHPTLASLAEVTHVESTVTVGTGHADDEATLGAIQHWLLDQDLPDLAHWNQGLILKLTRSLDPDRLEKAISRLLEEHQSLRARFLRKNGQWQQKFAPLSAMPPMQQLAATDENDVTDFARKLHAGFDLGAGPLFGAILATLPDGSGRLILAAHHLIVDGVSWRMIVADIERHYLEASTIRSGAVAAGSWNSRLSRSALFDGEEEYWRGVCEEDVRALPLDNESGSNTQSDAVTYRQTIDAETTRQLLRDVPECFSIASNEVLVAALYLTLRQWSGQ

SEQ ID NO: 14806 - protein, 471 aa, Agrobacterium tumefaciens; identical to SEQ ID NO: 11494

SEQ ID NO: 14807 - protein, 379 aa, Agrobacterium tumefaciens; identical to SEQ ID NO: 11495

SEQ ID NO: 14808 - protein, 241 aa, Agrobacterium tumefaciens
ALITGASSGLGIEFAELLAAQKMNLVLAARRKEPMEKLAEDLRRRHGVDILVEPIDLAAPGAAARLKDSLNERAIQIDILVNNAGYGLQGEFLKTPIERTTDMIQLNITALTELSYVFGRDMAARGSGEILLIASLLAFQPVPTYAAYAATKSYVLSFGEALHDELRTQGVVVTSLCPGHTETGFDAAAGAQVSPMLRLLTMKPRPVAEAGLEALAKGKASVIAGFMNKVVAFSTRLTPRS

SEQ ID NO: 14809 - protein, 419 aa, Agrobacterium tumefaciens
RRIVVTGMGAVSPLGANVDISWSRLLAGQSGIRRLTDDVVGDLPAKVGGVVPSLAEDPERGFDPDRIIAPKDQRKVDRFIIFALAAAEEALVQANWKPVSNEDRLRTATIIASGIGGFPAITEAVRTVDQRGVRRLSPFTIPSFLVNLAAGQVSIRHGFKGPLGAPVTACAAGVQAIGDAARLIRSNEADIAVCGGTEACMNIVSLGGFAAARSLSTGFNETPTKASRPFDTARDGFVMGEGAGVLVIEALSHALARGATPIAELVGYGTTADAHHITSGPEDGSGARRAMEIAIAQAGIAPHEIGHLNAHATSTPVGDLGEIRAIKSVFGQRKSVAVSGTKSATGHLLGAAGGLEAIFTILALKNRIAPPTLNLNAPDTESDGIDFVANLARSLDAEYAISNGFGFGGVNASVLFRRW

SEQ ID NO: 14810 - protein, 262 aa, Agrobacterium tumefaciens; identical to SEQ ID NO: 14242

SEQ ID NO: 14811 - protein, 298 aa, Agrobacterium tumefaciens; identical to SEQ ID NO: 11499

SEQ ID NO: 14812 - protein, 380 aa, Agrobacterium tumefaciens
SDAEAIEVAKIVAAEIAPGAALRDRDRIWPVKELDAFSQSGLWSINVPKKFGGPEVSYATLAKVIEIVSAADSSIGQIAQNHLGVVAAIRTVSDEAQQKLLFAEVLRGTRFGNAFSEFGSKRAADFETKFVDAGDHVIVNGQKFYSSGALLAHLVPIVALDDEGRAWYAIAERDAPGLTVIDDWSSFGQRTTLSGTVILNNVKVPKTYLVPGYKGYAEPTADGAIFQIIQVAVDTGIARAAIDETVSFVRTKSRAWVDSGVDHAWDDPYTIQAVGDLTLRLHAAQALLEKAGYAIDRAIQNPNAETVAEAQVVTAEAKILATEIAIAATNKLFELAGTRSTLAEHHLDRHWRNARTHTLHDPVRWKYSILGKYFLNGEKP

SEQ ID NO: 14813 - protein, 386 aa, Agrobacterium tumefaciens
FFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMP

SEQ ID NO: 14814 - protein, 248 aa, Agrobacterium tumefaciens; identical to SEQ ID NO: 11514

SEQ ID NO: 14815 - protein, 318 aa, Agrobacterium tumefaciens
VALFDAIPGEPEISTLDAALAAARVAKPDVVIGLGGGSVMDVAKLVAALWDGEQTLADVAGPNKVAGRRTRLAQIATTAGTGSEAGIRSLITDPIKGNKIAVESPHLIADLAVLDPELTYSVPPTVTAATGVDAMAHCVEAFTSKRSHPMIDGFARMGFHLVGKFLGRAVRDGSDREAREGLMLASYYGGICLGPVNTAAGHAIAYPLGTLLHLPHGLANAIVFPHVLAFNQPVVSAKTAEVAEALGLGAGLSQTQLQDSARGFCSDLGIEMSLAKHGAAEADLSRYAADAHAIRRLMDNNPADMSVDDVLDVYKASF

SEQ ID NO: 14816 - protein, 261 aa, Agrobacterium tumefaciens; identical to SEQ ID NO: 11449

SEQ ID NO: 14817 - protein, 1151 aa, Agrobacterium tumefaciens
LKISKILVANRSEIAIRVFRAANELGIKTVAIWAEEDKLSLHRFKADESYQVGRGPHLAKDMGPIESYLSIEEVIRVAKLSGADAIHPGYGLLSESPEFVEACNKAGITFIGPTPDTMRQLGNKVAARNLAISVDVPVVPATNPLPDDIAEVERMAEEIGYPVMLKASWGGGGRGMRAIRKKEDLAREVTEAKREAKAAFGKDEVYLEKLVERARHVESQILGDTHGNVVHLFERDCSIQRRNQKVVERAPAPYLSEAQRQELAAYSLKIAAATNYIGAGTVEYLMDADTGKFYFIEVNPRIQVEHTVTEVVTGIDIVKAQIHILEGAAIGTAESGVPKQEDIRLNGHALQCRITTEDPEHNFIPDYGRITAYRSASGFGIRLDGGTSYTGAVITRYYDPLLVKVTAWAPEPDEAISRMDRALREFRIRGVATNLTFLEAIIGHDSFRNNTYTTRFIDSTPELFAQVKRQDRATKLLTYLADVTVNGHPETKGRAKPADKAAKPIVPYIDAPTPDGTKQLLDKLGPKGFADWMRNEKRVLVTDTTMRDGHQSLLATRVRTHDIARVASVYSKALPQLLSLECWGGATFDVSMRFLTEDPWERLSLIREGAPNLLLQMLLRGANGVGYKNYPDNVVKYFVRQAARGGVDLFRVFDCLNWVENMRVSMDAIAEENKLCEATICYTGDLLNSARPKYDLKYYTNLAVELEKAGAHIIAVKDMAGLLKPAAAKVLFKALREATGLPIHFHTHDTSGISAATVLAAVDAGVDAVDAAMDAFSGNTSQPCLGSIVEALSGSERDTGLDTEWIRRISFYWEAVRNQYAAFESDLKGPASEVYLHEMPGGQFTNLKEQARSLGLESRWHEVAQAYADANRMFGDIVKVTPSSKVVGDMALMMVSQDLTVADVENPDREVSFPDSVVSMLKGDLGQSPGGWPEALQKKALKGEKPYTVRPGSLLEDADLDAERKVIETKLERKVDDFEFASYLMYPKVFTDFALTAETYGPVSVLPTHAYFYGMEDGEELFADIERGKTLVIVNQASSGIDDKGMVTVFFEINGQPRRIKVPDRAHGASGSAVRRKAEPGNASHIGAPMPGVISRVFINQGQEVKAGDVLLSIEAMKMETALHAERDGKIAEVLVKPGDQIDAKDLLISY

SEQ ID NO: 14818 - protein, 586 aa, Agrobacterium tumefaciens; identical to SEQ ID NO: 11451

SEQ ID NO: 14819 - protein, 469 aa, Agrobacterium tumefaciens; identical to SEQ ID NO: 11452

SEQ ID NO: 14820 - protein, 354 aa, Agrobacterium tumefaciens
MVDKRALIIGVTGQDGAYLSELLLAKGYMVHGLKRRSSSFNTGRIDHLYQDPFEEDLRFRLHFGDLTDATNLCRVIQEVQPDEIYNLGAQSHVQVSFETPEYTANADALGTLRLLEAMRILNLGDRCRFYQASTSELFGGMGTVAQHEGTPFYPISHYAAVKLYAYWMTGHYRESYGFHASNGILFNHESPIRGETFVTRKTTRGVAAIERGLMSKLRLGNLDAKRDWGHARDYVEGMWRIVQQEIPEDYVLATGEAHTVREFVELAFGVVGKTIEWHGDGSDEVGYDAKTGNSIIEIDPRYFRPAEVDFLLGDPSKARRKLDWSHSTSFCDLVQEMVEADLRLVMLEEGRNEF

SEQ ID NO: 14821 - protein, 252 aa, Agrobacterium tumefaciens; identical to SEQ ID NO: 11406

SEQ ID NO: 14822 - protein, 430 aa, Agrobacterium tumefaciens; identical to SEQ ID NO: 11405

SEQ ID NO: 14823 - protein, 192 aa, Agrobacterium tumefaciens; identical to SEQ ID NO: 11404

SEQ ID NO: 14824 - protein, 508 aa, Agrobacterium tumefaciens
MNLSHFLTQAARRNPDHIGFVWGEKTWSWAQMEARVDAMAHALETEFGVRKGDRILVQSSNNNQMFESMFACFRVGAVWVPTNYRQSPDEVAYLAKASGARGMICASAFPDHAKASHEASTIDFSIAIGTAEFGEDYDAIVARHMGRKVKSQAVDRDDPCWFFFTSGTTGRPKAAVLTHGQMAFVITNHLCDLMPGTGPDDASIVVAPLSHGAGIHQLVQVAHGAKTVLPAAEKLDVPAVWALIEKWRITNAFTVPTILKMLVEDPSVDRFDHSSLRYVIYAGAPMYRADQKRALAKLGPVLVQYFGLGEVTGNITVLPPSFHNAEDGPETRVGTCGFDRTGMEVQIQNDAAEEVGAGETGEICVIGPAVFAGYYDNPEANAKAFRNGWFRTGDLGHRDENGFLYITGRASDMYISGGSNIYPREIEEKILMHPDISETAVLGVPDAVWGEVGVAVCVAREGADIAAIDLKAYLEGKMARYKLPKSVVFWDAMPKSAYGKITKKMIRE

SEQ ID NO: 14825 - protein, 388 aa, Agrobacterium tumefaciens; identical to SEQ ID NO: 14257

SEQ ID NO: 14826 - protein, 263 aa, Agrobacterium tumefaciens
LTGRLTGKRALVFGAGSSGPGFGNGKAAAVQFAREGARVACVDLCADAAEETAEIIRGEGLEAIAAAADVTELQSVSATVDRTCEAFGGIDILHNNVGVTHMGGPVELDEESFRASVDLNIGSVYRTSKAVLPVMLAQGGGAIVNISSLASIRWTGYPYFAYYAMKAAVNQATVALAMQYARQGIRANCILPGMIDTPLIYKQISNQYASVEEMVAARNAAVPVGRMGDAFDIARAAVFLASDEAKFITGVCLPVDGGQSCAV

SEQ ID NO: 14827 - protein, 688 aa, Agrobacterium tumefaciens; identical to SEQ ID NO: 11400

SEQ ID NO: 14828 - protein, 450 aa, Agrobacterium tumefaciens; identical to SEQ ID NO: 11399

SEQ ID NO: 14829 - protein, 298 aa, Agrobacterium tumefaciens; identical to SEQ ID NO: 11397

SEQ ID NO: 14830 - protein, 569 aa, Agrobacterium tumefaciens; identical to SEQ ID NO: 11630
  unsure (1)..(569): unsure at all Xaa locations

SEQ ID NO: 14831 - protein, 243 aa, Agrobacterium tumefaciens; identical to SEQ ID NO: 11631

SEQ ID NO: 14832 - protein, 406 aa, Agrobacterium tumefaciens
LAPKSYPDMPALRGVRMATAAAGIKYKNRTDVLLMVFDKPASVAGVFTKSKCPSAPVDFCRANLGSGAARAVVVNSGNANAFTGVKGKAATELTAKSAAAAVGCSEGEIFLASTGVIGEPLDASKFAGVLGDMNVRAEADFWQEAAKAIMTTDTYPKVSTRTAEIGGVIVTINGISKGAGMIAPDMATMLSFVVTDADIEPAALQSLLSAGVGPTFNSVTVDSDTSTSDTLMLFATGAAAEDGQVKVTSADDERLSSFRAALNDLLKDLALQVVRDGEGARKMVEVTVTGAENDAAAKKIALSIANSPLVKTAVAGEDANWGRVVMAVGKSGEMADRDRLAIWFGGVRVAVNGERDPDYSEAETTAVMRLEDITVKVDIGLGQGTATVWTCDLTKEYVAINGDYRS

SEQ ID NO: 14833 - protein, 246 aa, Agrobacterium tumefaciens
TNRLQNKIAVVTGATSGIGLATAKLFAVEGARVYITGRRKDALDKAVAEIGHGAVGVQADSASNENLDKLFAQVKAEQGRLDALVVNAGGGSMLPLGQITEEQIDHTFGRNVKAVIFTVQKALPLMGKGASIVLTGFDRRHRRHGRLLRYSASKAAVRNLARSWALDLKGTGIRVNVVSPGATRTPGLVELAGDDKEQQQGLLDYLASRIPLGRVGESEEIAKATLFLASDDASFVNGAELFADGG

SEQ ID NO: 14834 - protein, 252 aa, Agrobacterium tumefaciens
LQGRRALITGGTSGAGAATVALFKDLGASVLTTARKKPADFAGAAFVEADLTTTAGVKTVVDAVQRELGGLDILVNVLGGSSAPSGGFAALTDEEWEKEFNLNFFPAVRLDRALVPGMIAQGSGVVIHVTSIQRNLPLPEATTGYASAKGALNTYSKSVSKEVSPKGVRVVRVSPGWIADPGANGLALRIAEEAGIDYAAAVQVIMNSLGGIPLGRPAKPEEVADLIAFLASDRAASITGTEHVIDGGTVPT

SEQ ID NO: 14835 - protein, 468 aa, Agrobacterium tumefaciens
WIDGTFVSSSKRGRSIDPATYETIGDYPDDGGAAAQSAIEAAKRAFRGTAWRDDAELRARVLDQMASAIERNRERLIDILSLENGKLLGEAALEIDGSPSKLRYWAAMARTEAGRAKSPKPGSLSVILRQPMGVAGIIVPWNSPVILSVRSFAPALAAGCTVVVKMPGQTAQVGSVITEVLAEATDLPEGVVNMFVESGADGAALLVESPDVPTISFTGSTQTGRTIGAIGAKRMKRFGLELGGKTPMIVFDDADLEAMLPVLEKALTIFAGQFCMTGSRLLVHSSIYELVRDRLAERLRAVKVGPASDPASDMGPLIDKENVARVDSVVKDALSKGATVVFRGGPVPEGPLAKGAFFRPSMLEVFDNSLPIVQQETFGPVITIQRFSDEREAVVLANDNDYGLSASVWTRDLDRSLRVAQALEAGSVFVNDWAKVYDGTEEGGFKQSGLGRLNGVAAIEDFIEYKQV

SEQ ID NO: 14836 - protein, 349 aa, Agrobacterium tumefaciens
LQMSDKKFRVGIIGADTHASWAGASHVPALASQAHLTLAAVATRREESARAAAEAFGAELWFADPYAMISDKTIDVITVAVKVPAHKNLVMAALHAGKAVYCEAPLGATLAETNEMAAAVGSLHTAIGLQGRHNPAVRRAAELVASGKLGRLMSARVGATTFGYGPQSPSMYDYFNKAASGASFMTITAGHVLDVIEAVLGNITEVDARTELLWPEIEIVDTGETSQREIPDHLDLIAKTASGAPVSVQVLAGVPADEASVVFEIRGSRGWLKLTGNHLAGVQVGDILLSSSVEFAAPDRPVANGVGPTAAEFWSGAAINVGEVYASLGRDLRNGTYTTPGFDHARHNS

SEQ ID NO: 14837 - protein, 361 aa, Agrobacterium tumefaciens
  unsure (1)..(361): unsure at all Xaa locations
MQMRKLGESGLFVSELCFGAMTFGGTDGLWGKVGRLDQEDADALVKAALEAGINLFDTANVYAHGRSEEILGRSLKNLGVSRSDVVIATKVASAMGDGPNHRGASRGHIISECRASLGRLGLDHIDLYQIHAFDSATPIEETLEALDTLVRAGDVRYIGLSNWAAWQIMKAIGITRARALAPITSLQAYYTLVGRDLEREIGPLLSSERVGLMVWSPLAGGYLTGKYSAGGNAAGGRQTELDFPPIDRIRGEPLIAVLKAVAEKHGSSPAQIAIAWLLKQKVVSTVIIGAKRVEQLQENIRSASIELDDNDMAKLDEVSRLPVEYPGWLLNDGNGHSRXHGKDAXDRXRMSLIIHPMNLHG

SEQ ID NO: 14838 - protein, 240 aa, Agrobacterium tumefaciens; identical to SEQ ID NO: 11520

SEQ ID NO: 14839 - protein, 243 aa, Agrobacterium tumefaciens; identical to SEQ ID NO: 14357

SEQ ID NO: 14840 - protein, 211 aa, Agrobacterium tumefaciens; identical to SEQ ID NO: 14421

SEQ ID NO: 14841 - protein, 386 aa, Agrobacterium tumefaciens; identical to SEQ ID NO: 11517

SEQ ID NO: 14842 - protein, 458 aa, Agrobacterium tumefaciens
AADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLC

SEQ ID NO: 14843 - protein, 463 aa, Agrobacterium tumefaciens
YIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSI

SEQ ID NO: 14844 - protein, 278 aa, Agrobacterium tumefaciens
VLVDCQNVWKIFGARASTAVKAVARGGLSKKQVLEDFDCVVGVCDASLQVHRGEIFCIMGLSGSGKSTLIRLLNRLIEPSLGKITVKGKDIARLNAAELRELRARNIAMVFQSVALLPYRTVLENAGFSLEVRGVAKDERNRIARAALEKVGLADWTSRYPHELSGGMQQRVGLARALAADPEIILMDEPFSALDPLIRRQLQDEFRQLTKSLGKSAVFITHDLEEAIRIGDRIAIMKDGVIVQVGTAEEIVTKPADDYVSDFVAGISRIHLVKAHTV

SEQ ID NO: 14845 - protein, 488 aa, Agrobacterium tumefaciens
AEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVLRCVLPRNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDV

SEQ ID NO: 14846 - protein, 289 aa, Agrobacterium tumefaciens; identical to SEQ ID NO: 14358

SEQ ID NO: 14847 - protein, 294 aa, Agrobacterium tumefaciens; identical to SEQ ID NO: 11364

SEQ ID NO: 14848 - protein, 927 aa, Agrobacterium tumefaciens; identical to SEQ ID NO: 11365

SEQ ID NO: 14849 - protein, 930 aa, Agrobacterium tumefaciens
ISKLSTSTIAGLTSEDVNALDSTKIKALSSSQIASLSTDNLALFSSEDLRAISVTAVKGLTLTQMAKLSSAQVSSLSSSQVTALYASQIDAMSTDQIKALNSSQVAGLSSAQVATLSSDELALFTTDEIKSISANAIAGLSAAAIAGLSTDNAAALTKSQIAAMSSTQFNALTLGSLATFSADEVKAISNKILAGLDVTKLSTGNIAALSKAQVSALSTTQFAAMSTDQIKALTSDQVAGLSSAQVATLSSDELALFSTDEIKAIGANAVAGLSAAALAALTTDNAAALTKTQIAGLSSTQLNALTSANLATFSADEIKAISTKALAGLDVTKLSTGNIAALTKTQAASLSSTQFAAMSTDQIKALTSEQVAGLSSAQVATLSSDELALFSTDEISAFSANAVAGLSTAALAALTTGNATALTKTQIAGLSSTQLNALTSGSIATFSADEVKAISTKALAGLDVTKLSTGNVAALSKAQVSALSTTQFAAMSTDQIKALTSEQVAGLSSAQVATLSSDELALFSTDEIKAIGANAVAGLSAAALAALTTDNASALTKTQIAGMSSTQINALTSANLATFSADEIKAITTKALGGLDVTKLSTGNIAALTKAQVTSLSSTQFAALSTDQIKALTSEQVSGLNSAQVATLSSDELALFTTDEIKSIAANAVAGLSAAALAALTTDNASALTKTQIASLSSTQLNALTSANLATFTADEIKAVTTKALAGLDVTKLSTGNVAALSKAQVSALSTTQFAAMSTDQIKALTSDQVAGLTSAQVATLSSDELALFSTDEIKAIGATAVSGLSAAALAALTTDNASALTKTQIAGLSSTQLNAFNSANLATFTADEVKAITAKALGGLDATKLSTGNIAALSKAQAAALSTTQFAALSTDQIKALTSEQVAGLNSAQVATLDSTELALFSTDEIKAI

SEQ ID NO: 14850 - protein, 345 aa, Agrobacterium tumefaciens; identical to SEQ ID NO: 14434

SEQ ID NO: 14851 - protein, 398 aa, Agrobacterium tumefaciens
VWHPFTQHGLEPPMKRVVSADGAFLVDEDGNRLFDAISSWWVITHGHRHPAIMAAIRAATETLDQVIFAEFSHEPAETLARGLIELAPAGLSHVFYSDSGSTAVEVALKMALGYFHNCGEKRDRIVVMEHGYHGDTIGTMSTGERGVFNAAYEPLLFGVDRLAFPEVGSEQCTLDMFEAYCRSGRVAALLVEPLVLGAGGMKVYAANVLAGLKQIAESHGCLVIADEVMTGWGRTGTVFACEQAAISPDILCTSKGLTGGSLPLAATLCSAQIFDAHFSTDRRKTFFHSSSYTANPIACAAAVANLQVWRDEPILQRIGQVQQTLGDHIRRFADDGRFANIRQAGTIAALDLVVPAGGYLSEAGPRMRQLFRRRGFLIRPLGNVLYLMPPYCSTADDL

SEQ ID NO: 14852 - protein, 321 aa, Agrobacterium tumefaciens
TRSSRMAGFGHAVPARCVDNAEIEASLGLEAGWIERRTGIRSRYWAEAGDTLSGLAERAGRMALEDAKINADDIALTLLATSTPDHLLPPSAPLLAHRLGLTRSGAIDLAGACSGFLYALTLADGFVRTYGRAVLVVAANILSRRINPAERASAVLFADAAGAVVLTPCPEVKRGVLSADLVADGSGYDLIQIAAGGSSQPFSAGMIAEDALMTMRDGREVFSRAVALMTNTSQRVLHEAELTAADISRFVPHQANARMSDAVCGNLGIEREKTVRTIGSFGNSSAATIPLSLSITNAERPLAGGETLLLTAAGAGMTGGA

SEQ ID NO: 14853 - protein, 306 aa, Agrobacterium tumefaciens; identical to SEQ ID NO: 11370

SEQ ID NO: 14854 - protein, 405 aa, Agrobacterium tumefaciens; identical to SEQ ID NO: 11584

SEQ ID NO: 14855 - protein, 220 aa, Agrobacterium tumefaciens
VKLEDSWKHVLSGEFASPYMQKLKEFLLAEKTAGKRIFPKGAEYFRALDLTPLDEVKVVILGQDPYHGLGQAHGLCFSVQPGVRIPPSLVNIYKELQSDLGIRPVKHGFLESWAKQGVLLLNSVLTVEEARAASHQGQGWEKFTDAVIRAVNDECDHVVFLLWGSYAQKKAAFVDQRKHLVLRSPHPSPLSAHNGFFGNGHFSKANAFLVSHGRDPIDWQ

SEQ ID NO: 14856 - protein, 337 aa, Agrobacterium tumefaciens; identical to SEQ ID NO: 11586

SEQ ID NO: 14857 - protein, 284 aa, Agrobacterium tumefaciens; identical to SEQ ID NO: 11587

SEQ ID NO: 14858 - protein, 242 aa, Agrobacterium tumefaciens; identical to SEQ ID NO: 11675

SEQ ID NO: 14859 - protein, 225 aa, Agrobacterium tumefaciens; identical to SEQ ID NO: 11674

SEQ ID NO: 14860 - protein, 295 aa, Agrobacterium tumefaciens; identical to SEQ ID NO: 11673

SEQ ID NO: 14861 - protein, 452 aa, Agrobacterium tumefaciens; identical to SEQ ID NO: 14450

SEQ ID NO: 14862 - protein, 240 aa, Agrobacterium tumefaciens; identical to SEQ ID NO: 11355

SEQ ID NO: 14863 - protein, 292 aa, Agrobacterium tumefaciens; identical to SEQ ID NO: 11433

SEQ ID NO: 14864 - protein, 308 aa, Agrobacterium tumefaciens
AGKVTQVIGAVVDVAFEGELPPILNALETQNNGNRLVLEVAQHLGENVVRTIAMDSTEGLVRGQSVADTGAPIEVPVGLETLGRIMNVIGEPVDEAGPIVTAKKRAIHQDAPSYVEQSTEGQILVTGIKVVDLLAPYAKGGKIGLFGGAGVGKTVLIMELINNVAKAHGGYSVFAGVGERTREGNDLYHEMIESNVNKLGGGEGSKAALVYGQMNEPPGARARVALTGLTIAENFRDEGQDVLFFVDNIFRFTHAGSEVSALLGRIPSAVGYQPTLATDMGQMQERITTTNKGSITSVQAIYVPADDL

SEQ ID NO: 14865 - protein, 245 aa, Agrobacterium tumefaciens; identical to SEQ ID NO: 14480

SEQ ID NO: 14866 - protein, 296 aa, Agrobacterium tumefaciens; identical to SEQ ID NO: 11669

SEQ ID NO: 14867 - protein, 373 aa, Agrobacterium tumefaciens; identical to SEQ ID NO: 14283

SEQ ID NO: 14868 - protein, 324 aa, Agrobacterium tumefaciens; identical to SEQ ID NO: 14483

SEQ ID NO: 14869 - protein, 684 aa, Agrobacterium tumefaciens
MAKLKVDGKEIEVPDHFTLLQACEEAGAEVPRFCFHERLSVAGNCRMCLIEVKGGPPKPAASCAMGVRDVRGGPNGELPEVFTNTPMVKKAREGVMEFLLINHPLDCPICDQGGECDLQDQAMAFGIAGSRYAENKRAVEDKYIGPLVKTVMNRCIHCTRCVRFTTEVAGIAELGLIGRGEDAEITTYLEQAMTSELQGNVVDLCPVGALTSKPFAFTARPWELNKTETIDVMDALGSAIRVDTRGREVMRVMPRVNEAINEEWISDKSRFIWDGLKTQRLDRPYVRKDGRLQPATWGEAFGAIKQAVAATSGSKIGAIAGDLSSVEEMFALKSLLASLGSANVDCRQDGAALDPSLGRASYIFNSTIEGIEHADALLIVGSNPRFEAAVLNARIRKRWRRGGFPIGVIGEAGELRYNYEYLGSGAETLSDLANGSHSFIDKLKSAKNPLIIIGQGALARADGAAVLAAAAKLAVSVGAVTEEWNGFSVLHTAAARVGGLDIGFVPGEGAVAAAEMVTSMDVLFLLGADEIDLSNKGAKFTVYIGSHGDQGAMNADVILPGAAYTEKSGIWVNTEGRVQVGNRAGFAPGEAREDWAILRALSDVLGKKLPFDSLSALRGQLYVAHPHLAETDEIVAGKATDIEALAGKTGSLTKSAFASPVKDFYLTNPIARASAVMAECSALA

SEQ ID NO: 14870 - protein, 261 aa, Agrobacterium tumefaciens; identical to SEQ ID NO: 11750

SEQ ID NO: 14871 - protein, 192 aa, Agrobacterium tumefaciens; identical to SEQ ID NO: 11749

SEQ ID NO: 14872 - protein, 250 aa, Agrobacterium tumefaciens; identical to SEQ ID NO: 11672

SEQ ID NO: 14873 - protein, 259 aa, Agrobacterium tumefaciens; identical to SEQ ID NO: 14488

SEQ ID NO: 14874 - protein, 320 aa, Agrobacterium tumefaciens; identical to SEQ ID NO: 14489

SEQ ID NO: 14875 - protein, 395 aa, Agrobacterium tumefaciens; identical to SEQ ID NO: 11440

SEQ ID NO: 14876 - protein, 299 aa, Agrobacterium tumefaciens; identical to SEQ ID NO: 11439

SEQ ID NO: 14877 - protein, 712 aa, Agrobacterium tumefaciens; identical to SEQ ID NO: 14492

SEQ ID NO: 14878 - protein, 180 aa, Agrobacterium tumefaciens
QAQFGDFANGAQVVFDHCMCSGERKWLRMSGLVCLLPHGYEGQGPEHSSARLERWLQMCAEDNMQVANVTTPANYFHILRRQMKRDFRKPLILMTPKSLLRHKRATSSLAELAGESSFHRLLWDDAEVIKDGPIKLQKDAKIRRVVMCTGKVYYDLLEEREKRGIDDVYLLRVEQLYPFP

SEQ ID NO: 14879 - protein, 252 aa, Agrobacterium tumefaciens
DGEGSRPLICIHGVGSYKEAWDGVVDPLKNDFTILTFDLRGHGASSRIKGRYEIEDFVREVIALANHVGFKTFSLAGFSLGGLIAQKLALTHQERVDHLILLSTVAGRTQEEKDRVAGRLAALTAGEPGSHYDASLSRWLTEEFQQNNPDKIARLRARNAENDPDCYAAAYRVLAETDLGEELSQIGVPTLIATGEDDSGSNPRMAGFLHSKIANSMLRILPGLRHSILTEAPELVASIMRDFLNKTRKAHG

SEQ ID NO: 14880 - protein, 474 aa, Agrobacterium tumefaciens
LFIDGRFVEPRSGKFVDSYDPTTGEAWYQFAEGGADDVDLAISSAQRAFRDPSWRRMTQTARGKLVRRLADLVLEHAEDLALLETRDNGKLIKEMRAQMRAIPDSYLYFAGMADKLQGDTIPVNKLDQLNFNMREPLGVIGMVTPWNSPLMLLTGTLAPCLAIGNTVVIKPSEHATASTLALAELIVEAGFPAGVVNVVTGGGAVTGEALTRHNGIAKFVFTGSTATGRRIAANAAANLVPCQMELGGKSPHVVFSDVDIEKTVNGVVSGVFAAAGQTCVAGSRCFVEANIYDRFIEALVERTRNIKLGDPMDDATDIGPLALESQLSKLEGYVASGVREGSRIAIGGKRPQSEELSRGWYFEPTVMADATNDMSFMRHELFGPMVGVMPFSSEEEMISLANDTNYGLASGIWTQNIDRAMRFANQIDAGTVWINTYRSAAYMSANGGFKESGYGRRGGFDVMREFSRAKNVVI

SEQ ID NO: 14881 - protein, 324 aa, Agrobacterium tumefaciens; identical to SEQ ID NO: 14493

SEQ ID NO: 14882 - protein, 496 aa, Agrobacterium tumefaciens
YILAIDQGTTSTRSMVFDRDMRVIGVGQREFPQHFPASGWVEHDAEDIWKSVLETIRLALADAGIAASDIAAIGITNQRETTVLWDRNTGEAVHRAVVWQDRRAAPVCEDLKRRGLEPLFSKKTGLLLDPYFSGTKLKWLLDSVSGLREKAVKGEICFGTVDSFLIYRLTGGRRHVTDATNASRTLIYNIEDNAWDDELLSILNIPRAMLPEVLDCAADFGVTDKALLGAEIPILGVAGDQQAAVIGNACFEPGMMKSTYGTGCFALLNTGTDRVASTNRLLTTIAYRLDGVTTYALEGSIFIAGAAVQWLRDELGFISVASEVSALAEKADPKQRVYLVPAFTGLGAPYWDAEARGAIFGLTRGTGPAEFARAALESVAYQTFDLLDAMRKDWAGDNGKTVLRVDGGMVASDWTMQRLADILAAPVDRPVFLETTILGAAWLAASRAGIWPDRKAFADHWRRDRRFSPDMEESERKNAIAGWRDSVGRCLSKRDN

SEQ ID NO: 14883 - protein, 288 aa, Agrobacterium tumefaciens; identical to SEQ ID NO: 11596

SEQ ID NO: 14884 - protein, 429 aa, Agrobacterium tumefaciens
LRIGIAGLGTVGASLVRILQQRSNELAITCGRAIEIIAVSARDRSRDRGIDLKGITWFDTPEQMASEADIDVFVELVGGASGQAENAVRAALSRGLHVVTANKALLAKHGVELATIAEDKGALLNFEAAVAGGIPVIKALRESLTGNHVSRIYGIMNGTCNYILTKMEKEGLSFEVCLKEAQRLGYAEADPAFDIEGNDTAHKLSILTTLAFGNKIAADDIYLEGITNISIEDIQAAAELGYRIKLLGVAQVTDSGIEQRVHPTMVPLDSVIAQVDGVTNAVAIESDILGELLMVGPGAGGNATASAVLGDIADIAKSRPGTQQVPVLGRPAKSLTEYRRAKMKSHEGGYFIRLTVKDQAGVFASIATRMADNNISLESIVQRQRVHVEGAPQTIILVTHATMEDAIRKAVKAIKNEKYLVSEPQVIRI

SEQ ID NO: 14885 - protein, 714 aa, Agrobacterium tumefaciens; identical to SEQ ID NO: 11800

SEQ ID NO: 14886 - protein, 313 aa, Agrobacterium tumefaciens; identical to SEQ ID NO: 11799

SEQ ID NO: 14887 - protein, 411 aa, Agrobacterium tumefaciens; identical to SEQ ID NO: 14378

SEQ ID NO: 14888 - protein, 408 aa, Agrobacterium tumefaciens; identical to SEQ ID NO: 14245

SEQ ID NO: 14889 - protein, 465 aa, Agrobacterium tumefaciens; identical to SEQ ID NO: 14497
  unsure (1)..(465): unsure at all Xaa locations

SEQ ID NO: 14890 - protein, 650 aa, Agrobacterium tumefaciens
DYLSGLNPEQREAVETLDGPVLVLAGAGTGKTRVLTTRIAHILATGRAYPSQILAVTFTNKAAREMKERIGVLVGGAVEGMPWLGTFHSIGVKLLRRHAELIGLKSDFTILDTDDVVRLIKQLIQAEGLDDKRWPAKQFAGMIDGWKNKGLTPPDIPEGDSRAFANGKGRELYAAYQARLKTLNACDFGDLLLHPISIFRRHTDILKEYHQKFRYILVDEYQDTNTAQYMWLRLLAQRAKDEPQNVCCVGDDDQSIYGWRGAEVDNILRFDKDFPGAKVIKLERNYRSTEHILGAAGHLIAHNEGRLGKTLFTERSSPDDEKVVVHAAWDSEEEARAVGEEIEQLQRKNYKLNDMAILVRASFQMREFEDRFVTLGLNYRVIGGPRFYERLEIRDAMAYFRLVCQPADDLAFERIVNTPKRGLGDTTIRNLHDYARARDIPMLAAAADIIETDELKPKARKALFDVVQDFRRWQGLLENTEHTTLAEQILDESGYTAMWQADKTAEAPGRLENLKELIRSMESFESMRGFLEHVALVMDAEQNAELDAVSIMTLHSAKGLEFDTVFLPGWEEGLFPHQRALDEGGRSGLEEERRLAYVGITRAKKLCHIWFVSNRRIHGLWQSTLPSRFLDELPPAHVDVAASDSNYGGY

SEQ ID NO: 14891 - protein, 137 aa, Agrobacterium tumefaciens
ILNGPNLNLLGQRQPEIYGYETLADVEADCRAIAEAAGHELFFAQSNREYELIDWIHEARGKSAGIVINPGAFTHTSVAILDALNAFEAPVIEVHISNIHKREVFRHHSYVSTRAEGVIAGLGIEGYGVALRHLINL

SEQ ID NO: 14892 - protein, 274 aa, Agrobacterium tumefaciens; identical to SEQ ID NO: 14499

SEQ ID NO: 14893 - protein, 244 aa, Agrobacterium tumefaciens; identical to SEQ ID NO: 11507

SEQ ID NO: 14894 - protein, 279 aa, Agrobacterium tumefaciens; identical to SEQ ID NO: 11506

SEQ ID NO: 14895 - protein, 256 aa, Agrobacterium tumefaciens
ISGKRALVLASSRGLGLGIATALAKEGANVLLVGRSGEKLAENCKAINALGKGKADWVWGDLADDNFVESMVQAVEDKLGGIDILVNNTGGPTPGLAQEMTVDKLDTFFQSMVLRVITLTNALLPQMKEQGFGRILTVASSGVFEPIPNLALSNTLRGALVGWSKTLSSEVASFGITSNLLLPGRIHTDRIDELDGANAKRLGKSIEEVREASVKGIPAGRLGTVEEFAAAGAFLCSVPASYITGTMLRVDGGAAK

SEQ ID NO: 14896 - protein, 250 aa, Agrobacterium tumefaciens; identical to SEQ ID NO: 11583

SEQ ID NO: 14897 - protein, 406 aa, Agrobacterium tumefaciens
EESSRQNTLLLKEIAAHKKTDAALQDAKETAEAANRAKSRYVVGLSHELRTPLNAVLGYAQILERDETIPAPRQSAIKVIRRSADHLSGLIDGLLDISKIEAGRLQVYSNEINIKDFLDQVVDMFRPQAQAKGLEFRHERTAALPQYVRTDEKRLRQILVNLLSNAIKFTDEGSVTFDVAYRSQVASFTVSDTGRGIAEKDLARIYEPFQRGEAESVRPMPGLGLGLTITRLLTNTLGGEISVSSEKDNGSTFRVRLMLSAVHRPSTAPAPEKTIRSYSGPRRTIVVVDDNEDHRELMRQVLSPLDFVVLTAQSGPECLTLIEGVKPDLFLIDISMPGMTGWQLVTKLREAGQTAPLIMLSANIGDGAVAGAGDDNHNDAIAKPVDIRHLCDRLAVHLGLKWIYET

SEQ ID NO: 14898 - protein, 490 aa, Agrobacterium tumefaciens; identical to SEQ ID NO: 14503

SEQ ID NO: 14899 - protein, 500 aa, Agrobacterium tumefaciens; identical to SEQ ID NO: 11758

SEQ ID NO: 14900 - protein, 187 aa, Agrobacterium tumefaciens
ADLSDIDAIKRTVDMAASATGGIKVLVNNAAWDDRHDIDSVTEAYWDANQAVNLKQMFFTVQAALPHLRQAKDASIVNFSSISFLLNMGELPSYAAAKAGIIGLTKSLAGRLGPENIRVNTLLPGMIVTERQKELWLTDEGITATTARQCLKRTLVAADLSGPCLFLASSASSAITAQSIIVDGGLL

SEQ ID NO: 14901 - protein, 262 aa, Agrobacterium tumefaciens
AYTYVDHSYDVIVVGAGGAGLRATLGMAEQGFRTACITKVFPTRSHTVAAQGGIAASLTNMTPDCWQWHLYDTVKGSDWLGDVDAMQYLAMEAPKAVYELEHYGVPFSRNAEGKIYQRPFGGHMQNYGEGPPVQRTCAAADRTGHAILHTLYGQSLRNNAEFFIEYFALDLIMAPDGRCTGVVAWNLDDGTIHRFSAKMVVLATGGYGRAYFSATSAHTCTGDGGGMIARAGLPLQDMEFVQFHPTGILGAACFIIEGARGE

SEQ ID NO: 14902 - protein, 304 aa, Agrobacterium tumefaciens; identical to SEQ ID NO: 14411

SEQ ID NO: 14903 - protein, 816 aa, Agrobacterium tumefaciens; identical to SEQ ID NO: 11470

SEQ ID NO: 14904 - protein, 352 aa, Agrobacterium tumefaciens
DNERYQKWYQESVEDPEKFWDKHGRRIDWFKPYTKVKNTSFKGRVPIKWFEDGLTNVSYNCIDRHLKTHGERTAIIWEGDNPYIDKKITYNQLYDYVCRLANVLKKHGVKKGDRVTIYMPMIPEAAYAMLACARIGAVHSVVFGGFSPEALAGRIVDCESTFVITCDEGVRGGKPIPLKENTDKAIDIAAKQYVIVNKVLVVRRTGGKTGWAPGRDIWYHQEIATVKPDCPPVKMRAEDPLFILYTSGSTGKPKGVLHTTGGYLVYTSMTHEYVFDYKDGEVFWCTADVGWVTGHSYIVYGPLANCATTLMFEGVPNFPDQGRFWEVIDKHKVNIFYTAPTALRSLMGAGDQ

SEQ ID NO: 14905 - protein, 478 aa, Agrobacterium tumefaciens; identical to SEQ ID NO: 11602

SEQ ID NO: 14906 - protein, 505 aa, Agrobacterium tumefaciens; identical to SEQ ID NO: 14505
  unsure (1)..(505): unsure at all Xaa locations

SEQ ID NO: 14907 - protein, 224 aa, Agrobacterium tumefaciens; identical to SEQ ID NO: 14168

SEQ ID NO: 14908 - protein, 256 aa, Agrobacterium tumefaciens; identical to SEQ ID NO: 14410

SEQ ID NO: 14909 - protein, 275 aa, Agrobacterium tumefaciens; identical to SEQ ID NO: 11408

SEQ ID NO: 14910 - protein, 361 aa, Agrobacterium tumefaciens; identical to SEQ ID NO: 14578

SEQ ID NO: 14911 - protein, 551 aa, Agrobacterium tumefaciens; identical to SEQ ID NO: 11690

SEQ ID NO: 14912 - protein, 467 aa, Agrobacterium tumefaciens
  unsure (1)..(467): unsure at all Xaa locations
DRLSTFPAFFRVEGRQVAVFGNGDEAFAKVRLLANTNAHIVAYADHPEADFARYISENSIDHRALAFASPLVDDATLVFAATGDEALDREIVSVARTKKIPANAVDQPEFCDFFTPALVARAPVAIAIGTEGAGPVLAQMIRARIDQMLSPSLGKLARLAVQYRDAAEENVPKGALRRNFWRRFFSGAVADAVALGDTSSARHAADRLLQSPERSEGRVWLVGAGPGAEDLLTLRAQRVLMEADVIVYDALVPQAIVDMGRRDAERLSVGKRKGCHSKSQNDINRLLVRLGLEGKRVVRLKSGDPLVYGRAGEEMAALREAGVAYEIVPGITSAFAAAADFELPLTLRGVASSLIFTTGHDLMGDVLPDWARLAVSGATIAVYMGRSVAASVAKRLIDAGLGVETTVAVIENASRADRRLLHGTLNDLPDLEYRDELIGPVMVIIGDAVAGRXFRQIRGACACSQAG

SEQ ID NO: 14913 - protein, 265 aa, Agrobacterium tumefaciens; identical to SEQ ID NO: 11790

SEQ ID NO: 14914 - protein, 293 aa, Agrobacterium tumefaciens; identical to SEQ ID NO: 14458

SEQ ID NO: 14915 - protein, 245 aa, Agrobacterium tumefaciens; identical to SEQ ID NO: 14509

SEQ ID NO: 14916 - protein, 593 aa, Agrobacterium tumefaciens
GIAPAIAQALEKRGYKDLTPVQQAMLAPELANKDALVSAQTGSGKTVAFGIALATTLLSENTRFGQASAPLALAIAPTRELAMQVKRELEWLYEFAGVSIASCVGGMDIRNERRALERGAHIVVGTPGRLCDHIKRNALDLSSIRAVVLDEADEMLDLGFREDLEFILEESPDDRRTLMFSATVPRSIAKLAESYQKNAVRIATASEQKQHVDIEYRALLVSPSDRENAIINALRFYEARNAIVFCSTRAAVNHLTARLNNRGFSVVALSGELTQNERTHALQAMRDGRARVCVATDVAARGIDLPGLELVIHADLPTNSETLLHRSGRTGRAGQKGVSAIVVPVSQRRKAERLLEGAKVSAAWVRPPSVEEIVERDGARLLADPTLSEAVTDDERDFVNKLLEQHGAEKVAAAFVRLYHSGRSAPERHFRSRARQHSQAPPRQLRNNRKQRARRDRSDFSDSAWFSLSVGRKQSAEPRWLIPMLCRFGKITRQDIGAIRMQQTETFVELAADAVDRFTSAIGKDMMLEKGIRLKQMEGKPEMTGNAREDTRPATAQRKFTKSDNAGAPRDDRKADDKPWKKKKAFGDKPKYE

SEQ ID NO: 14917 - protein, 735 aa, Agrobacterium tumefaciens; identical to SEQ ID NO: 14580
  unsure (1)..(735): unsure at all Xaa locations

SEQ ID NO: 14918 - protein, 420 aa, Agrobacterium tumefaciens
MARIVMKFGGTSVANLERIHNVARHVKREVDAGHEVAVVVSAMSGKTNELVDWVQNAAKVAGTNAASFYDAREYDAVVASGEQVTSGLLAITLQSMGINARSWQGWQIPIRTDNAHGAARILEIDGSDIVHRMGEGQVAVVAGFQGIGPDNRIATLGRGGSDTSAVAIAAAVKADRCDIYTDVDGVYTTDPRIEPKARRMKKIAFEEMLEMASLGAKVLQVRSVELAMVHKVRTFVRSSFEDPDAPGMGDLINPPGTLICDEDEIVEQEVVTGIAYAKDEAQISLRRVADRPGVSAAIFGPLAEAHINVDMIVQNISEDGSRTDMTFTVPSGDVAKALRVLDENKGQIGFDVAQNETGLAKVSVIGIGMRSHAGVAASAFKALAEKNINIKAITTSEIKISILIDGAYAELAVRTLHSAY

SEQ ID NO: 14919 - protein, 98 aa, Agrobacterium tumefaciens; identical to SEQ ID NO: 11759

SEQ ID NO: 14920 - protein, 548 aa, Agrobacterium tumefaciens; identical to SEQ ID NO: 11578

SEQ ID NO: 14921 - protein, 243 aa, Agrobacterium tumefaciens; identical to SEQ ID NO: 11359

SEQ ID NO: 14922 - protein, 335 aa, Agrobacterium tumefaciens; identical to SEQ ID NO: 11527

SEQ ID NO: 14923 - protein, 292 aa, Agrobacterium tumefaciens; identical to SEQ ID NO: 14460

SEQ ID NO: 14924 - protein, 180 aa, Agrobacterium tumefaciens; identical to SEQ ID NO: 11435

SEQ ID NO: 14925 - protein, 244 aa, Agrobacterium tumefaciens; identical to SEQ ID NO: 14278

SEQ ID NO: 14926 - protein, 586 aa, Agrobacterium tumefaciens; identical to SEQ ID NO: 11754

SEQ ID NO: 14927 - protein, 468 aa, Agrobacterium tumefaciens; identical to SEQ ID NO: 14445

SEQ ID NO: 14928 - protein, 635 aa, Agrobacterium tumefaciens; identical to SEQ ID NO: 14237

SEQ ID NO: 14929 - protein, 192 aa, Agrobacterium tumefaciens
DWDQVDQNPFFCPDPEMVPVWEEYLDGIRKSGSSIGAVVEVVAEGVPAGIGAPIYAKLDQDIASSLMSINAVKGVEIGEGFASAELSGEENADQMRMGNDGKPIFLSNHAGGILGGIATGEPVIARFAIKPTSSILTERLSIDTDGNNVDVRTKGRHDPCVGIRAVPIGEAMIACTVADHYLRDRGQTGRLK

SEQ ID NO: 14930 - protein, 285 aa, Agrobacterium tumefaciens; identical to SEQ ID NO: 14584

SEQ ID NO: 14931 - protein, 820 aa, Agrobacterium tumefaciens; identical to SEQ ID NO: 14777

SEQ ID NO: 14932 - protein, 420 aa, Agrobacterium tumefaciens; identical to SEQ ID NO: 11376

SEQ ID NO: 14933 - protein, 480 aa, Agrobacterium tumefaciens; identical to SEQ ID NO: 11375

SEQ ID NO: 14934 - protein, 542 aa, Agrobacterium tumefaciens; identical to SEQ ID NO: 14304

SEQ ID NO: 14935 - protein, 623 aa, Agrobacterium tumefaciens
  unsure (1)..(623): unsure at all Xaa locations
PKGATRTENGVEFTVYSRHASQIDLCLFDDAGEKETARLPMMRGEDDVHRLTHENAGPGTRYGFRAHGIYAPEHGLWFDPAKLLLDPYATEIDRPFRHDPSLYAFGAETGAIMPKAILSAHDPVKRQPPRFAEGGLIYELAVKSFTQLHPYVPEDIRGTVAALAHPAILAHLKKIGVDAVELMPITAWIDERHLPPLGLSNAWGYNPVGFIALDPRLCPGGVRELRDTVAALHAEGIGVILDLVFNHTGESDIEGSILSLRGLDNLTAFRHPQGKPGVLVNDTGTGNTVACDHPYIRQLIVDSLRHFVLNAGVDGFRFDLAPVLGRTAAGFDMASETLAAMHSDPVLYDRLLIAEPWDIGPGGYQLGNFPESFLEWNDRARDDMRRFWRGDAGTTGALANALSGSSPIFSRHGRLKSRSVNFLAAHDGFTLFDLVSHERKHNEKNGENNRDGHNDNHSWNNGFEGLTDDPAIVAARLADVKALLSTLFVSRGTLMLTAGDEGGRSQQGNXNAYCQXNEISWVDWSSLVPELIDHTAFLAALRKRFGVFSESGFFSGRGDVTWLAPGGEPMTVADWERPDGQAFAMVLSTPDRETGKATELAVLINRGRDIVPFTLPGDGWRSI

SEQ ID NO: 14936 - protein, 301 aa, Agrobacterium tumefaciens; identical to SEQ ID NO: 11372

SEQ ID NO: 14937 - protein, 238 aa, Agrobacterium tumefaciens
KVAIITGASSGIGRATAMLFVTQGAAVVINARGEKALQEVAADIRDAGGRVHAVAGDAGVAETHSRLADAAVGVFGGLDIAINNAGAVGAMKPLAEISPEEWDHVLNVNLTSAFLGARYQIPPMLKRGGGSIVFTSSFVGTSAGIPGMSAYGTAKAALMGLVKGITADYAINGIRANALLPGGVDTPAAGDPAQKEWAAGLHAMKRIAQPEEIAQAALFLASPMASFVAGAALFADGG

SEQ ID NO: 14938 - protein, 166 aa, Agrobacterium tumefaciens; identical to SEQ ID NO: 14308

SEQ ID NO: 14939 - protein, 465 aa, Agrobacterium tumefaciens
LKDVVAGKRNEEGIASALAVLKQQLGDKLQTGQAFREQHGHTTTYLTLQAPDGVVFAESADDVKAVVKACAQYKVPVIPFGTGSSLEGQVNAPNGGICIDFSRMNRIIEVNAEDLDVTVEPGVTREDLNVYLRDTGLFFPIDPGANASIGGMASTRASGTNAVRYGTMKDNVLAVTAVVANGEEIRTARRARKSSAGYDLTRLFVGAEGTLGVITSVTLRLQGIPEKITGGVCTFDSIKAACDAVIMTIQMGVPVARIELLDEVQVRACNAYSGLNYAEKPTLFVEFHGTEETAALQSQQFAEIAAECGSVDFRWTGDAAERNKLWKARHDAYWASRALAPHLDGLSTDVCVPISRLADCVVETQRDIAENGFLAPIVGHAGDGNFHVLILFDGKDAESVAKTEAFVARLNRRAIAMDGTCTGEHGIGQGKMSFLAEEAGNALDLMRAIKTSLDPDNIFNPGKLF

SEQ ID NO: 14940 - protein, 243 aa, Agrobacterium tumefaciens; identical to SEQ ID NO: 14783

SEQ ID NO: 14941 - protein, 224 aa, Agrobacterium tumefaciens; identical to SEQ ID NO: 14361

SEQ ID NO: 14942 - protein, 237 aa, Agrobacterium tumefaciens; identical to SEQ ID NO: 11741

SEQ ID NO: 14943 - protein, 469 aa, Agrobacterium tumefaciens; identical to SEQ ID NO: 11550

SEQ ID NO: 14944 - protein, 251 aa, Agrobacterium tumefaciens; identical to SEQ ID NO: 14215

SEQ ID NO: 14945 - protein, 302 aa, Agrobacterium tumefaciens
IVSIRNLTKSYANGFQALKGVSLDIKEGEILALLGPNGAGKTTLISIVCGLVNPGEGSVLVGGHNVVKDFRQTRALIGLVPQELTTDMFETVWNTVSFSRGLHGQKKNPALIESILKSLSLWDKKDNMLRELSGGMKRRVLIAKALAHEPKVLFLDEPTAGVDVTLRRDMWNVVSELRAKGVTIILTTHYIEEAEEIADRVGVINGGELLLVEEKTALMKKLGRKQLFLELTQPVERLPDSLAPFALTLSDDRSTITYEIEGNGEQGRIADLLGALSAANIHFKDISTRQSSLEDIFVSLVG

SEQ ID NO: 14946 - protein, 359 aa, Agrobacterium tumefaciens; identical to SEQ ID NO: 11683

SEQ ID NO: 14947 - protein, 740 aa, Agrobacterium tumefaciens
MSCCAPGTEGSLELGEPLNPPSSEELLLASRDLGQGLRQTDLSVPGVYCGACITTIETALGRLGQVERARVNLSSKRVAVVWKEEVNGVRTDPADIARAILATGYRIHLFASGQDASYALRSQLIRAVALCGFASANIMLLSVSVWSGADAATRDMFHWISAMIAAPALIYGGRFFYQSAWNALKHGRTNMDVPIALAITLSYAVSLWETIHHGEHAWFDATVSLLFFLLIGRTLDHIMRDKARSAIAGLARLSPRGATVIDADGVRDYRPLADIEPGMSIAIAAGDRVAVDAVVVCGSSDLDMSIVNGESAPRRVVAGDSLQAGTLNLTGSLVARVTASAKDSFLSEVIGLMEAAEGGRARYRRIADRAASYYSPVVHLLALVTFLGWGIFGGDWKQAMLIAIAVLIITCPCALGLAVPVVQVVAAGRLFRRGIMVKEGSAMERLSEIDTVLFDKTGTLTVGKPRLVETADVKPAIMAIAAGLAAHSRHPLSKALHAAYNGALPAYEAVREIPGSGVEAETEAGTYRLGNRRFACPDETRINNGDARSEVVLSLDGRHLASFGFEDNPRAGAIAALRSLSVRGLAQEIVSGDRAAAVSAMAQRLGIGNWRADLSPKDKAARCAALAGEGHRVLMVGDGINDAPALAAAHVSMAPATAADIGRQAADFVFMQEDLDAVPFAIETSQRAGNLIRQNFALAIGYNIIAVPIAIAGYATPMIAAIAMSTSSLIVVANALRLAG

SEQ ID NO: 14948 - protein, 335 aa, Agrobacterium tumefaciens; identical to SEQ ID NO: 11684

SEQ ID NO: 14949 - protein, 394 aa, Agrobacterium tumefaciens; identical to SEQ ID NO: 14350

SEQ ID NO: 14950 - protein, 299 aa, Agrobacterium tumefaciens; identical to SEQ ID NO: 11776

SEQ ID NO: 14951 - protein, 371 aa, Agrobacterium tumefaciens
RGEGVWLFTESGERYLDFAAGVAVNSLGHAHPHLVEAIKTQAEKVWHVSNLYEVPGQEKLAKRLTEATFADKVFFTNSGAEALECAIKTARRYHYSKGHPEKFRIITFEGAFHGRTLATIAAGGQQKYLEGFGPKVEGFDQVPFGDVDALKAAITAETAALLIEPIQGEGGIRAPAKEFLQLLRSLCDEHDLLLIFDEVQTGVGRTGKFFAYEQTGVAPDIMAVAKGIGGGFPLGACLATADAASGMTAGVHGTTYGGNPLAMAVGNAVLDVVLADGFLEKVRDVALVFRQGLASLKDRYPDVIEEIRGEGLLLGIKARVPSGELLQAMRAEHLLGVPAGDNVIRLLPPLVTTAEEAREGLARVEAAAASL

SEQ ID NO: 14952 - protein, 244 aa, Agrobacterium tumefaciens
LQGKIAVITGASKGLGAAIARSFAAEGASVVVNYSSSKSAAEAVVEEIIDAGGTAIAVKADMSEPAEVEELFAATNAAFGRVDILVNNAGVYDFQPLENLSIDLFRKHMELNVFGYLLAIKEAVKYMAEGGSIVNMSSTVTIFGPENASVYTASKGAIDGLTRALSNELAPRKIRVNAIKPGVVDTDGVQAGGFLHFDFGPMIMAQTPLKRLGVPEDIIPAAIFLASDESSWTTGEFFILAGGH

SEQ ID NO: 14953 - protein, 318 aa, Agrobacterium tumefaciens
MKAAVYDQAGPPDVLTYRDVADPIVGPDDVLIAVEAISIEGGDLINRRSTPPPGRPWIVGYAASGRVVGAGANVRDRKVGDRVTAFDMQGSHAELWAVPAIRTWLLPSGVDAASAAALPISFGTAHHCLFARGGLLRNQTVLVQAAAGGVGLAAVQLAAQAGATVIAVSSGESRLQRISSLGADHVVDRSMGNVVEAVRQNTGGKGVDLVIDPVGVTLSASLTLLAPEGRLVFVGNAGGGSLTIDLWPAMQSNQTLLGVFMGPLLERPQVRATVDEMLQMLDRREIRVMIEKTFPLSEAAAAHDFAENAKPLGRVIME

SEQ ID NO: 14954 - protein, 277 aa, Agrobacterium tumefaciens
DLFVIGGGINGCGIARDAVGRGYSVALAEKGDFASGTSSAATKLIHGGLRYLEHYEFRLVREALMEREILWAMAPHVIWPMRFILPVQKGGVRPSWMVRLGLFLYDNLGGRKLLPPTRTLDLRKDPAGKPLKPVFAKAFEYSDGWVDDARFVVLNARDAADRGATIMNRTRVVSARREGRLWLIETLDEKTGRPAMHKARMLVNAAGPWVDNVLSGVFGRNDVHNVRLVQGSHIIVRRKFSDPRAYFFQNPDNRIIFAIPYEQDFTLIGTTDRDYKG

SEQ ID NO: 14955 - protein, 480 aa, Agrobacterium tumefaciens; identical to SEQ ID NO: 11788

SEQ ID NO: 14956 - protein, 268 aa, Agrobacterium tumefaciens; identical to SEQ ID NO: 14516

SEQ ID NO: 14957 - protein, 302 aa, Agrobacterium tumefaciens; identical to SEQ ID NO: 11547

SEQ ID NO: 14958 - protein, 251 aa, Agrobacterium tumefaciens
LFDLSGQVALVTGAGSGIGQRIAMGLAQSGANVALLDRRTDDGLAQTADFIARAGRKSIQIAADVTSKQALTDAVARTQAELGALSLAVNAAGIANANPAEEMEESQFQTMMDINLKGVFLSCQAEANAMLKNGRGAIVNIASMSGVIVNRGLMQCHYNASKAGVIHMSKSMAMEWVGRGIRVNTISPGYTATPMNTRPEMVHQTKLFEEQTPMQRMAGVDEMVGPAIFLLSDAASFVTGVDLLVDGGFCC

SEQ ID NO: 14959 - protein, 450 aa, Agrobacterium tumefaciens; identical to SEQ ID NO: 11737

SEQ ID NO: 14960 - protein, 833 aa, Agrobacterium tumefaciens
VEGMTCASCVRRVETAAAKVPGVASSSVNFATKKLTVEPAEGFSARTLGAAIKKVGYDIAPERQEFAVDGLHGEAEAERLKAVLNAVATTVNVKVDAAAGKVAVETIGGRRERDALVETAKLAGFALKTPKPHGHSAHHDHGQHHAHHQGHSQMTAAGESGGHDHMQHAGEEGALKRDLTIAAILTAPLFVLEMGGHIYEPMHHWLMGIIETQNLYYIYFVLATAVIFGPGLRFLKAGFPALLRGAPEMNSLVALGVTAAYLYSVVATFAPDLLPAEAQFVYYEAATVIVTLILTGRLLEARASGRTGDAIRKLMSLQAKTARVERDGATIDISPDDLVAGDIIVIRPGERLAVDGEVVEGSSYVDESMISGEPVPVEKTVGATVVGGTINKTGAFKFKATKVGADTMLSQIIRMVEEAQGSKLPIQLLVDRVTALFVPVVIAIAVLTFIVWAIFGPEPAYTFALVNAVAVLIIACPCAMGLATPTSIMVGTGRAAELGVLFRKGQALQELRSAQIVVVDKTGTVTKGRPELTDLVVAEGFADNEVLALVAAVEGRSEHPIAEAIVRAAEEKNVATPAGLAPTTVENFESVTGYGIAATVNGRKVEVGADRYMAKLGHSVDIFAEAAARLGDEGKTPLYAAIDGRLAAAIAVADPLKPSSVTAIKALQAMGIEVAMVTGDNERTANAIARQVGISRVVAEVLPEGKVKAIHEMRAGGKVLAFVGDGINDAPALAEADIGIAVGTGTDVAIESADVVLVGGDLLGAVNAIEMSRATMRNIKENLFWAFGYNVALIPVAAGVLYPAFGITLSPMIGAGAMALSSVFVLANALRLK

SEQ ID NO: 14961 - protein, 346 aa, Agrobacterium tumefaciens; identical to SEQ ID NO: 11556

SEQ ID NO: 14962 - protein, 303 aa, Agrobacterium tumefaciens; identical to SEQ ID NO: 11371

SEQ ID NO: 14963 - protein, 203 aa, Agrobacterium tumefaciens
IKICGLKTPETLERVVRRGASHVGFIFFEKSPRYIEPDLAGRLAEAARGAAKVVAVTVDADNDYLDEIVDLVRPDILQLHGSESPERLLHIKALYGLPVMKAISIRDAADLAKIEPYIGIADRFLLDAKAPAGSDLPGGNGVSFDWTILRSLDESVDYMLSGGLNKDNVAEALAETRASGLDLSSGVESAPGVKDLSKIDAFF

SEQ ID NO: 14964 - protein, 186 aa, Agrobacterium tumefaciens; identical to SEQ ID NO: 14594

SEQ ID NO: 14965 - protein, 549 aa, Agrobacterium tumefaciens; identical to SEQ ID NO: 11743

SEQ ID NO: 14966 - protein, 877 aa, Agrobacterium tumefaciens; identical to SEQ ID NO: 14518

SEQ ID NO: 14967 - protein, 449 aa, Agrobacterium tumefaciens; identical to SEQ ID NO: 14183

SEQ ID NO: 14968 - protein, 281 aa, Agrobacterium tumefaciens; identical to SEQ ID NO: 14520

SEQ ID NO: 14969 - protein, 400 aa, Agrobacterium tumefaciens; identical to SEQ ID NO: 11569

SEQ ID NO: 14970 - protein, 418 aa, Agrobacterium tumefaciens; identical to SEQ ID NO: 11712

SEQ ID NO: 14971 - protein, 244 aa, Agrobacterium tumefaciens
VVVVTGGSTGIGFSVAKLFLEGGASTVYVTGRNSANLDAAVAKLGKGAIGFVSDVAKLSDLEQLKSRLEADGRKVDVLVANAGIAENNDLGETHEALYDRIFDINVKGVFYTVQTLLPVLRDGGSIVLTGSIVGNKGMERLSAYNASKAAVRSFARSFANDLKGRGIRVNTVSPGVTRTPIMENGLKMDDEKIAGFKAYLKDAAPIGRMADPDEIAEAVLFLASSKASYITGVELSVDGGLAQI

SEQ ID NO: 14972 - protein, 273 aa, Agrobacterium tumefaciens; identical to SEQ ID NO: 11715

SEQ ID NO: 14973 - protein, 305 aa, Agrobacterium tumefaciens; identical to SEQ ID NO: 11714

SEQ ID NO: 14974 - protein, 267 aa, Agrobacterium tumefaciens; identical to SEQ ID NO: 11713

SEQ ID NO: 14975 - protein, 56 aa, Agrobacterium tumefaciens; identical to SEQ ID NO: 14448

SEQ ID NO: 14976 - protein, 459 aa, Agrobacterium tumefaciens; identical to SEQ ID NO: 14463
  unsure (1)..(459): unsure at all Xaa locations

SEQ ID NO: 14977 - protein, 272 aa, Agrobacterium tumefaciens; identical to SEQ ID NO: 11488

SEQ ID NO: 14978 - protein, 372 aa, Agrobacterium tumefaciens
  unsure (1)..(372): unsure at all Xaa locations
VKAAILREMNMSRPYATSRPLAIEXIELAPPGPGEVLVRIRAAGLCHSDLSVNNGDRPRPMPMALGHEAAGVVEALGEGVRDLEPGDHVVMVFMPSCGHCLPCAEGRPALCEPGAAANAAGRLLGGATRLNYHGEVVHHHLGVSAFAEYAVVSRNSLVKIDRDLPFVEAALFGCAVLTGVGAVVNTARVRTGSTAVVIGLGGVGLAAVLGARAAGASKIVAVDLSQEKLALASELGATAIVNGRDEDAVEQVRELTSGGADYAFEMAGSIRALENAFRMTKRGGTTVTAGLPPPGAALPLNVVQLVGEERTLKGSYIGTCVPLRDIPRFIALYRDGRLPVNRLLSGRLKLEDINEGFDRLHDGSAVRQVIEF

SEQ ID NO: 14979 - protein, 264 aa, Agrobacterium tumefaciens; identical to SEQ ID NO: 11489

SEQ ID NO: 14980 - protein, 432 aa, Agrobacterium tumefaciens
ENGGIILFIDEMHTLVGAGKADGAMDASNLLKPALARGELHCVGATTLDEYRKHVEKDPALARRFQPVLVDEPNVEDTISILRGLKEKYEQHHKVRISDSALVAAATLSNRYITDRFLPDKAIDLMDEAASRLRMQVDSKPEELDELDRRIIQLKIEREALKQETDQSSVDRLRKLEDELADTEEKADALTARWQAEKQKLGHAADLKKRLDEARNELAIAQRNGQFQRAGELTYGIIPGLEKELAAAEARDSSGAGSMVQEVVTPDNIAHVVSRWTGIPVDKMLEGQREKLLRMEDELAKSVVGQGEAVQAVSKAVRRSRAGLQDPNRPIGSFIFLGPTGVGKTELTKSLARFLFDDETAMVRLDMSEYMEKHSVARLIGAPPGYVGYEEGGALTEAVRRRPYQVVLFDEIEKTHPDVFNVLLQVLDDGRL

SEQ ID NO: 14981 - protein, 331 aa, Agrobacterium tumefaciens
MRIARAATGRDKIVLFTGSYHGHSDPALHKATKLEYIRRGALLRSHPAWLVALKPLLKRMVLTKAVPGFSGVAPSSARDIVLLEYGNPRSIDYIRRHGDSLAGVLVEPVQSRNPELQPREFLHELRSVTEKTGSALIFDEMITGFRVAPGGAQSHFGIDADIATYGKIAGGGLPLSLIAGKGRFMDFVDGGAWAYGDSSFPKVAPTFFAGTYCRHPLALAAAKAVATRLLEDGPTLQEGLNARTQAFVERLNGALKGAGLPVAFMSFGSFFAISAARSRISPQAVTMLSFLLLTSGVHLRAGDRGGFLSTAHSDDDIAFVHDAVLQSLTAL

SEQ ID NO: 14982 - protein, 419 aa, Agrobacterium tumefaciens; identical to SEQ ID NO: 14809

SEQ ID NO: 14983 - protein, 262 aa, Agrobacterium tumefaciens; identical to SEQ ID NO: 14242

SEQ ID NO: 14984 - protein, 291 aa, Agrobacterium tumefaciens
RQALHGISGVPVTAYDADGEISFDITAEAYARVARAGIHNIVAAGNTGEFYALTPAEILTVYEAAIKGVDGIAPVTAAIGRSQREAIAMARTAKELGASAVMSHQPVDPFAAPQSQIAYFLGLAEDSALPLVAYVRADGFAVDDMVRLSSHPNVAGIKFATTDIMLLSRAIAASDADGALYICGLAESWAPAFAAVGARGFTSGLVNVAPHFSMQVHEALMAGDFDSARKIVEKIELFERLRTRYRNGANVTVVKEAMEIMGLAVGPVRAPGLVRLDAPDRALLENLLASW

SEQ ID NO: 14985 - protein, 472 aa, Agrobacterium tumefaciens
YIDGRFEDGEASFSSLDPATGQPWAEMPESREADIGRVVEAAHRALYEDTVWSKLTATQRGKLLYRLADLVAENAKTLAELETRDTGKIIRETSAQIAYVADYYRYYAGLADKIEGAYLPIDKPDMDVWLRREPVGVVAAIVPWNSQLFLAAVKIGPALAAGCTIVVKASEDGPAPLLEFARLVHEAGFPAGVVNVVTGFGASCGNALTTHPKVAHIAFTGGPETARHIVRNSAENLASTSLELGGKSPILVFADADLESAANAQVAGIFAATGQSCVAGSRLIIEKSVKDRFLQILAAKAEAIRIGSPLDMATEVGPLATERQRKHIVSLVSASVDAGAKVVTGGEPVEGEGYFYRPTILDCDGIRSPSLEKEFFGPVLSVVSFETEAEAISLANDTVYGLASGVFTQNLTRAHRLMKAIRAGIVWVNTYRAVSPIAPFGGFGLSGDGREGGLAAALDYTRTKTIWLRTSD

SEQ ID NO: 14986 - protein, 206 aa, Agrobacterium tumefaciens; identical to SEQ ID NO: 11796

SEQ ID NO: 14987 - protein, 633 aa, Agrobacterium tumefaciens
MAKVIGIDLGTTNSCVAVMDGKDTKVIENAEGARTTPSMVAFSDDGERLVGQPAKRQAVTNPTNTLFAVKRLIGRRYEDPTVEKDKALVPFEIVKGDNGDAWVKAQDKNYSPSQISAMILQKMKETAESYLGEKVEKAVITVPAYFNDAQRQAPRMPAASPGLDVLRIINEPTAAALAYGLDKKEGKTIGVYDLGGGTFDISVLEIGDGVFEVKSTNGDTFLGGEDFDMRLVEYLAGEFKKDQGIDLKNDKLALQRLKEAAEKAKIELSSSQQTEINLPFITADASGPKHLTLKLTRAKFESLVDDLVQRTVAPCKAALKDAGVTAAEIDEVVLVGGMSRMPKVQEVVKQLFGKEPHKGVNPDEVVAMGAAIQAGVLQGDVKDVLLLDVTPLSLGIETLGGVFTRLIDRNTTIPTKKSQTFSTAEDNQSAVTIRVSQGEREMAQDNKLLGQFDLVGLPPSPRGVPQIEVTFDIDANGIVQVSAKDKGTGKEQQIRIQASGGLSDADIEKMVKDAEANAEADKKRRAGVEAKNQAESLIHSTEKSVKEYGDKVSETDRKAIEDAIASLKTAVEAAEPDADDIQAKTQTLMEVSMKLGQAIYEAQQAEAGDASAEGKDDVVDADYEEIKDDKKSA

SEQ ID NO: 14988 - protein, 451 aa, Agrobacterium tumefaciens; identical to SEQ ID NO: 14329

SEQ ID NO: 14989 - protein, 380 aa, Agrobacterium tumefaciens; identical to SEQ ID NO: 14812

SEQ ID NO: 14990 - protein, 270 aa, Agrobacterium tumefaciens; identical to SEQ ID NO: 14524

SEQ ID NO: 14991 - protein, 338 aa, Agrobacterium tumefaciens; identical to SEQ ID NO: 11463

SEQ ID NO: 14992 - protein, 403 aa, Agrobacterium tumefaciens; identical to SEQ ID NO: 11431

SEQ ID NO: 14993 - protein, 337 aa, Agrobacterium tumefaciens; identical to SEQ ID NO: 11430

SEQ ID NO: 14994 - protein, 248 aa, Agrobacterium tumefaciens; identical to SEQ ID NO: 11514

SEQ ID NO: 14995 - protein, 444 aa, Agrobacterium tumefaciens
MLSSSNTPLTGPNDRQTSIAFFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMPYGAAASLSTPMTDNDMGDIVSVFDDFLVNLDRHAWEAA

SEQ ID NO: 14996 - protein, 318 aa, Agrobacterium tumefaciens; identical to SEQ ID NO: 14815

SEQ ID NO: 14997 - protein, 266 aa, Agrobacterium tumefaciens; identical to SEQ ID NO: 14314

SEQ ID NO: 14998 - protein, 195 aa, Agrobacterium tumefaciens; identical to SEQ ID NO: 14602

SEQ ID NO: 14999 - protein, 355 aa, Agrobacterium tumefaciens; identical to SEQ ID NO: 14336

SEQ ID NO: 15000 - protein, 351 aa, Agrobacterium tumefaciens; identical to SEQ ID NO: 11621

SEQ ID NO: 15001 - protein, 253 aa, Agrobacterium tumefaciens; identical to SEQ ID NO: 14604

SEQ ID NO: 15002 - protein, 469 aa, Agrobacterium tumefaciens
AMSAPRTLYDKIWDDHVVNRDPDGTCLLYIDRHLVHEVTSPQAFEGLRIAGRPVHSPTRTLAVVDHNVPTTADRLEGIKNEESRIQVEALAQNAKEFGVEYYSERDKRQGIVHIVGPEQGFTLPGMTIVCGDSHTSTHGAFGALAHGIGTSEVEHVLATQTLIQKKAKNMLVRVDGKLPESVTAKDIILAIIGEIGTAGGTGHVIEFAGEAIRSLSMEGRMTVCNMTIEGGARAGLIAPDETTFDYIKDKPRAPKGETLEQAIAYWKTLKSDEGAHYDKVVILDAANLPPIVSWGSSPEDVTSVEGIVPNPDDIEEENKRTSKWRALDYMGLKPGTRITDIAIDRVFIGSCTNGRIEDLRAAAKIVDGRKVASTVSAMIVPGSGLVKEQAEKEGLDKIFLDAGFEWREPGCSMCLAMNDDRLKPGERCASTSNRNFEGRQGYKSRTHLVSPAMAAAAAIAGHFVDVREW

SEQ ID NO: 15003 - protein, 261 aa, Agrobacterium tumefaciens; identical to SEQ ID NO: 11449

SEQ ID NO: 15004 - protein, 567 aa, Agrobacterium tumefaciens
VYTRALRYLTVHKWRVAVVVIANVILAAITIAEPVLFGRIIDAISSGTNVTPILILWAGFGVFNTVAYVAVAREADRLAHGRRATLLTEAFGRIISMPLSWHHLRGTSNALHTLLRASETLFGLWLEFMRTHLATFVALVLLIPTAMAMDLRLSFVLIGLGIVYWFIGKWVMGRTKDGQASVEEHYHSVFAHVSDSISNVSVLHSYNRIEAETKALKSFTEKLLSAQYPVLDWWAFASALNRTASTVSMMIILVIGTVLVKNGELRVGDVIAFIGFANLLIGRLDQMRQFVTQIFEARAKLEDFFVLEDAVKEREEPGDARELSNVSGTVEFRNINFGFANTKQGVHDVSFTAKAGETVAIVGPTGAGKTTLINLLQRVYDPDSGQILIDGTDISTVTKNSLRNSIATVFQDAGLLNRSIRENIRLGRETATDAEVVEAAAAAAATDFIDSRINGYLTQVGERGNRLSGGERQRIAIARAILKNAPILVLDEATSALDVETEARVKAAVDALRKNRTTFIIAHRLSTVRDADLVLFLDQGRIIEKGTFDELTQRGGRFTSLLRTSGL

SEQ ID NO: 15005 - protein, 469 aa, Agrobacterium tumefaciens; identical to SEQ ID NO: 11452

SEQ ID NO: 15006 - protein, 1151 aa, Agrobacterium tumefaciens; identical to SEQ ID NO: 14817

SEQ ID NO: 15007 - protein, 353 aa, Agrobacterium tumefaciens; identical to SEQ ID NO: 14606

SEQ ID NO: 15008 - protein, 354 aa, Agrobacterium tumefaciens; identical to SEQ ID NO: 14820

SEQ ID NO: 15009 - protein, 696 aa, Agrobacterium tumefaciens
APGAPGIDARWTSSAKNGVGTALSNTSPIWFTLSHGILNEVYYPRIDSACIRDLGLVVTRDDGYFSEEKRDCTSLTQPFESGIPAFHVTNTATDGAYRIEKQVITDPARACVLLHVSFSPLKGKMGDYRVSVLLAPHLVNAGNLNSAWIGDYEGRRVLFAVGRSRYLALVCDGPWRAASAGFVGVSDGWQQLRRHGRLIEEFQRADDGNVSLAAEIDFSDAHDTATLALGFGQTEYEAASCAVASLKSGFRRAHDAYIANWRGWQDSLCPLDRDTHHGVNSYRVSTAVLAAHRAADRPGAVVASLSIPWGASKGDDDLGGYHLIWPRDLVEAAGGFLAAGDHDEALAILDYLRQVQQPSGRWPQNLWLDGKPYWPGVQMDECAFPILLADMLHRHGHLDHAARADYMPMIRSAAAYILANGPTTGEDRWEEDAGYSPFTLAVEIAALLAAADLLDMEGDAAEATHLRQTADCWNEQIERWTFAGDQTMCAQLGISGHYVRIASPGTTDAVQLSGMTPILNQTPDRAFLPTSDVISPDALALVRFGLRAPDDPHILATVKAIDHCLRAELPQGPVWYRYTGDGYGEHADGTAFDGTGQGRPWPLLTGERAHYELAAGRRGAAEALLTTMEKSAGQSGLFPEQVWDQPDLPDRELFYGSPSGSAMPLVWAHAEHIKLLRSLADGSVFDMPPQGVERYI

SEQ ID NO: 15010 - protein, 450 aa, Agrobacterium tumefaciens; identical to SEQ ID NO: 11399

SEQ ID NO: 15011 - protein, 298 aa, Agrobacterium tumefaciens; identical to SEQ ID NO: 11397

SEQ ID NO: 15012 - protein, 252 aa, Agrobacterium tumefaciens; identical to SEQ ID NO: 11406

SEQ ID NO: 15013 - protein, 430 aa, Agrobacterium tumefaciens; identical to SEQ ID NO: 11405

SEQ ID NO: 15014 - protein, 508 aa, Agrobacterium tumefaciens; identical to SEQ ID NO: 14824

SEQ ID NO: 15015 - protein, 388 aa, Agrobacterium tumefaciens; identical to SEQ ID NO: 14257

SEQ ID NO: 15016 - protein, 552 aa, Agrobacterium tumefaciens; identical to SEQ ID NO: 14526

SEQ ID NO: 15017 - protein, 574 aa, Agrobacterium tumefaciens
MKKVLIANRGEIAVRIIRACRDYGLQSVAVYADPDQDALFVRLADEAYALEGVRPAETYLDISKLIAIAKRAGADAVHPGYGFLSERAEFAQAVIDAGLIWIGPDPDVIEALGDKVMARRIATGVGAPLVAGSDGPVSSAAEVTAFAEQHGLPVAIKAAHGGGGRGLKVAWKMEEIAELYESAVREATVAFGRGECFLERFLDRPRHIEAQVIADKHGNVLVLGTRDCSLQRRNQKLIEEAPAPFLSDEQRQKIHDAAKAICAAAGYSGAGTVEFLLGVDGTISFLEVNTRLQVEHPVTEETTGIDLVIEQFRIAEGHKLRVLETPEPRGHSMEFRINAEDPGRGFLPTPGLISVFDAPSGPGIRMDSGVISGSSIPGVFDSLMAKLIVTGVDRDQVLRRARRALREFRIEGIATVLPFHRAAIETEDFIGTDGFKVHTRWIETDFAAMPDAMERPAPADDPSITRTYLEIDGKRVSVGLPSILLSSLGTVSGGNASAPSAAVEKKEGEMTAPVSGTLQSFKVKDGETVSEGDLLAVMEAMKMETQIVATRAGKVRLIVKEGDYLQAGATLIDI

SEQ ID NO: 15018 - protein, 569 aa, Agrobacterium tumefaciens; identical to SEQ ID NO: 11630
  unsure (1)..(569): unsure at all Xaa locations

SEQ ID NO: 15019 - protein, 243 aa, Agrobacterium tumefaciens; identical to SEQ ID NO: 11631

SEQ ID NO: 15020 - protein, 406 aa, Agrobacterium tumefaciens; identical to SEQ ID NO: 14832

SEQ ID NO: 15021 - protein, 478 aa, Agrobacterium tumefaciens
VFQARNVEKVFPGVRALKGVNLSLQPGSIHALLGENGAGKSTLIKVVTGVHHQSSGQILVDGQAVRFSNPREAIARGIGVVHQERNLIPRFSIAENIHMEKLGAHYLKPIDYAALNRDARRWLEALNLEIDPATPVSELSVAQMQLVEIAKALSLQSRVLLLDEPTTSLTPSETDNLFRILRRLRDDGASLVFVSHKLEEVLDICDRVTVLRDGENACESRSMEGLGRQDLVRLMIGRAESGGGWRKRAVEHNPMVLELEGVSTAIGHGDVSLSVRKGEIVGLYGLVGAGRTELAKSIMGKFAVTSGNVRVSGRPARIRSVAEAIHDYGVGYVSEDRKGDGLILQHSVLANAGVPIWRKLSNTFGVLSDGRIRAAVTPFLKKLEVKTPSLSQTVGNLSGGNQQKISVAKWLAADVKLLIVDEPSVGIDIKTKAYLHDLLRELADNGTAILVITSDMPEMVALADRIVVMDQYRVKGIV

SEQ ID NO: 15022 - protein, 248 aa, Agrobacterium tumefaciens; identical to SEQ ID NO: 14211

SEQ ID NO: 15023 - protein, 328 aa, Agrobacterium tumefaciens
MQMRKLGESGLFVSELCFGAMTFGGTDGLWGKVGRLDQEDADALVKAALEAGINLFDTANVYAHGRSEEILGRSLKNLGVSRSDVVIATKVASAMGDGPNHRGASRGHIISECRASLGRLGLDHIDLYQIHAFDSATPIEETLEALDTLVRAGDVRYIGLSNWAAWQIMKAIGITRARALAPITSLQAYYTLVGRDLEREIGPLLSSERVGLMVWSPLAGGYLTGKYSAGGNAAGGRQTELDFPPIDRIRGEPLIAVLKAVAEKHGSSPAQIAIAWLLKQKVVSTVIIGAKRVEQLQENIRSASIELDDNDMAKLDEVSRLPVEYPGW

SEQ ID NO: 15024 - protein, 232 aa, Agrobacterium tumefaciens
VTGASRGIGAAIAIALAEKGADVAITYERAADRAAQVVATIEGKGRKALAIQADSMDPEAVKRSVDQAAQALGGLDILVNNAAIAIYKDVADFTVAEIDALFAVNARSPILASQAAMPYLGKGGRIVTIGSAGAERIVGPSTVYSMTKSALQSFTRGLARELGPRDITVNLIQPGSTNTEMNPAEGEFGDFQRALIPLGRYGEPEDVAAAVAFLASGAARQITGTILTVDGG

SEQ ID NO: 15025 - protein, 211 aa, Agrobacterium tumefaciens; identical to SEQ ID NO: 14421

SEQ ID NO: 15026 - protein, 386 aa, Agrobacterium tumefaciens; identical to SEQ ID NO: 11517

SEQ ID NO: 15027 - protein, 479 aa, Agrobacterium tumefaciens; identical to SEQ ID NO: 11516

SEQ ID NO: 15028 - protein, 443 aa, Agrobacterium tumefaciens; identical to SEQ ID NO: 11613

SEQ ID NO: 15029 - protein, 380 aa, Agrobacterium tumefaciens; identical to SEQ ID NO: 11614

SEQ ID NO: 15030 - protein, 465 aa, Agrobacterium tumefaciens
KFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSI

SEQ ID NO: 15031 - protein, 398 aa, Agrobacterium tumefaciens; identical to SEQ ID NO: 14851

SEQ ID NO: 15032 - protein, 342 aa, Agrobacterium tumefaciens
GLSRKSRLRALAPREGIDFTSNDYLGLAEAPRLKAAIAHAIGKGVPVGAGGSRLLRGNHPEHEALESEAAAFFGAEKAIYFGSGFAANVALFSTLPLRDDIVLHDALIHASVHDGIAAGKAKAVAVPHNEVEAFQREIIRWRQAGGSGRPWIAVESLYSMDGDCAPLAALADLAERHGGFLVVDEAHATGVFGPGGRGLAAQLEGRSNVLALHTCGKALGASGALLSLPAVLADYLVNRARGFIYSTAPSPLMAAAVREALRIVADEPSRRSRLAELVGFAGEELQSQLGVTPSGSQILPVMIGDNARSLKIAARLSQGGFDVRAIRPPTVPEGTGRLRIAI

SEQ ID NO: 15033 - protein, 318 aa, Agrobacterium tumefaciens
GFGHAVPARCVDNAEIEASLGLEAGWIERRTGIRSRYWAEAGDTLSGLAERAGRMALEDAKINADDIALTLLATSTPDHLLPPSAPLLAHRLGLTRSGAIDLAGACSGFLYALTLADGFVRTYGRAVLVVAANILSRRINPAERASAVLFADAAGAVVLTPCPEVKRGVLSADLVADGSGYDLIQIAAGGSSQPFSAGMIAEDALMTMRDGREVFSRAVALMTNTSQRVLHEAELTAADISRFVPHQANARMSDAVCGNLGIEREKTVRTIGSFGNSSAATIPLSLSITNAERPLAGGETLLLTAAGAGMTGGAVVYR

SEQ ID NO: 15034 - protein, 306 aa, Agrobacterium tumefaciens; identical to SEQ ID NO: 11370

SEQ ID NO: 15035 - protein, 280 aa, Agrobacterium tumefaciens
VLVDCQNVWKIFGARASTAVKAVARGGLSKKQVLEDFDCVVGVCDASLQVHRGEIFCIMGLSGSGKSTLIRLLNRLIEPSLGKITVKGKDIARLNAAELRELRARNIAMVFQSVALLPYRTVLENAGFSLEVRGVAKDERNRIARAALEKVGLADWTSRYPHELSGGMQQRVGLARALAADPEIILMDEPFSALDPLIRRQLQDEFRQLTKSLGKSAVFITHDLEEAIRIGDRIAIMKDGVIVQVGTAEEIVTKPADDYVSDFVAGISRIHLVKAHTVMQ

SEQ ID NO: 15036 - protein, 482 aa, Agrobacterium tumefaciens
ASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVLRCVLPRNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDV

SEQ ID NO: 15037 - protein, 294 aa, Agrobacterium tumefaciens; identical to SEQ ID NO: 11364

SEQ ID NO: 15038 - protein, 927 aa, Agrobacterium tumefaciens; identical to SEQ ID NO: 11365

SEQ ID NO: 15039 - protein, 850 aa, Agrobacterium tumefaciens
DKEYQMMRNASIAVLREIGVETGGSNVQFAVNPKDGRLVVIEMNPRVSRSSALASKATGFPIAKVAAKLAIGYTLDELENDITGGATPASFEPSIDYVVTKIPRFAFEKFPGASPILTTAMKSVGEVMAIGRTFAESLQKALRGMETGLTGLDEIEIPGYEEGEGSKNAIRAAIGTPTPDRLRMVAQAMRMGMSEEEVHENSKIDPWFIAQLKAIVDMEARIREHGLPQDAENLRMLKAMGFSDARLASLTSKRPKEVAELRNSLNVRPVFKRIDTCAAEFASPTAYCIRPMRRPSSGAARSEAQVSDRKKVVILGGGPNRIGQGIEFDYCCCHAAFALKDAGFEAIMINCNPETVSTDYDTSDRLYFEPLTAEDVIEIMRAEQEKGELVGVIVQFGGQTPLKLAEALEKNGIPILGTAPDMIDLAEDRDRFQKLLMKLDLAQPNNGIAYSVEQARLVASEIGFPLVVRPSYVLGGRAMQIIHSEGQLQTYLLDTVPGLVPEDIKQRYPNDKTGQINTLLGKNPLLFDSYLTNAVEVDVDALCDGENVFVSGIMEHIEEAGIHSGDSACSLPSRSLSKETLDELERQTTALAKALKVGGLMNVQYAIKDGTIYVLEVNPRASRTVPFVAKTIGAPIAKIAARVMAGEKLDAAIAAYGEKPDPRNLKHIAVKEAVFPFARFPGVDILLGPEMRSTGEVIGLDTDFALAFAKSQLGAGVDLPRSGTVFVSVRDEDKEGVLSAIRILVESGFKVLATGGTQRFLAEQGINAEKINKVQEGRPHIEDAIRNRQVQLVINTTDSNKAISDSKSLRRATLMQKVPYYTTMAGAEAAALAIKALKAGNLEVKPLQSY

SEQ ID NO: 15040 - protein, 263 aa, Agrobacterium tumefaciens; identical to SEQ ID NO: 14610

SEQ ID NO: 15041 - protein, 308 aa, Agrobacterium tumefaciens
VFAGNSNRHLAEAICKYLNVPLGNATVKRFADQEIFVEISENVRGEDVFIVQSTSFPANDHLMELLIMIDAMRRSSAKRITAVLPYFGYARQDRKAGPRTPISAKLVANLITEAGADRVLTLDLHAGQIQGFFDIPTDNLFAAPILARDVKDHYDTNNVMVVSPDVGGVVRARALSKRLDCLLAIVDKRRDRPGESEVMNVIGDVSGKDCILIDDIIDSGGTLCNAAEALLKKGATSVTAYITHGVLSGGAVARVASSKLRELVITDSIQPTTGVQSAHNIRVVSTAGLLGEAINRTAQEQSVSGLFD

SEQ ID NO: 15042 - protein, 240 aa, Agrobacterium tumefaciens
GTTGEGCSVGSRERQAILSSFIAAGIAPSRIVTGVLVDSIEDAADQSAEALNAGARNILLAPPSYFKNVSDDGLFAWFSAVFSKIGKDARDILVYNIPSVTMVTLSVELVGRLKAAFPGIVTGVKDSSGNWSHTERLLKEHGDLAILIGDERDLARGVRLGGQGAISGVANFLTQEVRAMAVDGKDDPRIVDLVVELLKFPVTPAVKVLVSHTTGETIWSDVRAPLVAISPEDRRQIEGA

SEQ ID NO: 15043 - protein, 405 aa, Agrobacterium tumefaciens; identical to SEQ ID NO: 11584

SEQ ID NO: 15044 - protein, 212 aa, Agrobacterium tumefaciens
EFASPYMQKLKEFLLAEKTAGKRIFPKGAEYFRALDLTPLDEVKVVILGQDPYHGLGQAHGLCFSVQPGVRIPPSLVNIYKELQSDLGIRPVKHGFLESWAKQGVLLLNSVLTVEEARAASHQGQGWEKFTDAVIRAVNDECDHVVFLLWGSYAQKKAAFVDQRKHLVLRSPHPSPLSAHNGFFGNGHFSKANAFLVSHGRDPIDWQLPDVV

SEQ ID NO: 15045 - protein, 337 aa, Agrobacterium tumefaciens; identical to SEQ ID NO: 11586

SEQ ID NO: 15046 - protein, 158 aa, Agrobacterium tumefaciens
MGVSGSGKSTVAEGLAEKLGIAFIEGDKLHPKSNVDKMSEGIPLTDDDRWPWLDLIGAELRNGSEGKGVLVSCSALKKIYRDRLREATGGPLAFVYLDGSLELLSRRMGERKGHFMPLSLLQTQLATLEVPTGEPGVVTVSIDSTPEEIVANALAGLK

SEQ ID NO: 15047 - protein, 573 aa, Agrobacterium tumefaciens; identical to SEQ ID NO: 11795

SEQ ID NO: 15048 - protein, 257 aa, Agrobacterium tumefaciens; identical to SEQ ID NO: 11794

SEQ ID NO: 15049 - protein, 239 aa, Agrobacterium tumefaciens; identical to SEQ ID NO: 14611

SEQ ID NO: 15050 - protein, 316 aa, Agrobacterium tumefaciens; identical to SEQ ID NO: 14167

SEQ ID NO: 15051 - protein, 512 aa, Agrobacterium tumefaciens; identical to SEQ ID NO: 14356

SEQ ID NO: 15052 - protein, 248 aa, Agrobacterium tumefaciens
NLFDLSGRRALITGSSQGIGFALAQGLSEAGAEVVLNGRDEAKLKAAAAGIKGARTLAFDATDHGAVREAIDRFEAEVGAIDILVNNAGMQHRTPLEDFPADAFERLLQTNIASVFHVGQATARHMISRGRGKIINIASVQTALARPGIAPYTATKGAVGNLTKGMATDWAKYGLQCNAIAPGYFDTPLNAALVADETFSAWLEKRTPAGRWGKVEELVGACIFLSSDASSFVNGHILYVDGGITASL

SEQ ID NO: 15053 - protein, 408 aa, Agrobacterium tumefaciens
YLSRFQPARMKATIVPLVFVLAILPFSWIAALVLLLAMPTIPLFMALIGWQAKAASEKQLAETGNINAFLLDRLRGLETIRTLKAVDLTAARLDADAQNLKKRTMAVLRIAFLSSAVLELFAAIGVAMTAVYIGFHLLGFLDFGAWGEKLTLAEGLFILLLAPAFFEPLRELSAVWHDRAAGEASLNALATLTAGGAAIVGEGADVVRAPSSTPGLLEMENLSFAYPNAPPVIRNFNLTVQQGERVAILGASGCGKSTILSLIAGLAEAGEGVIRIGGVTLDDATADGLRGTIGWVSQKPFFFAASMKANIGFGRLAVSEAMVEEVLHRTGLDGLTQARRHLQIGDGGNGISGGEAVRLAIARAFADPATQLVLADEPTAHLDRETAALVTDNLLQLAKGRTLIVATH

SEQ ID NO: 15054 - protein, 338 aa, Agrobacterium tumefaciens
VAHGAKDVRIEDRPEEKPGPGEVRLRLARGGICGSDLHYYNHGGFGAVRLREPMVLGHEVSAVIEELGEGVEGLKIGGLVAVSPSRPCRTCRFCQEGLHNQCLNMRFYGSAMPFPHIQGAFREILVADALQCVPADGLSAGEAAMAEPLAVTLHATRRAGDLLGKRVLVTGCGPIGILSILAARRAGAAEIVATDLSDFTLGKAREAGADRVINSKDEPDALAAYGANKGTFDILYECSGAAVALAGGITALRPRGIIVQLGLGGDMSLPMMAITAKELDLRGSFRFHEEFATGVELMRKGLIDVKPFITQTVDLADAISAFEFASDRSRAMKVQIAF

SEQ ID NO: 15055 - protein, 242 aa, Agrobacterium tumefaciens; identical to SEQ ID NO: 11675

SEQ ID NO: 15056 - protein, 292 aa, Agrobacterium tumefaciens
MRAFVIGNIALDETYSIAALPQAGASIFGEQASRSLGGKGCNQAIVLARCGVETTLVAAVGTDDRAIAIGKSLTREHLTPKLIPVDSATSDISIILTTPDGENSIITTRSAAAALDRDAALDALGDTVSGDLVILQGNLSEETTLVILNAARSKGLTTAFNPSPLQPWFASILPLIDIAVLNRIEAEALTGESGAGAGAFLLRAGVGLVIITLGGQGCVLVSANGAIEVAAAPATIVDTTGAGDCFTGVALASAIRRGVAIDARALEDASRAAAITVGRRGTQDAFPSHEEM

SEQ ID NO: 15057 - protein, 312 aa, Agrobacterium tumefaciens; identical to SEQ ID NO: 11670

SEQ ID NO: 15058 - protein, 523 aa, Agrobacterium tumefaciens
RDLALQGLRVLLVERNDFSSGCSAAPSRMIHGGLRYLENGEFGLVAESLRERDALLTLAPHMVQPLPTTIPIFSMFSGLFNAAATFFGSGGKPASRGALAIKAGLTLYDFVTRKNRLLPRHEFRGAGKTLKRWPGLTPDIRYSATYYDAWISQPERLALELLIDTSADAPQSIALNYAELVRNGDEYHIRAEETDETLPIRPRIIVNATGAWIDETIGTLSAGPAAEKQKPTVSGTKGSHLIIANDGLLKALNGHMIFFENADNRVCILFPYLGRVLAGSTDIKVDRPERVRCEPDERDYILDAIRQVFPDITVDHSDIVFSFSGIRPLPRSDAAFTGRISRSHFIHRVAGDPPQLCMIGGKWTTFRAFGEQVSDEVLAFLGRKRLTGTMNRPIGGGRNFPTGAGRLPALLSEQFSIDRRRAQHLALAYGSRAFELMGFCRGRPDDAPLSQKSPITAAEILWLIRCEHVRHLTDLILRRTTLAIAGLIDADLIDAILGVAARELGWTPTRAAVERQQLTQELE

SEQ ID NO: 15059 - protein, 489 aa, Agrobacterium tumefaciens; identical to SEQ ID NO: 11598

SEQ ID NO: 15060 - protein, 389 aa, Agrobacterium tumefaciens; identical to SEQ ID NO: 14615
  unsure (1)..(389): unsure at all Xaa locations

SEQ ID NO: 15061 - protein, 384 aa, Agrobacterium tumefaciens
KPKLLIADEPTTALDVTIQGQILDLIKQLQEEEGMSVLFITHDMGVVAEVADRTIVMFRGDVVETGTTDDIFHRGQHPYTRALLSAVPKLGSMRSRLLPARFPIIDIKTGESPPVVETKDTVSGGKTPILSVKDLTTRFDIRSGLFGRKSGAVHAVEKVSFDLAEGETLSLVGESGCGKSTTGRSITRLIEPTSGNVTLDGYEVLKLDRTTLRTMRRSVQMVFQDPFASLDPRMSVGTAIMEPFMEHRLGQKAQAREKAADLLEKVGLSPDMMKRFPHEFSGGQRQRIAIARSLMLDPKVIVADEAVSALDVSIKAQVCNLLLDLQQSLNLAFLFISHDMAVVERVSHRVAVMYLGEIVEIGPRAAVFDNPQHPYTKKLMSAVP

SEQ ID NO: 15062 - protein, 368 aa, Agrobacterium tumefaciens; identical to SEQ ID NO: 11664

SEQ ID NO: 15063 - protein, 270 aa, Agrobacterium tumefaciens
GAPAIFIDQVARCGGTAGIIAAVGDDDFGRLNIERLRRDGVDVSAITTIADRPTGSAFVRYRENGARDFVFNIAHSAASETRMTDEAQALIEKAGHVHIMGSAFAIAGIGAIILEAVKSVKARGGSVSFDPNIRKELAQGDEGRRLIDDLLAVTDLLLPSGEELQAASGLDDEEAAIEKLLAAGIGEIVLKRGANGASHFSRAHGRIDAPGLEVEEIDPTGAGDCFGATYLTCRRLGMRPGKALVYANASGAHNVTKRGPMEGAASLAEL

SEQ ID NO: 15064 - protein, 311 aa, Agrobacterium tumefaciens; identical to SEQ ID NO: 11667

SEQ ID NO: 15065 - protein, 248 aa, Agrobacterium tumefaciens
NKVALITGAARGIGLGFAQAFAAEGAKVIIADIDIARATTSAAAIGPAAKAVKLDVTDLAQIDAVVKAVDEEFGGIDILVNNAAIFDMAPINGITEESYERVFDINLKGPMFMMKAVSNVMIARARGGKIINMASQAGRRGEALVTLYCASKAAIISATQSAALALVKHGINVNAIAPGVVDGEHWEVVDAHFAKWEGLKPGEKKAAVAKSVPIGRFATPDDIKGLAVFLASADSDYILAQTYNVDGG

SEQ ID NO: 15066 - protein, 306 aa, Agrobacterium tumefaciens; identical to SEQ ID NO: 11780
  unsure (1)..(306): unsure at all Xaa locations

SEQ ID NO: 15067 - protein, 504 aa, Agrobacterium tumefaciens
  unsure (1)..(504): unsure at all Xaa locations
RFSRFSVKFDDLLMDYSKCAVNEEIVTLLEQLAREGGVEAKREEMFSGKAINFTEDRAVLHTALRNRSNTPVLVDDKDVMPDVNGVLAAMGKFADAIRSGSLKGATGKKITDVVNIGIGGSDLGPVMATLALAPFHDGPRAHFVSNIDGAHIADTLKLLDPETSLFIIASKTFTTIETMTNAATARRFIAEKLGEGAVKHHFAAVSTALDKVAAFGIESDRIFGFWDWVGGRYSIWSAIGLPLMIAIGPDNFGKFLDGAHAMDRHFREAPIRENLPMLLGLIGFYNRNVLDYPTRAILPYDQRLSRLPAYLQQLDMESNGKGATIDGTPDECQSGPVDXCEPGTNGQHAFYQLIHQGTSVIPAEFMIAANGFEPELRHQHQLLIANCLAQSEALMKGRTLAEAKAQLTSKGMEDSQADFIAPHRVFTGNRPSITFVYDKLTPFALGRLIALYEHRVFVEGVLFRINSFDQWGVELGKELATGLLPVVEGKESAAGHDSSTQGLV

SEQ ID NO: 15068 - protein, 551 aa, Agrobacterium tumefaciens
WLASYPPGVPSEIPASANASLIDLLEKSCKQFADRKAFSSMGKSLTYRELDADTRAVAAWLQSRGLEKGDRVAVMMPNILQNPVAVYGILRAGMVVVNVNPLYTPRELEHQLKDSGAKALFVLENFAHVAQQAVPKTAVRHVVVAAMGDLLGLKGHIVNLVVRKVKKLVPAHAIPGSISFKAMLKEGQGVSLKPVGLTAQDIAFLQYTGGTTGVSKGAVLTHANLLANKAQISLWLDAAFNGRKDRPEVLNFICALPLYHIFALTVNSLMGIALGGHNLLIANPRDIPGFVKELSHYQPHIFPGLTTLFNALMNNEEFRKLDLSSLIFVLGGGMAVQRPVAERWVSVVGCPITEGYGLSETSPVATVNRLDAAEFSGTIGLPISSTEIDIRDEDGNSLPTGEVGEICIRGPQVMAGYWQRPDETAKAITADGFFRSGDMGFMDERGYTKIVDRKKDMILVSGFNVYPNEVEEVAASHPGVLECAAIGVPDEHSGETVKLFVVKKDQSLTEAELKAFCAKNLTNYKRPKIIEFRTDLPKSNVGKILRRELRN

SEQ ID NO: 15069 - protein, 392 aa, Agrobacterium tumefaciens; identical to SEQ ID NO: 11600

SEQ ID NO: 15070 - protein, 226 aa, Agrobacterium tumefaciens; identical to SEQ ID NO: 11705

SEQ ID NO: 15071 - protein, 133 aa, Agrobacterium tumefaciens; identical to SEQ ID NO: 11706

SEQ ID NO: 15072 - protein, 260 aa, Agrobacterium tumefaciens; identical to SEQ ID NO: 14279

SEQ ID NO: 15073 - protein, 532 aa, Agrobacterium tumefaciens
TGGQLIVEALKANGVSRVSCVPGESYLAVLDALYESGIETVVCRQEGGAAMMADTWGRLTGEPGICMVTRGPGATNASAGLHIARQDSIPMILFIGQVQREAREREAFQEVEYRRAFTEFAKWVGEIDDARRIPEFVTRAFAVATSGRPGPVVLTLPEDMLVEEVEAPEAKPYMPVEAHPGPSQMTAFAKMLGEAKRPIFIIGGTRWSEESVATFRAFAENHKLPVGCSFRRQMLFDHLSPSYAGDVGIGINPALAKEIKESDLVVLLGGRLSEMPSSGYTLIDIPYPSQKLIHIYPEAEELGRVYRPDLAICAAPDDFVAVLSSLTLSGSAAWAERTAAMHAAYLAWSTPPQTGPGTVQMGPIMDWIEANVADDAIFTNGAGNYATWLHRFHRFRRYNTQSAPTSGSMGYGLPAAVAAKHLFPEREVICFAGDGCFMMHGQEFITAVRYGLPIITVLVNNGTYGTIRMHQEREYPGRVSGTDLVNPDFNAFAKAYGGHGETVERTQDFAAAFERARASGKPGIIEVKLDPE

SEQ ID NO: 15074 - protein, 370 aa, Agrobacterium tumefaciens; identical to SEQ ID NO: 14184

SEQ ID NO: 15075 - protein, 416 aa, Agrobacterium tumefaciens
KDWARRPLEDRVQLVLKGVARLNEMVAEVVPELAHMMGRPVRYGGEFRGFNERSNYVASIAADALAPLVIEESGNFERRIEREAHGVVFVIAPWNYPYMTAINTVAPALMAGNTVVIKHAAQTLLVGERMVRAFVEAGVPEDVFINVFLDHGTTSTLISEGLFNFVNFTGSVEGGRAIERAAAGTFTGLGLELGGKDPGYVMEDADLDAAVDTLMDGGTYNSGQCCCGIERIYVNENLYDEFVEKSVAWVSNYKLGNPLEQETTLGPMANKRFAKVVRAQIADAVSKGAKALVDPKLFPADDGESAYVAPQILVNVDHSMEFMTEETFGPAIGIMKVKNDDEAIALMNDSKYGLTASLWTQDAARAARIGREIETGTVFMNRADYLDPALCWTGVKETGRGGSLSVLGFQNLTRPK

SEQ ID NO: 15076 - protein, 325 aa, Agrobacterium tumefaciens; identical to SEQ ID NO: 14625

SEQ ID NO: 15077 - protein, 490 aa, Agrobacterium tumefaciens
FRIGRIDDRLYSAFIEHMGRAIYGGIYEPGHPQADANGFRKDVLKFVQDLKIPAIRYPGGNFVSAYRWEDGIGPRDQRPIRLDLAWRSKETNQIGINEFADWAQMAGIEMMLAVNLGSRGLDDARNFLEYVNFPGGTALSDLRRSHGTEKPHGVKMWCLGNEMDGPWQIGHKTAVEYGRLANETAKAFKGFDPTIEAIVCGSSNDGMPTYPEWEREVLEECYENVDHISLHKYFGNNSRDTLNYFGKIEETGRYIQTIAGVIDYVKAKKRAKNDVSICFDEWNVWYHIREDDGKRIKSWDWPEAPALLEETYNFEDALFVAGLLNEFIRRSDRVRIACIAQLVNVIAPIRAEKNGPAWRQTIYYPYQFASLYGRGVALNVAVDCPTYDCNAADDVKYLDVAGVYDEAEGMVTLFVLNRHLTEAADINVGLTGFSSATLDLHLAMAGYDLRVGNGPDQPDRVVPVPGSGVGVEDGALKGSVSALSYHVLRL

SEQ ID NO: 15078 - protein, 176 aa, Agrobacterium tumefaciens; identical to SEQ ID NO: 14373

SEQ ID NO: 15079 - protein, 418 aa, Agrobacterium tumefaciens; identical to SEQ ID NO: 14293

SEQ ID NO: 15080 - protein, 453 aa, Agrobacterium tumefaciens; identical to SEQ ID NO: 14294

SEQ ID NO: 15081 - protein, 293 aa, Agrobacterium tumefaciens
MTAPFKNIGVIGAGQMGCGIAHVSAIAGYRVHIYDLSKEGIEAGLATINGNLARQVTNNKLSDDARKQALALISGSTDVNDLAPMDIVIEAATENEEIKRKIYAQVCPVLKPEALLATNTSSLSITRLASATDRPEQFMGIHFMNPVPVMKLVELVRGIATNEKTFDAAKAYVRTLEKAITVAEDFPAFIVNRILLPMINEAIYTLYEGVGSVEAIDTAMRLGANHPMGPLQLADFIGLDTCLSIMQVLHDGLSDSKYRPCPLLVKYVEAGWLGRKSGRGFYDYRGETPVPTR

SEQ ID NO: 15082 - protein, 291 aa, Agrobacterium tumefaciens; identical to SEQ ID NO: 11589

SEQ ID NO: 15083 - protein, 264 aa, Agrobacterium tumefaciens; identical to SEQ ID NO: 11740

SEQ ID NO: 15084 - protein, 273 aa, Agrobacterium tumefaciens; identical to SEQ ID NO: 14470

SEQ ID NO: 15085 - protein, 273 aa, Agrobacterium tumefaciens; identical to SEQ ID NO: 14202

SEQ ID NO: 15086 - protein, 256 aa, Agrobacterium tumefaciens; identical to SEQ ID NO: 14282

SEQ ID NO: 15087 - protein, 592 aa, Agrobacterium tumefaciens; identical to SEQ ID NO: 14543

SEQ ID NO: 15088 - protein, 442 aa, Agrobacterium tumefaciens
DTVLIANRGEIAARIQRACHELGLKTVAICSEADRGASYVQTADSFLCIGPSAAGKSYLNKDAILLAARLTSSGAIHPGYGFLSENTAFSDAVEKAGLVFIGPGASSIATMGDKIAAKRAMIAAAVPCVPGPDTALPDDPAAVESIAQEIGYPVIVKAAGGGGGRGMRVVPDAGSLHEAIPTTREEARQAFGSPALYMEKFLQHPRHIEIQVLCDTHGHAVWLGHRDCSMQRRHQKVVEEAPAPGISPDVIRSVGQACVEACQQIGYRGVGTFEFLYENGAFYFIEMNTRLQVEHPVTEMTSGIDIVQAQIRAAQGEELVLRQQDVKCEGHAFECRINAEDPQTFLPSAGVVTGLAWPQGQGIRVDTHIHGGYRVSPYYDSLVAKLIVHAPTRSEAMAKMREALAGTSIEGISTNLPFLRALFEDDAFVCGETDIHYLEKWL

SEQ ID NO: 15089 - protein, 302 aa, Agrobacterium tumefaciens; identical to SEQ ID NO: 11708

SEQ ID NO: 15090 - protein, 273 aa, Agrobacterium tumefaciens; identical to SEQ ID NO: 14407

SEQ ID NO: 15091 - protein, 268 aa, Agrobacterium tumefaciens; identical to SEQ ID NO: 14408

SEQ ID NO: 15092 - protein, 404 aa, Agrobacterium tumefaciens
RTLGLSALGGALEFYDFIIFVFFATVIGHLFFPPEMPDWLVMIQTFGIFAAGYLVRPLGGIVLAHYGDRYGRKRVFAFSILLMALSTLGMALMPTYATIGVAAPILLIILRMLQGAAIGGEVPGAWTFVAEHVPFRRVGLACGFLTSGLSFGIMLGSLIAFAINSLFTPEDVAGYAWRIPFLLGGVFGLIAVYLRRWLEETPIYMEMKKSKSLTDKLPLGLVLKHHRRGVIISALLTWVLSAAIVVTTLMTATFLQKLYGYTPTQALAGTSFGTLFLIFGVIIAGALIDRVGSGIFFMGASIFFGIATFTFYSYAGTSLETMFVLYGVMGLSVGMAGAVPYVMVRAFPASVRFSGLSFAYNVSYAVFGGLTPIGVTTALAINPMAHAWYLVFIAFLAFAIGLYL

SEQ ID NO: 15093 - protein, 290 aa, Agrobacterium tumefaciens; identical to SEQ ID NO: 11565

SEQ ID NO: 15094 - protein, 405 aa, Agrobacterium tumefaciens
AKAASRPLSIAGTDQKNRALLAMASAIEASKEAILAANRKDLAAAESAGLAASFVDRLTLNDARIAGIAEGIRSVAALADPVGEVIAAWDRPNGLKIERVRTPLGVIGVIYESRPNVTADAGALCLKAGNAVILRGGSDSQHSSRAIHACLVQGLRIAGLPENAIQLVPVTDRAAVGALLSGLKGTVDVIVPRGGKSLVARVQSEARVPVFAHLEGICHIYVDKSADLDMAKAIVVNAKMRRTGICGAAETLLVDASAVSSHLEPVVKALLDAGCEVRGSQPVRNVVEGLEAATEEDWRTEYLDAIISVAVVDGISGAIEHIGTYSSNHTEAVIAEDPDVVARFFNELDSAILLHNASTQFADGGEFGMGAEIGIATGKMHARGPVGVEQLTSFKYRVHGTGQTR

SEQ ID NO: 15095 - protein, 241 aa, Agrobacterium tumefaciens; identical to SEQ ID NO: 11456

SEQ ID NO: 15096 - protein, 393 aa, Agrobacterium tumefaciens; identical to SEQ ID NO: 11455

SEQ ID NO: 15097 - protein, 263 aa, Agrobacterium tumefaciens; identical to SEQ ID NO: 11454

SEQ ID NO: 15098 - protein, 346 aa, Agrobacterium tumefaciens; identical to SEQ ID NO: 11727

SEQ ID NO: 15099 - protein, 220 aa, Agrobacterium tumefaciens; identical to SEQ ID NO: 11728

SEQ ID NO: 15100 - protein, 420 aa, Agrobacterium tumefaciens; identical to SEQ ID NO: 11723

SEQ ID NO: 15101 - protein, 245 aa, Agrobacterium tumefaciens; identical to SEQ ID NO: 11725

SEQ ID NO: 15102 - protein, 309 aa, Agrobacterium tumefaciens; identical to SEQ ID NO: 11726

SEQ ID NO: 15103 - protein, 396 aa, Agrobacterium tumefaciens
DISENDLLIGGLSVRDIVAETGTPCFLYDNSAMRQAYRDLETALSGFADIYYSVKANPLPAIISLFREEGAGAEIASVGEYRAAVKAGVAPDNIIFAGPGKSMAELREVIEGGIGEIHIESAEEIARIEAINRPVKASIRINPVPDAQAGAMRMGGKATAFGFDEEELENVLKLFANVRHIDLVGIHIYGGTQILDADMLVSQWRHAIALAGRMAQMLGKPLETIDLGGGLGIPYFAGETSLDLAKVAAAIPDLKALLKAHPLIADAHVIVEPGRFLAGPGGLYVVEVNSVKTSRGTTFVVTDGGMHHHLAASGNLGQIVKRNYPIVAPAMMQAAHDETATIVGPLCTPLDTLARNATLPKLNAGDLLAILQSGAYGASASPGGFLSHTVAKEVLV

SEQ ID NO: 15104 - protein, 429 aa, Agrobacterium tumefaciens; identical to SEQ ID NO: 11702

SEQ ID NO: 15105 - protein, 138 aa, Agrobacterium tumefaciens; identical to SEQ ID NO: 11703

SEQ ID NO: 15106 - protein, 509 aa, Agrobacterium tumefaciens; identical to SEQ ID NO: 14475

SEQ ID NO: 15107 - protein, 478 aa, Agrobacterium tumefaciens
FIDGDYVEDNTGTPFESIFPATGEMIAKLHAATPAIVERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYVSTGKVDAPY

SEQ ID NO: 15108 - protein, 565 aa, Agrobacterium tumefaciens
VTDVTEMKVREEELQRLLSRAEAADRAKSEFLANMSHEIRTPMNGVLGMAELLAKSKLDTRQKTFTDIIVKSGNALLTIINDILDFSKIEAGQMKLRSVPFDPAEAVEDVVSLLSSAALEKDIELIVRIDASVSGKVIGDAGRFRQIVTNIVGNAVKFTETGHVLVELSAQSAEASESIFSLRVEDSGIGIPVDKLETIFDKFSQVDGSATRRHEGTGLGLAITVGLVGLFDGKINVVSEVGRGSAFEVDIPFQVMERRRDVPLLSVAIDDIRVLVIDDNDVNRRILTEQLRSWGIDGHAVENGPSGIAVLQEAASLGFAIDAIILDYHMPVMNGLDVVERIRADKRFDDIAIVFLTSMDVVGDETLFTDLSVQAHLMKPARARLLRSTLFDVVRDVRLKRIRQHPLAQGTGGEKARPESRPAEKKQRAEAPATVPERSRPCLLDVLVAEDNDVNQIVFSQILQQAGLRFLIVGNGKRAVQAWEEYNPALILMDVSMPVMNGHQATQAIRAAEQAAGDSRHVPVIGVTAHTQEADRERCLEAGMDDYLSKPISPESLEDKIAQWL

SEQ ID NO: 15109 - protein, 339 aa, Agrobacterium tumefaciens; identical to SEQ ID NO: 11590

SEQ ID NO: 15110 - protein, 484 aa, Agrobacterium tumefaciens; identical to SEQ ID NO: 14477

SEQ ID NO: 15111 - protein, 246 aa, Agrobacterium tumefaciens; identical to SEQ ID NO: 14273

SEQ ID NO: 15112 - protein, 407 aa, Agrobacterium tumefaciens
VAKRQATFGASSVLFYEQPIEMVSAQGAYLYDAGGRKYLDVYNNVPSVGHCHPRVVEAIARQVGELNIHTRYLNRVVEAYTENLLSKFPAGLSNVVLTCTGSESNDLALRIARIGTGAEGFIVTEAAYHGNTALVTEVSPSSLRKRKPAAFVAIIPAPAARDGMSVASNFAASVEQAINELNSRGIKFAALIVDTIFSSDGIYADPAGFLKEAVDVVHRAGGLLIADEVQPGFGRTGGSLWGFERHGVTPDIVTMGKPMGNGFPMGGVVTRPDLLQRFCEETGYFNTFGGNPVAAAAGHAVLRVIEEEGLIERSATVGGYFKQSLQALQSRHSEIGDVRGAGLFIGLDFVDPATGEPDSTRATHAINQLRHNSILIGAAGKYGATLKIRPPLCFSNEDVDLFTGTLD

SEQ ID NO: 15113 - protein, 467 aa, Agrobacterium tumefaciens; identical to SEQ ID NO: 11410

SEQ ID NO: 15114 - protein, 477 aa, Agrobacterium tumefaciens
LHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFG

SEQ ID NO: 15115 - protein, 428 aa, Agrobacterium tumefaciens
YFQVLVAIIAGIALGHFYPTFGEQLKPLGDEFMRLVKIDIGPVIFLTVATGIAGMNDMKKVGRVAGAAHDLFLGFSTARAHVGLIVANTGAAGRGMNIDPATLDAKAVATYADKAHEQTITGFLMNIIPTTIVGAFASGDILQVLFFSVLFGIALGIVGEKGKPVTDFMHAMMYPIFKLVAILMKAAPIGAFGAMAFTIGKYGISSVTNLAMLIGTFYITSALFVFVVLGAVCRYNGFSIVALIRYIKEELLLVLGTSSSEAALPGLMSKMEKAGCKRSVVGLVIPTGYSFNLDGTNIYMTLAALFIAQATGIHLSFGEQILLLLVAMLSSKGAAGITGAGFITLAATLSVVPSVPVAGMALILGIDRFMSECRALTNFVGNAVATIVVARWEGELDQEQLARVLSGKEEFTSIADVDALPASVQPAE

SEQ ID NO: 15116 - protein, 403 aa, Agrobacterium tumefaciens; identical to SEQ ID NO: 11658

SEQ ID NO: 15117 - protein, 395 aa, Agrobacterium tumefaciens; identical to SEQ ID NO: 11657

SEQ ID NO: 15118 - protein, 434 aa, Agrobacterium tumefaciens
AHLVHPVSSFRGHEKLGVRVLKSASGATVTDMTGHQLIDGFAGLWCVNAGYGHDSIVEAAAKQMRELPYATAYFDIGSEPAIRLASELADRAPGDLNHVYFTLGGSDAVDSTIRFIRYYWHAKGQPQRDQFISIEQGYHGSTTAGSGLTALPAFHAGFGVPYDWQHKIPSHYAYRNPAGSDPAAIIASSLQILKDKIEAIGPDRVAAFYAEPIQGSGGVLVPPPGWIKAMRELCSSYGILFVADEVITGFGRTGPLFACADEDIVPDFITAAKGLTSGYVPMGAVFMADHVYDTIADFAGEAAIGHGYTYSAHPVSAAVGLEVLKLYEGGLLENGRRAGQRLMAGLEGLRNHPLVGDVRGRGMLAAIELVTDKDKKTPLPAAAAPARKVFDRAWENGLIVRAFANGILGYAPPLCCTDGEIDAIVERTLKTLDQ

SEQ ID NO: 15119 - protein, 572 aa, Agrobacterium tumefaciens
KKLLTRLFKENFKKHVGWYSAAIVAMLLVAGTTSLSAWIMRDIVNSVYLKQGFDVVLEIAFAVAAIFIVKGLATFVQSYYLSKAGNSIVAEQQRKIYDRLLKQGVSFFQNLPSSELLVRVTYNAQAARSVIDTIVTSFVRDLFSLLGLIIVMFAQNFLLSAISMIIGPVAIFSVRLVLRRVRKIMEAELASLGEIVNVVQETSIGVRVIKAFSLEKLMRQRMNKAVSDVEHRANGIAKLEAATSPIMETLSGLAIAVVIAVSGYTVLEKGGSPGDLMAFITALLLAYEPAKRLARMRVQIEGGMIGVRMMFEVLDAPLTLAEKKDAQPLPKASGNVELKNVSFEYVANQPVLKDVSVLFEGGKMTALVGPSGSGKSTIINLMMRLYDPQSGSVEINGMDLRDVSFASLREHVSYVGQETFLFSGTVKHNISVGRDNATDEEIIAAAKAANAHDFIMNMPDGYDSKLGENGSGLSGGQRQRVAIARAMLRDADILILDEATSALDSESEALVRDALERLTLNKTSIVIAHRLSTINRADKIVVMDNGQVVEQGSRRELLATDGLYKRLHSIQF

SEQ ID NO: 15120 - protein, 213 aa, Agrobacterium tumefaciens
IFSQEFAAFLFDMDGTLVNSIAVVERVWREWAVANGIEPNAFLQRIHGMRASEVIRREAVPGLDVDAEADMILRAEMDDVEGIIPIPGAADFLASLPAGKWAIVTSAVRELAEKRLAAAGITPPPVMICADDVVNGKPDPEGYRKAAERLGVAPESCVVFEDAPAGIQAGERMGAAVVVINVTHSHPIETPHLAIGSYGELDVVIDGNGGLKL

SEQ ID NO: 15121 - protein, 335 aa, Agrobacterium tumefaciens; identical to SEQ ID NO: 11660

SEQ ID NO: 15122 - protein, 391 aa, Agrobacterium tumefaciens; identical to SEQ ID NO: 11445

SEQ ID NO: 15123 - protein, 194 aa, Agrobacterium tumefaciens; identical to SEQ ID NO: 11469

SEQ ID NO: 15124 - protein, 254 aa, Agrobacterium tumefaciens
LKARIIPCLDVKDGRVVKGVNFVDLIDAGDPVEAAKAYDAAGADELCFLDITASSDNRDTIFDVVSRTADHCFMPVTVGGGVRSVADIRKLLLCGADKVSINSAAVKDPDFVAQAADKFGNQCIVVSIDAKRVSKDGEADRWEIFTHGGRQPTGIDAVEFAIKMVERGAGELLVTSMDRDGTKSGYDIGLTRSIADQVRVPVIASGGVGTLDDLVAGVRDGHATAVLAASIFHFGTYSIGEAKSYMAEHGIAMR

SEQ ID NO: 15125 - protein, 464 aa, Agrobacterium tumefaciens
LEKDYIVADINLAAFGRKELDIAETEMPGLMSCRKEFGESKPLKGARITGSLHMTIQTGVLIETLKELGAEIRWASCNIFSTQDHAAAAIAAAGIPVFAVKGESLTEYWEYTDKIFQWTDGGLSNMILDDGGDATMYILLGARAEAGEDVLSNPGSEEEEILFAQINKRLKASPGWFTKQRDALKGVTEETTTGVHRLYDLAKKGLLPFPAINVNDSVTKSKFDNKYGCKESLVDGIRRATDVMMAGKVAVVCGYGDVGKGSAASLQGAGARVKVTEIDPICALQAAMDGFEVVRLEDVVSSADIFITTTGNKDVIRIEHMREMKDMAIVGNIGHFDNEIQVASLRNLKWTNIKPQVDMIEFPKGNRIILLSEGRLLNLGNATGHPSFVMSASFTNQVLGQIELFTKPGEYKNEVYVLPKHLDEKVARLHLEKLGVRLTELSDLQADYIGISKQGPFKAEHYRY

SEQ ID NO: 15126 - protein, 889 aa, Agrobacterium tumefaciens; identical to SEQ ID NO: 14305

SEQ ID NO: 15127 - protein, 349 aa, Agrobacterium tumefaciens
  unsure (1)..(349): unsure at all Xaa locations
VLIGGTSYAGENKKSVFTVLNYLLPAKGVMPMHCSANVGPXGDSAVFFGLSGTGKTTLSADPARTLIGDDEHGWGEHGIFNFEGGCYAKAIKLSSEAEPEIYAATNRFGTVLENVVLDESRVPDFNDNSLTENTRSAYPLHFIPNASETGIAGHPKTIIMLTADAFGVLPPIARLTPEQAMYHFLSGYTAKVAGTEKGVTEPEATFSTCFGAPFMPRHPAEYGNLLRELIGKHGVDCWLVNTGWTGGAYGIGKRMPIKATRALLTAALTGDLKNAQFRTDANFGFAVPLSLDGVDGAILDPRSTWADGAAYDAQAKKLVSMFVSNFTKFEDHVDSKVRDAAPGLLLAAE

SEQ ID NO: 15128 - protein, 307 aa, Agrobacterium tumefaciens; identical to SEQ ID NO: 11662

SEQ ID NO: 15129 - protein, 169 aa, Agrobacterium tumefaciens; identical to SEQ ID NO: 14311

SEQ ID NO: 15130 - protein, 370 aa, Agrobacterium tumefaciens; identical to SEQ ID NO: 14656

SEQ ID NO: 15131 - protein, 329 aa, Agrobacterium tumefaciens
KKLDLITIGRSSVDLYGSQVGGRLEDMASFAKYIGGSPTNIAAGAARLGLNSAVITRVGDEHMGRFIREQLVREGVDVRGVKTDPERLTALVLLGIRDQNQFPLIFYRENCADMALSEDDIDPAFIADAGCICATGTHLSHPNTEAAVLKALKLARENGAKTALDIDYRPNLWGVAGHGDGESRFVESQKVTAKLQSTLHLFDLIVGTEEEFHIAGGSTDTLTALNAVRKVSNATLVCKRGPMGASVFTGDIPDSLDDGETGEGFPIEVFNVLGAGDGFMAGLFRGWLRGEDWPTTLKYANACGAFAVSRHGCTPAYPSWEELQYFFKA

SEQ ID NO: 15132 - protein, 959 aa, Agrobacterium tumefaciens
MALVTEFDYGTPKSNATDMVTLTIDGRQVTVPTGTSIMRASREAGIDVPKLCATDMVDAFGSCRLCLIEVEGRNGTPASCTTPVAAGLVVHTQTERLKQIRKGVMELYISDHPLDCLTCAANGDCELQDMAGAVGLRDVRYGYEGDNHVKSRTGGGDINARWMPKDESNPYFTYDPSKCIVCSRCVRACEEVQGTFALTIEGRGFESRVSPGAHEAFLDSDCVSCGACVQACPTATLTEKSVIEIGQPEHSMVTTCAYCGVGCSFKAEMRGEELVRMVPWKDGQANRGHSCVKGRFAYGYATHRDRILNPMIRENIGDPWREVSWDAAFAYVASEFRRIQGKYGRESIGGITSSRCTNEETFLVQKLVRAGFGNNNVDTCARVCHSPTGYGLGQAFGTSAGTQNFDSVEQSDVVLVIGANPTDGHPVFGSRLKKRLRQGAKLIVIDPRRIDLVRTPHVEAAFHLPLLPGTNVAVLTALAHVIVTEGLFNEAFIRERCDWSEFEDWAAFVAEPQHSPEETERFTGVPAEDCVVRPAFMPPAVMARSYYGLGVTEHSQGSTTVMAIANLAMVTGNIGRPGVGVNPLRGQNNVQGSCDMGSFPHELPGYRHISDDATRDVFEKLWGVKLNNEPGLRIPNMLDAAVDGSFKGIYIQGEDILQSDPDTKHVSAGLAAMECVVVHDLFLNETANYAHVFLPGSTFLEKDGTFTNAERRINRVRKVMSPKNGYADWEVTQKLAQAMGLTWNYTHPSEIMDEIAATTPSFASVSYAYLEEKGSVQWPCNEKFPEGSPIMHVDGFVRGKGKFIRTEYVATDERTGPRFPLLLTTGRILSQYNVGAQTRRTENVVWHEEDRLEIHPHDAEQRGVKDGDWIKLVSRSGDTTLRALITDRVAPGVVYTTFHHPGTQANVITTDFSDWATNCPEYKVTAVQVSPSNGPTEWQEEYDALARQSRRIAGKLEAA

SEQ ID NO: 15133 - protein, 443 aa, Agrobacterium tumefaciens; identical to SEQ ID NO: 11734

SEQ ID NO: 15134 - protein, 344 aa, Agrobacterium tumefaciens; identical to SEQ ID NO: 11733

SEQ ID NO: 15135 - protein, 238 aa, Agrobacterium tumefaciens; identical to SEQ ID NO: 11484

SEQ ID NO: 15136 - protein, 527 aa, Agrobacterium tumefaciens; identical to SEQ ID NO: 14296

SEQ ID NO: 15137 - protein, 241 aa, Agrobacterium tumefaciens; identical to SEQ ID NO: 11486

SEQ ID NO: 15138 - protein, 336 aa, Agrobacterium tumefaciens; identical to SEQ ID NO: 11487

SEQ ID NO: 15139 - protein, 342 aa, Agrobacterium tumefaciens; identical to SEQ ID NO: 11687

SEQ ID NO: 15140 - protein, 461 aa, Agrobacterium tumefaciens; identical to SEQ ID NO: 11537

SEQ ID NO: 15141 - protein, 297 aa, Agrobacterium tumefaciens
MDVRAAVAIQAGKPLEVMTVQLEGPRAGEVLIEVKATGICHTDDFTLSGADPEGLFPAILGHEGAGIVVDVGPGVTSVKKGDHVIPLYTPECRECYSCTSRKTNLCTSIRATQGQGVMPDGTSRFSIGKDKIHHYMGCSTFSNFTVLPEIALAKINPDAPFDKVCYIGCGVTTGIGAVINTAKVEIGSTAIVFGLGGIGLNVLQGLRLAGADMIIGVDINNDRKAWGEKFGMTHFVNPKEVGDDIVPYLVNMTKRNGDLIGGADYTFDCTGNTKVMRQALEASHRGWGKSVIIGVAG

SEQ ID NO: 15142 - protein, 279 aa, Agrobacterium tumefaciens; identical to SEQ ID NO: 11783

SEQ ID NO: 15143 - protein, 295 aa, Agrobacterium tumefaciens; identical to SEQ ID NO: 11782

SEQ ID NO: 15144 - protein, 284 aa, Agrobacterium tumefaciens; identical to SEQ ID NO: 11781

SEQ ID NO: 15145 - protein, 654 aa, Agrobacterium tumefaciens; identical to SEQ ID NO: 11423

SEQ ID NO: 15146 - protein, 809 aa, Agrobacterium tumefaciens
SHQIAIDGMTCASCVGRVEKAIARVPGVLKASVNLATERADISFSGPPDVPAVIAAVRHAGYGVEEKTVELDIEGMTCASCVGRVEKALKAVSGVSDASVNLATERAAIRVAGNAASAATLAEAIKRAGYQAKEIVADKAGDAEQDRRAADMRSLKISLAVAVVLTLPVFVLEMGSHLVPAIHDFVMETVGMRKSWYLQFVLTTLVLFGPGLRFFKKGIPALMRLAPDMNSLVVLGTAAAWGFSVVATFLPEILPRGTANVYYEAAAVIVTLILLGRFLEARAKGRTSEAIKRLVGLQAKSARVLRDGETIDVPLQDVRTGDVIVVRPGEKVPVDGLVLNGSSYVDESMITGEPVPVTKTEGSEVVGGTVNRNGSFTFRATKVGSDTLIAQIIRMVEEAQADKLPIQALVDKVTNWFVPAVMLAALVTFAVWFVFGPDPALTFALVNAVAVLIIACPCAMGLATPTSIMVGTGRAAEMGVLFRRGDALQTLRDADVIAVDKTGTLTLGKPKLVHFNTTQGFDADEVLRLVASLENRSEHPIAEAIVEAAKHGGLTLAEAEAFEATPGFGVAATVDGRRVEAGADRFMVKLGYDVGAFATDAERMGREGQSPLYAAVDGRLAAIIAVADPIKQTTPEAIAALHALGLKVTMITGDNRRTAEAIARRLGIDEVVAEVLPDGKVEAVKRLAAGGRRVAFVGDGINDAPALAAADVGLAIGTGTDVAIESADVVLMSGDLRGVANAIALSKATIRNIRQNLFWAFAYNAALVPVAAGILYPVNGVLLSPVLAAGAMALSSVFVLTNALRLKSF

SEQ ID NO: 15147 - protein, 322 aa, Agrobacterium tumefaciens; identical to SEQ ID NO: 11717

SEQ ID NO: 15148 - protein, 287 aa, Agrobacterium tumefaciens
KKIRKAVFPVAGLGTRFLPATKAVPKEMLTVVDKPVIQYVVDEAAEAGIEHFVFVTGRGKAVIEDYFDIQFELEQMLRERNKNAELTLLAGLLPKAGTASFTRQQVPLGLGHAVWCARDIVGDEPFAVLLPDMIMHSQKSCLKGMVELYDQTQGNVIAVQECAPDQTHKYGIVGVGNAVGEGFKITEMVEKPAKGTAPSNFYINGRYILQPEIFDILENQERGAGNEIQLTDGMLTLAKSQEFSGYTSFRGQTFDCGAKDGFILANVAFALERGDIRPAIEEPIKAL

SEQ ID NO: 15149 - protein, 305 aa, Agrobacterium tumefaciens
NQLILSRAGSDVQMIPEVANHLISSGGKRLRPMLTLASASMFGYEGDNHIKLATSVEFMHTATLLHDDVVDESDLRRGKSTARTIWGNQASVLVGDFLLGQAFRMMVDVGSLDALDVLSTAASVIAEGEVLQLSVAKNMETTEDDYLQVIRAKTAALFAAAAEVGPIVAKTDKASRSALKSYGMNLGLAFQLVDDVLDYGGKSADLGKNTGDDFREGKITLPVILSYRRGTQDERAFWRNAIEKGESSDENLEKALGLITKYNGLGDTIGRATHYGTIARDALAPLPQSPWKNALLEVIDFCIER

SEQ ID NO: 15150 - protein, 261 aa, Agrobacterium tumefaciens; identical to SEQ ID NO: 11764

SEQ ID NO: 15151 - protein, 400 aa, Agrobacterium tumefaciens
HPLSGKVEPPGSKSITNRALLLAGLAKGKSHLSGALKSDDTLYMAEALREMGVKVTEPDATTFVVEGTGVLQQPEKPLFLGNAGTATRFLTAAGALVDGAVIIDGDEHMRKRPILPLVQALRALGVEADAPTGCPPVTVRGKGMGFPKGSVTIDANLSSQYVSALLMAAACGDKPVDIILKGEEIGAKGYIDLTTSAMEAFGAKVERVSNAIWRVHPTGYTATDFHIEPDASAATYLWGAELLTGGAIDIGTPADKFTQPDAKAYEVMAQFPHLPAEIDGSQMQDAIPTIAVIAAFNETPVRFVGIANLRVKECDRIRAVSLGLNEIREGLAHEEGDDLIVHADPSLAGQTVDASIDTFADHRIAMSFALAALKIGGIAIQNPACVAKTYPGYWKALASL

SEQ ID NO: 15152 - protein, 337 aa, Agrobacterium tumefaciens
TMKAAVVRAFGKPLTIEEVAIPDPGPGEILINYKATGVCHTDLHAATGDWPVKPNPPFIPGHEGAGYVAKIGAGVTGIKEGDRAGTPWLYTACGCCIPCRTGWETLCPSQKNSGYSVNGSFAEYGLADPKFVGRLPDNLDFGPAAPVLCAGVTVYKGLKETEVRPGEWVVISGIGGLGHMAVQYAKAMGMHVVAADIFDDKLALAKKLGADVVVNGRAPDAVEQVQKATGGVHGALVTAVSPKAMEQAYGFLRSKGTMALVGLPPGFISIPVFDTVLKRITVRGSIVGTRQDLEEALTFAGEGKVAAHFSWDKLENINDIFHRMEEGKIDGRIVVDL

SEQ ID NO: 15153 - protein, 287 aa, Agrobacterium tumefaciens; identical to SEQ ID NO: 11576

SEQ ID NO: 15154 - protein, 487 aa, Agrobacterium tumefaciens
VRWQSYMHVARQSLTFFQNDFSGRIVTKVWSGGQAAGDLVTSLMESVWFVGIYSVSMLFLIGGLDWRLAVLVVVWVAIFSLLARYFVPRIRHHSKETAEAASMLSGRMVDAYSNIQTLRLFGRDDANDRYMRQGFDIFQTSTMKFTRFITGVRASMALLSGVMITSMAALCIDLWLSGKISSGAVAFTLALVLRLNFLLGRLMTQFNGIMRNFGTVQNAAELISQPIGLVDAPDAAVLEVKKPSIRFENVSFHYGRANGVIDNLNLEIRAGEKVGIVGRSGAGKSTLVNLLLRFYDVEKGRILIDGQDIARVSQESLRAHIGMVTQDTSLLHRSIRDNIMFGRTDATEAQLIEATRRAKADDFITRLEDQRGRTGFDAHVGERGVKLSGGQRQRIAIARVMLKDAPILVLDEATSALDSEVEAAIQSNLDELMQGKTVLAIAHRLSTIAALDRLIVMDQGLIVEEGSHAELVAQGGLYSELWARQSG

SEQ ID NO: 15155 - protein, 522 aa, Agrobacterium tumefaciens
GWHLIVMAGLVLFLLPLMGAIHTMTMHQTLAGNFGMIARWKMHRFLLRHSMNFFANEFAGRVSTKVMQTALAIREVALKVIDVFVYAISFVVSMLFMVAAADWRLVIPLLIWLGIYMAILAYFVPKLGRLAQEQADARSMMTGRIVDSYTNISTIKLFSHAGREERYAREGMNVFLGTVHRQMRKISGFNILIDLNNAVVLFSTATLGLYFWMQGSVTAGSVAIAISLAMRVNGMSQWIMWEVTSLFENIGTVYDGMSMMTKPHDIVDVPKAPELAAPQGAIHYDNVRFHYGKNKGVIDGLTLDIKPGEKVGLVGRSGAGKTTLMNLLLRFYDLEGGRITIDGQDISKVSQDSLRELIGVVTQDTSLLHRSIRDNIAYGHPEATDEQVIAAAKRANAWDFIETLVDMHGRQGLDAQVGERGVKLSGGQRQRIAIARVFLKNAPILVLDEATSALDSEVEAAIQENLFSLMEGKTVIAIAHRLSTLTEMDRLIILDKGRIVEAGSHAELAAMGGIYADLWRRQ

SEQ ID NO: 15156 - protein, 438 aa, Agrobacterium tumefaciens; identical to SEQ ID NO: 11577

SEQ ID NO: 15157 - protein, 277 aa, Agrobacterium tumefaciens; identical to SEQ ID NO: 11634

SEQ ID NO: 15158 - protein, 475 aa, Agrobacterium tumefaciens; identical to SEQ ID NO: 11633

SEQ ID NO: 15159 - protein, 322 aa, Agrobacterium tumefaciens; identical to SEQ ID NO: 11718

SEQ ID NO: 15160 - protein, 357 aa, Agrobacterium tumefaciens; identical to SEQ ID NO: 11719

SEQ ID NO: 15161 - protein, 242 aa, Agrobacterium tumefaciens; identical to SEQ ID NO: 11357

SEQ ID NO: 15162 - protein, 273 aa, Agrobacterium tumefaciens; identical to SEQ ID NO: 11644

SEQ ID NO: 15163 - protein, 222 aa, Agrobacterium tumefaciens
TFLITGASDGIGAVYAERLAGRGHDLILVARRAEKLKALAAQLEKDHGIAVEVLSADLSSAEDLEKVEVRLREDQRITGLVNNAGIAGEGAITALDPAYVTTMINLNILAVTRLAAAIAPRLAAAGKGTIINMTSVTALMPAAFTAVYPATKAFVLAFTEALQAQLSPSGVRVQAVLPGITRTAIWEEERLDAIPAAMVMDVHDMVDAALAGLDLGEALTIP

SEQ ID NO: 15164 - protein, 372 aa, Agrobacterium tumefaciens
EIAALRDSASAFADDKIAPLATEIDRNDRFPRQLWPQMGELGLHGITVSEEFGGADMGYLAHCVAMEEISRASASIGLSYGAHSNLCINQIHRWGTDEQKHRYLPKLVSGDHVGSLAMSETEAGSDVVSMRLKAERKGDRYVLNGAKMWITNGHEADTLVVYAKTDMSAGARGITAFLIEKGFKGFRPAQKLDKLGMRGSPTSELVFEDCEVPEENILGRLNDGVTVLMSGLDYERAVLAAGPVGIMQAAIDLVLPYVRERKQFGKAIGEFQLVQGKLADIYSAMNASRAYVYAVARACDNGRITRQDAAGAILFAAERATQVALDAIQLLGGSGYVNESPAGRLLRDAKLYEIGAGTSEIRRMLIGRELVK

SEQ ID NO: 15165 - protein, 652 aa, Agrobacterium tumefaciens; identical to SEQ ID NO: 14688

SEQ ID NO: 15166 - protein, 498 aa, Agrobacterium tumefaciens
KPVVLTILDGWGLNEDTSSNAPVLANTPTMDRLFATCPNATLTTFGPNVGLPTGQMGNSEVGHTNIGAGRIVAMDLGQIDLAIEDGSFFRNAAMLDFAATVKAAGGVAHLMCVVSDGGVHGHILHGQAAVKLMVSHGLKVVVHAITDGRDVAPQSAEDFVAALVASLPQGASIGTVIGRYYAMDRDNRWERVEKAYDAMVLGKGEHARDAVSAVAQSYANKVTDEFILPTVIDGYEGFKAGDGLFCLNFRADRAREILLAIGADDFDGFAREKPVLSALLGMVEYSTRHSDFMTTAYPKRDIVNTLGAWVAKQGLTQFRLAETEKYPHVTFFLNGGKEEPEVGEDRFMPKSPKVATYDLQPEMSAAEVTEKFVEVIGKGYDLIVTNYANPDMVGHTGDLQAAIKACEAVDRGLGAVVAALEKVGGAMLVIADHGNCETMVDPVTGGPHTAHTTNPVPVILFGGPEGAKVHDGILADVAPTLLQLMNVPLPPEMTGKSL

SEQ ID NO: 15167 - protein, 425 aa, Agrobacterium tumefaciens; identical to SEQ ID NO: 11641

SEQ ID NO: 15168 - protein, 252 aa, Agrobacterium tumefaciens
MTMIEAVRSAMDVSMERSDDVVVFGEDVGYFGGVFRATQGLQGKYGKTRCFDAPISESGIVGTAIGMAAYGLRPCVEIQFADYMYPAYDQITQEAARIRYRSNGDFTCPIVLRMPTGGGIFGGQTHSQSPEALFTHVCGLKVVVPSNPYDAKGLLIASIEDPDPVMFLEPKRLYNGPFDGHHDRPVTPWSKHEMGEVPEGHYTIPIGKAEIRRPGNDVTVIAYGTMVHVALAAAEETGVDAEIIDLRSLLPL

SEQ ID NO: 15169 - protein, 409 aa, Agrobacterium tumefaciens; identical to SEQ ID NO: 11639

SEQ ID NO: 15170 - protein, 255 aa, Agrobacterium tumefaciens
FALTEPQAGSDASNLKTRARRDGDRYVLDGAKQFITSGKNGDVIIVFAVTDAAAGKKGITAFIVPTDTPGYEVIRVEEKLGLHSSDTCQIAFTEMAVPVDLRLGEEGQGYRIALANLEGGRIGIAAQAVGMAQAAFEAARDYARERKAFGQAIIEHQAVAFRLADMATRITAARQLVLHAAALKEAGEPCLSEASMAKLFASEMAERVCSDAIQIHGGYGYMADYPVERIYRDVRICQIYEGTSDVQRMVIARNL

SEQ ID NO: 15171 - protein, 379 aa, Agrobacterium tumefaciens; identical to SEQ ID NO: 14686

SEQ ID NO: 15172 - protein, 217 aa, Agrobacterium tumefaciens; identical to SEQ ID NO: 11688

SEQ ID NO: 15173 - protein, 673 aa, Agrobacterium tumefaciens; identical to SEQ ID NO: 14690

SEQ ID NO: 15174 - protein, 236 aa, Agrobacterium tumefaciens
MNGTRASLDQIKAMAEGVKGALSEKVDALICPPSTLLYVATALCDDSPLLIGAQDCHQNDTGAHTGDISAEMIADCFGTHVIVGHSERRTDHAETDHLVRAKASAAHQVDLIAIVCIGETADERKAGQTLDILKRQLAGSLPDEATAENTVIAYEPVWAIGTGLTPTTQDVREAHAFMRDELVKRFGDAGKTMRILYGGSVKPANALELMGVENVDGALIGGASLKAADFLSIYAA

SEQ ID NO: 15175 - protein, 463 aa, Agrobacterium tumefaciens
EAVARQSRGRKKGKNMAQNWTPGSWRQKPIQQVPEYPDAAALAATEATLATYPPLVFAGEARRLKKQLANVAEGNAFLLQGGDCAESFLEHGADNIRDFFRAFLQMAVVLTYGAQLPVVKVGRIAGQFAKPRSSNVEVLDGVTLPSYRGDIINGIEFNEASRIPSPERQLDAYRQSAATLNLLRAFAMGGYANLENVHQWMLGFIKDSPQADRYRKLADRISETMNFMQAIGISAENNPSLRETDFFTSHEALLLGYEEALTRIDSTSGDWYATSGHMIWIGDRTRQLDHAHVEYFRGIKNPIGLKCGPSLTPDNLIELIDALNPANEAGRLTLICRFGHDKVADSLPKLIRAVEKEGRKVVWSCDPMHGNTITLNHYKTRPFERILSEVESFFQIHRAEGTHPGGIHIEMTGKDVTECTGGARAVTADSLSDRYHTHCDPRLNADQALELAFLLSERMKSGR

SEQ ID NO: 15176 - protein, 411 aa, Agrobacterium tumefaciens; identical to SEQ ID NO: 11680

SEQ ID NO: 15177 - protein, 327 aa, Agrobacterium tumefaciens; identical to SEQ ID NO: 11681

SEQ ID NO: 15178 - protein, 400 aa, Agrobacterium tumefaciens
GLDPKVGDAIIAAAQEVIDGKLTEHFPLVVWQTGCGTQSNMNANEVISNRAIEMLGGEMGTKKPVHPNDHVNMSQSSNDTYPTAMHIACVEEIVHHLLPALKHLHTALEAKVKQFEKIIKIGRTHTQDATPLTLGQEFSGYAAQVASAIANIELTLPALSKLAQGGTAVGTGLNAPVGFAEKVAEEISEITGLSFVTAPNKFEALASHDSMVFSHGAINAAAAALFKIANDIRFLGSGPRAGLGELSLPENEPGSSIMPGKVNPTQSEALTQVCAHIFGNNAALSFAGSQGHFELNVYNPMMAYNFLQSVQLLGDAAVSFTDNCVVGIEAREDNIRKGVENSLMLVTALNGKLGYDICAKIAKTAHKNGTTLREEAVGGGYLTNEEFDQYVRPENMIGPK

SEQ ID NO: 15179 - protein, 401 aa, Agrobacterium tumefaciens; identical to SEQ ID NO: 11471

SEQ ID NO: 15180 - protein, 471 aa, Agrobacterium tumefaciens; identical to SEQ ID NO: 14225

SEQ ID NO: 15181 - protein, 321 aa, Agrobacterium tumefaciens; identical to SEQ ID NO: 14698

SEQ ID NO: 15182 - protein, 778 aa, Agrobacterium tumefaciens
FAIGGWQLVALGGSPYFIIAGLSLIVSGLLILLRKPAGALLFGLVFILTGVWAVWEAGLHFWPLISRLLAIGVGATVVALSYPLLRRAAGKTPAYGSSFAVAAVLAIASGAGFAGMFVAHPTVAFNGEPAALTPVKPETEQKNWEHYGNTSGGSRFVALDEITRDNIKNLEVAWTYHTGDTPISPGANGAEDQQTPLQVGDTVFLCTPHNNVIALDADTGTEKWKAEINSKSSVWMRCRGLAYFDAKAPLKQPTAPGSTPVTAAVVAEGALCQRRILMNTINAELIALDADTGAFCPDFGTNGRVDLKIGMGDAPDPQYVLTSAPTLAGTTVVVGGRIADNVQVDMPGGVMRGFDVVTGELRWAFDPGNPDITKLPPPGQTYTRSTPNVWASMSYDPDLNTVFMPVGSPSVDLYGATRTPLDHKYGASMLALDATTGREKWVYQTVHNDLWDFDVPMQPSFVDFPKADGTSVPALVFGTKAGQLYVLDRATGQPLTKVEEVSVKAANIPNEPYAPTQPRSVGMPQIGAQTLTEADMWGATPFDQLLCRIAFKGMRYEGLYTAPGTDLSLAFPGSLGGMNWGGLSTDPTTNTIFVNDMRLGLWIEMKEAAPTKAVASGGESVNTGMGVVPMKGTPYAVNKNRFLSALGIPCQAPPYGTMTAIDMKTQQIKWQVPVGTVEDTGPLGIKMGLPIPIGMPTLGGTLATQGGLVFIAGTQDYYLRAFDTATGKEVWKARLPVGSQGGPMSYKSPKTGKQYVVISAGGARQSPDRGDYVIAYAL

SEQ ID NO: 15183 - protein, 119 aa, Agrobacterium tumefaciens; identical to SEQ ID NO: 11653

SEQ ID NO: 15184 - protein, 641 aa, Agrobacterium tumefaciens; identical to SEQ ID NO: 14428

SEQ ID NO: 15185 - protein, 524 aa, Agrobacterium tumefaciens; identical to SEQ ID NO: 11383

SEQ ID NO: 15186 - protein, 256 aa, Agrobacterium tumefaciens; identical to SEQ ID NO: 11385

SEQ ID NO: 15187 - protein, 783 aa, Agrobacterium tumefaciens; identical to SEQ ID NO: 11386

SEQ ID NO: 15188 - protein, 499 aa, Agrobacterium tumefaciens; identical to SEQ ID NO: 11388

SEQ ID NO: 15189 - protein, 434 aa, Agrobacterium tumefaciens; identical to SEQ ID NO: 14705

SEQ ID NO: 15190 - protein, 227 aa, Agrobacterium tumefaciens
LYHSPMSTASRFVRLILAEYGFQTDLVEEQPWERRREFLALNPAGTLPVYLDDNMRSLSGPYVLAEFLDETHGVLKRDRRLLAEDPFQRAEIRRLTEWFLQKMENDVTRPLVRERVYKLQMTAAQGGGPPDSKLLRTARNNIRQHIKYLEWLAGSRTWLAGDRLSYADLAAAAGVSVLDYLGEINWLEAPIAKEWYQRVKSRPSFRPFLSERIPRLAPSSHYADLDF

SEQ ID NO: 15191 - protein, 327 aa, Agrobacterium tumefaciens; identical to SEQ ID NO: 11774
  unsure (1)..(327): unsure at all Xaa locations

SEQ ID NO: 15192 - protein, 401 aa, Agrobacterium tumefaciens; identical to SEQ ID NO: 11773

SEQ ID NO: 15193 - protein, 140 aa, Agrobacterium tumefaciens; identical to SEQ ID NO: 11722

SEQ ID NO: 15194 - protein, 705 aa, Agrobacterium tumefaciens; identical to SEQ ID NO: 11720

SEQ ID NO: 15195 - protein, 431 aa, Agrobacterium tumefaciens; identical to SEQ ID NO: 11545

SEQ ID NO: 15196 - protein, 403 aa, Agrobacterium tumefaciens; identical to SEQ ID NO: 11546

SEQ ID NO: 15197 - protein, 599 aa, Agrobacterium tumefaciens; identical to SEQ ID NO: 14716

SEQ ID NO: 15198 - protein, 438 aa, Agrobacterium tumefaciens; identical to SEQ ID NO: 11427

SEQ ID NO: 15199 - protein, 283 aa, Agrobacterium tumefaciens
GLSPAPVTAFTRDGEVDYAANAKIARWLASMEGVKSLVILGHAGEGTFLTEDERLELIRVYVDAVGGSLPIIAGITGEGTRVAAAEAKKCKAAGATGALVYPNHGWLRFGFQRGAPQDRYKAIWEESGLQEILFQYPDVTKASYDLDTQLAIATQPGVVATKNGVRNMKRWYVEIPELKNANPNLQVLSCHDEWLLPTMFDVDGLLVGYGNIAPELLIDLIKAGKAQDYPQARKIFEQLLPVTRAVYHRGSHMEGTVALKLGLVHRGVLDHATIREPLEEPRR

SEQ ID NO: 15200 - protein, 418 aa, Agrobacterium tumefaciens
IVGAATFFDGYTVIAIAYAMPVLVREWGLTPSQTGMILSMGYLGQLIGAILFGWLAERIGRLKVLLFTILLFVSMDVACLFAAGAGMMMAFRFVQGIGTGGEVPVASAYINELIGSKGRGRFFLLYEVMFLLGLVGAGLIGYFMVPLYGWKAMFIVGLVPAMLMIPLRWFLKESPRWLAATGRYDEANVIVKRMEESARAAGKALPEPRIIATPAKRVSDWRELFQGIYLKRTLSIWAMWFCAYMVANGTITWLPTLYRQTFNLPLETSILYGFMTSAAGVVAAVICALLIDKVGRKRWYAGALLLAPVPLAILAWLGATSPMQVLIFAGLAYAIVQTVTFSLYLYSAEIYPTRMRAIGTGAGSAWLRLGSSAGPMLVGFVMSSMGIQYVFATFAFILIIGAVVTMLFAVETKGKVLE

SEQ ID NO: 15201 - protein, 242 aa, Agrobacterium tumefaciens; identical to SEQ ID NO: 11501

SEQ ID NO: 15202 - protein, 237 aa, Agrobacterium tumefaciens; identical to SEQ ID NO: 14723

SEQ ID NO: 15203 - protein, 368 aa, Agrobacterium tumefaciens; identical to SEQ ID NO: 11770

SEQ ID NO: 15204 - protein, 370 aa, Agrobacterium tumefaciens; identical to SEQ ID NO: 14724

SEQ ID NO: 15205 - protein, 325 aa, Agrobacterium tumefaciens; identical to SEQ ID NO: 14442

SEQ ID NO: 15206 - protein, 436 aa, Agrobacterium tumefaciens; identical to SEQ ID NO: 11459

SEQ ID NO: 15207 - protein, 1104 aa, Agrobacterium tumefaciens; identical to SEQ ID NO: 11460

SEQ ID NO: 15208 - protein, 333 aa, Agrobacterium tumefaciens; identical to SEQ ID NO: 11462

SEQ ID NO: 15209 - protein, 326 aa, Agrobacterium tumefaciens
KVGVLLVNLGTPDGTDYWPMRRYLAEFLSDKRVIEWSRLYWYPILYGIVLNKRPQKVGKAYEEIWNHERNESYLRTYTRSQGELMAAALKDFPNVVVDWAMRYGQPSIASRIDALKEQGCEKILLFPLYPQYAASTTATVNDKAFEHLMKLRWQPAIRTVPPYHDDPAYIEGLAASVKNHLATLDWEPEMLITSFHGIPQSYFKKGDPYYCHCQKTARLLREALGRTEKNFMITFQSRFGPEEWLQPYTDKTVEKLASEGIKRIAVMNPGFVSDCLETLEEIAGEAGEIFLHNGGEKFTHIPCLNDSTEGMNVLEKVVRRELQGWV

SEQ ID NO: 15210 - protein, 508 aa, Agrobacterium tumefaciens
YELNILHINDFHSRIESINKFDSTCSAEEEGKNECFGGAARLLTAINQTRDALKAGGKNVLLLNAGDNFQGSLFYTTYKGTVEAEVLNAMKFDAMTVGNHEFDDSEDGLAGFLDKVQFPVVTANVVATAASKIGDRVKPSIVLEVGGQKIGIVGAVANDTAELATPGPNITIAEDVAKIGEQVQKLKQDGVNKIIALTHVGYPRDLEFIAKIPDVDVVVGGHSHTLLSNTDQKAEGPYPTLVDNPGGYKVPVVQAGQYSKYLGDLKVVFDDNGVVKESKGDPILIDSTFKPDEATLKRIDELKAPIEALKSKVVGTSEGPIEGDRKVCRVKECSMGNLVADATLARVKDQGVTIAFANSGGLRSSIDGGDVSMGEVLTVLPFQNTVATFQLKGEDIRAALENGVSQIDDVAGRFMQVSGMKYSFDRSKPAGSRIVSVDVKEGDGFVPLDPTKTYTVAANNYVRTGGDGFKVFATNAINAYDFGPNLEDAVAAYITANSPYKPYTDGRI

SEQ ID NO: 15211 - protein, 471 aa, Agrobacterium tumefaciens; identical to SEQ ID NO: 11606

SEQ ID NO: 15212 - protein, 584 aa, Agrobacterium tumefaciens
KAAKQRSLKPLLGLFPYLRRYRGLMAAALFALVLSSATTLALPLAVRRIIDHGFQTPDGGMINSYFAMLLAIAVVLALASAMRYYYVMTIGERVVADLRRDVFAHLTTLSQQFFDSNRSGELTSRLTADTVQIRSAFGSSASVALRNIIMCCGAVAMMIYTSPGLSGLALLAIPFIVFPLIAFGRSVRARSRTTQDTLANSAAYASETIAASRTVQSFNAEVLANARYGASVEAAYQGARAAIGARSVLTAVAIALVFGSVVGILWYGAQNVLAGSMTAGTLGQFVLYSVIAASGLGQLSEVWGELAQAGGAAERLSELLNERSPVAEPAAPVAMPQPPRGEAEFDNVDFVYPLATGRPIVSGLSLKVAAGETVAIVGPSGAGKSTVFSLLMRFYDPQQGRITIDGVDIRNVSLADLRARLSIVPQDVAIFASSIHDNIAFGRPEATREDVRAAAIAAQADGFIERLGDGYDTQVGERGVTLSGGQRQRIAIARAILRDAPILLLDEATSALDAESETLVQKALDELMKTRTTIVIAHRLATVLKADRILVMDEGRIIEEGTHQSLIRQNGLYARLARLQFQTG

SEQ ID NO: 15213 - protein, 319 aa, Agrobacterium tumefaciens; identical to SEQ ID NO: 14398

SEQ ID NO: 15214 - protein, 394 aa, Agrobacterium tumefaciens; identical to SEQ ID NO: 11609

SEQ ID NO: 15215 - protein, 255 aa, Agrobacterium tumefaciens; identical to SEQ ID NO: 14741

SEQ ID NO: 15216 - protein, 576 aa, Agrobacterium tumefaciens; identical to SEQ ID NO: 11697

SEQ ID NO: 15217 - protein, 409 aa, Agrobacterium tumefaciens
ILNEAARFAETVLEPLNTPADREGCTVVDGRVRVPTGFADAFRRHAGDGWLAMDVPERFGGQALPLVLQAACAPLFERGCVALMMASGSTRAACHLLAETAEGAVADEWVPRLAAGEWAATICISEPDAGSDLARLRSRAVFREGAWRIEGRKIWISFGDHDMAMRIGHCLLARTGEETGTRGLSLFLVPDEIDGERNGVTVERIEEKMGLHGSPTCALRFDGARGLLLGEEGRGLAQLFAMIELMRLQTGCQGLGLASAAIDIAETYAQERQQGGDPAKPAVAIAHHPDIRRQLQEARLRTETLRAATLELATVMDLARMEPKEELRGDLQALSRWLLPLVKNFGADAGFTVSNQAIQILGGAGYTREWPLEQYLRDARVMTIYEGTTGMQAIDLLTRRLWREGGKGL

SEQ ID NO: 15218 - protein, 480 aa, Agrobacterium tumefaciens
MAQSYDVIIIGSGPGGYIAAIRAAQLGMKVAVVEREHLAGICSNWGCIPTKALLRTADVMHTATHAKDYGLTLEGSIKPDVKAIVARSRGIAARMNNGVGFLFKKNKVDIIWGEAKITKPGEIVVGKSTKPVVQPQGPVPKNTLGEGTYTAKHIIVATGARPRALPGIEPDGKLIWTYFEAMKPEELPKSLLVMGSGAIGIEFASFYRTMGVDVTVVEIMSQVMPVEDAEISAFAKKQLEKQGIKIHLETKVSKVEKAANSVTATLEKKDGSSEKIIADRMISAVGVVANVEGIGLEAAGVKTDRGFIIIDGYGKTNVPGIYAIGDVAGPPLLAHKAEHEAVICVEKIAGLPNVHPMDKLKIPGCTYCNPQVASVGLTEAKAKEQGRDIRVGRFSFAANGKAVALGEDQGMVKTIFDKKTGELLGAHMVGAEVTELIQGFVVAMNLETTEEDLMHTIFPHPTISESMKESVLDAYGRVLN

SEQ ID NO: 15219 - protein, 452 aa, Agrobacterium tumefaciens; identical to SEQ ID NO: 11693

SEQ ID NO: 15220 - protein, 473 aa, Agrobacterium tumefaciens; identical to SEQ ID NO: 11694

SEQ ID NO: 15221 - protein, 347 aa, Agrobacterium tumefaciens; identical to SEQ ID NO: 11695

SEQ ID NO: 15222 - protein, 423 aa, Agrobacterium tumefaciens
MTAITDIIAREILDSRGNPTVEVDVYLEDGSMGRAAVPSGASTGAHEAVELRDGGKRYLGKGVEKAVEAVNTEIFDAIGGFDAENQIQIDQMMIALDGTPNKSRLGANAILGVSLAIAKAAAEASGLPLYRYVGGPNAHLLPVPMMNIINGGVHDHNPIDFQQFMILSVGAENIREAVRMGSEVFHTLKKELSAQGHNTNVGDEGGFAPGLESAPAALDFIMKSIEKAGYRPGEDMYVGLDCASTEFFKDGKYVLEGEGRTLEPGAMAEYLAELVNKYPIISVEDGMAEDDWEGWKTLTDLVGNKCQLVGDDLFVTNSARLRDGIKMGVANSILVKVNQIGSLSETLDAVETAHKAGYTAVMSHRSGETEDSTIADLAVATNCGQIKTGSLARSDRLAKYNQLIRIEEMLGPQAAYAGRSILR

SEQ ID NO: 15223 - protein, 252 aa, Agrobacterium tumefaciens
MSNQIIFDLGGRTALVTGSSRGLGRAMAEGLAVAGARILINGTDPSRVAQTVQEFRNVGHDAEAVAFDVTSESEIIEAFARLDEQGIDVDILVNNAGIQFRKPMIELETADWQRVIDTNLTSAFMIGREAAKRMIPRGYGKIVNIGSLTSELARATVAPYTVAKGGIKMLTRAMAAEWAQYGIQANAIGPGYMLTDMNQALIDNPEFDAWVKARTPAKRWGKPQELVGTAVFLSASASDYVNGQIIYVDGGM

SEQ ID NO: 15224 - protein, 188 aa, Agrobacterium tumefaciens; identical to SEQ ID NO: 11747

SEQ ID NO: 15225 - protein, 403 aa, Agrobacterium tumefaciens
TRLSSGLTVVTERMPHLESVALGVWIKSGSRNETTAEHGIAHLLEHMAFKGTARRTARQIAEEIENVGGEVNAATSTETTSYYARVLKDHVPLAVDILADILTESLFDEDELEREKNVILQEIGAATDTPDDVIFDNFSGVAYRDQTIGRPILGTPDTVQSFTSGEIRHYLARNYTTDRIFVVAAGAVDHESFVKQVEERFASLPLVPAAPPVMEKAIYTGGEIRETRDLMDAQVLLGFEGKAYHARDFYCSQILANILGGGMSSRLFQEVREARGLCYSVYAFHWGFSDTGIFGVHAATGGNDLPELIPVIVDELRKSSETIHQDEINRARAQIRAQLLMGQESPAARAGQIARQMMLYGRPIPNEEMMTRLEDITRERLTDLAGRLFFDTVPTLSAIGPLE

SEQ ID NO: 15226 - protein, 881 aa, Agrobacterium tumefaciens; identical to SEQ ID NO: 11745

SEQ ID NO: 15227 - protein, 1149 aa, Agrobacterium tumefaciens
LRVVGFKSFVEPSEFIIEPGLTGVVGPNGCGKSNLVEALRWVMGENSYKNMRASGMDDVIFSGSGNRPARNTAEVGLYLDNSDRTAPAAFNDADEIQVTRRIERENGSVYRINGKEARAKDVQLLFADASTGARSPSMVGQGRIGELINAKPQARRQLLEEAAGISGLHSRRHEAELRLRAAETNLERLEDVTAQLESQIESLKRQARQANRFKMLSADIRAREATLLHIRWVEAKEAEGEAESALNQATNIVAEKAQGQMEAAKQQGIASLKLPELREDEARVAAALQRLQIARTQLDDEANRLLRRRDELARRLSQLGEDIVREERLVADNAQILARLDEEEAELLDILSDSGRHADEMREAFEAAAVKLAESEAVFTSITAERAEAAAGRQQLERAIRDLSDRKLRLERQSQEASAEIDTIDEKLSGLPDPAERREAVEAAEIAVEDALIVAEEAEAAGCRGAFREALARGPLETAKNRLNALDTEARTITKMLATSAAANGSFTPVAEEMTVERGYEAALGAALGDDLESPLDASAPAYWGGNGNGADDPGLPQGAKPLLDYAQAPDALRRALAQIGVVADVSEARRLLPSLKAGQRLVTREGALFRWDGHIASADAPGAAALRLSQKNRLAEIEAELDEARSILEEAEDQLAAKTEDIRSSELRLSEVRDRSRLATRQLAEAREALTSAERASGDLLRRRDVVSEAQNQIGAQIDEIAVQEENARIEMEDAPDLSVLDLRLRESQLEVATDRGLLAEARARHEGVSREAESRQRRIQAIGQERSTWASRAASAADHIATLREREEEAREEIAELDIAPEEFDEKRRNLLNELQKTEDARRAAADRLAEAENLQRAADRVAATALSELAEAREKRGRAEERLVSAREKRLETEHRIRETLNTEPHMAFRLTGLGPDQPKPDIRDVERDLDRLKIERERLGAVNLRAEEEQAELSGKLEALIKERDDIIDAVRKLRAGIQSLNREGRERLIAAFDVVNSQFQRLFTHLFGGGTAELQLIESDDPLEAGLEILARPPGKKPQTMTLLSGGEQALTAMALIFAVFLTNPAPICVLDEVDAPLDDHNVERYCNLMDEMVASTETRFVIITHNPITMARMNRLFGVTMAEQGVSQLVSVDLQTAEQLREA

SEQ ID NO: 15228 - protein, 481 aa, Agrobacterium tumefaciens; identical to SEQ ID NO: 11729

SEQ ID NO: 15229 - protein, 204 aa, Agrobacterium tumefaciens; identical to SEQ ID NO: 11540

SEQ ID NO: 15230 - protein, 256 aa, Agrobacterium tumefaciens; identical to SEQ ID NO: 14751

SEQ ID NO: 15231 - protein, 226 aa, Agrobacterium tumefaciens
AIARRLIESGAKVSLWDMSETAIEQACGVLGEGASGKVVDVTDFAGLARVHAEVEAETGPVSILVNSAGIAGSNATLEDYDIEEWRRVVEINLNGTFYVNKTVIPSMKARNYGRIVNISSVAGKEGNPKLSAYSAAKAGVIGLTKSLGKELAAHDIAVNAITPATARTRILETLTPEFIDYMLTRIPRGRFLEVEEAAAMVAWLVSRENSFTTASVFDLSGGRTTY

SEQ ID NO: 15232 - protein, 393 aa, Agrobacterium tumefaciens
SERAAFHWQDPFLLEDQLTDDERMIRDSAEAFGKSELLPRISEAYLSETTEPELFRLMGRTGLLGVTLPEEYGAANASYVAYGLVAREVERIDSGYRSMMSVQSSLVIHPIFAYGSDEQKKKYLPGLVSGELIGCFGLTEPDAGSDPGGMKTRAEKIEGGYRLRGSKMWISNAPIADVFVVWAKSEAHDNEIRGFVLEKGMKGLSAPKIGGKLSLRASITGEIVMDGVEVGEDALLPNVSGLKGPFGCLNRARYGISWGVMGAAEDCWFRSRQYGLDRKQFGKPLAGTQLYQKKLADMQTEIALGLQASLRVGRLMDEHKMAPEMISIVKRNNCGKALDIARQARDMHGGNGIQIEYHVMRHAQNLETVNTYEGTHDVHALILGRAQTGIQAF

SEQ ID NO: 15233 - protein, 850 aa, Agrobacterium tumefaciens
PPTWFSNTSIQRRQAAMSSELTRRNLLKAHAAGIAAATAGIALPAAAQPVPGGVSALQIKWSKAPCRFCGTGCGVMVGVKEGKVVATHGDMQAEVNRGLNCIKGYFLSKIMYGKDRLETPLLRKKNGVYAKDGEFEPVSWDEAFDVMAQQCKRVLKEKGPTAVGMFGSGQWTIFEGYAATKLMRAGFRSNNLDPNARHCMASAAYAFMRTFGMDEPMGCYDDFEHADAFVLWGSNMAEMHPILWTRIADRRLGFDHVRVAVLSTFTHRSMDLADIPMVFKPGTDLVILNYIANHIIKTGRVNEDFVRNHTKFVRGVTDIGYGLRPDDPVEVNAANSADPTKTEAIDFETFKEFVSEYTLEKTAAMTGVEAGFLEELAELYADPKRKVMSLWTMGFNQHVRGVWANQMVYNIHLLTGKISEPGNSPFSLTGQPSACGTAREVGTFAHRLPADMTVTNPEHRKHAEEIWRIPHGIIPEKPGYHAVQQDRMLHDGKLNFYWVQVNNNVQAGPNTKNETYLGYRNPENFIVVSDAYPTITAMSADLILPAAMWVEKEGAYGNAERRTHVWHQLVEASGEARSDLWQLVEFSKRFTTDEVWPAEILDANPAYRGKTLYEVLYKDSDVGKFPLSEINADYKNQESSDFGFYLQKGLFEEYAAFGRGHGHDLAPYDAYHEVRGMRWPVVDGKETLWRYREGYDPYVKPGEGVKFYGNKDGRAVIIAVPYEPPAESPDQEFDTWLVTGRVLEHWHSGSMTMRVPELYKAFPGARCFMNADDARKRGLNQGAEIRIVSRRGEIRSRVETRGRNRMPPGVIFVPWFDASQLINKVTLDATDPISKQTDFKKCAVKIEPVA

SEQ ID NO: 15234 - protein, 285 aa, Agrobacterium tumefaciens; identical to SEQ ID NO: 14755

SEQ ID NO: 15235 - protein, 712 aa, Agrobacterium tumefaciens
CPVMHGGNTASGKSVTEWWPNALNLDILHQHDTKTNPLGTSFNYREALKTLDVEALKADLRALMTDSQEWWPAHWGSYVGMMARVTWHAAGSYRVTDGRGGANTGNQRFAPLNSWPDNVNTDKGRRLLWPIKKKYGNKISWADLIALAGTIAYDVAGLKTFGFAFGREDIWAPEKDTYWGDEKEWLAPSDGRYGDVSKPETLENPLAAVQMGLIYVNPEGVNGKSDPLATAAQMRETFARMGMDDEETVALTAGGHTIGKSHGNGSAANLSPDPEAAGPEYQGLGWINTKGRGIGRDTVVSGIEGAWTSEPTKWDNGFFDMLFKHEWTLTHSPAGASQWAPITIAEEDKPVDVEDASIRTIPMMTDADMALKVDPIYREISLKFKDDQDHFSDVFARAWFKLTHRDMGPKSRYVGPDVPAEDLIWQDPIPAGSTSYDVAAVKAKIAASGLSVADLVSTAWDSARTFRGSDKRGGANGARIRLAPQKDWEGNEPARLSRVLSVLEPIARETGASIADVIVLAGNYGVEQAAKAAGFDIAVPFAAGRGDASAEQTDADSFAPLEPLADGFRNWVKKDYVVSPEELLLDRAQLLGLTAPELTVLIGGLRVIGANYGGAAHGVFTDKPGALTTDFFTTLTDMAYSWVPTGNNLYEIRDRKTGAARYSATRVDLVIGSNSILRAYAEVYAQDDNREKFARDFIAAWTKVMNADRFDL

SEQ ID NO: 15236 - protein, 483 aa, Agrobacterium tumefaciens
MQTVNLFIGGDHCAAANGKRFERNNPITGDAVTSAAAASVEDATNAADAAAAAFPKWSATTPGERRRHLLAAAEALRAAGPQIIQAMMEEIGATEAWAGFNVMLASDMLVEAASLTTHITGEVIPSNRPGTMAMALRQPAGVVLSMAPWNAPVILGVRSIATPLACGNTVVMKTSELCPRTHALIIEAVASAGLPKGVLNAISNAPDDAAKIVETLIAHPAVRRVNFTGSTRVGRVIAETAGRYLKPALLELGGKAPFIVLDDADIDAAVAAAAFGAYMNQGQICMSTERIIVLDSIADTFVEAFAKKAASLTAGDPREGKTPLGSLVSAEAASRIRVLVDDAVSKGARRVAGGGGDGTMLDAIAVDGVTPAMRLYSEESFGPVVSIIRAGSIDEAVSIANESEFGLSAAVFGRDQARALSVAARIESGICHVNGPTVHDEAQLPFGGVKASGYGRFGGTAGIAEFTELRWVTLQDGPLHYPI

SEQ ID NO: 15237 - protein, 501 aa, Agrobacterium tumefaciens; identical to SEQ ID NO: 11419

SEQ ID NO: 15238 - protein, 484 aa, Agrobacterium tumefaciens
SFKIAIIGAGSVGFTKKLFTDLLCVPEFRDIEVALTDISQHNLDMIKAILEKIVEANGFPVKVTADTDRRRALEGAKYIISCVRVGGLEAYADDIRIPLKYGIDQCVGDTICAGGILYGQRNIPVILDFCKDIREVAAPGAKFLNYANPMAMNTWAAIEYGKVDTVGLCHGVQHGAEQIAEILGAESPSELDYICSGINHQTWFIDLRLNGRRIEKDELVAAFEAHPVFSQQEKLRIDVLKRFGVYSTESNGHLSEYLPWYRKRPEEIARWIDMSDWIHGETGGYLRHSTETRNWFETEFPQFLASAAKPIEPAKRSNEHASHILEALETGRVYRGHFNVKNNGVITNLPSDAIIESPGFVDRFGINMVSGITLPEACAATCMASINVQRMSVHAAVSGDIDLLKLAVLHDPLVGAVATPEEVWQMVDEMVVAQARWLPQYADAVPAAKERLAKSTVKTRDWAGAARRNVRSIEELRAEKSALK

SEQ ID NO: 15239 - protein, 446 aa, Agrobacterium tumefaciens
MARDPKITFIGAGSTVFMKNIIGDVLQRPALSGATIALMDINRERLEESAIVVNKLISTLGAKAKAETYTDQKKALAGADFVEVAFQIGGYEPCTVTDFEVPRKYGLRQTIADTLGVCGIMRGLRTVPHLWKICEDILAVCPNAVMLQYVNPMAINTWAIAEKYPTIRQVGLCHSVQGTAMELAHDLDIPYEEIRYRSAGINHMAFFLEFEHRQPDGSYRNLYPDLVRGYREGRAPKPGWNPRCPNKVRYEMLTRLGYFVTESSEHFAEYTPYFIKEGRDDLIEKFGIPLDEYPKRCIEQIERWKGQAAAYRSAEKIEVKQSKEYASSIINSVWTGEPSVIYGNQRNNGCITSLPSDCAAEVPCLVDHNGVQPTFIGELPPQLAPLMRTIINVQELQVRAPMSENRAHIFHAAMMDPDTGGELDLDQIWSLVDDLLLAHRDWLPEW

SEQ ID NO: 15240 - protein, 432 aa, Agrobacterium tumefaciens; identical to SEQ ID NO: 11534

SEQ ID NO: 15241 - protein, 473 aa, Agrobacterium tumefaciens; identical to SEQ ID NO: 14765

SEQ ID NO: 15242 - protein, 281 aa, Agrobacterium tumefaciens; identical to SEQ ID NO: 14766

SEQ ID NO: 15243 - protein, 172 aa, Agrobacterium tumefaciens
IERLEVQNATLRYNQRIIAEDLSVKIPDGSFTVIVGPNACGKSTLLRALSRLLTPSAGEVILDGKAIAGYPAKQLARAIGLLPQSSIAPDGITVAELVARGRYPHQSLFRQWSSEDEAAVALAMAATQTTQLSTRLVDELSGGQRQRVWVAMVLAQETPILLLDEPTTFLDI

SEQ ID NO: 15244 - protein, 305 aa, Agrobacterium tumefaciens; identical to SEQ ID NO: 11533
  unsure (1)..(305): unsure at all Xaa locations

SEQ ID NO: 15245 - protein, 424 aa, Agrobacterium tumefaciens
  unsure (1)..(424): unsure at all Xaa locations
VREGVVLALPSDDLPAPAQLLKAALKPFARSKAKRAQRSDRLAVAVERLGPSYVKMGQFLATRPDVVGADFADDLASLQDRMAFFPAAAAKANIEGSLGRSISELYREFGDPIAAASIAQVHPAMVDTPKGPRKVAVKVIRPGVRQRFQNDLEAMYLIADLQQRFVRSARRLRPVEVTRTLEQTTKIEMDLRLEAAALSELAENTRQDPGFRVPEVDWERTGRDVVTMEWIDGVKMSDIEGLKAAGHDLNKLADTLIQSFLRHTLRDGFFHADMHPGNLFVDAKGEIVAVDMGIAGRLGKKERRFLAEILYGFITRDYMRVAEVHFEAGYVPGHHDKASFAQAIRAIGEPIHGQPAETISMGKLLTCCSKXPSLFDMETRPELVMLQKTMVVVEGVSRMLNPRFNMWKAADPVVGGWIRDNLGP

SEQ ID NO: 15246 - protein, 881 aa, Agrobacterium tumefaciens
ATPMMEQYIEIKANNPGSLLFYRMGDFYELFFDDAVEASRALGITLTKRGQHMGHDIPMCGVPVHAADDYLQKLILRGYRVAVCEQIEDPAEAKKRGSKSVVKRDVVRLVTPGTLTEEKLLSPTESNYLMALARIRGSAEAQFALAWIDISTGVFRLAETTLTRLLADIWRIDPRELIVADSLFHDEELRPVFDVLGRVAVPQPAILFDSAVAEGRIARYFNVSTLDGFGTFSRVEMAAAAAAVAYVEKTQIAERPPLGAPERESAASTLFIDPATRANLELVKTLSGDRDGSLLHALNRTVTGGGARLLAERLMSPLTDPERINARLDAVAYLIDDVSLCDGLRDALKHVADMPRALSRLALERGGPRDLGAIRQGLVSAEKIAVILDGGLLPDELAKALRDLKALPGALEAMLGSMLADDLPLLKRDGGFLREGANPELDEVRALRDQSRRVIAGLQLQYADETGIKSLKIKHNNVLGYFIEVTAGNADVMMATDEAKARFIHRQTMAGAMRFTTTELADLESRIANAAAEALTMELEAFERMVEAVVQQAEAIKAGALALAVIDVASSLAYLATEQAYCRPIVDAFMTFSIKGGRHPVVEQALRRQSAGPFIANNCDLSAVNGGKNGAIWLLTGPDMGGKSTFLRQNALIAILAQIGSFVPAEAAHIGVVDRLFSRVGASDDLARGRSTFMVEMVETAAILNQATDRSLVILDEIGRGTATFDGLSIAWAAVEHLHEVNRCRGLFATHFHELTVLSEKLGRLSNATMRVKEWEGDVIFLHEVGPGAADRSYGIQVARLAGLPASVVERAREVLTKLEDADRKNPASQLIDDLPLFQIAVRREETRKAGPSKVEEALKSFNPDEMTPREALYALYALKK

SEQ ID NO: 15247 - protein, 680 aa, Agrobacterium tumefaciens; identical to SEQ ID NO: 14769

SEQ ID NO: 15248 - protein, 239 aa, Agrobacterium tumefaciens
MDLRLIFGPTCTGKTSTAIALAQQTGLPVLSLDRVQCCPQLSTGSGRPTVEELKGTTRLYLDDRPLVKGIITAKQAHERLIAEVHNHEAKGGLILEGGSISLLRCMAQSRYWNADFRWHIIRNELADEESFMSVAKTRVKQMLRPSAGLSIIQELVQLWREPRLRPILEGIDGYRYALLFATQNQITPDMLLQLDADMENKLIHGIAQEFLIHARRQEQKFPLVGATAVEAFEGPPFRM

SEQ ID NO: 15249 - protein, 240 aa, Agrobacterium tumefaciens
MDLHLIFGPTCTGKTTTAIALAQQTGLPVLSLDRVQCCPQLSTGSGRPTVEELKGTTRLYLDDRPLVEGIIAAKQAHHRLIEEVYNHEANGGLILEGGSTSLLNCMARNSYWSADFRWHIIRHKLPDQETFMKAAKARVKQMLHPAAGHSIIQELVYLWNEPRLRPILKEIDGYRYAMLFASQNQITADMLLQLDANMEGKLINGIAQEYFIHARQQEQKFPQVNAAAFDGFEGHPFGMY

SEQ ID NO: 15250 - protein, 167 aa, Agrobacterium tumefaciens
MTVANWQVRDLTLILRTGEMKSRLEQARTDFGALLSETVYFQPSAIRLGEFDDEYIHSRQELVYVYLREDIARQCALRRNLPSNSSNFGTMATAIPPWLMNARSLNRVMQERCDQGGLVNYYQGPHTNQFFLAIMPSNCFVRFGTDIINNENYGFKPGEEYTRGRRR

SEQ ID NO: 15251 - protein, 324 aa, Agrobacterium tumefaciens; identical to SEQ ID NO: 11356

SEQ ID NO: 15252 - protein, 324 aa, Agrobacterium tumefaciens; identical to SEQ ID NO: 11356

SEQ ID NO: 15253 - protein, 240 aa, Agrobacterium tumefaciens; identical to SEQ ID NO: 15249

SEQ ID NO: 15254 - protein, 243 aa, Agrobacterium tumefaciens
MILHLIYGPTCSGKTDMAIQIAQETGWPVVALDRVQCCPQIATGSGRPLESELQSTRRIYLDSRPLTEGILDAESAHRRLIFEVDWRKSEDGLILEGGSISLLNCMAKSPFWRSGFQWHVKRLRLGDSDAFLTRAKQRVAEMFAIREDRPSLLEELAELWNYPAARPILEDIDGYRCAIRFARKHDLAISQLPNIDAGRHVELIEAIANEYLEHALSQERDFPQWPEDGAGQPVCPVTLTRIR

SEQ ID NO: 15255 - protein, 243 aa, Agrobacterium tumefaciens; identical to SEQ ID NO: 11359

SEQ ID NO: 15256 - protein, 272 aa, Agrobacterium tumefaciens
MRVCGVGDNVVDRYFNQKLMFPGGNAVNFAVHAQRSGMDAAYIGVIGTDADGDLIRSSLQAEGVELKHLRVKEGPNAFATVHMDEDGNNRVWGLCEKGVSMFQLDTADLEYLGKFDLAHTGETSQLDSQLPAMRERVAISFDFSDRSLDYAASVLPYIKIAAFSRSDASDDEVKRVLDTAVSAGVELVTVTQGARGATVCHRGNVLFAPAVPVDAVDTLGAGDAFLSRLACRVLAGVTLNEAARDGAQYAAHICGTRGAFGHARPITREIPA

SEQ ID NO: 15257 - protein, 248 aa, Agrobacterium tumefaciens
MKLQGKTAVITGAGRGIGRATALELAKEGCNVVLAAIELNEVEAVAEEVRAIGSEALALRTDVQHKSEVDALAKAAFERFGAVDILVNNAGVAIHNTIPNIKEADWDWMMAINLKGTFLCTQAFFQHMCDRRHGHIINVVSRARKVASAKFGAYAASKFGMLGFTQTTDQEGIEFGVKATAVCPGAVDTQQRSDNHVDDRSQLLQPEDVAEYIAFIVTRHDRVYIGEVSPIAQQLKPLPGSGWLKPGI

SEQ ID NO: 15258 - protein, 354 aa, Agrobacterium tumefaciens
MEYRLLGRSGLKVSTLTVGTMTFGGVGWAKTVGDLGVTEAKRLVDLCLDAGINLIDTADVYSDGKSEEILGEILGGKRKGGALVATKARFNMGPGPNDGGLSRQYLIAACEASLKRLKTDVIDLYQLHEWDGQTPLEETMEALDTLVRQGKVRYIGCSNFTGWQIMKALGISEKDKRQRFVSQQIHYTLEARDAEYELLPISVDQGLGVLIWSPLAGGLLSGKHRRNQSAPEGSRQFAGWTEPPVRDEERLWNIVDTLLSVADGRGVSAAQVALAWLIGRKAVTSIIIGGRTEAQFKDNLAAADLQLSAEERKRLDDVSLLQLLYPYWHQRNNASDRLSEADLELLAPHLSKKG

SEQ ID NO: 15259 - protein, 578 aa, Agrobacterium tumefaciens
NRLKRRSDWIENLTLFQVYTRALRYLTVHKWRVAVVVIANVILAAITIAEPVLFGRIIDAISSGTNVTPILILWAGFGVFNTVAYVAVAREADRLAHGRRATLLTEAFGRIISMPLSWHHLRGTSNALHTLLRASETLFGLWLEFMRTHLATFVALVLLIPTAMAMDLRLSFVLIGLGIVYWFIGKWVMGRTKDGQASVEEHYHSVFAHVSDSISNVSVLHSYNRIEAETKALKSFTEKLLSAQYPVLDWWAFASALNRTASTVSMMIILVIGTVLVKNGELRVGDVIAFIGFANLLIGRLDQMRQFVTQIFEARAKLEDFFVLEDAVKEREEPGDARELSNVSGTVEFRNINFGFANTKQGVHDVSFTAKAGETVAIVGPTGAGKTTLINLLQRVYDPDSGQILIDGTDISTVTKNSLRNSIATVFQDAGLLNRSIRENIRLGRETATDAEVVEAAAAAAATDFIDSRINGYLTQVGERGNRLSGGERQRIAIARAILKNAPILVLDEATSALDVETEARVKAAVDALRKNRTTFIIAHRLSTVRDADLVLFLDQGRIIEKGTFDELTQRGGRFTSL

SEQ ID NO: 15260 - protein, 370 aa, Agrobacterium tumefaciens
MTVRSVFLLPGDGIGPEAMTEVRKLIEYMNSAHNAGFTVSEGLVGGSAYDAHGVAISDADMEKALAADAILFGAVGGPKWDGVPYEHRPEAGLLRLRKDLELFANLRPAICYPALAAASSLKPELVEGLDILIVRELTGGVYFGEPKQIIDLGNGQKRGIDTQIYDTFEIERIASVAFELARSRDNRVCSMEKRNVMKSGVLWNQVVTETHAAKYKDVQLEHMLADAGGMQLVRKPKQFDVIVTDNLFGDMLSDVAAMLTGSLGMLPSASLGAPDAKTGKRKAMYEPVHGSAPDIAGKSIANPIAMIASFAMCLRYSFNMVDEATKLEAAIANVLDKGIRTADIMADGCRQVGTSDMGDAVLAEFKALSA

SEQ ID NO: 15261 - protein, 312 aa, Agrobacterium tumefaciens
MALATRATGGAGRRKPVRARCARGLHLVSCHKTQLLGFTIRNAASWTIHPQGCEDLTAAASTIIAPHDSPNTDGFNPESCRNVMISGVRFSVGDDCIAVKAGKRGPDGEDDHLAETRGITVRHCLMQPGHGGLVIGSEMSGGVHDVTVEDCDMIGTDRGLRLKTGARSGGGMVGNITMRRVLLDGVQTALSANAHYHCDADGHDDWVQSRNPAPVNDGTPFVDGITVEDVEIRNLAHAAGVFLGLPDVPSATSLSATSPIVSHDPSAVATPPIMADRVRPMRMRLVFEQADVVCDDPALLNDAPVSISSYFD

SEQ ID NO: 15262 - protein, 240 aa, Agrobacterium tumefaciens
MDLRLIFGPTCTGKTSTAIALAQQTGLPVLSLDRVQCCPQLSTGSGRPTVEELKGTTRLYLDDRPLVKGIIAAEQAHERLIAEVYNYEAHGGLILEGGSISLLKCMAQSGYWSADFRWHIIRHKLADEETFMKAAKARVKQMLCPAIGPSLIQELVYLWNEPRLRPILKEIDGYRYAMLFASQNRITPDMLLQLDADMEGKLIHGIAQEYLIHARRQEHEFPPVSAAAFEGFEGPPFGAY

SEQ ID NO: 15263 - protein, 633 aa, Agrobacterium tumefaciens
MAKVIGIDLGTTNSCVAVMDGKDTKVIENAEGARTTPSMVAFSDDGERLVGQPAKRQAVTNPTNTLFAVKRLIGRRYEDPTVEKDKALVPFEIVKGDNGDAWVKAQDKNYSPSQISAMILQKMKETAESYLGEKVEKAVITVPAYFNDAQRQATKDAGRIAGLDVLRIINEPTAAALAYGLDKKEGKTIAVYDLGGGTFDISVLEIGDGVFEVKSTNGDTFLGGEDFDMRLVEYLAGEFKKDQGIDLKNDKLALQRLKEAAEKAKIELSSSQQTEINLPFITADASGPKHLTPKLTRAKFESLVDDLVQRTVAPCKAALKDAGVTAAEIDEVVLVGGMSRMPKVREVVKQLFGKEPHKGVNPDEVVAMGAAIQAGVLQGDVKDVLLLDVTPLSLGIETLGGVFTRLIDRNTTIPTKKSQTFSTAEDNQSAVTIRVSQGEREMAQDNKLLGQFDLVGLPPSPRAVPQIEVTFDIDANGIVQVSAKDKGTGKEQQIRIQASGGLSDADIEKMVKDAEANAEADKKRRAGVEAKNQAESLIHSTEKSVKEYGDKVSETDRKAIEDAIASLKTAVEAAEPDADDIQAKTQTLMEVSMKLGQAIYEAQQAEAGDASAEGKDDVVDADYEEIKDDKKSA

SEQ ID NO: 15264 - protein, 98 aa, Agrobacterium tumefaciens
MTSTNFRPLHDRVVVRRVESEAKTKGGIIIPDTAKEKPQEGEIVAVGSGARDEAGKVVALDVKVGDRVLFGQWSGTEVKLDGEDSSIMKEADIMGIIG

SEQ ID NO: 15265 - protein, 543 aa, Agrobacterium tumefaciens
MAAKEVKPGASAREKMLKGVDILADAVKVTLGPKGRNVVIDKSFGAPPITKDGVSVAKEIELEDKFENMGAQLVREVASKTNDIAGDGTTTATVLAQAIVREGAKAVAAGMNPMDLKRGIDLAVAEVVKDLQAKAKKINTSEEVAQVGTISANGERQIGLDIAEAMQRVGNEGVITVEEAKTAETELEVVEGMQFDRGYLSPYFVTNPEKMVADLEDAYILLHEKKLSNLQAMLPVLEAVVQTGKPLVIIAEDVEGERLATLVVNKLRGGLKIAAVKAPGFGDRRKAMLEDIAILTGGTVISEDLGIKLESVTLDMLGKSKKVSISKENTTIVDGAGQKSDIEGRVAQIKAQIEETTSDYDREKLQERLAKLAGGVAVIRVGGSTEVEVKEKKDRIDDALNATRAAVQEGIVPGGGVALLRSSTKITVKGVNDDQEAGINIVRKALQSLVRQIAENAGDEASIVVGKILDKNEDNYGYNAQTGEYGDLIALGIVDPVKVVRTALQNAASVASVLITTEAMIAELPKKESAMPQMPGGGMGGMD

SEQ ID NO: 15266 - protein, 240 aa, Agrobacterium tumefaciens; identical to SEQ ID NO: 15262

SEQ ID NO: 15267 - protein, 240 aa, Agrobacterium tumefaciens; identical to SEQ ID NO: 11355

SEQ ID NO: 15268 - protein, 821 aa, Agrobacterium tumefaciens
MINNLTAADLPRPAPRSSNPEIMAAEIIERLTYRIGKDVKVAKPHDWLTATILVVRDPRIIDKWMASTRKAYADNSKRVYYLSLEFLIGRLMRDAISNIGLMHEIRDALSSLGVDLDVIAGLEPDAALGNGGLGRLAACFMESMATVDIPAYGYGIRYVHGLFRQQMADGWQVELPETWLAHGNPWEFERRESSYEIGFGGSVETIGGYEDPQRFVWKPAERVIAMAYDTPVVGWRGTRVNTLRLWSAQPIDPILLAAFNAGDHIGALRESNKAESLTRVLYPADATPAGQELRLRQEFFFSSASLQDILRRHLQQYPDFTSLPDKVSIQLNDTHPAISICEMIRLLCDVHGLEFDEAWRITQGTFSYTNHTLLPEALESWPVPLLERLLPRHMQIVYAINANTLLFARKEKKMADQQIRSISLIDEGGERRVRMGNLAFIGSHSINGVSALHTELMKETVFADLHSLYPERINNKTNGITPRRWLMQCNPGLTGLIREAIGDDFLDDAEKLIALDRFADDAGFREKFAEVKRLNKVRLANTVAQRMGLRVDPSAMFDIQIKRIHEYKRQLLNLIETVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGADNIVIFGMTAEEVSRARAEGHNPRAIIEGSAELSQALSSIASGVFSPDDRSRFSALMDGIYNSDWFMVAADFDAYADAQRKVDAIWSDQDSWNTKAVRNTARMGWFSSDRTIRQYATEIWRA

SEQ ID NO: 15269 - protein, 420 aa, Agrobacterium tumefaciens
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEAVRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 15270 - protein, 480 aa, Agrobacterium tumefaciens; identical to SEQ ID NO: 11375

SEQ ID NO: 15271 - protein, 542 aa, Agrobacterium tumefaciens
MIKTIKTTPYQDQKPGTSGLRKKVPVFAQENYAENFIQSIFDALEGFEGQTLVIGGDGRYYNREVIQKAIKMAAAAGFGKVLVGQGGILSTPAASNVIRKYKAFGGIVLSASHNPGGPTEDFGIKYNIGNGGPAPEKITDAIYARSKVIDSYKISDAADIDLDKIGSFKVDELTVDVIDPVADYAALMEELFDFGAIRSLIAGGFKVVVDSMSAVTGPYAVEILEKRLGAPKGSVRNATPLPDFGGHHPDPNLVHAKELYDDVMSPEGPDFGAASDGDGDRNMVVGKGMFVTPSDSLAIIAANAKLAPGYAAGISGIARSMPTSAAADRVAEKLGLGMYETPTGWKFFGNLMDAGKVTICGEESFGTGSNHVREKDGLWAVLYWLNIVAARKESVKDIVTKHWAEYGRNYYSRHDYEEVDSDAANTLVAILREKLATLPGTSYGNLKVAAADDFAYHDPVDQSVSKNQGIRILFEGGSRIVLRLSGTGTAGATLRLYVERYEPDAARHGIETQSALADLISVADTIAGIKAHTADSEPTVIT

SEQ ID NO: 15272 - protein, 244 aa, Agrobacterium tumefaciens
RLDGKVALITGGTRGIGLATAYAFGEAGAKLYLSARREEYEDAGAILTAGYDVTFYPADLKTREAACALVKRVADDAGRLDILINNAGIANGGDTPLFTEQQWRDVIATNVETVFWCSQAAIPVMREGGRGAIVNVGSMSGIVSNIPQNQVAYNSSKAAVHMMTKSLASELALDNIRVNAVAPGYIDTDMSRGGMVHPVRGPIWLEMTPMKRFGRPDEIATAILFLASEASSYVTGDILVVDGG

SEQ ID NO: 15273 - protein, 244 aa, Agrobacterium tumefaciens; identical to SEQ ID NO: 15272

SEQ ID NO: 15274 - protein, 306 aa, Agrobacterium tumefaciens
MDIRLIGAPLQIGAGQLGCEMGPSAYRIAGLTRALEDLGHRVVDTGNVTPAPLREFSHPNPAVHHLAETVAWTEALTEAAYRESAAAVPIFLGGDHAISAGTVAGMARRVAQSGRPFFVLWLDAHTDYHTLETTRSGNLHGTPVAYFSGRDGFSGYFPPLSHAVPEENIGMIGIRSVDPAERAALEDSGITVHDMRSIDEHGVAVLLRAFLARVQAANGLLHVSLDVDFLEPSIAPAVGTTVPGGATFREAHLVMEMLHDSGLVCSLDLVELNPFLDERGRTATLMVDLAASLMGKRVMDRPTRAG

SEQ ID NO: 15275 - protein, 1228 aa, Agrobacterium tumefaciens
MADGASKADVNPQQTVNGIFQNFAPPVREQSPLRKAITAAYRRPEEECLAPLIDAATVTPEQAAAIRTTATKLIEALRAKTKGTGVEGLVQEYSLSSHEGVALMCLAEALLRIPDTATRDALIRDKIARGDWKSHIGGGRSLFVNAATWGLVITGKLTSTVNDSGLSAALTKLIARAGEPVIRRGVDMAMRMMGDQFVTGETIGEAIKRSKPLEEQGFQYSYDMLGEAATTAKDAERYYKDYENAIHAIGKASAGRGIYGGPGISIKLSALHPRYARVQAERVMAELLPRVKSLMLLSKKYDIGLNIDAEEADRLELSLDLLEELALDKDLAGWNGLGFVVQAYGRRCPFVLDYIIDLAQRAGRRIMVRLVKGAYWDAEIKRAQVDGLEDFPVFTRKVHTDVSYIACARKLLAARDVVFPQFATHNAQSMATIYHLAGPDFKLGDYEFQCLHGMGEPLYSEVVGKKKLDRPCRFYAPVGTHETLLAYLVRRLLENGANSSFVNRIADPAVPVASLLEDPVTVVKAYPVPGARHDRIAAPAGLFGPERANSAGLDLSNETALAALDNVLKAGATTEWKAAAPHAGGKTRPVLNPGDHNDVVGYVTEPTEADVEAAMQRAAASNWSSTPVEERAACLERAADRMQAEMPALLGLIMREAGKSMPNAIAEVREAIDFLRYYAAEARKTFKANETPLGPVVCISPWNFPLAIFIGQVTAALVAGNPVLAKPAEETPLIAAQGVRLLHEAGVPQDAVQLLPGDGKTGAALVGSALTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDSLSVDVGPVITAEAKGIIEKHVDSMRALGHRIEQISLAGETGKGTFVPPTIIEMKSLADLKKEVFGPVLHVIRFKRDNLDRLIDEINATGYGLTFGLHTRLDDTIQHVLSRVAAGNLYVNRNIIGAVVGVQPFGGRGLSGTGPKAGGPLYLGRVTQTAPKIDRVASQQDQAAVDLARWLDENGQSVAAEAARQAAALSGLGFETELAGPVGERNVYALHPRGKVLLIPATEQGLYRQLAAALATGNSVVIDNASGLEKSIYGLPATVTSRITWADSWEKSAPFAGALIEGDAERVVAINKKIPALPGPLVLVQAATTEALDRETQPYNLDWLVEEVSVSVNTTAAGGNASLMSIG

SEQ ID NO: 15276 - protein, 394 aa, Agrobacterium tumefaciens
MDTGDRADFKRELLDGMQAMTRENRWRDVTGRVAAYDAAAEKIETVEVERPNLYATRAFSLSNWRLIAANWLSSNVLSYSLAFIGFGVAARFCHLRNAAHDGAASMKSGISKIAGIVSLSAMMLFAGLSLSRAASIPTDAWAAYKGAFLDPGGRIIDTGNSNISHSEGQGYGMWLAVLADNLSDFELIWSFTRTELLVRDDGLSAWKWDPRTRPHVTDINNATDGDILIAYAVALAAGQWNRQDYAEASAAIASVILKKTVVQRGGRTLLLPAAKRFWRGRIGPMGRVVNPSYLIFEAFPVLNLVAPSPLWKAVADDGVAQIGAFAFSDRKLPADWVSVKTKPQPASGFQPEFGYNAVRIPLYLARANMGAPELLSRLKDGMTLESRCLPAPSI

SEQ ID NO: 15277 - protein, 240 aa, Agrobacterium tumefaciens; identical to SEQ ID NO: 15249

SEQ ID NO: 15278 - protein, 167 aa, Agrobacterium tumefaciens; identical to SEQ ID NO: 15250

SEQ ID NO: 15279 - protein, 240 aa, Agrobacterium tumefaciens; identical to SEQ ID NO: 15249

SEQ ID NO: 15280 - protein, 167 aa, Agrobacterium tumefaciens; identical to SEQ ID NO: 15250

SEQ ID NO: 15281 - protein, 240 aa, Agrobacterium tumefaciens
MDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWHIIRHELAHEETFMNVAKARVKQMLRPASGLSIIQELVDLWKEPRLRRILKEIDGYRYAMLFVSQNQITSDMLLQLDADMEDKLIHGIAQEYLIHARRQEQKFPRVNAAAYDGFEGHPFGMY

SEQ ID NO: 15282 - protein, 240 aa, Agrobacterium tumefaciens
MDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWDIIRHELADEETFMNVAKARVKQMLRPAAGLSIIQELVDLWKEPRLRPILKEIDGYRYAMLFASQNQITSDMLLQLDADMEDKLIHGIAQEYLIHARRQEQKFPRVNAAAYDGFEGHPFGMY

SEQ ID NO: 15283 - protein, 473 aa, Agrobacterium tumefaciens; identical to SEQ ID NO: 14722

SEQ ID NO: 15284 - protein, 259 aa, Agrobacterium tumefaciens
MIHFSNPKNINLYSRYRKTLMDLRLIFGPTCTGKTSTAIALAQQTGQPVLSLDRVQCCPQLSTGSGRPTVEELKGTTRLYLDEQPLVKGIISAKQAHERLIAEVYNNEAHGGLILEGGSISLLKCMVQSSYWSNDFRWRIIRHKLADEETFMKAAKARVKQMLHPAAGLSIIEELVHLWNQPQLRPILEGIDGYRYAMLFASQNQITPDMLLQLGADMEDKLAHGIAQEYLIHARRQEQEFPSINAVAFEGFEGHPFGM

SEQ ID NO: 15285 - protein, 290 aa, Agrobacterium tumefaciens
VSFQGVTRRFGPVTAVDNVSLDISQGEFFALLGSSGSGKTTLLTLLAGFDNPNEGQVLMSGVSVSDVPPHKRQIGVVFQNYALFPHLTAAENVAYPLRMRGVARHEREERVKAALALVNLSDRLGAYPIQLSGGQQQRVALARALVFSPAILLMDEPLGALDRRLRDQMQQELKRIQHELGITVIYVTHDQSEAMAMADRIGIMSAGRLLQVADPEAIYAAPSSHFVARFIGECSILRVSGTNEGRGYEIAGAASHCPPPPMGHSISSLDRKTSRSGPHRQHPSTLSVFP

SEQ ID NO: 15286 - protein, 444 aa, Agrobacterium tumefaciens; identical to SEQ ID NO: 14995

SEQ ID NO: 15287 - protein, 478 aa, Agrobacterium tumefaciens
KLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPVVLIGPLIDQEAVPKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSDLGREGSHYGIDEYLEIKYLC

SEQ ID NO: 15288 - protein, 386 aa, Agrobacterium tumefaciens; identical to SEQ ID NO: 11517

SEQ ID NO: 15289 - protein, 211 aa, Agrobacterium tumefaciens; identical to SEQ ID NO: 14421

SEQ ID NO: 15290 - protein, 714 aa, Agrobacterium tumefaciens
GKCPVMHGGNTVSGKSVTEWWPNALNLDILHQHDTKTNPLGTSFNYREALKTLDVEALKADLRALMTDSQEWWPADWGSYVGMMARVTWHAAGSYRVTDGRGGANTGNQRFAPLNSWPDNVNTDKGRRLLWPIKKKYGNKISWADLIALAGTIAYDVAGLKTFGFAFGREDIWAPEKDTYWGDEKEWLAPSDGRYGDVSKPETLENPLAAVQMGLIYVNPEGVNGKSDPLATAAQMRETFARMGMDDEETVALTAGGHTIGKSHGNGSAANLSPDPEAAGPEYQGLGWINTKGRGIGRDTVVSGIEGAWTSEPTKWDNGFFDMLFKHEWTLTHSPAGASQWAPITIAEEDKPVDVEDASIRTIPMMTDADMALKVDPIYREISLKFKDDQDHFSDVFARAWFKLTHRDMGPKSRYVGPDVPAEDLIWQDPIPAGSTSYDVAAVKAKIAASGLSVADLVSTAWDSARTFRGSDKRGGANGARIRLAPQKDWEGNEPARLSRVLSVLEPIARETGASIADVIVLAGNYGVEQAAKAAGFDIAVPFAAGRGDASAEQTDADSFAPLEPLADGFRNWVKKDYVVSPEELLLDRAQLLGLTAPELTVLIGGLRVIGANYGGAAHGVFTDKPGALTTDFFTTLTDMAYSWVPTGNNLYEIRDRKTGAARYSATRVDLVIGSNSILRAYAEVYAQDDNREKFARDFIAAWTKVMNADRFDL

SEQ ID NO: 15291 - protein, 607 aa, Agrobacterium tumefaciens
MGQSLMLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGQQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQVHGNISPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 15292 - protein, 156 aa, Xanthomonas campestris
  unsure (1)..(156): unsure at all Xaa locations
VATALECIHVYSLIHDDLPAMDDDDMRRGKPTVHKAFDEATAILAGDCLHDLAFELLAHEATHADPFVRVELISELARSSGPAGMAGGQMMDLEAEKASFDLATVTRLQALKTGALISCAVECSAILGRVQHAGRTGLRGYTRNIGLAFQIVXAIL

SEQ ID NO: 15293 - protein, 229 aa, Xanthomonas campestris
  unsure (1)..(229): unsure at all Xaa locations
QLPFPAIRVNDSVTKSKFDNLYGCKESLVDAIRRAGDVMLAGKVACVAGFGDVGKGSAQSLRNGGARMMVTEIDPICALQAAMEGFEVVTMDEAVKRADIFVTATGNADVITADHMKAMKPMSIVCNIGHFDSEIQIAALSNYKWTEVKPGTDLVEFPDGKQIIILAKGRLVNMGXATGHPSFVMSASFTNQTLAHIELWTRGEHYKNEVYVLPKHLDEKVTALHLEKL

SEQ ID NO: 15294 - protein, 822 aa, Xanthomonas campestris
PTPSARTVVHKFGGTSVADAERYRHVAQLLLARDETVQVTVVSAMKGVTDALIELAELAAQNRPEWRERWHETRARHRGAAVALLGEHSGPTVEWLDERFEHLSQILAALAVIGELPREVLDRVQGLGEVYSAQLLGDHFRALGEDCAVLDARDVLVVNRGELGVDVDWAVSAQRLDTWRQAHPQTRVVVTGFVARDRGDRITTLGRNGSDYSGAIFAALFDAHELHIWTDVDGVLSADPRVVPEAVQLETLSYDEACELAYFGAKVVHPQTMSPAIERGLPIIIRNTFQPEHPGTRITASSAVSGPIKGLTLSPDLAVLNLEGTGLIGVPGTAERVFAALRTAQVSVVMISQGSSEHSICCVVKQHESERARNALLQAFAHEITVGQVQRVQLTTGISVLAAVGDGMAGQPGVAARLFESLGRAQVNILAIAQGSSERNISVAIDAAHATKALRAAHAGFWLSPQTFSVGVIGPGNVGAALLDQLRTAQPQLLGKANLDLRLRGVVSRGRMLLEERSVTGDWRDAFAAASTPTDLERFTAHLLSAHLPHTVIIDCSGSAEVADRYAGWLAAGIHVVTPNKQAGSGPLARYEAIRAAADASGARFRYEATVGAGLPVITTLRDLVDTGDAVTSIEGIFSGTLAWLFNKYDGSVPFSELVTQARGMGYTEPDPRDDLSGVDVARKLVILAREAGRAISLDDVSVESLVPEALRQASVDDFMAQLQTVDAGFAQRLADAHARGNVLRYVAQLPPDRAPSVGLVELPAHHAFANLRLTDNVVQFTTRRYCENPLVVQGPGAGPEVTAAGVFADLLRVAAGEGARL

SEQ ID NO: 15295 - protein, 473 aa, Xanthomonas campestris
MSSVSIDGAPDAGENTRFIILISCVATIGGFLFGFDSGVINGTVDGLKQTFQSSAFFTGLEVASMLIGCAIGAFFAGSLADRWGRRAVLIISAALFLVSAIAAGAAHNSWFFIFARMMGGLAVGAASVISPAYIAEVASARYRGRLATMQQIAIISGLFCAFLSNYLLANAAGASTEPLWAGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQM

SEQ ID NO: 15296 - protein, 464 aa, Xanthomonas campestris
FADLGLSDAVMKAVAAVGYETPSPIQAATIPALLAGRDVLGQAQTGTGKTAAFALPVLSNADLNQVKPQALVLAPTRELAIQVAEAFQKYAEAIPGFRVLPVYGGQPYAQQLSALKRGVHVVVGTPGRVIDHLDRGTLDLSQLKTLVLDEADEMLRMGFIDDVEAVLKKLPEKRQVALFSATMPPAIRRIAQTYLKDPAEVTIAAKTTTSANIRQRYWWVSGLHKLDALTRILEVEPFDGMIIFARTKAATEELAQKLQARGLAAAAINGDMQQAAREKTIAQLKDGKLDILVATDVAARGLDVERVSHVLNYDIPYDTESYVHRIGRTGRAGRNGDAILFVTPREKGMLRAIERATRQPIEEMQLPSVDAVNDTRVARFMTRITETLAGGQIEMYRDLLQRYESENNVPAIDIAAAMAKLLQGDAPFLLTPPVRGAREDFAPRERTDRADRGERPRFEPKFER

SEQ ID NO: 15297 - protein, 493 aa, Xanthomonas campestris
MSVLAPLAPLRAHAGRRLTAGLDDATIERLATDHPTLRQAIEAAGSEYALVQAEVADLLDLDEDAQISAVQDGFINFYADDAVTPYVALAARGPWVITLKGAVLYDAGGYGMLGFGHTPEAVLDAMARPQVMANVMTPSLAQRKLDRALRAEIGHTRGGCPFARFMCLNSGSEAVGLAARIVDTNAKLHTDPGARHAGATIKRLVVKGSFHGRTDRPGLYSDSSRKTYSKYLASYRDEDSVIAIAPYDIAALQHAFDEARANHWFIEAVFLEPVMGKDDPDRALPAEFYAAARTLTRNHGSLLLVDSIQAGLRAHGVLSVVDYPGFEQLDPPDLETYSKALNAAQYPLSVLAVTEQAAQVYRKGTYGNTMTTNPRALDVACATLALFTPQIRDNIRLRGAQALRKLEALQAELGGLITKVQGTGLLFSCELAPQYKCYGAGSTEEWLRHHGVNVIHGGENSLRFTPHFGMDEAELDLLVGLIAKALKEGPRQA

SEQ ID NO: 15298 - protein, 406 aa, Xanthomonas campestris
IAPMSAQPISDFHAYPDAAGHFGKFGGRFVAETLIAPLQELSAAYDLARQDPAFIAEYDKDLKHYVGRPSPIYHAERLSREVGGAQILLKREDLNHTGAHKINNTIGQALLASRMGKTRIIAETGAGQHGVASATVAARLGLECVVYMGATDIERQKINVYRMQLLGAKVIPVTSGSATLKDALNEAMRDWVSNVQDTFYIIGTVAGPDPYPRMVRDFNAIVGREARAQMLEDYGRLPDAISACVGGGSNAIGLFHAFLNDPGVKIYGAEAAGDGIASGRHAASIAAGRPGVLHGNRTYVICDDDGQIIETHSVSAGLDYPGVGPEHAFLSDSGRAVYQGITDDEALAAFHLLAHTEGILAALESSHAVAQSIKLAREMPKDALVLCNLSGRGDKDVHTIAAREGM

SEQ ID NO: 15299 - protein, 177 aa, Xanthomonas campestris
MNPAPNLVMIGPMGAGKSCIGRRLAERFGLDFVDVDQAIVEQVGSSIPAIFEQHGEARFRQHEAEALHGLLAQSNKLVSTGGGAILDAGNRQRIRERGFVVYLHVSVPAQLTRLARDRNRPLLQRPDREQVLHGMAALRTPLYQEVADLTLETDHLSPAEATAQLVLRLAAQWRMSS

SEQ ID NO: 15300 - protein, 370 aa, Xanthomonas campestris
MTLPPSLRSVEVDGAQPYTISIAPGLLADGARLARHVRGRHVLLLSDTQVAPHYAAGVRAALLQARPDLQLGELVIAAGEASKTLDNFSLAITALAELGATRDACVFALGGGVVGDLAGFAAACWMRGVDCVQLPTSLLAMVDSSVGGKTAVDIPQGKNLVGAFHPPRAVIADTDTLRTLPTRELRAGLAEVIKYGAIGDPLFFQWLHAERRALLDGDPAALAQAIARSCEHKADIVARDPLEKGERALLNLGHTFGHAIETEQGYGAPGNDNLNHGEAVAVGMVLAARLSAALGMADAQDTEALRTLLHEFGLPTQIPTGLAPEALLGRMRLDKKNIAGRLRLVLWRGIGKAEVVPDVDEAAVLEILAD

SEQ ID NO: 15301 - protein, 486 aa, Xanthomonas campestris
KSLLRVKPIEPAGRVDAGEPVEGSLQGEATLQRTLTAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGNILNLPAVLIVAAVSGLCYVGITQSAFINAIVVAIKIAVICLFVGFGAAYIDPANWHPFIPENTAPGVFGWSGVFRAASIVFFAYIGFDAVSTSAGETKDPQRNMPIGILGSLAVCTIIYIIVCAVLTGLMPYTQLGTAKPVATALEAHPQLTWLKTAVEIGAIAGLSSVVLVMLMAQPRIFYTMAKDGLMPKLFGKVHPKFHTPYVGTVIVGVVAASLAGLIPLSVLGELVSMGTLLAFATVCAGVMVLRFTKPELERPFRVPLAMIVCPLGTLACLALFFQAFQEHWKVFVGWTVIGLVIYFGYGIHHSRLAR

SEQ ID NO: 15302 - protein, 472 aa, Xanthomonas campestris
MFKQLWATKHPHASHEAADGLGLQRALGPWGLTALGIGAVIGGGIFVITGQAAADHAGPAIVLSFVLAAICCAFCAMAYAEFAAMVPVSGSAYTYTYATFGELAAWFIGWMLVLEYGVSASAVAVSWTGYFLSLLEHFGIHLPAALVSAPLDGKLQRTGAIANLPAAGIVLLLTWLCYVGIRKSSAMNMAMVILKTGLIILVIAAGWKYVDPANWHPFIPANEAPGKYGMEGVLRGAAMVFFAYIGFEAVSVAAQESHRPQRDLPIGMMLSLVICTVLYIAMAAVMTGLVPFTQLGTDEPVVTAVAAHPQLAWLRVVVEVGALIGLSSVVLVMIIGQPRIFMIIARDGLLPAVFTRIHPKYRTPHINTVITGIGIALLAAVFPLDVLGELTSMGTLIAFAAVCAGVLILRRTHPELPRPFRMPAAWLICSAGVLSCLALLSAMTLHNWMLMGLWTLVGLVVYFGYGYRHSRL

SEQ ID NO: 15303 - protein, 573 aa, Xanthomonas campestris
VSSWQTYRRLLAFAKPYRLLLVAALIAALIEAAGTTGFLALMKPITDETFIYKNAEVSRWLPVQIILLFVIRGAAGYITDMAMGKSARSIARDLRVKVMSKYLRLPGSRFDSEPVPSMLIRLGSDSDQVAQAAVDAVKVMIQQSLQVIGALALMLWHSWQVTLTILVLAPVLAWVMDKVARRYRRISHSIQESGAHLLQAADQTLSSHQEVKIYGAQQSEMERYSGLADRNLRLAMKVESTRGISTATVQMIGAIGLSALLFVAGAQALAGRLTAGDFVVLMTSMLTIIPGLKQLTNVQNMVQRGLASAERLFSVLDSPDEPDQGQVPLTRAKGLIEFRDVTARYPGQANPALADVSFVAQPGTVTAIVGRSGSGKSSLIKLIPRFYEAESGQILLDGHPVQAYALADLRRQIALVGQQVMLFDGSIAENVAYGEMRQCDAGQLERAIQGANAMEFVAQLPEGLQSHVGTKGGRLSGGQRQRLAIARAMLKDAPILILDEATAALDNESERLVQDALHKLMPDRTTLVIAHRLSTIEHADQVLVMDQGRIVERGTHQELLALGGLYSHLHGMQ

SEQ ID NO: 15304 - protein, 1001 aa, Xanthomonas campestris
  unsure (1)..(1001): unsure at all Xaa locations
LVSHSSEAIVAETPDGEITHWNPAAEAMFGYPADVAIGQDLTTLLSPQPYAMPQIDQDEAPPVAALSAAQTMRHRDGHQVFVLASKAPIIEHDNAVSGHSHFFRDISERVRSHQRIVDLNASLEHQVAERTSELVQFSVLQRAILAHAGYAIIATDSSGFVTLFNPAAEKLLGYSADDVIGRRKASQFIEADELQERALRLAEQTGTPVAGTLEAVAALTSLGRSDTSEWTYVSQDGRRLPVLLTLSTLRDDNDQVIGYLGVAVDLTEQKLHEKQLRLAMDAARSANQSKSDFLANMSHEIRTPMNAILGMLYLLQRSELPGAAQDMVTKIDRSARSLLEIINDILDFSKIEAGRIDLERAPFDLNQLFDNIADLMRSSLSAKPVEMIVEPLPRECRWLLGDALRINQVLVNLVGNAIKFTEQGEVVLSVRRFPSGDPNKIKLLFSVRDTGIGISKEKQSLIFSPFLQADTSTSRRYGGSGLGLTISRRLIELMGGALEVESVPGRGSEFYFVITLERTDPPKAQQEAALLPPESMPRVLIADDHDAALNNLVRIATELGWRVDAVASGQAAMQAIEDATEPYDIFLLDWRMPDIDGVAIARQVRARATPGRHPVIVMVTAYERRLLEQHPEQQDLDAVMTKPVTSAALHRLVEQLVDERPKARPSTPTFVARRLEGAQLLLVDDSEINCEVAQRILEGEGAMVTVAHDGEQAVNTLKRAPDLFHLVLMDVQMPVVDGYEATRRLRQIPSLASLPVIALTAGAFRPQQEKALEAGMNGFIAKPFNVEELVTAIRHFRQPGSRRVSSLPHERAPAAGPEWAHTDPLLLDAARAQSLWREREPYXRYLLQVAVRQLRPGSDRRRSSAQQRAVRDWRLAHKLRGAAGSLAMPALAGVSGDLESRVEQGHDLSAALLALKDTMAQTTAAIHAFLQTSPSTQDTGQTGAALDDDSALILENALRSDDADKIDHALLICAPRLPPPLQEDLQRAVDDFDFRRAEATL

SEQ ID NO: 15305 - protein, 208 aa, Xanthomonas campestris
MKLTIPTWLTLLRIVMIPVLVVVFYLPYKWTNFASAGVFALAAITDWLDGWVARRYHQYSAFGAFLDPVADKLMVAVALFLIVQGHPTPWMAFWAAVIVGREIAVSALREWMAEIGQRAKVRVAMIGKVKTTAQMVALLCLLYSVTPGQMPTHEIWLGNLIFQAGYWTLAIAALLTLWSGFQYLQAAWPSLRADEKAAITNKPKKVES

SEQ ID NO: 15306 - protein, 243 aa, Xanthomonas campestris
PPQPQRVLIAGGSRGIGLAIAQAFVQSGAQVSLCARNPEGLANAAAQLAADGAPVHTFACDLADAAQIERYVHAAAQAFGGLDVVVNNASGYGHGNDDESWQAGLDVDLMAAVRCNRAAVPYLRQSGNAVILNISSINGQRPTPRAIAYSTAKAALNYYTTTLAAELARERIRVNAIAPGSIEFPGGLWEQRSRDEPALYARIRDSIPFGGFGQVQHIADAALFLASPQARWITGQVLAVDGG

SEQ ID NO: 15307 - protein, 343 aa, Xanthomonas campestris
PRQLLRCALVMLCIATMSIAQAQSPNRLKYAGVNISGAEIQSSKKPGVLNIDYRYPTASEYRYFAGKQMNIVRLPILWERMQPKAQGPLDQAQLALLKQAVANAKAANQYLIIDVHNYAKYYGQKIGSKRVPVRTFTDLWRRLAIAFKSDNAVIFGLMNEPYDISPESWAAAAQASIDSIRATGATNLILVPGALWSGAHSWYSTVAGQSNAVALANIRDPLNRYAIEVHQYLDTDSSGTSAGCVSRTIGAERLRSFTGWLRAQGKRGFLGEFGTANNATCTAALDGMLGYLETNHDVWIGWTFWAAGAWWNTSYPFNVQPDAQGRDKPQMKTLSARAHRVTR

SEQ ID NO: 15308 - protein, 340 aa, Xanthomonas campestris
  unsure (1)..(340): unsure at all Xaa locations
SCAVFFLLLGVLPMGHAQTRALKYAGVNLAGAEFASSKKPGVLNKDYMYPASTDYSYFAGTGMNVIRLPILWERLQPAARGELDPAQLALVQQAVARAKASGMYLVLDIHNYSKYYGYKMGGPEVPLATFADLWRRLAVIFNSDNAVIFGLMNEPNNISASEWAGAAQAGIDAIRATGANNLILVPGALWTGAHSWHSLTSDGYSNATALASISDPLNRYAFEVHQYLDADSSGTSSVCVSETIGADRLRAFTEWLRTNNKRGFLGEFGTANNAVCNTALQGMLAYMENYADVWLGWTWWAAGAWWNTSYAYNVHPNKDGTDKPQMVILSPQAARATRXH

SEQ ID NO: 15309 - protein, 306 aa, Xanthomonas campestris
ASSAHAGLSVSGTQLKESNGNTLILRGINLPHAWFADRTDAALAQIAATGANSVRVVLSSGHRWNRTPEAEVARIIARCKALGLIAVLEVHDTTGYGEDGAAGSLANAASYWTSVRTALVGQEDYVIINIGNEPFGNQLSASEWVNGHANAIATLRGAGLTHALMVDAPNWGQDWQFYMRDNAAALLARDSRRNLIFSVHMYEVFGSDAVVDSYLRTFRSNNLALVVGEFGADHRGAPVDEAAIMRRAREYGVGYLGWSWSGNDSSTQSLDIVLGWDPARLSSWGRSLIQGPDGIAATSRRARVFG

SEQ ID NO: 15310 - protein, 634 aa, Xanthomonas campestris
  unsure (1)..(634): unsure at all Xaa locations
MTVDTDKQTLGFQTEVKQLLQLMIHSLYSNKEIFLRELVSNAADAADKLRFEALVKPDLLEGSGELRIRVDFDKDARTVTIDDNGIGMSREDAVSHLGTIAKSGTADFLKHLSGDQKKDANLIGQFGVGFYSAFIVADQVDVYSRRAGLPASDGVHWSSRGEGEFEVASVDKPERGTRIVLQLKEGEESFADGWTLRNILKKYSDHIGLPIEMRKEHYGEDADKPAEPEWEVVNRASALWTRPKSEIKDEEYQEFYKHVAHDAGNPLAWSHNKVEGKLDYTSLLFVPGRXPFDLYHRDSAKGLKLYVQRVFIMDQAEQFLPLYLRFIKGVVDSADLSLNVSREILQSGPVVDSMKSALTKRALDMLEKLAKDKPDDYATFWRNFGQALKEGPAEDYANREKVAGLLRFSSTHDTTGAQSVALADYVGRMTEGQDKLYYLTGESYAQIKDSPHLEVFRKKGIEVLLLTDRIDEWLMSYLTEFDGKSFVDVARGDLDLGKLDSEEDKKAQEEVAKSKEGLASRIKAALGDDVAEVRVSHRLTDSPAILAIGQGDLGLQMRQLLEASGQAVPETKPVFEFNPAHPLIEKLDAEQDMDRFGDLSRVLFDQAALAAGDSLKDPAGYVRRLNKLLLELSA

SEQ ID NO: 15311 - protein, 221 aa, Xanthomonas campestris
ATSLIPVDWLEQDSYDWYARHHAALATARSLKPEVVMIGDSITHFWAGPPQATRVSGPASWAWLYGKRPVLNLGFGWDRTQNVLWRIRQGELDGLDPRWVVLHIGTNNLTGTAQSRASTPAETAQGVEAVVAEVRQRLPNSKLILMAIMPRGHRPDSPQRAPIAETNRLLAARFAGDPAVRLVDIGPQMLQPDGALPEALMPDGTHPSEAGYRIWAQALRA

SEQ ID NO: 15312 - protein, 242 aa, Xanthomonas campestris
QTPPPSIVPTDRLQEPWWAQRHARVLEQAKQHADTPLLLIGDSITQNYDKAQAPDENFQPTWQTFYGSRGALNLGFSGDGTEHVLWRLANGEVDGLHPKVAVVLIGTNNTGHLQHTAEQTQLGIDAVVAAIEQKLPRTHILLLGVLPSAVSAEKSRRDAQVNQALAMRYGDNPRVTYLDVGSIFLRDGALRTELFYDTRFRPPAGALHPDTQGQRMLAEAIEPTLAKLLGEPTGQAGRRAEP

SEQ ID NO: 15313 - protein, 376 aa, Xanthomonas campestris
VDFSFTEEQLMIQDVARRIAQEKIAPSAEQFDRSGEFPLENIQLLGENGLMGIEVPAEYGGAGMDPISYALAMIEIAAADGAHSTIMSVNNSLFCTGILKNGTEAQKQLYVRAIAEGTHIGAFALTEPQSGSDASAMRCRAIKQGDGSFVINGKKSWITSGPVAKYIVLFAVTEPDKGSRGITAFMVDTARAGFHRGKTEPKLGIRASATCEIEFADYVAQPDEVLGAEGEGFKTAMSVLDAGRIGIASQAVGVARAAYEATLAYVKERKAFGAAIGTFQMTQAKIADMKCKLDAALLLTLRAAWLKGQGQKFGTEAAVAKLIASEAAMWITHQAVQIHGGMGYSKEMPLERYFRDAKITEIYEGTSEIQRLVIAR

SEQ ID NO: 15314 - protein, 311 aa, Xanthomonas campestris
QLRDLSVVVADTGDYDAIKRLKPVDCTTNPTLVKKALDLPVYADLIERELAWGRAHGGEDRNSTINEVADRLTVGVGTMLSELVPGRVSTEVDADLAHDTQATIAKARKFIAMYAERGVSKDKILIKIAATWEGIEAARQLQQEGIDCNLTLIFNRSQALACAEAGVFLISPFVGRILDFFVAKGQTPASIDEDPGVVFVRGVYDEFKRRGSSTVVMGASFRSTAQIEALAGCDRLTISPDLLEKLDADHGDLPRKLSPLNADNAAITPINSDSFATDLAADDMATEKLASGIDTFAKDLEALRKTIADKL

SEQ ID NO: 15315 - protein, 204 aa, Xanthomonas campestris
SETTAAGDALDALDWNKGDGLLPVIVQDADNLRVLMLGYMNAEALAVTRARGEVTFFSRSKQRLWTKGESSGNVLRVVAIETDCDADTLLVQARPHGPTCHLGRTSCFPTAPSQFLGSLDALIAEREHERPHGSYTTKLFEQGIRRIAQKVGEEGVETALAGVVQGDAELLGESADLLYHLIVLLRARGLGLGDAVALLESRHK

SEQ ID NO: 15316 - protein, 256 aa, Xanthomonas campestris
MLSRRIIPCLDVRDGRVVKGVKFRDHIDMGDIVELAMRYRDQGADELVFYDIGASPEGRSVDYAWVERVARLIDIPFCVAGGIRDVETARAVLHAGADKISINSPALGRPQLISELADAFGVQCVVVGIDSIREEDGQWRVRRYTGDPSKTQALPMRTLDWVAEAQRLGAGEIVLNCMDNDGVRHGYDIAQLRQVRALCRVPLIASGGAGEMQHFADVFDQADADGALAASVFHSGAIPIPELKRFLRAQQIEVRD

SEQ ID NO: 15317 - protein, 376 aa, Xanthomonas campestris
RMTPILFVDRDGTLITEPADFQIDAYEKLRFVDGVIPAMLKLRDAGYQFVIVSNQDGLGSESYPQASFDGPNNLMLQIFASQGIVFREVLIDCSWPADNAPTRKPGVGLMVPYLQDRTIDWSRSAMVGDRITDIQFAQNLNIRGFQLRTEQFGGDWDWAGIAHELADAPRRAVVQRNTKETRIRVELDLDRVAEPHTATGLPFFDHMLEQIGKHGGFALDIRAEGDLHIDEHHTIEDTGLALGQALREALGDKRGIGRYGFDPDDSPWRVAGDTTQHGFTLPMDETIASAALDFSGRPYFVFDGDFKRERVGDMPTELVPHFFRSVCDASGLNLHLHVRGENDHHKVEGCFKALARALRQAIRREGTALPSTKGAL

SEQ ID NO: 15318 - protein, 357 aa, Xanthomonas campestris
TASVMDLVRDDLRAFAGYASARTSALQGDVWLNANESAWGNPADPDASTRRYPDPQPKGLRAALAQLYGCAPEQLLIGRGSDEAIDLLVRGLCVPERDAVVVTPPVFGMYAVCARLQSAPLVEVPLVDGADGLHADVPAIVQAALDAKAKLVFLCSPSNPAGSAIPLAEIEAALQALQGKALVVVDEAYGEFSDVPSAIGLLARYDNLAVLRTLSKAHALAAARIGSLIANAELIALLRRCQAPYPVPTPCAVMAEQALSAPALAVTQRRVTEIRAERARLHAALVQVAGVRQVYPSQGNFLLVRFDDAEAAFQALLEAGVVVRDQRAVPRLSDALRITIGTPDQNDRVLGALQRKQ

SEQ ID NO: 15319 - protein, 428 aa, Xanthomonas campestris
MNTLDWTQLTADARTQALTRPVQTVATQTREAVATLIADVRARGDVALREITARFDGVTLESFAVSDAEFAAADAAIAPELRQAMQDAVARIDTFHRAGMSEGYAVETAPGVVCEKIVRPIGRVGLYVPAGSAPLPSTALMLGVPARLAGCREVVLCTPPRKDGSVDPAVLVAAQLTGVRRVFKLGGAQAIAAMAYGTDSIPSCDKLFGPGNSFVTEAKQQVAQSGAAAIDMPAGPSEVLVIADAGAQPAFVAADLLSQAEHGPDSQVLLLSDSDALITAVQEQLDLQLAQLSRADIARQALAQSRLIKVATLQDAFEISNRYAPEHLILALREPRAWLAQVEAAGSVFLGDYTPEALGDYCSGTNHVLPTSGAARAYSGVSVASFQNMVSVQAASKAGIDGIGACAVILARAEGLDAHANAVALRMG

SEQ ID NO: 15320 - protein, 303 aa, Xanthomonas campestris
MSASTAAPARDRLRIAIQKNGRLAEPARSLLAACGLSWRQSRDKLFCYGESLPVDLLLVRDDDIPGLIADGVCDLGIVGQNELDEQASARRRAGLPAAYHAVRGVGFGQCRLMLAVPEEWDWQGVAQLAGKRIATSYPAILADWLERQGIDASVVELSGSVEIAPRLGTADLICDLVSSGATLAANQLKPVELVMESEAVLAGAVREPADARAALLAMLLRRMDGVLKLRDSKLLMFRAEQGNVDALRRLLPDADPLVQLPDDGNGALRLQTMCHGAVTWQRLEELERAGAQGLMVLTVERSL

SEQ ID NO: 15321 - protein, 471 aa, Xanthomonas campestris
MHRHVHEPEILADPAAFEAAEHWRQRDLAVVWHPCTQMREHPHTLPLVPIARGDGAWLIGHDGRHYLDAVSSWWTNLFGHAEPRIGAAIAQQAGRLEQVMLAGFTHAPAVQLAERLLAIAPRQPDRAPLAKVFYADNGSAGVEVALKMAFHYFHNRDEHRRTRFIALENGYHGETIGALSVGDIPLYRRVYAPLLLESIFAPSPDAYLAEPGQSAEDYALQAADALQHLLEQSPGEICALILEPRVQCAGGMRMYHPAYLRRARELCDAHGVFLIADEIATGFGRTGTLFACEQAGVMPDLLCLSKGLTGGFLPLSAVLATQQLYDAFLDDSRERAFLHSHSYTGNPLACAAALATLQIFADDDIIARNQRTAAHMTQLAAQIGEHSAVADVRQAGMIVAFELTQGGDKRTPFPAAARVGLQAYRAALARGVVLRPLGDVLYWMPPYCVDDAQLALLADTTRHAIAKAVAC

SEQ ID NO: 15322 - protein, 195 aa, Xanthomonas campestris
VHGMSSSGNCYKVRLLLEQLGSRYHWVEVDSVSGETRTPEYLAKNPNGKVPMVERDDGRVLTESNAILFWLAEGTPYLPTDTWQRAQALSWMFFEQYSHEPYVAVARFISLWTPRDAARRAELPQLRARGEQALTVMEQHLRQHAWFTGADYGIADIALFAYTHCAEDGGFDLERWPAIDGWLQRVRALPGFVAM

SEQ ID NO: 15323 - protein, 312 aa, Xanthomonas campestris
LVFSGNANKPLAQSICKELGVRMGKALVTRFSDGEVQVEIEESVRRQEVFVIQPTCAPSAENLMELLVLIDALKRASAASVTAVIPYFGYSRQDRRMRSSRVPITAKVAAKMICAMEADRVLTVDLHADQIQGFFDVPVDNVYASPLLLADIWRAYGTDNLIVVSPDVGGVVRARAVAKRLDDADLAIIDKRRPRANVATVMNIIGDVQGKTCVLVDDLVDTAGTLCAAAAALKQRGALKVVAYITHPVLSGPAVDNINNSQLDELVVTDTIPLSAAARTCPKIRQLSVAELLAETIRRIAFGESVSSLYVD

SEQ ID NO: 15324 - protein, 294 aa, Xanthomonas campestris
MDALALMSASNPAWSAWPAPAKLNLFLQIVGRRADGYHLLQTVFRLLDWGDTVHVRLRTDGQIQRIGASLPGVAEDDDLMVRAARALQIHAGTALGAELRVDKRIPAGGGFGGGSSDAATVLVALNALWGLGLPVDTLAELGLRLGADVPVFVRGHNAWAEGVGEKLTPISLPQAAYVLVDPGIHVPTPVLFQSQELTRDAAPAKIADFASGSLLDNAFEPVLRRREPAIEAVFQALSRIGTPRLTGSGSGCFVEFATRAAAEQAMAHLPGNLRAWVVEGAAHSPLLDALDAIQ

SEQ ID NO: 15325 - protein, 431 aa, Xanthomonas campestris
MTLWVLGLNHQTAPVDLRERAAFAGDALPRALDSLRILPQVREAALLSTCNRTELYAMADDPQTLVAWLDMHAPGLSGYLYQHRDAEAVRHLFRVATGLDSMVLGEPQILGQVKDAWAVARAHGALGSGLDRLFQQTFSVAKRARTDTRVGANPVSVASTAVRLAQESFARLNESTVLLVGAGETIELAAKHLSEGRVRRLLIANRTLAHAQTLATQHGGVALPLTELDRHLAEADVVFSATAAREPVVTRVQVEQALRTRKRKPMLLFDLAVPRDIEASVAELSDAYLYTVDDLERAVEDNRRSRREAADQAEAIIDLQVARYVETLQANERQAPLKRLRAFGDSTRDELLAKARQQLSNGKPADEVLEQLAHALTNRLLHPPTAALRDAALNNDLDLTSAADRLFPEKPGYRHPPVATPIVRTDDANPA

SEQ ID NO: 15326 - protein, 336 aa, Xanthomonas campestris
MSLKHFLNTQDWSRAELDALLTQAALFKRNKLGSELKGKSIALVFFNPSMRTRTSFELGAFQLAGHAVVLQPGKDAWPIEFNLGTVMDGDTEEHIAEVARVLGRYVDLIGVRAFPKFVDWSKDREDQVLKSFAKYSPVPVINMETITHPCQELAHALALQEHFGTQDLRGKKYVLTWTYHPKPLNTAVANSALTIATRMGMDVTLLCPTPDYILDERYMDWAAQNVAESGGSLQVSHDIDSAYAGADVVYAKSWGALPFFGNWEPEKPIRDQYQHFIVDERKMALTNNGVFSHCLPLRRNVKATDAVMDLPNCIAIDEAENRLHVQKAIMAALVGQ

SEQ ID NO: 15327 - protein, 397 aa, Xanthomonas campestris
MSSKDIVLAFSGGLDTSFCIPYLQERGYAVHTVFADTGGVDAEERDFIEKRAAELGAASHVTVDGGPAIWEGFVKPFVWAGEGYQGQYPLLVSDRYLIVDAALKRAEELGTRIIAHGCTGMGNDQVRFDLAVKALGDYQIVAPIREIQKEHTQTRAYEQKYLEERGFGVRAKQKAYTINENLLGVTMSGGEIDRWEAPGEGARGWCAPRSAWPTEALTVTLKFVEGEAVALDGKALPGAQILAKLNTLFAQYGVGRGVYTGDTVIGLKGRIVFEAPGLISLLTAHRALEDAVLTKQQNRFKPDVARKWVELVYEGFYHDPLKTDIEAFLKSSQSKVNGEVTLETRGGRVDAVAVRSPHLLNAKGATYAQSADWGVEEAEGFIKLFGMSSTLYAQVNR

SEQ ID NO: 15328 - protein, 442 aa, Xanthomonas campestris
  unsure (1)..(442): unsure at all Xaa locations
PMTNLLWQKPGVAVDAKIQTFLAGDDVILDREFFLYDIAASKAHAQGLQHIGILSLEELGGLSEQLDLLADDFRSGAFVLDAHYEDCHSAIEARLTERLGDAGRKIHTGRSRNDQILVATRLWLKDKLQRVAALSTEVAKVALDRAQAEAELPVPGYTHIQRAVVSSAGMWWAGWAEAFIDNAVRANDTFKLVDTNPLGTAAGYGVNLPLDRAHTTAELGFARLQVSPIYAQLSRGKFELAALEALGGATLDLRRIAWDLSLFTSGEFAFVALPAQYTTGSSIMPNKRNPDVIELMRATHASVAAARTEIEQLLSLPSGYHRDLQSSKGAIVHGFARGLAALELLPALLANLEWRPDKLRAAIDSGMYATDVAVEAAVAGVPFRDAYKAAAAASDSAGQGRTPEASLAARVSPGAAADLQLDVLRARWEALQXSRPSVPTPP

SEQ ID NO: 15329 - protein, 505 aa, Xanthomonas campestris
SMSEQVTTPPCIIVVFGARGDLTRRLVMPALYNLRRAGALGEEFAIVGMDHGDITERAWRTNMGKAMTELLSSRDAEFQADGFDTDTWDWLRERMHYVRGDFTDLRAYQALDGVLEKLHKRYGTRGNVLFYLATAARFFEPVLLNLGEAGLVKQHEGAGWRRVIVEKPFGHDLPSAKHLNATVARVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVNRSAVPGYREEDTVPDESETETFVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRAL

SEQ ID NO: 15330 - protein, 624 aa, Xanthomonas campestris
MAIRQLPEILINQIAAGEVVERPASVVKELVENALDAGATRVDIDLEEGGVRLIRIRDNGGGIAPEELPLAVSRHATSKIASLDDLETVATLGFRGEALPSIASVSRFTLASRRPDAEHGSALQIEGGRLGEVMPRAHAPGTTVEVRELFFNVPARRKFLRAERTELGHIEEWLRSLALARPDVELRVSHNGKPSRRYKPGDLYSDARLGETLGEDFARQALRVDHSGAGLRLHGWVAQPHYSRASTDQQYLYVNGRSVRDRSVAHAVKMAYGDVLFHGRQPAYVLFLELDPARVDVNVHPAKHEVRFREARLIHDFVYRTLQDALAQTRAGALPADVGLGGSAALGIGAGAAQGDGSYVADAGAGHPGAGSGSGYASWAPSQAPLGLRVDEARAAYAALYAPAAGSALRDDGQPVLSGTGLPATAHDSGVPPLGYAVAQLHGIYILAENAEGLIVVDMHAAHERIGYERLKQAHDSIGLHAQPLLVPMTLAVGEREADTAEREADTLASLGFEITRSGPQSLHVRSIPALLANADPEALLRDVLGDLREHGQSRRIATARDELLSTMACHGAVRANRRLTVPEMNALLRDMEATERSGQCNHGRPTWARFTLGEIDRWFLRGR

SEQ ID NO: 15331 - protein, 443 aa, Xanthomonas campestris
  unsure (1)..(443): unsure at all Xaa locations
AVAPSAHHRRTVGARSRPRPRRLQCVCHALGRHVMSHANEVPAIDAMAELESLRQQNQALREELDETNQGVLALYAELDQQAEQLRDVSELKSRFLSYMSHEFRTPLGSILSITRLLEDGMDGPLNAEQLKQVRFVSASTRELSEMVDDLLDLAKIEAGRVTISPGWFDLMDLFAALRGMFRPLTDANRTTLIFEDPPVLPMLYTDDKKLAQILRNFISNALKFTPQGHVRVFAQLQGDTHVRFSVQDTGIGIPAELHDALFEDFVQVDSPLQKRLTGTGLGLSICKRFAELLGGTVGINSVVGQGSEFFVVLPVTLAPQQEDGLAXQSRILVVDDNAVTRYSVRRVLEHHQFVVEEAGTGGEGLVRLAAEAFAAVVLDVNLPDMSGFDIVRTLRAEPRTALLPVVHVSAASIATGDMITGLDAGADAYLIHPVDPNVLVATL

SEQ ID NO: 15332 - protein, 253 aa, Xanthomonas campestris
MRLTALPAFDDNYIWALVANDGRAVIVDPGQAAPVLEAAQREGFTPVAALLTHHHADHIGGVAELQQHFPALELYGPDDERMPAATRHVAHGDTVTALDIDFAVLDVPGHTRSHVAYVGDGHLFSGDTLFSLGCGRMFEGTPPQMFDALQRLASLPGETLVCCGHEYTLANAAFALHVDPTNAALQRRQQEAQAMRHAARPTLPISLKSELATNPFLRLHTPEIRAAVAAHASISITSDVDVFAELRRWKDVF

SEQ ID NO: 15333 - protein, 445 aa, Xanthomonas campestris
  unsure (1)..(445): unsure at all Xaa locations
MSFAHLSLSPTLQPCFDTALAKAGHHTPTPIQQQAIPAMLAGRDLIAMAQTGSGKTLAYALPLLQQRMQAPDQAPRVLGGLILVPTRELAAQVEQSLLQLAAHLPRRLKIVAATGGSSINPQLMALRGGADIVVATPGRLLDLVEHNALQLGTVATLVLDEADRLLDLGFGAELERILALLPAQRQSVLFSATFPPAITVLAKRRLRDPLRITIAATPEQAPAIAQRAIAVDAGLRTQLVRQLLQDHGWPQLLVFVASRHTAEKVAEKLEKTGITALPLHGDLSQGRRERTLHAFKQAEVQVLVATDLAARGIDIAALPAVLNYDLPRVTVDYTHRIGRTARAGANGTAISFVTPESRPQWRLIEKREDVRVPVEVLAGFEPVAAPQTDATARAPDATGGIKGKRPNKKDKLRAAQAAAASGDQHXHRRADARFNPSGVRLVRRR

SEQ ID NO: 15334 - protein, 476 aa, Xanthomonas campestris
MHNTLILFGATGDLAQRYLFPSLLRLFVDGLLPEDFRIRALALSQHDTDAFREVLRPRLAQALPIATAAQIDALLQRIDYRSADLRNAESVAEAVRELASRQCVSYLAIPPGLYISTCQGLALGGALAAPHRLMLEKPIGHDSDSAREILQSIGALIDEDRVFRLDHYLGKAAVQNLVALRFGNTLLEAVWNRTYIESVQILVAESEGVDGRDAYYARSGALRDMVQSHILQLLCLVAMEPPASLEADRIRDEKVKVLRALRPMTAEHAAQDSVRGRYTAGSINGEPAQAYHPPEGSDVETFVAVTAHIDNWRWAGVPFHLCTGKRLAERSTRIVVTLKPVTHWLFERPDRQNAVPNRLTFQLQPLENIELGLMSSLAGPEWGAIELQPLELELSVPTGLHRRIAYERLFVDAFNGNPALFVRDDEVKAAWAWIDSVSDAWSDAQLPLQPYPAGSWGPETAAPFLPPATDAQGNNA

SEQ ID NO: 15335 - protein, 600 aa, Xanthomonas campestris
  unsure (1)..(600): unsure at all Xaa locations
IYNSMSAYKITEHKYDMVVVGAGGAGLRATFGLAQKGLQTVCLTKVFPTRSHTVAAQGGISAALGNMGEDDWRYHFYDTIKGSDWLGDQDAIEYMCREAIPAIIELEHYGVPFSRTEEGKIYQRPFGGMTTKYGEGPSAQRTCAAADRTGHAMLHTLYQQSLAHNARFMIEYFALDLIFDEEGVCRGVLALDMAEGSLHLFRAHGVVLATGGYGRAYFSATSAHTCTGDGGGLMMRAGLPMQDMEFVQFHPTGIYGAGCLITQSLRCXGGILRNSNSERFMERYAPHYKDLASRDVVSRSMTIEIREGRGVGEHKDHILLDLTHLGPEVINDKLPGIAESAHIFAGVDVAKQPIPVLPTVHYNMGGIPTNYHGEVVRKQGDNPDAVVPGLYAIGEAACVSVHGANRLGSNSLLDLVVFGRAVANRCAETVKTNQPHKPLPSDACDKALGLLDKLRHANGSTPTSVIRDNMQRTMQSDAAVFRTSKTLKEGVDKMAEIFATFEDVKVSDRSLVWNSDLIETYELNNLLLNAVATINSAEQRKESRGAHAHEDFPDRDDVNWQKHTLVTVDDKGQCDFEYRPVHMYTLSKEVDVVPPKPRVY

SEQ ID NO: 15336 - protein, 269 aa, Xanthomonas campestris
GLPSHRASPEPTRAAMAEFTLPKNSKIGKGKHYPAQGAKNKRTFKVYRWDPDGDANPRTDSYEIDLDKCGPMVLDALIKIKNEIDPTLTFRRSCREGICGSCAMNIDGTNTLACTKAIAACGKAEVPIYPLPHMRVIKDLVPDLTHFYAQYASIKPWIRTQTPPPPDRERLQSPEDRKKLDGLYECILCACCSTSCPSYWWNGERYLGPAILLQAYRWIIDSRDEDTGARLDDLEDPFKLYRCHTIMNCARTCPKGLNPALAIAEIKKL

SEQ ID NO: 15337 - protein, 460 aa, Xanthomonas campestris
  unsure (1)..(460): unsure at all Xaa locations
PMRFGNGAVCGDNPAACFRCTSPLYWXPIGPMTTIAKILAREILDSRGNPTLEAEVTLADGSFGRAAVPSGASTGTKEAVELRDGDKTRYLGKGVRKAVENVNGTIAETLKDFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFFASGKYNLVGENKRLTSEQFVDFLADWVAQYPIISIEDGLARDDWAGWKLLTDRVGKKVQLVGDDLFVTNPKIFKEGIDSGTANAILIKVNQIGTLTETLEAIAMAHAANYASIVSHRSGETEDTTIADIAVATTATQIKTGSLCRSDRVAKYNQLLRIEQALGSGARYAGRDAFVSLK

SEQ ID NO: 15338 - protein, 449 aa, Xanthomonas campestris
RSLQQLDAAHHLHPFNDNAALASKGTRILTRGEGVYVWDADGNKLLDAFAGLWCVNVGYGRAELAQAAARQMEQLAYYNSFFQCTTEPTVHLAAKLAELAPGDLNHAFFANSGSEANDTILRLVRHFWAVQGQPQKHIFIGRHDGYHGTTMGGASLGGMRGMHRQGGLPNSGDRAHRRHPIILARVASMDPDDYGLLAARRLEEKILQLGPDTVAAFIGEPIMGAIGSTYPPRSYWPEIERICRRYDVLLVADEVICGFGRTGAWFGAEYFGFQPDVMTLAKGITSGYIPLAAAMFNDRVAGVLKRQGGELAHGGTYAGHPVCAAVALENLRLLQDEGIVDTARTQIAPYLAQRWAELGAHRLVGEARIAGLVGALELVPDKRRRGVYFPERGRVGALCRDFALRRGLILRATYDAMLLSPPLIITWEQVDELFDKTWAALDDTAQALG

SEQ ID NO: 15339 - protein, 677 aa, Xanthomonas campestris
  unsure (1)..(677): unsure at all Xaa locations
MALLLALNPGALXPSRTSPQGPPVNPRLLLLALAVAAGTLSLSSCRQDAVPTPKPATTKTAPSESADQFVARISAEYKAAYPEMTAAQWLSSTYINGDSQLLAAKANERALSQLDRWIDQSKQYAGTPMSADSARALQLLKLMSALPAPRDPTKLAELTRIAAKMEGDYGAGSACTGEGEQRRCRQLGELEQVLARSRGYDEQLQAWQGWHATAQPMRKDYQRFVELANDGARGMGFADVGAMWRSGYDMPPAQLASETDRLWEQLKPLYTQLQCYARGKLDTQYGKDKGEVAGGMLPAHLMGNMWQQDWSNLWDLLQPYPGAGDLDITSALEKQYQGNLSAALARNTGGDGGAAARFLAERDAQLRTAQQMTERAQDFYTSLGMPKLPDTYWQRSQFIKPLDRDVVCHASAWDMNMGGEPNAGIGPDVRTKMCIRPTEEDFTTIYHELGHIYYDMAYNPLPPLFQNGANDGFHEAIGDTIVLAMTPKYLQSIGMVGEQQSGREALINSQMRMALSKVAFLPFGLMIDRWRWGVFDGSIPPERYNQAWWELKATYQGVAPVSPRGEDFFDAGAKYHVPGNTPYTRYFLAHILQFQFYKGLCDAAGHQGPLYECSFYGNKEAGQKFWSMLQRGSSQPWQTTLKEVTGKDTLDAGPMLEYFAPMQEWLKQQNQGQMCGW

SEQ ID NO: 15340 - protein, 242 aa, Xanthomonas campestris
MSTAADSPLSLAHYYLPVYRPRQVVLERGQGSRVWDDQGREYLDLSSGIAVSGLGHNDPDLMAALTEQAGKLWHTSNVFFSAPPLKLAEELVTASRFAQKVFLCNSGTEANEAAIKLVRKWASSQGRPADKRVIVTFRGSFHGRTLASVTATAQPKYQEGYEPLPGGFRYVDFNDVPALESAMASGDVAAVMLEPIQGEGGVMPAAPGFLARVRALCDQHDALLVLDEIQCGMGRTDSLLAH

SEQ ID NO: 15341 - protein, 273 aa, Xanthomonas campestris
NPMTLSGKTLFITGASRGIGLAIALRAARDGANVAIAAKSAVANPKLPGTIHSAAAAVNAAGGQGLALKCDIREEDQVRAAVAATVDTFGGIDILVNNASAIWLRGTLDTPMKRFDLMQQVNARGSFVCAQACLPHLLQAPNPHILTLAPPPSLNPAWWGAHTGYTLAKMGMSLVTLGLAAEFGPQGVAINALWPRTVIATDAINMLPGVDAAACRRPEIMADAAHAVLTRDAAGFHGQFLIDDEVLAQAGITDLSGYAVDPQRALLPDLFLE

SEQ ID NO: 15342 - protein, 794 aa, Xanthomonas campestris
GASRLNENILWLHELRLVDLARVGGKNSSLGEMIGNLAGLGVSVPGGYATTAEAFKDFIAHNDLSKRIFDKLETLDVEDVTALTVAGKEIRGWVIDAPLQPELDRDIRSAYEKLCAENGGGEVAVAVRSSATAEDLPDASFAGQQETFLNVTGADDVVHKVKEVLASLYNDRAIAYRVHHGFKHEDVFLSAGVQLMVRSGVGSSGVLFTLDTESGFRDVVFVTSSFGLGEMVVQGAVNPDEFYVYKPTLTAGKPAILRRSLGSKAIRMVYSDVPGERVRIEDTPVELRNTFSISDEDVQELSKQALVIEKHYGRPMDIEWAKDGVSGKLFIVQARPETVKSRSHATQIERFSLEAKDAKILVEGRAVGAKIGSGVARVVRSLEDMNRVQAGDVLIADMTDPDWEPVMKRASAIVTNRGGRTCHAAIIARELGVPAVVGSGNATDVISDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYINRLAEGIATLTASVAPNTVIVRLSDFKSNEYANLIGGSRYEPHEENPMIGFRGASRYVDPSFTKAFSLECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKS

SEQ ID NO: 15343 - protein, 251 aa, Xanthomonas campestris
RSILITGAGSGIGAGLATVLAADGHHLLVSDADLAAAEQTTQQVRAAGGSAEALALDVTDEHSIAQALAAASRAPEVLVNNAGLQQVAPLEEFPMQRWALLVDVMLTGAARLSRAVLPGMRAGGYGRIVNIGSIHSLVASPYKSAYVAAKHGLIGLSKVLALETADCDITANTLCPSYVRTPLVERQIADQARTRGIAEDAVIREVMLKPMPKGAFIEYDELAGTVAFLMSHAARNLTGQAIAIDGGWTAQ

SEQ ID NO: 15344 - protein, 201 aa, Xanthomonas campestris
RHFSMLRDFQLADWFTLANAFCGTGAVFAAMRFLQEGHRGDLLLGMALIPLAFVFDALDGHVARWRKASSTLGRELDSLADVISFGVAPAALGYACGMRGGWDWLVLSYFVCCGVSRLARYNVTAEEIAGEADKVPYFEGTPIPTSLVLVILLAVAASTGHIGQTLWWGQWQLGPWQFHPLVLLFAVSGSLMISKTLRIPK

SEQ ID NO: 15345 - protein, 852 aa, Xanthomonas campestris
ATSAASAITTQLPRTARPSHYAIEITPHAETMTFDGKVSIDVEVLAPTDAIVLQAAQLTFGKATLAAAGRKPVAAKVTTDADAQTASIATGKPLAPGKYVLTLAYSGTINTQANGLFALDYTTAQGARRALFTQFENSDARRFVPSWDEPNFKATFDLVINAPAGQMAVSNMPVASSKPGTNGCTRVAFQTSPKMSTYLLFVSVGDFERATVKADNGTEIGVIAQKGKVGQAQFALESGRDVLHEYNDYFGIQYPLPKLDNIAAPGRSQFFSAMENWGAIFTFEYTLLLDPAVANVSTKQGVFTVAAHEIAHQWFGNLVTMAWWDDLWLNEALPTGWKHAPRQNCIPEWDIDKTGPAQKSRAAMRRDAYVTTHPVVQHVATVEQASQAFDSITYAKGEAVIAMLEDYVGEDAWRTGVRSYIRQHQYGNAVTDQLWQQIDTVAPGKQFIQVAHDFTLQPGVPLIKASSRCVGGQTTVTLEQGEFTLDRPDKQPLRWHVPVVLRGGDGKQVRVLVDGTAQVQLPGCKVPVVVNAGQKGYFRTAYAPMQFKALAAGFSALPVVDQLGVLNDTNALAGAGVQPETDLLNLAAQVKVGASPDIWEMVASIYDSVDGSFERDQAARAAWRAYAVPHLSAEFATLGWDNRDDDSAEIQQLRTRLIGSLSGMGDAAVIAEARRRFAGFQANPASLSPELRDSVLGAVALNADAATWDALHALAKQETSSMVRDTYYDFLSMADDQALAKRALELALTEEPGATTGASMIDRVASRHPELAFDFAVAHRAQVDMLVDSTSRARYYPSLGMDSADLATANKIKAYADTYIAPTSRQTADNAINTIQTRVKLRAASLPQIKAW

SEQ ID NO: 15346 - protein, 432 aa, Xanthomonas campestris
PVMGQSVVVLGAQWGDEGKGKIVDLLTEEIGAVVRFQGGHNAGHTLVINGKKTVLHLIPSGILRDDALCLIGNGVVISPAALIKEIGELESAGVEVRSRLKISPAAPLIMPYHIALDQAREKAAGGKAIGTTGRGIGPAYEDKVARRGIRIADLHYPAQLEELLRTALDYHNFVLTKYLGVEAVDFQKTFDEALAFGEYVQPMKSDVAGILHDLRKQGKRVLFEGAQGALLDIDHGTYPYVTSSNTTVGGALAGTGVGADAIDYVLGIAKAYATRVGGGPFPTELDDEVGQGIRDRGAEYGASTGRPRRCGWMDIVALKRAVAINGISGLCITKLDVLDGMEKLKVCIAYEYRGKRTEYAPLDAQGWEECTPVYLEFPGWTENTHGITEWDKLPVAARAYLRALEELAGCPISIVSTGPDRDHTMVLQDPFA

SEQ ID NO: 15347 - protein, 296 aa, Xanthomonas campestris
MEFKDYYATLGVEPSAGEAEIKTAYRRLARKYHPDVSKEAGAEDKFKAINEAYEALRDPQKRAAYDQLKAQGYRPGDEFQTPPNFNGGQGFDYEEVFGNGGAGGGFSDFFESLFAGQRGGRPRGPGAGAGPGAQTRGDTRAKLAVPLEAVYSGDSVRITITGKQLDVRVPKGIQPGQVIRLSGQGNGGGNLLLEIEHAAHPQFEVDGRNILYTLQVMPWQAALGTTISVPTLGGAVELKVPADSEAGRKLRLRGRGLPGATPGDQIVELEILAPAPTDEAQKKAYRTLAKAFGESI

SEQ ID NO: 15348 - protein, 838 aa, Xanthomonas campestris
LSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLLRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHCLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDADCVLGLATAQGGPTLHTGILSRTLGLAALVPAGGQLLDIQKGVTAIIDGSSGRLYINPSEQDLDAARTHIAEQQAIREREAAQRALPAETTDGHHIDIGANVNLPEQVAMALTQGAEGVGLMRTEFLFLERGSTPTEDEQYHTYLAMAQALNGRPLIVRALDIGGDKQVAHLELPHEENPFLGVRGARLLLRRPDLLEPQLRALYRAAKDGARLSIMFPMITSVPELISLREICARIRAELDAPELPIGIMIEVPAAAAQADVLARHADFFSIGTNDLTQYVLAIDRQNPELAAEADSLHPAVLRMIRSTIDGARKHDRWVGVCGGLAGDPFGASLLAGLGVQELSMTPNDIPAVKARLRGRALSALQQLAEQALHCETAEQVRALEAQREGQA

SEQ ID NO: 15349 - protein, 468 aa, Xanthomonas campestris
MTCRTRFAPSPTGYLHIGGARTALYCWLEARHRGGQFVLRIEDTDRERSTQVAIDAILEAMEWLGLGYDEGPIYQTQRIARYQEVAEQLLAQGKAYYAYETREELDAMREAAMAKQEKPRYNGAAREQQLPYRDDPNRVIRFKNPLAGTVVFDDLIKGRIEIANSELDDMVIFRPDGYPTYNFAVVVDDWDMGITEVIRGDDHINNTPRQINIYESAGPHRYPSSAHMPMILDEQGAKLSKRTGAADVMQYKDAGYLPHALINYLARLGWSHGDQELFSQQELLDLFDVKDVNSKAARLDMAKLGWVNQHYLKTDDPASIAPQLEYQLRKLGIDVAAGPAAADVVVALRERVQTLKEMAEKAVVWYQPLETYDEAAVIKHLKLGAEVPLGKAREMLAALNEWSVENVSAALHAAAAALELGMGKVAQPLRVAITGTQVSPDISQTVYLAGREGALKRIDAALIKIGAA

SEQ ID NO: 15350 - protein, 257 aa, Xanthomonas campestris
TAHRWRLDGQTALITGASAGIGLAIARELLGFGADLLMVARDADALAQARDELAEEFPERELHGLAADVSDDEERRAILDWVEDHADGLHLLINNAGGNITRAAIDYTEDEWRGIFETNVFSAFELSRYAHPLLTRHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRHGF

SEQ ID NO: 15351 - protein, 500 aa, Xanthomonas campestris
NGFDALHAHAQRLRGVAIPTLLAAEPQRPTQYARQVGPLYFNFARQKYDRAALDALFAIARERDLAGAFQRLFRGEQVNVTEKRAALHTALRGDLTDAPVASDAYATAAEVRHRMGALIQQLEGTDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLDGAAQFDAHALNTPLEENVAVLHGLTAVWNRNLLGSATHAVMTYDQRLALLPAYLQQLVMESLGKRVKLDGSAVDSDTVAVWWGGAGTDVQHSFFQALHQGTSVVPADFIGTVHNDDPYAENHVALMANVLAQTEALANGQDSSDPHRSYPGGRPSTVILLDALTPQALGALISMYEHSVYVQSVMWGINAFDQFGVELGKQLASQLLPALKGEAADVADPVTRELLAKLRG

SEQ ID NO: 15352 - protein, 701 aa, Xanthomonas campestris
MAKSPSKPAQIPSVGSSASAHELRGTGDELHQKAGGSHPQLTTNQGIPVGDNQNSLRATPRGPTLLEDFILREKITHFDHERIPERIVHARGSAAHGYFELTKSLSQYTTAKLLTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMIMWAMSDRTIPRSLRMIEGFGIHSFRLLNENGDSTFVKFHWRPKLGLQSTIWDEAVKLAGADPDFQRRDLFEAIQKGDFPEWELGVQLFTEAEAEAFPFDHLDSTKVIPEELVPLQIVGRMVLDRWPDNFFAETEQVAYCPANIVPGIDFSNDPLLQGRLFSYLDTQLSRLGGPNFHQIPINAPKCPFANNQRDGHMQMGVPKGRVAYEPSSLQADAPREALRGFPSHATPAEDGAKGRVRAESFADHYSQARMFFRSQTAPEQAHLASALVFELSKVETAHVREAIVGHLRHIDEALAKRVADGMGMTSLPPAPPAAVAPTDMQLSPALQLIGKMKDTLQGRTVGILIHDGSDAAAIKAVRKAAEAAGATVKIVAPKLGGAKLSDGKQLAADGQLAGTPSIVFDAVAVLLSSEAAKALTRESAALDFVSNAWAHLKAIAFDDGAQLLLKAGNVGKDPGVVDAADTKAFITAAKTRQWAREPKVRMLA

SEQ ID NO: 15353 - protein, 273 aa, Xanthomonas campestris
VTLRNGRSVPALGMGSWNLGQGRHAPQQEIEALQTGQALGMRLIDTAEMYGNGRSEQLISQVIARGQPPYLVSKVLPSNASARGIARACEASLQRLGVRTLDLYLLHWRGGSDLAEVVAAFETLRDAGKIRDWGVSNFDVDDMQELWQIDGGQHCLVNQVLYRAGSRGIEFDLLPWCAQHAVTVMAYSPLGSRALLDHPVLHAIGARRGVAATAVALAWAIRSGQVIAIPESGTPAHVRANADACTLQLDARDLADLDNAFPPPTRKQPLDLL

SEQ ID NO: 15354 - protein, 367 aa, Xanthomonas campestris
FSALPLSPALAPGIDALGYTTLTPIQAQSLPPILQGLDVIAQAPTGSGKTAAFGLGLLQKLDPALTRAQALVLCPTRELADQVGKQLRKLATGIPNMKLLVLTGGMPLGPQLASLEAHDPQVVVGTPGRIQELARKRALHLGGVRTLVLDEADRMLDMGFEEPIREIASRCDKHCQSLLFSATFPDIIRTLARELLKDPVEITVEGADNAPEIDQQFFEVDPTYRQKAVAGLLLRFNPESSVVFCNTRKEVDEVAGSLQEFGFSALALHGDMEQRDRDEVLVRFVNRSCNVLVASDVAARGLDVEDLAAVVNYELPTDTETYRHRIGRTARAGKHGLALSLVAPRESARAQALEAEHGQPLKWSRAP

SEQ ID NO: 15355 - protein, 150 aa, Xanthomonas campestris
IRDIADFPKPGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEIVGAAVLVELLALQGR

SEQ ID NO: 15356 - protein, 282 aa, Xanthomonas campestris
YRGRFAPSPTGPLHFGSLLAALGSWLLARHAGGEWHVRIEDIDPPRAEPGASERQLHTLAAFGLHPDGPVLYQSDRDAHYEAALSRLLRTGAAFECSCSRAELAVMGGIHHVCVAPLGIRRAVRLRVPPNTQASFQDALQGRITQDVYAEVGDVVLRRADGYWAYQLAVVVDDAAQGITDVVRGADLLDSTPRQLVLQQALGVAPPRYLHLPLILGADGRKLSKSHAAQPVDDSDPLPALRAAWRALGQAPAALPARASVAGVLQHAVQHFSPQRLPRVASL

SEQ ID NO: 15357 - protein, 223 aa, Xanthomonas campestris
MTSRVALVTGGTGGIGTAICKRLADQGHRVASNFRNEEKAREWQQRMQVQGYEFALFRGDVASSDHARALVDDVEAALGPIEVLVNNAGITRDTTFHRMTAEQWHDVINTNLNSVFNVTRPVIEGMRKRGWGRVIQISSINGLKGQYGQANYAAAKAGMHGFTISLARENAAFGITVNTVSPGYVATDMVMAVPEEVRAKIVADIPTGRLGRPEEIAYAVAFL

SEQ ID NO: 15358 - protein, 508 aa, Xanthomonas campestris
  unsure (1)..(508): unsure at all Xaa locations
WWRGAVIYQIYPRSFLDSNGDGVGDLPGIIAKLDYIAGLGVDAIWISPFFKSPMADFGYDIADYRAVDPLFGSLVDFDRLLEKAHGLGLKVMIDQVLSHSSIAHVWFQESRQDRSNPKADWYVWADPREDGTPPNNWLSLFGGVAWQWEPRREQYYLHNFLVDQPDLNFHNAEVQQATLDNVRFWLDRGVDGFRLDAINFCFHDAQLRDNPAKPADKRVGRGFSADNPYAYQYHYFNNTQPENLAFLERLRGLLDLYPNAVSLGEISSEDSLATTAEYTAQGRLHMGYSFELLVQDYSAAYIRDTVSRLEATMLEGWPCWAISNHDVVRAVTRWGGAHATPAFARMVVALLCSLRGSICLYQGEELGLSEAEVAFEDLQDPYGITFWPTFKGRDGCRTPMPWTDAPSAGFTSGKPWLPLAASHRARCCERATGXCAFRVEAVRDFLAWRKEMPALREGSIAFYDTAEPVLMFRREHAGQVVLLAFNLSADPADLALPAGEWEQVDVPG

SEQ ID NO: 15359 - protein, 337 aa, Xanthomonas campestris
LALLATLPLAHAKEADNARGGLKYVGVNISGAEFNSRKKPGTLYKDYTYPAAADFSYFASKGMNTIRLPFLWERLQPTLNGELDAAQLALIKKSVAAAKANKQFLILDLHNYAKYNGKRIGTDEVPPAALADLWRRLALEFKDDKQVIFGLMNEPNGISSTDWAAAAQAAINTIRKTGANNLILVPGTAYTGAHSWRSTSYGVSNAKALQILKDPGNNLAFEAHQYLDGDYSGTKPECTSATVGADKLRGFTDWLRENKQKGFLGEFGTANNAVCNDALKGMLSYMEKNSDVWLGWTWWAAGAWWKPDYPFNVQPGKDGSEKPQMSILSEHARRAGK

SEQ ID NO: 15360 - protein, 345 aa, Xanthomonas campestris
HAYAAQTADQPLAPFVFERRAPGPDDVQIDIAYCGVCHSDLHTARNEWHNTVYPSVPGHEIVGRVTAVGSAVTNFKVGDLAGVGCMVDSCRSCSSCQEGEEQYCEQGFTGTYNGPMFGGGENTYGGYSDHIVVDQKYVLHISHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAMVLVGVPEHSHPSPAVFNLVMKRRTLAGSLIGGIRQTQEMLDFCAKHNIVSDIETIRADQINEAYERMLKGDVKYRFVIDMDTLA

SEQ ID NO: 15361 - protein, 535 aa, Xanthomonas campestris
TFQASAARPHGLDVADTAHSISTSWGVVQQPALPSQVCTTLKAALVPVAGSLDALDQDPTQSKRDTARLQAAIDDCPAGSAVRLVVGDGGESGLLSGPLTIKSGVTLWIDRGVTLFGSRNPQDYDNGLGTCGTATTDKAKSCNPLIHVADTAKSAIVGAGKIDGRGGSTLTAGPNAGKASWWDLAYLNVTKGLSQHVPRLLQIDDSTDFTLYDITLENSPNFHVTTDNVVGLTAWGIKILAPSLVYSRPGYHCPAGSTPDVNPHASCFTPETVKNTDGFDPGQSKNVLLAYSYIGTGDDGVAIKAHAKNKRSIASENMLFAYNQFYYTHGFSLGSETDSGMRHIAVRGLSIDGFNANDVQRDPYSANGLRIKSDASRGGQVYDIRFENICMRGVARPLVFDANYANPATRDQLPRFSGIALTNVHSLGSKAFGGGELSFYGYRDATTTLPITMSLDNVVLDGGPVAFAQPHFGGPASNPGAVHFTFKGGPVSFFDQLTESAANDVQLQGRPGPGAPLQCDDAFIAYHSVLPDSPI

SEQ ID NO: 15362 - protein, 378 aa, Xanthomonas campestris
SLISLDAAALTGTASRPQLTSSEASTYTISKALAKAGPITALVTDNWNPTAGVALLTADFAVAADGSTRYRTVQSAIDAAVAAGGSTRRYISVKAGTYNELVCVPSGAPPLTLFGLGSATTDTVIRYNNANPTPKPTGTASHPCASNASAATVGTSNSATVTVRASGFQARHLRFDNNYVEGTYADNNQSAVALAVRGDQASFEDVLVTGNQDTLLISATNAANVIRAYFKSSTIEGDVDFIFGSGIGVFDNAIIRSAGARLGSSRGGYIFAPSTRPGSGYGFLAINSRFVAGSGSPDNQTYLGRAWDEGVSGLSAYVNGTSPNGQVTIRDSTLGSHIRKTAPWNASTASRPFCSSNCTNSANRFFFEYGNSGAGSAD

SEQ ID NO: 15363 - protein, 249 aa, Xanthomonas campestris
VTRKLVLLRHGQSQWNLDNRFTGWVDVDLTEQGRQEAAAAGKLMKDEGLQFDVAYTSVLKRAIHTLQGALKELDQDWLPVHKSWRLNERHYGGLQGLDKAETAAKHGEEQVKIWRRSYDIPPPAMDVTDPGHPGHDRRYATLDRNALPGTESLATTLVRVLPYWHDAIAPQLKAGQTVLVTAHGNSLRALYKYLNDISNAQILELNIPTGIPLLFELDDNLRVQSYRYLGDPEAAKRAAEAVANQGKAK

SEQ ID NO: 15364 - protein, 695 aa, Xanthomonas campestris
KFAPLSLAVAIAVTLSACGASDDTSKPAAAAPAAPTRVDVSKLDAPIVAFGSGDLDPAIAACQDLNGFVNAKWLKANPVPSDRTSWGSFEVLAERSLTIQHALVEQLARGNLSAGSVDAKIADLWRTGSDEAAIDKAGITPLQPQLKAIDVLSDAPAIAAWLRDSYAKGQGFLFSFGANADYKNSEQMIAYAGQGGLGLPEKGYYTDPAQAKIREQYVAYIARVLELSGIPAAQAAEQAKAVMAFETQLANASLSRIELRDPAKRYNPVDVAGANAITPHFDWQAFFNALKVPAGTFSLSQPEYFRALDGMLVNTPADTWKAYLRFHSIDEAAPYLAKPFEQANFDFYAKTLRGQQDMLPRWKRTLNAVNEAMGEALGQLYVQSAFPAESKAQMQQLVQNLSNALKARLEKLDWMSAQTKQRALEKWASFTPKIGYPDQWRDWSGLETRGDGFLANMQAAQAFNYRYMLDKIGKPVDKREWHMTPQTVNAYYNATRNEIVFPAAILQPPFFDPKADPALNYGGIGAVIGHEMMHGYDDSGSQFDAKGNFDTWWTDADRKLFTQRTDQLVAQFDGYEAIPGVHVKGKLTLGENIGDLGGLTVAYDALQMALQEQPAANKEIDGHSQDQRFFMNWATVWRRNFTDGELRVRLNTDPHAPANFRANGAPSNMPAFAQAFQCKPGDAMVRGDKDRVAIW

SEQ ID NO: 15365 - protein, 276 aa, Xanthomonas campestris
GEGVLWCEQREALYWVDISEKRLWRHHPGSAQTRFWTLPDRPGCIGLMDDGRLLIALAKAICIADPDNADGDTLPLDHLADVEADNPLTRSNDGRADRHGNFVFGTMDEHEDKAGRGAMYQFSLRHGLRRLPLPGVSIPNSICFSPDGRTLYYCDSVRPQILRCDYHPDTGQTTNTRVYTTLDRDDAQPDGSIINNAGHLWNAHWPSWRVLRYHPDSSVKRIVHMPVKHPTCSAFGGPALDRLHVISSRLDHSDAELAQTPQAGGLYLCDLPVRGL

SEQ ID NO: 15366 - protein, 583 aa, Xanthomonas campestris
  unsure (1)..(583): unsure at all Xaa locations
LSLWSEAGQMIDYYFVSADSYDQAVAGYRELTGKSVMLPKWAYGFWQSRERYKSQDELVGAVAEYRKRKLSLDNIVLDWSYWPENAWGSHDFDPQHFPDPDGMVKAVHDMHAQIMISIWPKFYPTTVNYKELDAAGFMFKRNVQVPELDWIGKGYKISFXYPYSEKAQTIYWRQINEKLNSKGFDAWWMDADEPDVHSNLDIGERKARTTPTALGPSTEFFNSYPLPHTHGVYVGDRAADDKRVFILSRKGYAGTQRNAVAVWSGDIVSRWDDMHDQISAGVNMALSGLPNWTFDIGGFAVEKRYENQDPAHLPEWRELNTRWFQFGAFVPIFRSHGQFPYREIWNIAPEGTPFYESMAYYNRLRYALLPYIYSLAGDTYQRDGVIMRGMMMDFPDDAKARDINDQYLFGPAFLVAPVTRFGATSRQVYLPAGSSWLDFATGKRYEGGQTIEAAAPIERMPLFVRAGSIVPTGPVQEYVDQKPDAPLTVVVYTGANGQFSLYEDDGKGYGYEKGEFSRIPLSWDQAKGELRIGQREGSWTGMQAKRTINVRFVDGPREDAGALEPKVDTSIQYDGKPVSVLQR

SEQ ID NO: 15367 - protein, 448 aa, Xanthomonas campestris
MSDPSAPDHLQRSLSNRHLQLIAIGGAIGTGLFMGSGRTISLAGPSILFVYLIIGVMLFFVMRAMGELLLSNLDYKSFIDFSTDLLGPWAGFFCGWTYWFCWIITAIADVIAIAAYAQFWFPELAPWVPAVLCVLLLLALNLVTVKLFGEMEFWFALIKIIAICALIITGAGLVMWGFRSPSGHVASLSNLWNDGGMFPMGIGGFFAGFQIAVFAFVGIELVGTTAAETADPQRNLPKAINSIPVRILIFYVLALIAIMAVTPWRQVVADKSPFVELFVLAGVPAAASLINFVVLTSATSSANSGIFSTSRMLYGLAEERNAPRGFAKLTRAAVPARGLLFSCICLLLGAMLVYLIPDLVTAFTLVTTLSAVLFMFVWSLILCAYIAYRRKRPEQHAASAFKMPGGVLMCYVCLAFFAFIIVLLTLQPDTLHALLVSPLWFLVLAIAY

SEQ ID NO: 15368 - protein, 542 aa, Xanthomonas campestris
  unsure (1)..(542): unsure at all Xaa locations
MPXALLRPRAAPRCLVCRXACSLRPAPWRPRRWKVRWSSAPAPTPPTPDLAYPELFQAVQRGELFDDQKHFVDFLPLRDPALINADYLAQHEHAGFDLRKFVDANFEESPPVQTDAIRQDTALREHIDALWPKLVRSQTNVPAHSSLLALPHPYVVPGGRFREVYYWDSYFTMLGLVKSGETTLSRQMLDNFAYLIDTYGHIPNGNRTYYLSRSQPPLFSYMVELQAGVEGEAVYQRYLPQLQKEYAYWMQGGDDLQPGQAARHVVRLADGSVLNRYWDERDTPRPEAWLHDTRTAAEAHDRPAADVYRDLRAGAESGWDYTSRWLADGKTLSTIRTTAIVPIDLNSLLYHLERTLAQACAHTGTACSQDYAALAQQRKQAIDAHLWNAAGYYADYDWQTRTLSNQVTAAALYPLFAGLASDDHAKRTATSVRARLLRPGGLATTALKTGQQWDEPNGWAPLQWVAVDGLRRYGEDGLARTIGERFLTQVQALFAREHKLVEKYGLDADAAGGGGGEYALQDGFGWTNGVTLMLLNLYPSQG

SEQ ID NO: 15369 - protein, 304 aa, Xanthomonas campestris
PMTPIVSIQGLSKTYAGGFQALKRVDLDIQRGEIFALLGPNGAGKTTLISIICGLVNPSTGTVLADGHDIVRDYRAARASIGLVPQELATDAFETVWATVRFSRGLFGKPANPQYLESVLRQLSLWDKRNSKISTLSGGMKRRVLIAKALAHEPRILFLDEPTAGVDVELRHDMWQMVRRLREQGTTVILTTHYIEEAEDMADRVGVINRGELVLVEDKHTLMRKLGKKQLSLSLQAPLQVIPAPLADLPLELSADGTSLIYTFDTQAEQTGIGALLRRLNEQGIDFKDLHSSESSLEEIFVNL

SEQ ID NO: 15370 - protein, 246 aa, Xanthomonas campestris
MTLRIAYVTSGMGSVGTAICQKLARTGHTVVAGCGPNSPRKSAWLREQRELGFDFVASEGNAADWDSTMAAFAKVKAEVGEIDVLVNNAGGSRDTLFRQMSRDDWNAVIASNLHSLFNITKQVVDGMTSRGWGRIVNIGSVSAHKGQIGQINFATAKAAMHGFSRALAQEVASRGVTVNTISPGYIASASISNFPPDVLDRLATSVPVRRLGKPAEVAGLCAWLASDDAAYVTGADYAVNGGLYMG

SEQ ID NO: 15371 - protein, 302 aa, Xanthomonas campestris
MTTLRIATRKSPLALWQSEHVATALRQHHPGLEVVLVPMSTRGDEVLDRSLAAIGGKGLFLKELELAMLRGEADCAVHSLKDVPMELDAPFVLPAILERGDPADALVSNLYATLQALPLGARVGTSSLRRQAQLRAARPDLELIDLRGNVNTRLAKLDNGGYDAIVLACAGLQRLGLEARITARLDAPEWLPAPAQGAVAVECRGDDARIHDLLAVLDAGRTRACVEAERAMNRALHGSCHVPVAAFARWEGEDLFLQGMVGSASDGRLIHAEAHGSPDATEDLGRRVADGLFEKGAAQLLA

SEQ ID NO: 15372 - protein, 218 aa, Xanthomonas campestris
MLDVIERETGPNPQWAVIWLHGLGADGSDFAPMVPELVRAQWPALRFVFPHAPIRPITINNGVRMRGWYDIVGMDFAQRADKVGIAESVAQVEALIANEQARGIAPERILLAGFSQGGAVTLAVGLQRRVPLAGLIAMSTYLPDPAAAASQLQPGALAQPLFMAHGSADPVVPYRAGEQSAQALQALGFMLEWHSYPMGHQVCVEEIDALRDWMQARF

SEQ ID NO: 15373 - protein, 518 aa, Xanthomonas campestris
MSIFRTASTLALATALALAAGPAFSYSINNSRQIVDDSGKVVQLKGVNVFGFETGNHVMHGLWARNWKDMIVQMQGLGFNAVRLPFCPATLRSDTMPASIDYSRNADLQGLTSLQILDKVIAEFNARGMYVLLDHHTPDCAGISELWYTGSYTEAQWLADLRFVANRYKNVPYVLGLDLKNEPHGAATWGTGNAATDWNKAAERGSAAVLAVAPKWLIAVEGITDNPVCSTNGGIFWGGNLQPLACTPLNIPANRLLLAPHVYGPDVFVQSYFNDSNFPNNMPAIWERHFGQFAGTHALLLGEFDGKYGEGDARDKTWQDALVKYLRSKGINQGFYWSWNPNSGDTGGILRDDWTSVRQDKMTLLRTLWGTAGNTTPTPTPTPTPTPTPTPTPTPTPTPGTSTFSTKVIVDNSWNGGYCNRVQVTNTGTASGTWSIAVPVTGTSTTPGMRPGRRAAARSEPAAWTSTAPWQPAPPPSSASAPRAECTVAGTAPVSATFATCSGIVEALRSRLMITCGA

SEQ ID NO: 15374 - protein, 382 aa, Xanthomonas campestris
AQTVTVNPNQTYQTVRGFGGMNGAGWINNLTPAQVDLAYGSGNGQIGLSILRMRIDPSSSGWSLQVPTAARVRALGGILFATPWSPPAYMKSNKSLVKGGKLLSTSYAAYTTHLLDFANYLSARNAPLYAISLQNEPDWHPDYESADWNGSDFVNYLNAEGGKFGALKVIVGESVGFTFSITDPVLNNAKASQATSIVAGHLYGAQPKDYALARSKGKQVWMTEHYTDTSDGNAWPSALGVASELHQSMVANYNAYIWWYIRRSYGLISEGGSVSKRGYVMSQFARFVRPGSVRIGATEHPYADVSTTAYRTPDNKIVVVAVNTGTAHQRLDLTVPAGAATQFVKYTTSSSLNAGYAGAYTVSGGKTSLYIDPQSIATLVGQ

SEQ ID NO: 15375 - protein, 311 aa, Xanthomonas campestris
INGFGRIGRNVLRSAVQNFANDIEIVAINDLLEPDYLAYMLQYDSVHGRFKAEVSVDGNTLIVNGKKIRLTQERDPANLKWDAVGAEVVIESTGLFLTKETAQKHIDAGAKKVILSAPSKDDTPMFVYGVNDKTYKGEAIVSNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGILGYTEDKVVATDFRGETCTSVFDADAGIALDSTFVKLVSWYDNE

SEQ ID NO: 15376 - protein, 475 aa, Xanthomonas campestris
MHATSRPCPRTFWQRAHQLLLIALTLLLTTASAQADVILHAFNWPYATVEARAKQIADAGYRKVLVAPAYRSEGSAWWARYQPQDIRLIDNPLGDTTAFARMVQALANNGVETYADVVFNHMANEAATRSDLNYPGSAVLAQYAANPGRYDALRLFGTVQSNFLSGSDFGPAQCISNYNDAFQVRNYRICGGGSDPGLPDLLGNDWVVQQQRAYLQALKGLGVTGFRVDAAKHMTFDHLNRVFDAGIRSGVYVFGEVITGGGSGNGDYDQFLAPYLQSTPHAAYDFPLFNAVRTAFGVGASMQQLVDPASAGQALPGNRAVTFAVTHDIPNNAGFRYAILDPVDETLAYAYLLGRNGGVPMVYTDNNESGDNRWVNAYLRDDLRRMIGFHNGVQGSDMQVLSSSACHILFRRGSLGIVGINKCGNPVNTTVAMNGSVLFWNADYVDALGSGTVVRISSGSYTFTLPARQARMWRR

SEQ ID NO: 15377 - protein, 446 aa, Xanthomonas campestris
MPGLMSIRRKHAQTKPLKDVRITGSLHMTIQTAVLIETLKDIGANVRWASCNIFSTQDHAAAAIAATGTPVFAWKGETLEEYWDCTLDALTFTLPDGTLTGPELVVDDGGDVTLLIHKGYELENGSTWVDEPASSHEEGVIKALLKRVAVERPGYWARVVKDWKGVSEETTTGVHRLYQIAEAGKLLIPAINVNDSVTKSKFDNLYGCRESLADGLKRAMDVMLAGKVAVVCGYGDVGKGSAASLRAYGARVIVTEIDPICALQASMEGFEVNTIESTLGRGDIYVTTTGNKDIITVEHLQAMKDQAIVCNIGHFDNEIQVDALNALKGVEKINIKPQVDKYVFGNGNAIFLLADGRLVNLGCATGHPSFVMSNSFANQTLAQIDLWEKRDSYEKKVYILPKHLDEEVARLHLEKIGVKLTTLTKDQADYLGVDVAGPYKPDHYRY

SEQ ID NO: 15378 - protein, 172 aa, Xanthomonas campestris
MGVSGSGKTTIAQALATHYGFRFLDADDYHSVAARAQMASGQPLTDAMRLPWVELLSATLRDCVQSGESVVLAFSGLRGTHRQLLRRSGVPMRFVFLHAAPHVIAARLSARAGHFMPPSLLDSQLQTLELPLDEADVVSVDVDATVPEVVQDAIAQLALGVTQTRCSGSGSD

SEQ ID NO: 15379 - protein, 505 aa, Xanthomonas campestris
LLKALDLAPSNAGTYLGEGTWSQATGAGVLQPLNPTTNAVIADVQATTPEDYELIVARAQAAFKVWRTTPAPRRGEAVRLCGEALRAHKDALGSLVALEMGKSKPEGDGEVQEMIDIADFAVGQSRMLYGYTMHSERPGHRMYEQYQPLGLVGIISAFNFPVAVWAWNAFLAAICGDICIWKPSNKTPLTAIATMKICNAALKEAGFPDIFFLINDAGTSLSEKLVEDGRVPLISFTGSTQIGRVVAEKVARRLGRCLLELGGNNAIILDETADLKLAVPGIVFGAVGTAGQRCTTTRRLIVHESIHDNVLATLVKAYKQLDSKIGDPTDPANLMGPLNSRGAVEQFLESIAKAKAAGGTVEVGGTAIDRPGNFVLPAIVTGLKNSDAVVQHETFAPILYVMKYSTLDEAIDLQNGVPQGLSSSIFTQNLKAAEKFLSAAGSDCGIANVNIGTSGAEIGGAFGGEKETGGGRESGSDAWKVYMRRQTNTINYSDSLPLAQGIKFD

SEQ ID NO: 15380 - protein, 346 aa, Xanthomonas campestris
MYSLARPFLFAFDAERAHALALRAIDTAYRTGTTALVATRPVPLPTPAFGLMFPNPVGLGAGLDKNGEHIDALLALGFGFVEIGTVTPKPQEGNPKPRMFRLPEYQAVINRMGFNNLGVDVLVKNVQRARRRGGLLGINIGKNKDTPNEEATSDYRYCMERVYPLADYITVNISSPNTAGLRELQEEQALRRLIADLRETQEALAAQHGKRVPMLVKVAPDLNDRDIDAAARVLADLAVDGVIATNTTVTRTLVASHPMAEQAGGLSGAPLLGQSTLVLRRLRARLPESIPLIGVGGITSGADAVAKMAAGASLVQCYSGLVYRGPRLIGECVDAIRRRRESPSGG

SEQ ID NO: 15381 - protein, 201 aa, Xanthomonas campestris
SPLPRAFYAADARTVAPLLLNKVLVSADGRRGRITEVEAYCGSEDAAAHSFRGMTPRTQVMFGAPGHLYVYFIYGMHWAINAVCGGAPGHAVLIRALEPLAGCDAMHAARGAAPFKSLTTGPGRLAQAFGVSAADNGLDLTTGVARLWIEDDGTPPPVAPLAGPRIGIRKAVELPWRWVVPGSAYLSRPLPRVSGARASVP

SEQ ID NO: 15382 - protein, 418 aa, Xanthomonas campestris
ALPGAVALPRDTDDVVAIVQACRAHGVPIVARGAGTGTTGAAVPFSGGVVVSMARMNRILALRPADRCAVVQPGVLNGDLQQALQPHGLFWPPDPSSAEICSVGGNLSTNAGGPRAVKYGATRDNVLGLVAVTGTGDVIHCGGAYTKNSTGYDLTHLLVGSEGTLAIIVEATLKLTPRAVAQAGVRALYRDAASAAAAVSRIMAQPTTPTMLEFMDASAIALLRRNGSDVPDAGAMLLIEADGDHDTLPYALQALHDAADGDGVLSLDIAADGSARDKLWAARRALSPALRTIKPGKINEDVVVPVSRIPELVAGVEALAVEFAVPIVAFGHAGNGNLHVNIMYDPDDADETARAQAALPRVFALVLALEGTLSGEHGIGVAKRDFMTQAFSAPTLAAMRAIKAALDPDGILNPGKVL

SEQ ID NO: 15383 - protein, 442 aa, Xanthomonas campestris
CRRNWIIRMSNSSQHWIAQRGTALQGSLTIPGDKSVSHRAVMFAALADGTSKIDGFLEGEDTRSTAAIFAQLGVRIETPSASQRIVHGVGVDGLQPPQGPLDCGNAGTGMRLLAGVLAAQRFDSVLVGDASLSKRPMRRVTGPLAQMGARIETESDGTPPLRVHGGQPLQGITFASPVASAQVKSAVLLAGLYAAGETSVSEPHPTRDYTERMLSAFGVDIAFSPGQARLRGGQRLRATDIAVPADFSSAAFFIVAASIIPGSDVTLRAVGLNPRRTGLLAALRLMGADIVEDNHAEHGGEPVADLRVRYAPLQGAQIPEALVPDMIDEFPALFVAAAAARGDTVVSGAAELRVKESDRLAAMATGLRALGIVVDETPDGATIHGGTLGSGVIESHGDHRIAMAFAIAGQLSTGTVQVNDVANVATSFPGFDSLAQGAGFGL

SEQ ID NO: 15384 - protein, 264 aa, Xanthomonas campestris
MRIISFNANGLRSAASKGFFEWFATQDADVLCIQETKAQEHQLAGPEFLPAGYKAWFRDASTKKGYSGVAIYAKREPDEVRTALGWPEFDEEGRYIEARFGNLSVVSFYIPSGSSGELRQGYKFQVMEWLRPILSEWLASGRQYVLCGDWNIVRSALDIKNWKSNQKNSGCLPPERDWLNGLCADLLDEADASNGRGWVDSYRVLHPQGEDYTWWSNRGAARANNVGWRIDYQLVTPGLRDKVQACSIYREQRFSDHAPYIVDY

SEQ ID NO: 15385 - protein, 462 aa, Xanthomonas campestris
VAAEMFRAYDIRGVVGKDLNPGIAALIGQAIGSVMQAQGLRDIVVGRDGRLSGPELTNGLIEGLRRAGCNVTDIGLAPTPVVYFGAYELRAGSCVAVTGSHNPPDYNGFKIVIGGETLSGAAITELHQRITEGRLHTAASPGELEQRDISDAYIQRIADDVQLDRPIKVVVDAGNGAAGEIAPRLLEAIGAEVVPLYCEIDGTFPNHHPDPSEPHNLGDLVQMVQRFDADIGVAFDGDADRLGVVTKEGAIVFPDRLLMLFAADVLQRNPGALVIYDVKCTGKLSDYVLRNGGSPLMWKTGHSLIKAKMRETDAELAGEMSGHFFFKERWYGFDDGIYAAARLLEILAQREETPSDVLGELPESVSTPEIKVPLDGDAHALVARFVERAQAGEESPFEAARLSTIDGLRADFGDGWGLVRASNTTPILVLRFEADTAVALERIRALFRSELQALLPDHPLAF

SEQ ID NO: 15386 - protein, 545 aa, Xanthomonas campestris
SDPLFRYQWHLLNDGQEVIADTRPRAGTDLNVGPLHTLGLRGQGVTVAVVDDALELRHPDLVANVVPGGSKNFVDGSNDPTPRNGASHGTMVGGIMAAVGWNGLGGRGVAPDARLKGFNILSSEESPTDFDTNLRASWGDSVQSRDVDVFNNSFGSDLTYYPTISPAAERSLDRLMRRARNGKGGLYVQAAGNTFDSFTVLDDQGNWVERCPVLARTLGVTCSTPATDPLSNQPLIIATGAVNARGLRSSYSSAGAALWVTGFGGEFGLQRRYFGDRPRPALFDPAIVTTDLTGCAVGDNRDIAGQPPINALASSSSPIDASCNYSAAMNGTSAAAPTVAGVVALIVQANPSLTARDLKYILATSARQIDPAQQVIRYQGSVIEPGWITNAAGHAFSNWYGFGLVDAAEAVYRAYGFQPLPPQRDLGWKAARAGTSTIGGPNAAATLRLRLGDTLKIDTVQWSMQTTHKTPSNLRVVLISPSGTRSYVLTPFQALDTITQGAGFEIPLSTSNAFLDENVAGTWTLEVTDMTGSDVPAQLTGFKLR

SEQ ID NO: 15387 - protein, 559 aa, Xanthomonas campestris
TGTTRASAAGDPLYRYQWHLSNQGQPVIGDSRPVAGVDMDVDLLHALGIRGRGVRVAVVDNGLEIGHEDLAGNIIPNGSHNFGNGSHDPTPSDPGFGHGTSVAGIIAAVGWNGRGGRGVAPEALLAGFDFLGSDSAGSYAEVRYSWGDGPEARTLDVFNNSWGSAPDFYPDVSLEEGQSWEALMRSTRGGLGGIYIKSAGNSFKRVRARDAEGRIVNLCSDLSRTLNVGCLLTNVDPLSNMPATVVVASVDATGKRASYSSSGSALWISGLGGEFGYQRKFYPNAAQVFAPETAPFAYDPAIVTTDLSGCSAGDNVDGTTVENALTGSTSRIDASCNYSALMNGTSAAAPTVSGVAALILGANPSLTARDVKYILAKTARQIDPWQPASVYQGSVIDPGWITNAAGHHFSNWYGFGLADGAAAVYEATYFKPLPPVRDTQWVASTAAASQIGGPARPAKQRIRITQAMKVEAVQLSLATTHRTPANLRVVLESPSGTRSYVMTPFSLLDADAYAQTGFYIDLTSSNAFLDERAQGVWTLEITDMSEPTSTAALQNFKLR

SEQ ID NO: 15388 - protein, 973 aa, Xanthomonas campestris
TVVYDGKTLHGQADIPLIEFLSGHGIDLSHICYHPALGAPQTCDVCWVEVGGELVRGCTLRSHDGLEVSSTVERAHAARHEGMDRVLAKHELYCTLCEHNTGDCTLHNTFADMKMPIQRYAFQRKPYEKDHSNPFYTYDPDQCILCGRCVEACQKVEVNETLSIDFSMEHPRVLWDGGKPINESSCVSCGHCVTVCPCNALLEKTMQPDAGPLTALPQELKRPMIDMVKTLENTIGAPPITGVSVLDMHWRQPEIKRTKTVCTYCGVGCSFEMWTRDRHLLKVQPVVDAPANGISTCVKGKFAWDFVNDPKRLTTPLIREHGRFREASWDEALALVARRLLEIRDLHGAQSIGFIGSSKASNEEAYLTQKIARLIIGTNSVDNSSRYCQNPATEGLFRTVGYGGDAGTIADLQQAELVVIVGSNLAENHPVIASKLKAARKLHGQKLIVVDPRKHEMAERADLFLRPVPSTDIVWASALSRYMFDNGYADTQFLAQRVNQVDEYRQSLEPFTLDDAAHITGLSREQLVEAGEMIGRAGSVCIVWAMGITQHTHGADTSTALSNLLLVTGNYGRPGTGGYPMRGHNNVQGASDFGCLKNMYPGYESVSDPAVRNKWAQAWHVPAEQLSLEVGSDNFMMVQQADKGEIRAMYVIGEETAFSDADARNVHRGFSKLDFMVVQDLFFSRTAEFADVVLPACPSVEKDGTFVNTERRIQRFHQVFPPLGQSRPDWQILTELAARMGHDWGYTHPSQIMDEVARIATLFKGVNYQRLEGWRSLLWPMQADGRDTPLLYTERFHTDDGKARLHPLQWKRPGEEADAQFDLMLDNGRMLEQFQGMNQTGRGPRLWSLAPNWFVEVSPQLAAERGLQEGDWVKLSSRRGSLEVPVVITDRVAGNTLFLPIHQGKPGINLLTGEHHDPDVNTPAYKELAVRMEPLGRTGKPPLPAHNFRHGQRTPNDGVPVQQKWAREDYVAP

SEQ ID NO: 15389 - protein, 844 aa, Xanthomonas campestris
WPHNGAIGFFYAPIPRSRGAPMAQSQPEILDLPVLPLRDVVVFPHMVIPLFVGRDKSMRALEKAMEADKRILLVAQKSAETDDPAAGDLYTVGTLAQVLQLLKLPDGTIKVLVEGLSRVTVDKVAEQDGALQGRGTEVEASDAREPRELEAIARSLMSLFEQYVKTNRKLPPELLQTLAGIDEPGRLADTIAAHIGVRLADKQRLLEITEIGDRLELLVGLVDGEIDVQQLEKRIRGRVKSQMEKSQREYYLNEQMKAIQKELGDLDDAPGELEELARKIAEAGMPKPVETKAKAELNKLKQMSPMSAEAAVVRNYLDWLLGVPWKKRTKVRKDLKVAQDTLDADHYGLDKVKERILEYLAVQSRVKQMKGPILCLVGPPGVGKTSLGQSIAKATNRKFVRMSLGGVRDEAEIRGHRRTYVGSMPGRLVQNLNKVGSKNPLFLLDEIDKMSMDFRGDPSSALLEVLDPEQNHTFNDHYLEVDLDLSEVMFVATSNSLNIPGPLLDRMEVIRIPGYTEDEKLNIAMRYLVPKQIKANGLKPEEIEIGSDAIQDVVRYYTRESGVRNLEREVAKICRKVVKEIALAGPQPAAKKAVAKKAKPKALVTVTSRNLDKYLGVRRFDFGRAEEENEIGLVTGLAWTEVGGELLQIESTLVPGKGNLILTGQLGNVMKESASAALSVVRSRAERLGIDVDFLQKQDVHVHVPDGATPKDGPSAGIAMVTSLVSILTKVPIRADVAMTGEITLRGRVSAIGGLKEKLLAALRGGIRTVLIPDENRKDLADIPANVTRDLKIVPVKWIDEVLDLALERPLAPKKAGKEKTRKTASRVAVRGKSRTTPGTRVKH

SEQ ID NO: 15390 - protein, 346 aa, Xanthomonas campestris
  unsure (1)..(346): unsure at all Xaa locations
APPLXVRKPNVMTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQEVSADGEVAVSGARVTRKGSERIVRYAFDLARATGRKKVTAVHKANIIKSTSGLFLKVARDVATQYPEIEFQEMIVDNTCMQLVMRPEQFDIIVTTNLFGDIISDLCAGLVGGLGLAPGANIGVDAAIFEAVHGSAPDIAGQGKANPCALLLGAAQMLDHIGQPQNAERLREAIVATLEAKDSLTPDLGGTGNTMGFAKAIASRL

SEQ ID NO: 15391 - protein, 688 aa, Xanthomonas campestris
SPSRRDFLKRVAALTAAGALPASIGRALALPANARTGTLRDIEHVVILMQENRSFDHYFGTMRGVRGFGDPRALQLRDGNPVWSQAASDGRRVLPFAFDARNTCAPLIKSLDHSWKAGHGQDPLRWQEYDAWVPYKGELTMGYFQRSDIPYYHALADAFTICDGYFCSLHGPTNPNRMYLFTGTSGLSVGNTGAQTVTNADDGNWTADMARDKPGYAAMQWTTYAQRLQAAGVDWRVYQEYDNFGCNSLAYFAHYRDLDRNDERYRRARACVPGSTADNAATTQADHLVAAIAADVQANRLPQVSWVIPPTAYCEHPEAPPAYGESLVARLIDALTANPEVWSKTALIINYDENDGFFDHVPAPLPALDARMGRSNVDARGEVHEGVPVGLGIRVPMLVISPWTRGGWVNSQVFDHTSVLRLLERRFGVAEPNISPWRRAVSGDLTSVFDFRQPDHSALSALPAIGDYRARTAAVRDKPLPVPPTTAQMPRQEPGQRPARALPYALQVHARVHDDSGVQLQFINTGAAAAAFNVYTSAATGGPWYYTVLPGTQLDDVPMGAVHDGAYALRVHGPNGFLREFAGNLGAEQPALAAPWVQARQDGELLVLEIGNAGRQPCTLQVRALDYAEPTTQPLQLAAGQRHTLRLTLAASDHWYDIVVEQPGSAFRRRLAGHLETGKPSRSDPALG

SEQ ID NO: 15392 - protein, 340 aa, Xanthomonas campestris
MKALVKREASKGIWLEQVPVPTPGPNEVLIKLEKTAICGTDLHIYLWDEWSQRTITPGLTIGHEFVGRVAELGSAVTGYQVGQRVSAEGHIVCGHCRNCRGGRPHLCPNTVGIGVNVNGAFAEYMVMPASNLWPIPDQIPSELAAFFDPYGNAAHCALEFDVIGEDVLITGAGPIGIIAAGICKHIGARNVVVTDVNDFRLKLAADLGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLQKVLTHQLSIDEFQKGFDLMEEGKAGKVVLSWN

SEQ ID NO: 15393 - protein, 395 aa, Xanthomonas campestris
AALTAHYAAELESIQSQGLFKSERIITGPQSAQITLADGRRVLNFCANNYLGLADHPDIIQAAKDALDTHGFGMASVRFICGTQDLHKQLERTIADFFGTEDTILYAACFDANGGLFEPLLGEHDAIISDALNHASIIDGVRLCKAKRFRYANCDMADLETQLQAADAAGCKTKLITSDGVFSMDGFIAPLDEITALARKYNALVHIDECHATGFLGATGRGSAEVKGVMDQIDIFTGTLGKAMGGALGGFTTAKREVIELLRQRSRPYLFSNSLPPHVVAAGIKAFEMLDAAGELRTQLVENTRYFRERMTAAGFDVKPGVHPISPVMLYDAPLAQRFAERLLEEGIYAIGFFFPVVPKGQARIRTQISAAHTREQLDQAIDAFTRIGHELKVI

SEQ ID NO: 15394 - protein, 245 aa, Xanthomonas campestris
MTDSSKVVLITGAARRIGAQIATTLHGAGYRVALHAHRSGDALAARVAALCAQRAGSACALQADLRTPEAPAQLVDACVAAFGRLDAVVNNASAFYPTVLGEATPAQWDELFAVNARAPFFIAQAAAAQLRAHHGAIVNLTDLHAEQPMRQHPLYGASKSALEMLTRSLALELAPQVRVNAVAPGAILWPEDGKADAAKQALLARTPLARIGTPEEVAEAVRWLLDDASFITGHTLRVDGGRRLS

SEQ ID NO: 15395 - protein, 300 aa, Xanthomonas campestris
MELGMVGLGRMGANMAERLVRGGHRVHGFDLGAAARTSAQSKGIQTTDALATLVSALPSPRVVWLMVPAGKIVDDTLAQLLPLLQAGDIVIDGGNSYYKDSQRRAAQLQSSGIAFVDCGTSGGVWGLQEGYSLMVGGDEAAVTTLHPVLATLAPAPDKGWGRVGPSGAGHFTKMVHNGIEYGMMQAYAEGFALLQHKTDFALDLHQVAEIWRDGSVVRSWLLDLTADALAHNPTMGGIAPYVADSGEGRWTVAEAIDLEVSAPVITLSLMERLRSRDKDSFTDKLLAAMRNQFGGHAVLT

SEQ ID NO: 15396 - protein, 303 aa, Xanthomonas campestris
RIPGLDITRFDSDREAFVAELGAAYRQWGFAGIRNHGIAQSDIDAAYEVFKAFFALPDEVKRSYHVPGSGGARGYTAFGVETAKDSKHFDLKEFWHIGREIPDDSPYRAVMAPNLWPTEVPGFRERGYHLYQQLDQLGSRVLSALALHIGLPQDYFADKTDHGNSILRPIHYPPITSDDIPNVRAGAHGDINFITLLVGASAAGLEVRSNEGEWVPFTADADTIVVNIGDMLQRLTNHVYPSTIHRVVNPPGEEARKPRYSVPFFLHPNPDFLIDVLPSCISADNPSRYPEPITAHGFLEERL

SEQ ID NO: 15397 - protein, 250 aa, Xanthomonas campestris
MRRKIVAGNWKLHGTRAFATELVAQVAAHMPLAGVDVVILPPLPYLGDLIEDFEAHHLAFGAQDVSSNEKGAYTGEVSASMLVDVGAEYGLVGHSERRQYHQESSELVARKFAAAMHAGLIPVLCVGESLEQREAGHTEAILRAQLEPVLSLVGSAGFARAVVAYEPIWAIGTGRTATPDQAQAVHAFIRGEVAKADARIADSLPILYGGSVKPDNASELFFQPDVDGGLVGGASLVAEDFLAIARAAAA

SEQ ID NO: 15398 - protein, 720 aa, Xanthomonas campestris
  unsure (1)..(720): unsure at all Xaa locations
VEIDGQSLVVPKGSMIIQAADKAGIPIPRFCYHEKLPIAANCRMCLVDVEKSPKPSPACATPVMDGMKVTTRSEKALKXQRSVMEFLLINHPLDCPICDQGGECELQDVSLGYGRSVSRFNERKRVVPDEDIGPLVATEMTRCIQCTRCVRFTADIAGTYELGGMYRGENLQIGTYDGKPLTTEISGNVIDVCPVGALTNKVFQFRARPWELMARESLGYHDAMGSNLFLHVRRGEVLRTVPRENEAVNECWLSDRDRYSHQGLYAEDRAVKPLKKVNGEWTEVSWAEGLAAATQILRDNAGDQLGVLVHPATSNEEGALLARLAEGLGSGNLDHRLLNRDFSDAAVAEAFATPLAEIEQADVVVLFGTNVRHELPLLHARLRKASIQNRTQIHSVNPVDFDFAFTQASRTVVSPTQLAGALDDATLRDAVKGASRAVIVVGALAENHPQAATLRAAARAFAAATGASLCRIPQGANAVGLVSQGVLPTARTVAGMFAEPRQAYVVYGIEPGLDFADAAAARSALAGAKVVAFSQFACASTRDVADVILPIGALPEIDASLTNLDGRVQTARAAGRLPVEAREGWRVLRALGGELGLAGFEFIDLVGLRAGMQQRSVTAATSAQPATASEGLEVAATAAIYRTDAVVRRAAALQSHPLNIAPCVAMHPEQAAQLQVAAGQVVKVGTDAGRATLPVVLDKRVAPGTVWIESGHGATAPLGA

SEQ ID NO: 15399 - protein, 374 aa, Xanthomonas campestris
KPKKSVALSGTAAGNTALCTVGRSGNDLHYRGYDILDLATSSEFEEIAYLLVHGKLPNSGELRGYKAKLRSLRGVPAAVKTALEQLPPSAHPMDVMRTGVSVLGCLQPEKDDHNHPGARDIADKLMASLGSMLLYWYHYSHNGKRIEVETDDDSIGGHFLHLLHGFAPKESWVRAMHTSLILYAEHEFNASTFASRVIAGTGSDMYSAIAGGIGALRGPKHGGANEVAFEVQKRYDTPDEAEADIKARVERKEVVIGFGHPVYTVSDPRNKVIKDVARELSDEQGSRKMYDIAERLETVMWDIKKMFPNLDWFSAVSYHMMGVPTAMFTPLFVLARTAGWSAHIIEQRVDGKIIRPSANYTGPEDQAFVPLDQR

SEQ ID NO: 15400 - protein, 864 aa, Xanthomonas campestris
AMNNSYRKPLPGTSLDYFDARAAVDALQPGAYATLPYTARVHAENLVRRADPQHVDAYLRQLIERKRDLDFPWFPARVVCHDILGQTALVDLAGLRDAIAEQGGDPAQVNPVVPVQLIVDHSLAVEYAGFDKQAFAKNRGVEDRRNADRFHFIEWTKRAFENVEVIPPGNGIMHQINLEKMSPVIYVQDGVAFPDTCVGTDSHTPHVDALGVIAVGVGGLEAENVMLGRASWMRLPDIIGVELLGRPAPGITATDIVLALTEFLRQQRVVGAYLEFYGAGASALTIGDRATISNMTPEFGATAAMFYIDQQTLDYLRLTGREDTQIALVETYARQTGLWADDLVTAQYERMLQFDLSSVVRNMAGPSNPHKRVATSELASRGIAAAWEQVPGQMPDGAVIIAAITSCTNTSNPRNVIAAGLLARNANARGLTRKPWVKSSLAPGSKAVQLYLEEAGLLGELEQLGFGIVAFACTTCNGMSGALDPVIQQEIIERDLYATAVLSGNRNFDGRIHPYAKQAFLASPPLVIAYAIAGTVRFDIEKDVLGVDAEGVPVTLKDLWPSDAEIDAVVARSVKPEHFRSVYEPMFRRSGLQGARVSPLYDWRAQSTYIRRPPYWEGALAGARTLQGMRPLAVLGDNITTDHLSPSNAILASSAAGEYLTQMGVPEEDFNSYATHRGDHLTAQRATFANPKLVNEMAVVDGQVTAGSLARLEPEGQVLRMWEAIETYMQRKQPLIIIAGADYGQGSSRDWAAKGVRLAGVEAIVAEGFERIHRTNLIGMGVLPLEFKPGTDRKMLGIDGSETFDVVGERTPGATLTLSVHRRDGEQLQVPVTCRLDTAEEVSIYEAGGVLQRFAQDFLEATKA

SEQ ID NO: 15401 - protein, 293 aa, Xanthomonas campestris
MTASAPAALAPARLLDGRRIAEELLDGLKLRVDARLAAGKTRPGLAVVLVGGDPASSVYVRNKRRAAEKVGIEAFDYDLPQGTTEAELAALIDQLNTDPKIHGILIQLPLPGIPDANRLIQRIDPRKDVDGFHPQNVGHLALREFGLRPCTPRGIVTLLAHTDQPVRGRNATIVGVSYHVGRPMGLELLIAGCTVTSCHKFTPPDVLEASVRNADILVVAVGRPGLIPGEWVKPGAVVIDVGINRLDDGRLVGDVGFEAAAQRAGWITPVPGGVGPMTVATLMQNTLEAADAA

SEQ ID NO: 15402 - protein, 328 aa, Xanthomonas campestris
  unsure (1)..(328): unsure at all Xaa locations
MSKRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVLCAKAVVGDEPFAVLLPDDLMWNRGDAALTQMADVAEASGGSVIAVEDVPHDKTASYGIVSTDAFDGRKGRINAIVEKPKPEVAPSNLAVVGRYVLSPKIFEYLESTGAGAGGEIQLTDAIAELLKQEQVDAFRFEGRRFDCGAHIGLIEATVHFALEHDKHGAPAKEIIRSALAAADARRLSVRLAVLQRTAPLGPFVVSGPRVSEXWRRA

SEQ ID NO: 15403 - protein, 279 aa, Xanthomonas campestris
VSLVTSLTYVLPHRLLSSLARALAYSKTPATKQWLIDTVTRKFGVDLSEAQEPDPHAYPTFNAFFTRALKPGARVPDADPQALLMPADGRISQLGPIENGRIFQAKGQSFTAAELLGDESAAVPFHNGLFATVYLSPKDYHRVHMPWSGTLRETVHVPGRLFSVGPDAVRNVPRLFARNERLVCHFDTDFGPMASVMVGALLVSGVETVWSGVEIPRYGDRITRKDYRGKGITLERFAEMARFNYGSTVIVLLPPGVAALEGGLAAESSVRLGQALARR

SEQ ID NO: 15404 - protein, 361 aa, Xanthomonas campestris
MGSNSFGRLFTVTTFGESHGPAIGCIIDGCPPGLEIAPEEFTHDLQRRATGKSRHTSARREADEIEILSGVYEGRTTGTPIGLLIRNTDQRSKDYTNIAQQFRPGHADYTYWQKYGIRDPRGGGRSSARETTMRVAAGVIAKKWLKQRYGVLVRGFLSQLGEIRPTGFDWDAVEDNPFFWPHAAQVPELETYMDALRKSGDSVGARVDVVAGGVPPGWGEPIYGKLDSELAAALMSINAVKGVEIGDGFASAAQKGTEHRDLITPEGFLSNHAGGILGGISTGQAVTASMVLKPTSSLRLPGATVDADGAVVDVITTGRHDPCVGIRATPIAEAMMALVLMDQALRHRAQCGDVGEVSPLI

SEQ ID NO: 15405 - protein, 339 aa, Xanthomonas campestris
SNETRRFNVAVVGATGAVGETMLSILAERQFPVATLYALASARSAGGQVEFNGGKVDVLDLAEFDPTGVDIALFSAGGSVSKEYGPKFAAAGAVVIDNSSAFRYDDDVPLVVSEVNPEALKQRPRGIIANPNCSTMQMLVALGPIHRKYGIERINVATYQSVSGGGRSAMEELGKQTSELLSFQQIDPQRFPVQIAFNLIPHIDDFQDNGYTKEEMKLVWETRKILGDENIQVNPTAVRVPVFYGHSEAVAIETREKITVAEARALLAASPGVEVVDEHKAGGYPTPVTHASGQDAVFVGRIREDLSHPCGLNLWIVSDNIRKGAALNAVQLAELVAQE

SEQ ID NO: 15406 - protein, 217 aa, Xanthomonas campestris
MNRSLYRTRIKFCGMTRAGDIRLAGELGVDAVGFIFAHGSPRRVAPAEARAMRQATAPMVDVVALFRNNSKEEVREVVRTVRPTLLQFHGEEDDAFCRSFNLPYLKAVPMGASGVNGEDANARTLQLAYPNTAGFLFDSHAPGEGGGTGKTFDWSRLPTGLHRPFLLAGGITADNVFDAIVATLPWGVDVSSGVELAPGIKDGHKMRKFVEEVRRAD

SEQ ID NO: 15407 - protein, 606 aa, Xanthomonas campestris
MFRWFESLIDTFPPIEREMPPRSVWRFYLHYLRPLWPILLATLIAGLLLALVEVAMFDFLGRIVDMLAEQPGPEFFRRHAGELVWMAAITLVARPFFTGLHNLLVNQAIVPGLSNRSRWLMHNYVVRQSLAFFHNDFAGRIANRVMQTGTSLRESAVQMVDALWYIVVYTGSALWLFAQADPWLMVPLLCWLVVYVGLMAFFVPRMKARAWVASDARSKATGRIVDGYTNIATLKLFSHARREEAYVRDAIDELAVKHRLQTRVTTAMDTAIAIANGFLIVGTCGLALWLWSRGQISVGAITLATGLVIRIHNMSGWIMWTVNGIFEDIGSVQDGMQTIAQPLTVQDQPTALPLQVTRGAVHFDQIHFHYGKRGGVIAGLDLRVRAGEKIGLVGPSGAGKSTLVNVLLRLYDLEQGRILIDGQDIAQVTQESLRGQIGLVTQDTSLLHRSIRDNLLYGRPQATEAQLLDAVHKARADGFIDTLVDGEGRRGFDAHVGERGVKLSGGQRQRIAIARVLLKDAPILILDEATSALDSEVEAAIQDSLDALMSDKTVIAIAHRLSTIARMDRLVVMDGGRIVETGTHAELIAHGGLYARLWARQTGGFV

SEQ ID NO: 15408 - protein, 353 aa, Xanthomonas campestris
RDNVMPPLTDDLRIRKIEPLTPPSQLLSLLPCDERASETVTNARAALHEILHGRDDRLAVVIGPCSIHEPVAAMEYAQRLRPLREQFGDALEIVMRVYFEKPRTTIGWKGLINDPDLDGSFQINKGLRVARGLLRDINNLGLPAGVEFLDIISPQYIADLVAWGAIGARTTESQVHREMASGLSCPVGFKNGTGGDVKIAVDAVGAASHPHHFLAVTKDGHTAVAATAGNPDCHVILRGGKQPNFDAANVEASSQVLNKAGLPARLMIDASHANSGKNPDNQPKVIDDIATQLEGGETRIVGVMVESHLVGGRQELVPGGTLTYGQSITDGCLDWDTSLQVLERLASAVRARR

SEQ ID NO: 15409 - protein, 263 aa, Xanthomonas campestris
LYDQATWSEGPTWWEAQRTLVWSDLVGRRVLGWREDGAVDVLLDATAFTNGNAVDAQQRLVHCEHGRRAITRSDADGQAHLLVGRYAGKRLNSPNDLIVARDGAIWFTDPPFGLRKPSQGCPADPELAHHSVYRLPPDGGPLQRMADLDHPNGLAFSPDEQTLYVSQTPEQGHGSVEITAFAWRDGALHDRRHFASVPDGLPDGFCVDRGGWLWSSSGTGVCVFDSDGQLLGHIPTPGTASNCTFDQAQQRLFITGGPCLWML

SEQ ID NO: 15410 - protein, 435 aa, Xanthomonas campestris
LATRLGGLGLDPAAGRTLIREGILRRAVGLTLEATGCEAPMGATCKVEVDGGWVDAEVVGFSGERTYLMPSAELHGLLPNARVVPSRRRGGVEVGEGLLGRVIDSDGTPLDGKGPIRAEGSVGMAGVSINPLAREPITTSLDVGVRAINAMLPIGRGQRVGLFAGSGVGKSTLLGMMTRFTSADVIVVGLIGERGREVRDFVETTLGEEGLRRAVVVAAPADRPPLARLHGAYRATAIAEWFRDQGLNVLLLMDSLTRFAQAQREIGLSVGEPPTTRGYPPSVFAKLPALVERAGNGAKGRGSITAFYTVLTEGDDPQDPIADAARAILDGHILLSRRVADSGLYPAIDLESSVSRVVQDIADDTWRLRIRKLKRLLSAYTANRDLIAIGAYQRGSDPATDEALARWPEIVDFLGQDVHKASDLTDSLSALQRLV

SEQ ID NO: 15411 - protein, 1167 aa, Xanthomonas campestris
MGLSTIKLSGSKSFGRTRPRCTCPTNMTGIVGPNGCGKSNIIDPVRWVMAQSSASRLRGDSLTDVIFSGSSARKPVSQATVELIFDNSDHTISGEFASFNEISVKRLVSRDGTSAYYLNGTKCRRRDITDLFLGTGLGPRSYSIIEQGMISQIIEARPEDLRVYLEEAAGISKYKERRKETETRIRHTRENLDRLGDLREEITKQLAHLQRQARQAEQYQALQEERRIKDAEWKALEYRGLDGRLQGLREKLNQEETRLQQLIAEQRDAEARIETGRVRREEAAEAVAKAQADVYQVGGALARIEQQIQHQRELSHRLHKARDEAQSQLQELTQHISGDSAKLAVLREAVADAEPQLEQLREDHEFRQDALREAEARLADWQQRWETHNRDTGEASRAGEVERTRVDYLDRQSLEADRRREALVNERAGLDLDALAEAFEQIELRHETQKASLDGLTEQVEARKHALGGLQEQQRASQGELAEVRKQAQAARGRLSSLETLQQAALGQEQGAAVAWLKARGLDSAVRVGERISVESGWENAVEGALGQLIEGVLVEAPEQLVDALGELGDGRIALVSSATDNVQFAPTSLAAKVQGPIAIRRLLARLHAAEDLDAARSLQCNLPDGDSVITRSGERLGEGWVRVSRSGAAKQGALLREREIQELRSQIDTLQEREGDLEEQLASFREQLLAAEQQREDAQRQLYMAHRSVSELAGQLQSQQGKVDAARGRIERIEAELGQLLETLDTSREQAREARAKLEDAVVRMGDLQGTREALESERRQLTDARDQARDAARGVRDAMHALALTLESQRTQITSLSQTLERMDSQRGQLDTRLEDLVAQLSEGDSPVETLEHEHQAALSERVRTERVLGEARTMLDSIDGELRSFEQTRQQRDEQALAQRERISQRKLDQQALVLNAEQLAAAVVKAGFVLEDVVNGLEEAANPAEWDAAVGQIDARMRRLEPVNLAAIQEYGEAAQRSEYLDAQNVDLTTALETLEEAIRKIDRETRGRFKDTFDRVNSGVQALYPRLFGGGHAYLELTGEDLLDTGVTIMARPPGKRVSSISLLSGGEKAMTAVALVFAIFQLNPAPFCLLDEVDAPLDEANVGRLANMVKEMSEKVQFLFVSHNKATMEAARQLSGVTMREPGVSRLVSVDLEEAARLAGA

SEQ ID NO: 15412 - protein, 370 aa, Xanthomonas campestris
VSRRSFLSLATSGLAVSALGLTPAAEAARKRAAAPAAPSVALAAGTVYLNFNEHPTGLSPAALDAASRSLARSGRYLFEMEQDLRNLMAGELQLPHDHLAFFPGSSDPLNRAGTLFTSPRAGLVMADPTFEALADLAAAQGVPVRKVPLRADGAHDVKAMAKADPSAGLIYLCNPNNPTGSITPRAEIEWLLANKPASAVLVVDEAYIHYSTEPSVADLVRQRQDLIVLRTFSKLYGMAGMRLGAALAPPGLLTKLASLGGNPLPVPAMAAGIASLRDPMLVPSRRADNARVRDDTIAWLKSKGYTCLPSQANCFMVDVKRDGKVFADSMQKQGVIVGRSWPIWPKRVRVTVGSEAEMLRFREAFAKAKR

SEQ ID NO: 15413 - protein, 798 aa, Xanthomonas campestris
LLGLVLLAGGAWLATLGGSWYYAPAGLAMLIAGVLLFRGRNAGAWWFAAVVAATLLWTWWESGSDYWRWVPRLGLIVGLAFVLALLLPKLERPVSRAVSRSVAGGLAVVFVVAFALAFVPFGITEAEGALTQVAGIAAGVVNRPADGAQPAQPANAPVDDDWAAYGRSQAGQRYSPLTQINRDNVSQLQQAWVFHTGDVPTKRWGAETTPLKVGDSLYLCSARNQVIALDASTGKQRWRYDPKVKDEAIPYTAACRGVSYYEVPTAAPAANDAAASQAATAPALCRTRVIEGTLDGRLIALDARTGTPCADFGTHGQVDITVGMGETPPGYISINSPPAIVRGVVVIGHQVLDGQKRYEPSGVIQGFDAVTGQLRWAWDMTHPEWNGAPPPGQTWTRGTPNMWTTAAADEQLGYVYLPMGNSTADYWSSSRTPPENRYATSLVALDVTTGKPVWNFQTTHIDAWDYDLGSQPSLIDFPKDGVNVPAVLLPSKQGELYVLDRRTGEPLVGVEERAVPGGGVEPQMRYKTQPFSLYHTLRKPDLTERDMWGMTPIDQLVCRIQFRKASYKGIYTPPEADRHSIEYPGYNGGSDWGSVAVDPHRGVIVANYNDMPNYNILVPRAKADKLGWAPRDQVRGDAGGAEGAGDPQAGTPYAVNVNAGWRLPFTKLLCKQPPYGGIRAIDLKSGKTLWDRPFGSARGNGPFGIRSGLPIEIGTPNNGGSVVTAGGLIFIAAATDDLIRAIDLATGKELWHAKLPAGGQANPMVYAYGGREYLVIMAAGHHFMETPAGDALVAYALP

SEQ ID NO: 15414 - protein, 507 aa, Xanthomonas campestris
SVVLQPGQVTLAQWRALYRGAEVTLDPACAQAVLRSAQTVEAIVARGEPVYGVNTGFGKLASVRIERDDLQTLQRNIVLSHAAGVGDPTPVPVVRLMMALKLTSLAQGASGIQPDTLALLEAMLRQGITPVVPCQGSVGASGDLAPLSHLAAVMIGVGEAFVGDQRLPAADALARAQLQPRVLGAKEGLALLNGTQFSTACALAGLFEIETVLQAALVTGALSVEAAKGSDTPFDARIHALRGQPGQIATAAALRALMAESAIRESHRLGDVRVQDPYCLRCQPQVMGAALDVMRQAARTLEIEANGVSDNPLVFSDTGEALSGGNFHAEPVAFAADMLALAVCEIGSISERRTAMLVDPALSGLPAFLTPRPGLNSGFMIPQVTAAALVSENKQCAYPASVDSIPTSANQEDHVSMAAHGARRLLAMADNAAHVIGIELLAAVQGCDFHAPLRSSAALEAARALLRAQVPTLQDDRYFHPDMLAASALVRSGALATAVGIVLPGVE

SEQ ID NO: 15415 - protein, 359 aa, Xanthomonas campestris
RAFNFSAGPATLPESVLRQAQEEMVEWNGVGASIVEISHRSADFMAVAAAAEADLRTLLSIPDDYAVLFTSGGATTIQALLPLNFAAPGQAVDYVVSGHWGKTAIKQATPYVDVRVAADGQPGGYVDIPPVASWTLSPHAAYVHITANETIHGVEFRDTPDVGTLPLFADFSSSIASEPLDIRRYGLIYAGAQKNLGPVGISVVIVRRELLERAGQPRADIFNYASHVARDSMLNTPPTWNWYLLGLTVKWMLEQGGVAAFAQRNAEKAALVYGAIDGSGGFYRNQVMPTVRSRMNIPFFLGDEQLDALFVSESKAAGLLALKGHKAVGGIRASLYNAMPVAGAQALVAFMHDFQQRHG

SEQ ID NO: 15416 - protein, 119 aa, Xanthomonas campestris
NAMDIFKVFTLEAAHRLPNVPPGHKCARLHGHSFRVELHVSGEPGAETGWIMDFGDIKAAFQPIYDRLDHHYLNDIEGLENPTSERLAIWIWQQLKPALPQLSEIVVHETCTSGCRYRG

SEQ ID NO: 15417 - protein, 402 aa, Xanthomonas campestris
MRRVVVTGMGINSCLGNDLDTVSSALRESRSGITALPDHAEAGLRSQVGGAVDIDLDGLIDRKLKRFMGDASAYAYLAMRDAIADAGLSPEQVSDLRTGVIAGSGGGSSQWQVETADLLRARGVRKVGPYMVPRTMCSAVSASLATAFKIRGLSYSLSAACATSAHCIGAAADLIRHGAQDVMFAGGGEELHWTMSVMFDAMGALSTGFNDRPAVASRPYDAQRDGFVIGSGGGMLVLEDYDHAIARGARIHAELLGYGVTSDGADMVAPSGEGAVRCMHMAMQGLDRPIDYLNTHGTSTPLGDATELGAVREVFGDNVPPLSSTKALSGHSLGAASVHEAIYSMLMLRDGFMAGSAHIDELDPRAEGFPILRATREATLNTVMSNSFGFGGTNGVLVFGRV

SEQ ID NO: 15418 - protein, 672 aa, Xanthomonas campestris
MTNPLLDFSGLPSFDTIRPDHVGPAIDQLLADAEAAVKAAEQVSPVSWDSFVVPLDDATERLWRAWGQVGHLQAVMNTPELREAYNSNLPKVSRFGSALAQNLALYAQYKALAASPEAAHYDEARRKVLDNALRDFRLGGAELDDASKARFAQIQEELSGLAAKFSQNVLDATDAWAHVTQDETQLSGLPSEVVAAARAAAEKDGAAGWKFTLQMPCYLPVQSDADSRELRARLYRANAERASEFGDVALDNSATIQRILALRAELAQLLGFASYADYSIATKMAQSPDEVMGFLRDLAVRAKPYAQQDRAELEAFARDELGLEQLEAWDLAYAGEKLKQARYSFSEQEVKQYFTEPKVLAGLFDVIHSLYGLTVKPDSAPVWHPDVRFYRLEDAQGALVGQFYLDLYAREGKRGGAWMDDCRNRRETSQGVQTPLVYLVCNFGRGSGDAPATFRHGEVTTLFHEMGHGLHQLLTRIGELGVAGINGVEWDAVELPSQFMENFCWEWERVQAMTAHVQTGEPLPRNLFDRLLAARNFQSGMFTVRQLEFALFDMQLHSSFDPAQDSVLELIERVRDEVAVNRPPTWNRFPHQFSHIFAGGYAAGYYSYKWAEVLSADAYAAFEEAPEQVADTGARFRHEVLARGGSRSAADNFRAFRGRAPKIDALLRHNGM

SEQ ID NO: 15419 - protein, 624 aa, Xanthomonas campestris
WSLDQARKTYSIPHWADGYFDVNDAGHVVVKPTADGPAVSLPEVVDAARAAGAKLPLLVRFPDILGQRLGKLQAAFAQAQADWDYAGGYTAVYPIKVNQHRGVAGTLASHHGEGFGLEAGSKPELMAVLALSRPGGLIVCNGYKDREYIRLALIGRKLGLQTFIVIEKPSELNLVLEEARALDVKPGLGVRMRLASLGAGKWQNSGGDKAKFGLSPRQVLDLWKSLRDTEYADSLNLLHFHMGSQISNVRDIANGMREATRYFVELSRLGAKISHVDVGGGLGIDYEGTRSRSYCSINYGLHSYASNIVQPLASACEEHGLPPPRIVTECGRAMTAHHAVLIANVSEVEQAPEGRVPDAHDDEPAAIRHLREIHDELDVRPAVELFQEAQHFHAEGLSAYALGQIDLTHRARIDDLFYAIAHGVRARLSFDEKSHRPVLDELNERLVDKYFVNFSVFESIPDVWAIDQVFPIVPIERLNEAPQRRGIIADMTCDSDGMVKTYVENESLDSSLPLHGLNPGESYRIGFFLVGAYQEILGDIHNLFGDTDAVEVAVDGTGYRIAQQRRGDTTDVMLDYVGYQLDTLRATYAERIAAAQLPPERAQEVHDALEAGLTGYTYLSDEPL

SEQ ID NO: 15420 - protein, 607 aa, Xanthomonas campestris
  unsure (1)..(607): unsure at all Xaa locations
VIEIKTTHMGXNNDVPVIEAIACVFDPLLKDHGLETLNSDNANLEAHDSCAGVRKELNVKIGYTLAXRPNDLLLETQGDVSTQHAAPETYTGTSDWDPRRTPGTKCPATPSHRAAHESGGHNLSLASPYGCAIQCKISETTGLHLGRYTPPMTRCELCLNTVLIKRYARLMGIXLNVGCIPSKALLHAAAVIDEVAHAGDFGVDFGQPKITLDKLREYKEKVVGKLTGGLASMAKQRKVRTVTGVASFVSPNELEIVGDDGKTQLLRFEHCVIAAGSQAVKLPNFPWDDKRVMDSTDALELHDIPKTLLVVGGGIIGLEMATVYSALGSKVTVVEFMDQLMPGADKDLVKPLADRLKKQGVEVHLKTKATDVSADAKGITVSFEAASEGEKPGLQATAFDRVLVAVGRSPNGKKIGAEKAGVTVTERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEDTHRIIGGAIVGVHAGDLLAEIGLAIEMGAEAEDIGHTIHAHPTLSESVGMAAEVYDGTITDLYIPKKK

SEQ ID NO: 15421 - protein, 511 aa, Xanthomonas campestris
LNPSEISDLIKTRIEAVKLSAESRNEGSVTSVSDGIVRIFGLADVMQGEMIELPNNTFALALNLERDSVGAVVLGDYENLREGDVAKTTGRILEVPVGPELLGRVVNALGEPIDGKGPLGATQTAPVERVAPGVIWRKSVDQPVQTGYKSVDAMIPIGRGQRELVIGDRQTGKTALAIDAVINQKGTGIKCVYVAIGQKASTVANIVRKLEENGALAHTVVVAATASESAAMQYISPYAGCTMGEYFMDRGEDALIVYDDLSKQAVAYRQISLLLKRPPGREAYPGDVFYLHSRLLERAARVSEEYVEKFTNGAVTGKTGSLTALPIIETQAGDVSAFVPTNVISITDGQIFLETDLFNAGIRPAVNAGISVSRVGGAAQTKIIKKLSGGIRISLAQYRELAAFAQFASDLDEATRKQLERGQRVTELMKQKQYAPMSIANQALSIYAVNEGYLDEVPVNKLLAFEEGLHAHFANTQGELVSKINTTGGWDNDIEAAFKKGIEEFKTTGSW

SEQ ID NO: 15422 - protein, 287 aa, Xanthomonas campestris
MAGGREIKTKIKSVQNTRKVTRALEMVSASKIRKAQERMKTSRPYAQAMKQVIGHLAQASTDYQHPFLVEREQVKRVGYIVISSDRGLAGGLNNNLFRKMLGEVRPWQDKGAEIDVVTIGQKASAFFRRIKVNMVGSVTHLGDSPHIEQLVGVIKVMLDAFTEGKVDRVYLVYNRFVNTMTQKASFEQLLPLPAAEHKVAHHDWDYLYEPDAATVLEHVMTRYIESLVYQAVLENVASEHAARMVAMKAASDNANKMIGTLQLVYNKARQAAITQEISEIVSGAAAV

SEQ ID NO: 15423 - protein, 464 aa, Xanthomonas campestris
MSQGKIVQIIGAVVDVEFQRNEVPKVYHALKVEGTAITLEVQQQLGDGVVRTIALGSTDGLKRNLLATNTERAISVPVGAGTLGRIMDVLGRPIDEAGDVQASDHWEIHRAAPSYEDQSSSTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDENGKGKDVLLFVDNIYRYTLAGTEVSALLGRMPSAVGYQPTLAEEMGVLQERITSTKSGSITSIQAVYVPADDLTDPSPATTFAHLDSTVTLSRNIASLGIYPAVDPLDSTSRQMDPLVIGHEHYDTAQRVQQTLQKYKELKDIIAILGMDELSEEDKQSVSRARKIERFFSQPFHVAEVFTGSPGKYVSLKDTIRGFKAICDGEYDHLPEQAFYMVGSIEEAVEKANKM

SEQ ID NO: 15424 - protein, 609 aa, Xanthomonas campestris
MCGIVGAIAGRDVVPVLIEGLKRLEYRGYDSSGIAVLDGTQVRRVRRTGRVAEMAQAAQAEQFGATLGIGHTRWATHGGVTEANAHPHISAGVALVHNGIIENHEEQREKLRALGYTFESQTDTEVIAHLIHHHLADAGDLLSALQRTVKELTGAYALAVMSQAEPERFVCARMGCPLLIGVGEGENFVASDVSAIVQATRQVIFLEEGDTAELRRDGVRVFDASDAAVERPLHLSDVSLASLELGPFRHFMQKEIHEQPRALADTIEAAIDAKGFPASLFGPTADAVLRDIEGVQILACGTSYYAGLTARYWIEAIAGLPCSVEIASEYRYRTAYANPKHLIVTISQSGETLDTMEALKYAKSLGHLHTLSICNVPESAIPRASELVCYTRAGAEIGVASTKAFTTQLAVLFQLTMVLGKLQGRISDSEEADYLEQLRFLPGSVQHALNLEPQIMAWAERFSPKENALFLGRGLHYPIALEGALKLKEISYIHAEAYPAGELKHGPLALVDATMPVVVIAPNDRLLEKVKSNMQEVRARGGELFVFADQDSHFSESDGVHVIRTPRHAGVLSPVIHTIPVQLLAYHTALARGTDVDKPRNLAKSVTVE

SEQ ID NO: 15425 - protein, 393 aa, Xanthomonas campestris
VAITAFTATTALGAGLDAQASALRERRSGMRRNDFGPQPLECWIGRVAGVEDVVLPDALQGWDCRNNQLAWLALQQDGMAAAVQAAAQRYGAERVAVVMGTSTSSVGASEEAYTRLVEDAHGLRFPDDLQRPIVHTPHSLGDFVQHATGLRGPAITVATACSSSAKVFAQAARLMAAGVVDAAVVGGVDTLCGSVLFGFNSLQVVAPQLCQPFDARRVGLSLGEAGGFALLERPAAAPDAAQWLYGYGESSDAHHMSAPHPQGLGAQLAMRGALDTAGLDAAAVGYLNLHGTATPANDSVEAAAVAAIFPDTLHASSTKAWMGHTLGAAGIVESVIALLALRDGLLPGTLNSAVPDPACGPQIRFDNAHSRIQYAMNNSFGFGGNNCSLLFGQ

SEQ ID NO: 15426 - protein, 244 aa, Xanthomonas campestris
MSTSVPQRRALVTGGSGDLGGAICRQLAAQGRHVIVHANRNLARAEEVVASIVAAGGSAEAVAFDVADAQASADALAALLEAGPIHIVVNNAGIHDDAPMAGMNAQQWHRVIDVSLHGFFNVTQPLLLPMARARWGRIVSVSSVAAVLGNRGQTNYAAAKAALHGASKSLAREMASRGIAVNVVAPGVIESEMVGDSFAPELIKQMVPAGRVGTPDEVAALVAFLCSDVAGYINGQVIGINGGM

SEQ ID NO: 15427 - protein, 889 aa, Xanthomonas campestris
PLRDDVRRLGALVGDLLAEQVSADFLEEIERIRTTAIARRESDTPPAGLLSLLEGREPRAAEALVRAFSTYFQVVNIAERVHRIRRRRDYQRSGTDTPQPEGLHDALRRLKAQGVTLDELSEWLPRIDVEPVFTAHPTEAVRRALLEKEQLMVASLVDNLDGMRTPNERATDAARFRMALTASWQTADSSPVRPTVEDEREHVGFYLTQVLYRVIPVMYETLEHAIEETYGSTLALPRLLRFGTWVGGDMDGNPNVDAHTIAGTLDAQRRAVLDRYLNELWQLASLLSQSTTLVAVSPALSAQLERYQALLPDAAARSRPRHGDMPYRLLNDLMRARLQATLDDADGAYAAPAELEHDLQLILDSLEVNKGLHAGWFAVRRLLWRVRSFGFHLARLDVRQESSVHARAVADALGQADWDSQDATHRAGLLGPYASGEQALPQVDDEGNARLDAVFAALADARTRHGADALGSYIISMAHNRADVLTVLALARRGGLVDDAGAVPLDIVPLFETVDDLRGGTGTVQDLLADPVYRQHLRARGDTQMVMLGYSDSGKDGGIAASRWGLQRAQVELLEAAAELGVRLTFFHGRGGSIVRGGDKTTRALDAAPRGSVDGRLRVTEQGEVIHRKYGIRALALRSLEQMTGAVLLSSLRPRAPEPREDAWRPVMDLVAERSTVAYRGFVGAPDFMQYFRLATPIDVIERMTLGSRPSRRLGQDAALSNLRAIPWVFAWSQARAVIPGWYGVGSGLQAAVEAGHEDSLREMAQDWPFFRTFLDDIAMVLSKGDLNIAELFSRLAGPLHARFFPRIRDELALTKHWVKTLLGQRSLLQHDPRLALSIRLRNPYIDPISVLQVDLLQRWRATDGEDEELLRALVACVNGVAQGVQNTG

SEQ ID NO: 15428 - protein, 402 aa, Xanthomonas campestris
MSSYLFTSESVSEGHPDKIADQISDAVLDAILAQDKRARVACETMVKTGVAIVAGEVTTSAWIDLEALTRKVILDIGYNSSDVGFDGETCGVLNLIGKQSPDINQGVDRKNPEQQGAGDQGLMFGYATNETDSYMPAAIHLSHRLVEQQAKIRKKKNSALSWLRPDAKSQVTLRYEDGVATAIDAVVLSTQHDPGVKQKDLIEAVREEILKPVLPAKWLHKGTKFHINPTGKFVIGGPVGDCGLTGRKIIVDTYGGWARHGGGAFSGKDPSKVDRSAAYAARYVAKNVVAAGLADRCEVQVSYAIGVAEPTSISVTTFGTGKIADELIEKLIRKHFDLRPFGIIQMLDLIHPMYQQTASYGHFGRKPKDFTYTDGTGAQHSATSFSWEKTDRAEALRAAAKL

SEQ ID NO: 15429 - protein, 728 aa, Xanthomonas campestris
VDVSHLLDHLNPAQREAVSAPPGHYLVLAGAGSGKTRVLIHRIAWLNEVQGVPNHGIFAVTFTNKAAGEMRHRTDLQLRNGSRGMWIGTFHGLAHRLLRLHWQDARLPEGFQVMDSDDQLRLVKRVVQSLELDESKYPPKQMSWWINEQKDEGRRPQHIQPEPNDDWTEVRRQVYAAYQERCDRSGLLDFAELLLRAHELLRDTPALLAHYRARFREILVDEFQDTNAIQYAFVRVLAGESGHVFVVGDDDQAIYGWRGAKVENVQRFLKDFPGAQTVRLEQNYRSSANILGAANAVIAHNPDRIGKQLWTDSGDGDPIDLYAAYNEVDEARYVVERARQWVRDGGSYGEVAVLYRSNAQSRALEEALIAEQLPYRVYGGMRFFERAEIKDALAYLRMLTNRSDDAAFERAVNTPTRGIGDRTLDEVRRLARANALSLWEAAMLCTQENTLAARARNALATFLSLVGQLQAETGEMDLAERIDHVLMRSGLREHWAKESRGGLDSESRTENLDELVSVASRFTRPDDEDSQGMTELVAFLAYASLEAGEGQAQAGEEGVQLMTLHSAKGLEFPIVFLVGLEDGLFPSARSLEESGRLEEERRLAYVGITRARQKLVLCYAESRRIHGQDNYNVPSRFLREIPRDLLHEVRPKVQVSRTASLGAARGGPVHAVVDAAPIKLGANVEHPKFGGGVVVDYEGAGAHARVQVQFDEVGAKWLVMAYANLTVV

SEQ ID NO: 15430 - protein, 298 aa, Xanthomonas campestris
MNEFDRVRDYLTDLQDRICAAVEAIDGKARFAEDLWQRAEGGGGRTRILRDGAVFEQAGIGFSDVSGARLPPSASAHRPELAGATWRACGVSLVFHPHNPHIPTTHANVRYFRAERDGEMVAAWFGGGFDLTPFYPVDEDVMHWHRTAQALCAPFGEERYAAHKRWCDEYFFLRHRNETRGVGGLFFDDLGQDFERDFAYQRAVGDGFLDAYLPIVERRKDTPYGEAERAFQLYRRGRYVEFNLVYDRGTLFGLQSGGRAESILMSLPPQVRWEYGFQPQPGSAEARLADYLIPRDWL

SEQ ID NO: 15431 - protein, 632 aa, Xanthomonas campestris
LTKNLLLWVVVAVVLMVVFQSFSPRMAGGVGPDSITYTQFLKEVDSGRVKSVDYTDETNLAVNAIRFKRTDGSEATVYGPRDDKLVDVLYSKNIEMTRQKPSTGPGFWSLVLNFLPVILIIGFWLFIMRQMQGGGGGAKGAMSFGKSRAKLQGEDQVKVTFADVAGCDEAKEEVGELVDFLRDPTKFTKLGGKIPRGVLMVGPPGTGKTLLAKAIAGEAKVPFFSISGSDFVEMFVGVGASRVRDMFEQAKKHAPCIIFIDEIDAVGRHRGAGLGGGHDEREQTLNQLLVEMDGFEGGEGVIVIAATNRPDVLDPALLRPGRFDRQVVVGLPDVKGREQILRVHMRKLPLADDVVPLVIARGTPGFSGADLANLANEAALFAARGNEKEVRMDHFDRARDKILMGAERRSMAMSEDEKTLTAYHEAGHAIVGRLVPEHDPVYKVTIIPRGRALGVTMYLPEGDRYSMNRVAIESQLCSLYGGRVAEELIFGGDKVTTGASNDIERATKMARNMVTKWGLSDELGPVAYGEEEDEVFLGRSVTQHKNVSDETARKIDEVVRSILDKAYSKTKTILTENLDKLHAMSQLLLQYETIDVPQIDAIMEGRDPPPPAGWGKSDKDGGNNNDKGSPRP

SEQ ID NO: 15432 - protein, 501 aa, Xanthomonas campestris
SAATRVRRALEELGPTFVKLGQVLATRVDLLPPDWIEELSELQNAVPALPFAHIRPQLVAALGMEPEQVFARLDEEPLAAASLAQTHRAWLADGTAVVLKIRRPGIGDTIDADLRLLARLAEIVETRAPDLKRYRPAEVVQQFTLSLRRELDFAAECRNAERIAANFANDPQILIPAVHWEWTCESLNVQDFVDGIPGRDLVAVDAAGLDRKALARTGAGIVLKMVLQDGCFHADPHPGNIFYLRDGRIAVIDFGMVGRISEQRRFQVAQLLHGMVSYDAESVIDVLLEWAGTSLDIDEPRLQQDIGAFVDAYRGVPLKELRIGAMLGDVTAILRDHGLTLPSDLALMIKAFLTLEGMGRQLDPDFDMASEARPYLERVVLQRYAPSAMLRRGRRTVTGAIDLIGDLPRDLKRLIQAARRGKLQLHVETRALREFGEQVDRAANRLTMGIVTAALVIGSSIVMNSVGGIASRWLLALGVSGFIGAALCGVWILFSIWRSRR

SEQ ID NO: 15433 - protein, 311 aa, Xanthomonas campestris
FLSRKSSRILSLSGIITALATPFGPDGALDLDAWRRLLEQQLHGGVQGIVVAGSTGEAAALSDDEYDTLVRAAVAQVAGRVPVLAGTGLSGTAKTIAQTRRAATLGAQYALVVTPPYVRPTQAGLLAHFQAVADNGGLPVLLYNVPGRTGCDLLPETVAALVSHPNIVGIKEARSEPERVAALVAMRSDSFVVLSGDDGSAAQSMLAGADGLVSVASNALPSAYRRLCDLARTGQHEAANAWDTRLSEYHSFCGIESNPIPVKALLQRAGIGHGLRLPLLPLSAAHQPAADRLAANAIALEALSSREMLAA

SEQ ID NO: 15434 - protein, 593 aa, Xanthomonas campestris
MLRTTLAPLVLALSIALPITATAASDDQWPTFATQGTQFVRDGKPYQVLSGAIHFQRIPRTYWKDRLQKARALGLNTVETYVFWNLVEPQQGQFDFNANNDVAAFVREAAAQGLNVILRPGPYACAEWEAGGYPAWLFGKDNIRIRSRDPRFLAASQSYLDAVAQQVRPLLNHNGGPIIAVQVENEYGSYDDDHAYMADNRAMFVKAGFDKALLFTSDGADMLANGTLPGTLAVVNFAPGEAKSAFDKLIKFQPDQPRMVGEYWAGWFDHWGTPHASTNAKQQTEELEWILRQGHSANLYMFIGGTSFGFMNGANFQGNPSDHYAPQTTSYDYDAILDEAGRPTPKFALMRDVITRVTGVQPPALPAPIAMAALKDAPLRESASLWDNLPAPIAIDTPQPMEHFGQDYGYILYRTTVTGPRKESLYLGEVRDVARVYVDQKPVGSVERRLQQVATEVDIPAGQHTLDVLVENSGRINYGPRMADGRAGLVDPVLLDNQQLTNWQAFPLPMRSPDSIRGWTRNTVEGPAFHRGNLRIGTPADTYLDMRAFGKGIAWANGVNLGRHWNIGPQRALYFPAPSSARATTPWWCSIWT

SEQ ID NO: 15435 - protein, 771 aa, Xanthomonas campestris
HRPLLVPAPPRQLPPNTPLPLIPAPAQVTRGSGSFHIGAGTVISIVGGDADARRSAEYLAELLKRTRGLSLEVRNETSASPGSIRLERSAQAPVAQKEGYSLDSDAKGLRIQARDGAGLFYGTVSAWQLMTPDARKGDVEVPAVAIRDWPRFSWRGQHLDVARHFHDVATVKHVLDTMAVHKLNVLHWHLTDDQGWRIEIKRYPKLTEVGAWRTPPGAGQHGTPERYGGFYTQEQISEVVAYAARLHITVLPELDMPGHAQAAVAAYPEEVGVPGVRTQVGVDWGVNPYLFNTSERSLTFITNVLDEVLTLFPSTYIHIGGDEAVKDQWEASPAVRAQMRKLGVKDAHAMQGWFNEQLAQYLTQHGRRMIGWDEILEGGVPASAAVMSWRGIEGAVTAAKQGHDVVLAPGDSLYLDNLQTTRSDEPNGRLTTLPLSKVYAFNPVPAALNAEQARHVLGAQGALWAEYIPSRWHVDHALFPRLAAVAEVTWSPMAARDWKNFLARMPAQLQRYQALGIDYSDGAFAADIDLDGDVNAVLAGGPAKVSLGNQSGAGSLHYTVDGSDPTPDAPRYTAPFAIQLPTTVKATAFTDDGIALAAPRSRTFDRAALLSRDTQGLRHCVEQGALGLRLPLLPDLPGADTPVYNVDLFHACRLYPQARLDGVGAIKVDAARLARNFGLAHEQSKVQKYPAKTPGGELEVRLGCEGELLARIPLPKGNALGEQFTLESALPARTGTHDLCLRFTAPITGPLYAIGAVHLIETTAQAPPAAT

SEQ ID NO: 15436 - protein, 268 aa, Xanthomonas campestris
VAFVGGGNMARSLIAGLLRQGAPASAIRVAEPVAELRQALSADFGVQVFDDARSAVEGAALWVLAVKPQVMSTVCTQLADLAQQQHPLLLSIAAGITATQLERWCGGTAAVVRAMPNTPALLGAGVTGLYANARVSAAQRTQATRLLESAGVTVWLDDEAQMDAVTAVSGSGPAYVFLLAEAMEAAARAQGLPAETARTLVLHTLLGAARMLTESGEAPEVLRRRVTSPNGTTQAAIEEFQAGGFEALTATAIAAATERGRSLSAAND

SEQ ID NO: 15437 - protein, 316 aa, Xanthomonas campestris
AMTTMQLDSDGRLRHLLTLEGLPRATLLQLLDRAGQIRDAAVGRVGKRSVLAGTAVCTLFFEPSTRTRSSFHLAAQRLGADVLNFDASTSSTRKGETARDTLKNLEAMGVRGFVVRHPEDGAVERLAEAAGEGTALINAGDGRSAHPTQGLLDMLTLRQAKGTDFSKLKVVIVGDVKHSRVARSDLHALRTLGAGEIRVCGPASLLPDDDMLDGCVVGEDFDAMLEGADALMMLRLQRERMEEGLVPSLEQYHADYGLTRERLARAGRDAAVLHPGPINRGVEITDEVADGAQSCVLRQVANGVAVRMAVLETLLG

SEQ ID NO: 15438 - protein, 300 aa, Xanthomonas campestris
MISQHVRKKTREYPNRFFDSSVWNDLALRRGDIVIASYAKAGTTWLQQIVAQLIFGGEPNIDVSAISPWVDGVYPDKATKLALLKAQSHRRFMKTHLPADALVTSPLARYLYIGRDGRDMALSLYDHQCAVSQDAQARLHANGGKSGKLRVVSPPGLPRDAYVAHWLEYDGAPFWPLWENVRSWWERREDANVLLLHYADLLDDLPGQIRLIAAFLGITVAQDRWDAIVAHCRFDYMRQHAARYVPQGTGLWREDGKAFFNQGRIGRWREVLPAELNTAYSRRAEAELGRDAAQWLAHGQ

SEQ ID NO: 15439 - protein, 866 aa, Xanthomonas campestris
MSASLSTDRWIVLKFGGTSVSRRHRWDTIGKLASKRANETGGRVLVVVSALSGVTNELTAIADGAADSAQRVAALELRHREFLAELELDADAVLGARLAALHALVGDARAASRTLDWQAEVLGQGELLSSTIGAAYLHANGLDMGWLDAREWLSALPPQPNQSEWSKRLSVSCQWQSDAAWRARFDAQPTRLLITQGFISRHADGGTAILGRGGSDTSAAYFGALLGASRVEIWTDVPGMFSANPKEVPDARLLTRLDYYEAQEIATTGAKVLHPRSIKPCRDSGVPMAILDTERPDLPGTSIDGSAEPVLGVKAISRRNGIVLVSMEGIGMWQQVGFLADVFTLFKKHGLSVDLIGSAETNVTVSLDPSENLVNTDVLAALSADLSQICKVKIIVPCAAITLVGRGMRSLLHKLSDVWATFGQERVHMISQSSNDLNLTFVIDESDADGLLPILHAELIDSGAMPVSEGEVFGPRWRDIIGSVRPRPTPWWHAERAHLLTLSKAGTPRYVYHLPTVRARAQALAQIAAVDQRYYAIKANSHPAILMALEQAGFGLECVSHGELRRVFDTLPELSPRRVLFTPSFAPRSEYEAAFALGVTVTVDNVEALKRWPELFRGRNVWLRIDLGHGDGHHEKVNTGGKASKFGLSSTRVDEFVELARTLEVTITGVHAHLGSGVETGEHWRMMYDELAGFARRIGTVETIDIGGGLPIPYSAEDEPFDLELWAKGLAEVKAVHPGFRLAIEPGRYLVAEAGVLLAQATQVIEKDGVHRVGLDAGMNSLIRPALYDAWHDIENLSQLGAPADGSFDVVGPICESSDVFGKRRRLPAATAPGNVMLIADAGAYGYSMASTYNQRELPREEVIDA

SEQ ID NO: 15440 - protein, 332 aa, Xanthomonas campestris
MTIAQDLPTVLGLPQIQSLAAPDMAAVDALIRRRLASDVVLINQIADHIISAGGKRLRPMLVMLAGHAAGGSGPEHHQLAAIIEFIHTSTLLHDDVVDESDLRRGRSTANALWGNAPSVLVGDFLYSRSFQLMVELDRMEVMQILADTTNRIAEGEVLQLLHVHNPDTDEAAYLRVIERKTAVLFAAGTRLGALASGADAQVQQCLYDYGMQLGFAFQIADDVLDYAADATDLGKNLGDDLAEGKATLPLIHAIAHSDAATQQRLRQIVEQGDAEAMPEVLTAIRATGGLDYSRQRAAEYAAAAEQALDGLPPSPAVAALRGLARYAVERTH

SEQ ID NO: 15441 - protein, 268 aa, Xanthomonas campestris
SSTAASTPFAESMRGQQPQPQDRQFPELLQDLYATANQRREGGAETFAPLANGWSRMDDSALQQAGIDPALLHDAKSGFDAAFYRNDQGQVVFGFCGTDEGKDWKHNIGQGLGFDDAQYASAIQLGSQAKQAFGDQVVISGHSLGGGLASASAMVNDIPAVTYNAAGVNDRTLEREGLDASAAKQYASEELIRGYHVKNEILTHLQEDSIPLKWTMPNAAGHQIELPEPDPLSFGQRLVPGMMLKHRLDLHGMDSVIKAQDMQSPDQA

SEQ ID NO: 15442 - protein, 217 aa, Xanthomonas campestris
  unsure (1)..(217): unsure at all Xaa locations
LISDCDGVLVDSEILADRVMRETLAAFVPAEPLEHLLETTFGQTTREVLRRVEEHFALQLPETLLAQIQARSEALIAAEVQPIAGVRQALEQIPLPLAVASNSRRHNVIASVERAGLTERAAGRIFSADMVERPKPAPDVYLLAARTAGVVPERCLVIEDSPTGATAALAAGMQVLGFTGASHIPQGHGDTLRRIGVLEVFDDMRDLPALFERLAXT

SEQ ID NO: 15443 - protein, 431 aa, Xanthomonas campestris
MEAFWMPFTANRQFKARPRLLASAAGMYYRDVEGRQILDGTAGLWCCNAGHARERIVAAIRAQAGTLDFAPTFQMGSPLPFALAERLAALAPPGLGHVFFTNSGSEAVDSAMKIVLAYHRLRGEGQRTRFIGREKAYHGVGFGGMSIGGLPNNRKWFGPLLAGTDHLRHTLDLQRNAYSRGLPAFGVELADDLERLITLHDASTIAAVFVEPVSGSAGVILPPEGYLQRLRAICDRHGIVLVFDEVITGFGRVGEAFAAQRFGVTPDLITAAKGLTSGTVPMGAVLVADAIHDAFMHGPQAAIELFHGYTYSGHPLACAAALATLDTYAEEQLFTRAITLGPQWEEALYSLRGLPHVIDIRNIGLIGAIELAPREGAPGARGYEVFERCFHEGGLLVRVTGDVIALSPPLIVTPDQIGQMLETLAAILRKV

SEQ ID NO: 15444 - protein, 255 aa, Xanthomonas campestris
IGMTVSIPTTPNTRLQGKRCLITAAGAGIGRESALACARVGAHVIATDIDAAALQALAAESDAITTQLLDVTDAAAITALVAAHGPFDVLFNCAGYVHQGSILDCDEPAWRRSFSINVDAMYYTCKAVLPGMLERGRGSIINMSSVASSIKGVPNRFVYGVTKAAVIGLSKAIAADYVAQGVRCNAICPGTIKTPSLGQRVQALGGDEQAVWKSFTDRQPMGRLGDPREIAQLVVYLASDESSFTTGQTHIIDGG

SEQ ID NO: 15445 - protein, 688 aa, Xanthomonas campestris
LAVATVMALSACKRDPATAPGATATPAAAPQHAPQRAAFDPQELQPTISACQDLNGFVNSKWLAKTTIPPDETEVGSYPTLQDESDAAQREIVEALGRSKPVEGSVEQLVGTFYASGMDEATIQRLGDAPIRPRLAQIEALKTPQDVANFIAARNTQGAGLVFKFGAYPDFQDASKVIAYAEENGMTLPSKAYYTDPRYADIRKAYLDYITQSFVLAGATPEAATVQAKQVLQVETALAAASLSPVEARDPKTQYHLVSVAQADAVTPHFSWKAYLAAQGLSTDQRFSLSQPRFFAGFDHLLKTLPVSQWQAYLRFRAIDDAAFALSKPFVDNRFAFRYKTMDGQQAQRPRWKRVLFATDEAIGEGLGQLYVAKMFTPEAKQRATELIENIRQALKLRIQQADWMTAETKSAALKKWAGFVVKVGYPDHWRSWSGLHFERDAYLRNVETAAAFNYRYELAKVGKPADRTAWFTTPQTVNAFYFSLDNSINFPAAVLRPPFFDVTADDALNYGAIGAVMGHEATHGFDDQGSKFNAVGTNVNWWAPADLAAFTARASKLVTQFNAYTPLPNKPDVHVNGELTLGENIADLGGINIAFDALQANLQRHPERGADIDGFTPQQRFFLGWARLWRGTMREEKQLSLLSSDGHAPYAVRTNASPSNMPQFATAFGCKPGDAMVRSEQDRVVIW

SEQ ID NO: 15446 - protein, 469 aa, Xanthomonas campestris
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVNLPHALIAGPHAGGIVNLPAVVITFLVAGMLMAGTKESATLNAVLVVLKIIALGVFVAIALPAFNSANLQPFMPYGFSKAMGPDGVERGVMAAAAIIFFAFYGFDAISTAAEETKNPGRDLSIGIVGSMIGCTLIYVLVALSAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPTRARAFRTPLAWVVGPVAILGCLYLFWSLPSTTQGWFLVWNALGVVVYLAYGRRNSRLGK

SEQ ID NO: 15447 - protein, 376 aa, Xanthomonas campestris
LARASALQKRLVTLDSHLDTPANLERGDFDVMQGHAGNRLSQVDYPRMLEGALDGGFWAVYTGQGNRSAAAHLDDRDAGLQRLMKIHNLLAAQPQRFALATTPADAARIKAAGKRVVYISMENASPLVADPSLLRFYYAQGLRLMSTVHFLNNEFADSATDPKGAEWKGLSPAGKQLVQQALGIVIDQSHASDAVFDQLIALSPVPIVLSHSGARAVYNHPRNIDDARLKVLAAHGGVIQVNSYGGYLIDSGASPERKAAEKALADQYGGWEHLKMSDGTALSEALKALDARYPVKRATEEDFFAHLEHVLAVAGPAHVGIGMDWDGGGGVVGLEDVSDLPRITAWLLRKGYSEPQIAGIWGGNLLRVMEQAQAYA

SEQ ID NO: 15448 - protein, 451 aa, Xanthomonas campestris
IAARIDRLPASATLWRLVGLLALGGFFELYDLFQTAYISPGLIRDGIFASGNDGAFGMSDQAAFAAATFLGLFVGAALLSPFADRFGRRLVFTVALVWYTAATVAMGLQSTATAVIVLRFVVGIGLGIELVTIDTYLSELVPRHMRGAAFAFAFFLQFLAVPSVALSAWLLVPHAPLGVSGWRWVVLLSGVFALAIWWLRSRLPESARWLAAQGRHAEAEAVMAQLEAACSRDLGRALPPPEPVQRVAAPDSRLSALWRQPYRGRIGMLVVFQIFQAIGFFGFGNWLPALINAQGAGVTKSLAYAFAISLAYPLAPLLLLRVAHRWENKWQISASALGAVVFGVLFALQHAPLGMIACGAMIAFCNAWMSFAYHGYQAELFPTALRARAVGFCYSFSRLSTAGSSVLIGWLLAQTGSHGVLAFIVISMTIVASVIAAFGPRTRNRALEDIA

SEQ ID NO: 15449 - protein, 291 aa, Xanthomonas campestris
VSAALFERWVARTERQLDACLPSPALAPQRLHAAMRHAVLGGGKRMRPLLVYASGALFGAEEGSLDAPAVAVELIHAYSLVHDDLPAMDDDALRRGHPTVHIAFDEATAILAGDALQARAFELLAEAPADAALRVGWLQSLASAAGAAGMCGGQALDIDATGQVQALEALQRMHALKTGALIRAAVRMGVLTGGAGIADQQRLDAFADALGLAFQVRDDILDVESSSAQLGKTAGKDAAQSKSTYPALLGMDGAKTKLAELASHMHALLLPYGESGATLASLGRFAVDRAH

SEQ ID NO: 15450 - protein, 434 aa, Xanthomonas campestris
MTLVSAWLRIPFWQRVVAGFVLGAIAGAAMGPAAEVWFGPLGDLYVTLIKMIAVPLVFFAVINAISSLHGQKSVAALGGRTFLWFVITAALAVGVGLAVGTIMQPGAGHFSLSVDSAWKPRDVPSPIKVLLDVVPSNPFYALTGIGTKTNAAGETVLAAGRGSILPVIFFAALLGFAMVKLGDRVAEARKLTGQMSDIMIQVTRFVLEMTPLGTFGLIAGLVGSYGFAKLLPFGNFVLALYVACALHIVVVYSSLLLLHGLNPWKFFRGAAPGMQVAFVSSSSFAAMPVAMRSITHNLGVNKDYAAFAVPLGASIKMDGCGAIFPALCAVFIAQYTGVPLTANQYFVVLIASVLGSFGTAGVPGTAVVMATVVLSAANLPLEVIGYLYAIDRILDMMRTMTNVTGQMLVPVLVAKETGLLDKTIYESASTNVGL

SEQ ID NO: 15451 - protein, 627 aa, Xanthomonas campestris
CTDFYDYANAGWLKSNPVPQAGAVTALGQLSDRALQQQRELLDAAMNSPQGNVQKLLGDFWASGLDEAAVEKDGSNPIAPLLSRIDAIKKAKDVPASIAALHQVGIPVGFNFGPDVDLKALDRHIGYFMQGGMGMPDPAFYTRTDADTQALMGRYRAYVKQILALTGTPADKLDADAASVLQIETALARSAQSVQGINNPFNNYAPIATKELTKQYKNLRLGDFLEAQGVKDDLVSMADPAMFKQLDSMIVSIKPEQWKAYLRWRVGDAMAPYLSKSFHDAEYQFRGRLLRGDALPPQRWQQVLDAINVAAGPMLGREYVSRYLSSDTRRQAEAIADQIRDAQLAALERTGWGNGEVIAEAKAKLSAMKIEVGAPRRDLDYTVQPMGRGSFGGNMLIASTWRHREEMKRIGKGNADRRWDVLPQQPALAYDIAQNRLIITAAVLQPPVLSTGATPAAQYGAYGALVAHEMTRAIDAKGALVDAKGELRSWWTPAEKSSWTLLTGKVANQYGAYAYPGVPNAKVNGAQTAEENLADLAGVELAWQAFSKAQPAATQADKQAFFTAWAGLWAQQLSPNEAVQRASADIRAPGQWRTNGPLSNLPEFGATFSCKPGQPMQRVDADQLKIW

SEQ ID NO: 15452 - protein, 693 aa, Xanthomonas campestris
LALALLVALPGCKRTSDAESAPASAAIAAPAAPPTTAANTPAFDISELGPAASACQNLDEFVNGAWAKANPIPADHTSWGIDELLTEKSLLIQRELLEAAAKQAGTQAPSLEQKIGALYASGMDEAAIEAAGAKPIQPQLDKIAALHSGKDVAAYIISRHGEGDAQVFAFGAGADFHNADQQIAFTQEGGLGLPTKDYYTGAEHAPIRAAYLAYIAKSFELTGTPAALAKTQANDVLALETRLAAASLAPVDAREPKNQYRLVTLAEADKLTPHFPWEDFFATQGVPVGSGFSLAQPRFFAAFDQALASAPIAQWQAYLRFHAIDDASTRLSKAFADNRFAFYGKTLSGQPEQLPRWKRVLRSVNGAMGEGVGQLYVAKVFTPDAKQRASELVDNVRAALKTRIEQVDWMSAETKAKALAKWQTFLPKIGYPDTWRDWSGLQITPGDYYGNLQAADTFNYRYDIAQIGKPTDRGRWSMTPQTVNAYYDPMTNSINFPAAILQPPYFDATADDALNYGGIGAVIGHEATHGFDDQGSQFDGAGNNVNWWTAEDRRKFDQRSNQLVKQFDAYAPLPSHPTLHVNGKLTLGENIADLGGTNVAYDALQTALQQHPERAKAIDGYSPDQRFFLAFARSWRQRVRDQQQMVYLASDPHAPAKLRAIASPSNMPQFATAFACKPGDAMVRPEKDRVVIW

SEQ ID NO: 15453 - protein, 699 aa, Xanthomonas campestris
LTLSLAVAAALSGCKKPEDAAPATAPDAAASAAAAPKTLTLDQSKLPAVNQFTAADLDPNGNACTDLNAYANAKFLAANPVPGDRTSWGAFEMLDERSNAIQQQLAEQAAADTGATGVEKIVGDLWSTGMDEAKINAQGIEPLKPELAAIDAISDQAKLVDYLRSSAAKGNNELFSFGAEADFKKSSQNIAYAMQGGLGLPDPEYYTSAGNKAKLDAYQAHVAKVLELSGVAAADATAQAKQVVAFETRLAKVSKTSTQMSRDASLAYNPISPADADKLTPNWSWTEFFKSQGVATPEMFSLAIPAFHQEVSKMIADTDPAIWRAYLRFHTVDGASPYLSQPFVDESFAFYNKTMRGQKEIKPRWKRVLATINSQAGETLGQMYVKVAFPGDSKAKMETLVTNLRTALKARIEKLDWMSPETKAKAIAKWESFTPKIGYPEKWREWNGLSTSRDSYLGNVMAASEFNYKWNLSKIGKPVDKTEWGMSPQTVNAYYNPLQNEIVFPAAILQPPFFDPNAPEEMNYGGIGAVIGHEMTHGYDDQGSRFGADGNFIADPGWWTQKDLDAFKARTGKLVAQFDSYRTPAGDKVKGDLTLGENIADLGGLNTAYDAMKTATAGKDDPKSDGITRDQRFFLNWATVWRRNFTPEELVVRLKTDPHAPANFRAIGAPSNMPAFAAAFSCKAGDAMVRQGDQQVVIW

SEQ ID NO: 15454 - protein, 291 aa, Xanthomonas campestris
MSVLINKNTKVIVQGFTGQQGTFHATQMIEYGTQVVGGVTPGKGSTTHIDLPVFNTVADAVQSTGADASVIYVPPPYAADAILEAAAAGIKVIVCITEGIPVLDMLRVKNVLTRSHPDTVLIGPNCPGVITPGECKIGIMPGHIHKPGKIGIVSRSGTLTYEAVKQTTEVGLGQSTCIGIGGDPINGLNFVDCLKLFNEDPQTEGIIMVGEIGGDAEEAGAEYIKQFVKKPVVGFIAGASAPAGKRMGHAGAIASGGKGTAEGKFAAMEAAGVKTVRSPGDLGAAIAALVK

SEQ ID NO: 15455 - protein, 376 aa, Xanthomonas campestris
  unsure (1)..(376): unsure at all Xaa locations
QLLAEYGIPVPAGKVASTPDEAVEVANSLGKGPWMVKAQIHAGGRGKAGGVKFCKTTDDVKAAADKMLGTKMSTYQTAGVELPVNLVLVTTAGEIVKELYLSILVDRGTKTITYIASSEGGVEIEQVAAETPXLIHSLNVDFVEGVQGYHGRDFGFKLGLNAKQAGQFASIMVNLYRLFNDKDLALVEINPLAILDDGNLYALDGKFDSDDNAAFRQKALVAMRDKTQEDETEVTASELDINYVTMDGNIGCMVNGAGLAMATMDVIKLNGGEPANFLDVGGGANKQRVIEAFKLILSSDKVEGIFVNIFGGIVRCDMIAEGIIAAVKEVGVKVPVVVRLEGTNVEEGKQLLRDSGMAIIPADNINDGAKKVVEAV

SEQ ID NO: 15456 - protein, 694 aa, Xanthomonas campestris
PSRIRQGRPFPRGAIFDGKGTNFALFSAHATRVELCLFDEQGNESRVDLPEYTNEIWHGYLPDVKPGQRYGYRVHGPYAPTEGHRFNHNKLLLDPYARELDGDLVWADELYGYTVGHPDGDLSFDERDSAPFMPKCVVVEDTYDWEDDARLLKPWNETVIYETHVRGYTMRNAQVPEAVRGTFAGLAQPSVLQYIKDLGITAVELLPVHAYLDDQHLLDKGLRNYWGYNTISFFALKSRHLSSGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGETDNADILQLRERQMKNLLATLLLSQGTPMMLAGDERAQSQGGNNNTYCQDNEITWLDWENDPTDGRLTDFVKSLTALRKRYPILSRGRFLNGQYNEEAGLRDLTWLNPGGTEMDDAHWTDAGARSVGLLLEGKAQTSGVKERGNDATLLIVINAYHEGVTFTLPSSDEPVHWKLALSTDEALEVDSMPAGASEFLAPPRSITVFE

SEQ ID NO: 15457 - protein, 704 aa, Xanthomonas campestris
IRQTESSECGLACIAMLLSYYGHETSLGELRNRFTVSTSGATLASLIEIADANGLTTRPLRLELYELPKLSLPCMVHLHHGHFVVLTAVRGGHVHISDPATGVKKIKLDEFDELFSGIALEAHPGPAFKKIKSVPSVSLRDLAGSLRSLVPAFWGVGILALFLEGCALIAPQYLRLTMDQVLSVKDDGLVTTLAIGFSIVLLVQLVLTVARKWTLLWISSTTGLRWSSNLFRHLVSLPQSYFVKRHTGDISSRFQSIYSIQQSLTTKMMEAVIDGVMSFLMLLLLMSYDAPLAFALLAFTIAYVGSRYAYYAKLKEANLDQINIDARRQSLLYETVRSIQPIKLFNKSALWASRFTNYSAKATNATIGAERIRIGFDSVQLLIQGLCRIFVIWEGTRLVLSGDMTIGVLTVFLIYATQFSQRSINLADYLMQLRLLRLHTERISDITHSEPESFLHGNGALEDAAPAIAIANGYFRYSSTDKWIMSALQLRAPAGQVIAIVGNSGVGKTTLIRVLAGLEDLQVGDFLVNGEDLRKVGKSSYRSKVSIVMQGDNLLSGTLSENISMFDEHIDQERLVQAAKLACIHDDIQRMPMGFNTRVGDLGNTLSGGQKQRIFLARAFYRRTKLLLMDEPTTGVDEQMGIQLMKNIKSIGATTVVVTHDKNISRMCDMHYLFVNGNLRPLIKEQPSSFEQDNAVETAGKSSQ

SEQ ID NO: 15458 - protein, 253 aa, Xanthomonas campestris
MTASESPVVQLSGVRIDRGGRAILRDVSLDVPRGSITAVLGPSGSGKSTLLAALTGELRPVAGRVTLFGQEIPRGSRALLEMRRNVGVLLQGNGLLTDLSVADNVALPLRTHTRLPAPVLQRLVQMKLHAVGLLAAADAWPRELSGGMARRVALARALALDPPLMIYDEPLTGLDPIASGVIMSLIQRLNDSLDLTSIIVSHHVHETLPICDQAVVIANGGIVFAGTPEQLQDSTDPLVQQFLHGQPDGPIPF

SEQ ID NO: 15459 - protein, 495 aa, Xanthomonas campestris
QSIFKPRYDNFIGGAWVAPQGGQYFDNTTPITGKVFTSIARSTAPDIEAALDAAHAAKEAWGKTSTTDRSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMEVIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDTFMEKALKRVAAIKQGNPLDPNTMVGAQASSEQLEKILSYIDIGKQEGAEILIGGERNMLDGELSDGFYVKPTVFKGHNKMRVFQEEIFGPVVSVTTFKDEADALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 15460 - protein, 398 aa, Xanthomonas campestris
FFANVEQVPGDPILGLTEAYNADSRPNKVNLGVGIYYDENGRIPLLRAVQKIEQQLALDAKPRGYLPIDGLAAYDKATQELLFGAESALVASGRVATSQTVGGSGALRVGADLLKKLLPTSTIAISNPSWENHRAVFGAAGFEVVDYTYFDAASHGLNFDGMLADLAKLEPGTVVLLHACCHNPTGADLSREQWKQLAGLLKERNLFPFVDIAYQGFDKGIEADAYAVRLLAAEGIDTYVVASSYSKSFSLYGERVGALSVVSATAAEAKAVQSQVKRIIRTIYSSPSTHGAALVAGVLTSPELRDVWEQELTEMRERIHALRAGLVAKLAALGAPEFEFIQRQAGMFSYSGLTKSQVDRLRDEFAIYAVGTGRICVAALSQRNLDYVAQAVATVSRG

SEQ ID NO: 15461 - protein, 332 aa, Xanthomonas campestris
MSRPSLTRFLIEEQHAGRIDPELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQADMRVPEDTAEFAINMSNQRHWEPAMQAYVGDLLAGKDGARGKDFNMRWIASMVADVHRILTRGGIFIYPWDKKDAAKPGKLRLMYEANPMGMLVEQAGGAATTGRERILDIQPTQLHQRVPVFLGSKNEVAEATRYHVE

SEQ ID NO: 15462 - protein, 430 aa, Xanthomonas campestris
LKPRQLMMMGLGTAIGAGLFLGSGVGIHAAGPAVLVSYLIAGALVIIVMNALGEMAAAKPASGAFSVYAADAMGPTAGATVGWLWWLQIVVVIAAEAVGAASLLATVWPALPVPMLASVFMATFTVINLLGVRNFGEFEFWFAILKVVAILIFLMIGGALLAGLLPGVASPGLSNFTQHGGFAPKGLAGIGTALLVVVFAFGGTEIVAVAAAETADPGRSLARTIRTVAWRILVFYIGSISVIVAVVPWTSDALSSPFAAVLEVARIPGAATGITLVAVVALLSALNANLYGASRMIFSLAQRGEAPRWLGNTSRQQVPLVAVIASVLFGFAAAVLELLYPGKVLPMLLNIVGATCLLVWTISLLSQLILRARADRAGIALPFRMRGYPVLTLLALAILAVIFVLLALSADTRAQFLSMVGLTAGIALVS

SEQ ID NO: 15463 - protein, 559 aa, Xanthomonas campestris
MSLRLRGHAASRGNALGRARVRQSHTPEVAEQRVPANQVETQLQRLHAAIAAARTEMQQLRDRLHGALAREVGEFLELHALLLDDPELLQGLDDLIRTHRYSADYALRVQRDRLAAVFDGMEDAYLRSRMDDLDHVIGRIHAFLHKRAPDLKGVAGEILVCDNVAPSELAQLQAQGVVGIVTTAGSALSHSAILARSLHLPLVVGVADAVQRVNDGDVLIVDAGSGQVIVDPTPEHLRDYRERLRTLAKEQRELGRLRSKPTRTRDNVDITLLANAESLEDVAKAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILLVRKQLKKLTAQLRDEGHEIAEHIPLGAMIEVPAAALALDCFIDDIDFLSIGTNDLVQYLLAVDRNNEALGELYSPLHPAVLRLIAQVIATGRAHNKPVAVCGEIAGDPRFVAMLLALGLTEFSLHPATLLEVRRAVRDLHLGQLRVHGEKLLRARD

SEQ ID NO: 15464 - protein, 423 aa, Xanthomonas campestris
MAKIVVTGGQALHGEVHISGAKNAVLPILCATLLADAPVEISNVPHLHDVITTVKLLSELGAEVTIDEGTLAKGRSILVDPRSVTHQIAPYELVKTMRASILVLGPLLARYGTAEVSLPGGCAIGSRPVDQHIKGLQALGADISVENGYIKATSNGRLKGGRYVFDMVSVTGTENVLMAAVLAEGTTVLENAAMEPEVTDLADCLIALGAQIEGAGTPRITVQGVERLGGGHHAVLPDRIETGTFLVAAAMTGGSVTVRRARPDTLDAVLDKLTEAGATITTTADSVTLDMHGKRPRAVNLTTAPYPAFPTDMQAQFMALNCVADGVGVINETIFENRFMHVNELLRLGADIQVEGHTAIVRGAERLSGAPVMATDLRASASLILAGLVADGDTTIDRIYHLDRGYENIEEKLGALGATIRRI

SEQ ID NO: 15465 - protein, 275 aa, Xanthomonas campestris
SATLAAALQHPQLRLLDARAAPPTAPDPGAAQRDYAQGHLPGAHFANLHDALADVSRPGQGRHPLPHSDVFAAQLGRWGITPDSQVVVYDAADGSMAAARAWWMLRLMGHRRVAVLDGGLAAWRAAGLPETTAVPSPADSGAYPGSFDADAVVDAEAILARLDAAPGWLLDARAGERFRGEVEPIDPVAGHVPGAVSRPLGMSLRDGRFKPAAELRAELGALLCDYAPEQAVVMCGSGVTACHLLLALEVAGLSGARVYAGSWSGWLQDRSRPVA

SEQ ID NO: 15466 - protein, 452 aa, Xanthomonas campestris
MLDKVVIANRGEIALRILRACHTLGIRTVAVHSTVDRNLKHVAMADESVCIGPAASSDSYLNIPALIAAAEVTDAQAIHPGYGFLSENADFAERVEESGFIFIGPKADTIRLMGDKVEAIRAMKAAGVPCVPGSGGPLGDDIVANTKIAREIGYPVIIKAAGGGGGRGMRVVHSEAALKAAIETTKSEAKAAFSNDQVYMEKFLENPRHVEIQVLADGQGNAIHLGERDCSMQRRHQKVVEEAPAPGISEELRAEIGKVCVDACIRIGYRGAGTFEFLFEGGRFYFIEMNTRIQVEHPVTERITGIDLVCEQLRIAAGHKLSIKQSDIVLRGHAIECRINAEDPETFMPNPGLITAFHPPGGPGVRVDTHIYAGYKVPPNYDSMIGKLIVHGPDRETAIARMRVALSEMVVDGIKTNIPLQQRIMRDKGFQAGGQNIHYLEKRLAERKNKSI

SEQ ID NO: 15467 - protein, 147 aa, Xanthomonas campestris
MAHLLLLHGPNLNLLGTREPEVYGRTTLAQIDAALVDRAQAAGHTLDCLQSNAEHVLVERIHAAREDGTAFILINPAAFTHTSVSLRDALLGVGLPFVEIHLSNPHTREPFRHHSYLSDKAAGVICGFGADSYRLALEAVIARLERD

SEQ ID NO: 15468 - protein, 544 aa, Xanthomonas campestris
MAAKDIRFGEDARTRMVRGVNVLANAVKATLGPKGRNVVLEKSFGAPTITKDGVSVAKEIELADKFENMGAQMVKEVASRTNDNAGDGTTTATVLAQALIREGAKAVAAGMNPMDLKRGIDQAVKAAVIELKNISKPTTDDKAIAQVGTISANSDESIGNIIAEAMQKVGKEGVITVEEGSGLENELDVVEGMQFDRGYLSPYFINNQQSQSADLDDPFILLHDKKISNVRDLLPVLEGVAKAGKPLLIVAEEVEGEALATLVVNTIRGIVKVVAVKAPGFGDRRKAMLEDMAVLTGGTVISEEVGLALEKATIKDLGRAKKVQVSKENTTIIDGAGDSATIEARVGQIKTQIEDTSSDYDREKLQERVAKLAGGVAVIKVGASTEIEMKEKKARVEDALHATRAAVEEGVVPGGGVALVRALVAVGNLTGANEDQTHGIQIALRAMEAPLREIVANAGEEPSVILNKVKEGTGNYGYNAANGEFGDMVEFGILDPTKVTRSALQNAASIAGLMITTEAMVADAPKKDEPAMPAGGGMGGMGGM

SEQ ID NO: 15469 - protein, 585 aa, Xanthomonas campestris
MAEIKEALVPDIGDYSDVPVIEVLVSVGDTVSKDQSLVTLESDKATMEVPSSVAGVVKEIKVKVGDSLSQGALVALIEVADADAGAETAAAPAPAAAPAKAAPAAAPAPAAKAAPAAASDGGQVEARVPDIGDYSGVPVIEVLVAVGDTVAKDQSLVTLESDKATMEVPSSVAGVIKELKVKVGDSLSQGDLVAIIAASDGGAGAAQSPAKPTTDTAETAGKVEPVAVPAEPDKLAQREIAQVQSARSTAASQPAQAAPGTPSSPPVTFDADSVLPSKVPYASPVVRVFARELGVDLNQIKGSEKGGRITREDVQRFVKAALSGGAPAAAGAAPAGGGNGLNLLAWPKVDFSKFGETETQPLSRIKKISGANLARNWAMIPHVTQFESADITDLEALRVALNKENEKAGIKLTMLAFLIKASAAALKKFPEFNASLDAAGENLTLKKYINIGFAADTPNGLVVPVIRDVDKKGVLQIAQESGELAKKARDGKLGPADMSGGCFSISSLGGIGGTAFTPIINAPEVAILGVSKSAMQPVWNGKDFAPKLMLPLSLSYDHRVIDGALAARFTTYLSQVLADMRRVLL

SEQ ID NO: 15470 - protein, 254 aa, Xanthomonas campestris
LQDRVVIITGGAQGIGRGIAQAVLGAGGSVVIGDLDADAGKACLQDWALPRRSAFVRADAAREPHAARLVATALKRFGRLDGLVNNAGVPDPHIAALAQLEWQEWQRRLSSLHGAFLCSKHALPALAKAADGGAIVNIASTRAWQSEPHSEAYAAAKGGLVAMTHALALSEGPQVRVNSISPGWISTDAWRAPARRRAPKLSRRDHAQHPVGRVGTPEDIAQLAVYLLAPQLSGFVTGQDFIVDGGMSRKMQYV

SEQ ID NO: 15471 - protein, 222 aa, Xanthomonas campestris
MTAATPLPFWPQAVIFDMDGLMLDSERAITACLSQAADEHGLQIEPAFWLRMVGTGDAACRRLLGERIGTTAMEHVLARCQGLYDAAVSAGIAHRPGIIALLEFLIAHGMPRAVATSTQRPLALRKLAASDLLWRFDAVCTASDVAHPKPAPDIYLLAARTLGVDPAQCLVLEDSPTGVRAALAAGMTPIQVPDLLAPDAEVRALGHRIVASLMDAQTLLEA

SEQ ID NO: 15472 - protein, 453 aa, Xanthomonas campestris
LQQAVPALRLKTGPADLEHYGRDWTRRWTPNPLAIALPGSVEEVQAVVRWANTHAVAVVPSGGRTGLSGGAVAANGELVLSLERLNKPLAFDAVDRTLTVQAGMPLEAVHNAAREHGLVYPVDFAARGSCSIGGNIATNAGGIRVIRYGNTREWVAGLSVVTGTGELLHLNNALVKNSSGYDFRHLMIGSEGTLGIVVEATLRLTDLPPPSNVMLLALPSFDVLMQVFAAFRAQLRLEAFEFFTDRALEHVLAHGAQAPFAQVHPYYVVTEFAAGDEAQEAAAMAAFEACMEQGWVSDGVISQSDAQAAQLWRLREGITEALARYTPYKNDVSVRISAMPAFLAETQALLHDAYPHFDVVWFGHIGDGNLHINVLKPDATSQADFITACEQVTKLLAQSLQRFDGSISAEHGIGLVKKPYLWSTRSAAEIALMRGIKQVLDPHLLLNPGKLFD

SEQ ID NO: 15473 - protein, 235 aa, Xanthomonas campestris
SPVKVLIHGASGRMGKALLRLAAEDDALHVVGAVVGRSPSQRVVDGVPYFAANELGGAPAFDVAIDFSLPQGFAPILALCVQRGKPLVSGTTGLDEAQRAGLLQAAGQIPLVWASNFSLGVAVLTELVERAAGSLPGWDCDIIEAHHVHKQDAPSGTALTLGEAATGSGAQPRFASVRAGDIVGEHSVQFTGLGERVELIHRATNRDIFARGALHAAKRLLGKPPGSYRVRDLVL

SEQ ID NO: 15474 - protein, 382 aa, Xanthomonas campestris
IGVPGSQSETPVTQPAILVLEDGTVFEGESVGANGLSVGEVVFNTAMTGYQEVLTDPSYARQMVTLTYPHIGNTGFNDQDDEAKQVWAAGLIVRDVPRRPSSWRNQVALPDWLQTRGVVAISGIDTRKLTRLLREKGAQNGALMAGEIDVEKALEAARKFPGLKGMDLAKVVSTETTYQWQEGQLDLNANAFLQAELKFKVVAYDYGVKINILRMLAERGCEVTVVPAQTPVAEVLALQPDGVFLSNGPGDPEPCDYAITAIQELIAKKVPTFGICLGHQLLALAAGAKTVKMATGHHGANHPVQDLEGGRVMITSQNHGFAVDETTLPANVRVTHRSLFDGTNQGIALTDAPAFSFQGHPEASPGPRDVGPLFDRFVASMA

SEQ ID NO: 15475 - protein, 1079 aa, Xanthomonas campestris
MPKRTDLKTILIIGAGPIVIGQACEFDYSGAQACKALRDEGYRVVLVNSNPATIMTDPNMADAVYIEPINWQTVEKIIAKEKPDALLPTMGGQTALNCALDLADHGVLEKYNVELIGAKREAIRMAEDRELFRVAMGEIGLDCPRAEVAHTLEEALDIQTRVGYPTIIRPSFTLGGSGGGIAYNREELIDIVGRGLELSPTTEVLVEESVLGWKEFEMEVVRDTADNCIIVCAIENLDPMGVHTGDSITVAPAQTLTDKEYQRLRDASIAVLRKIGVDTGGSNVQFGISPTTGRVVVIEMNPRVSRSSALASKATGFPIAKVAAKLAVGYTLDELKNEITGGLTPASFEPSIDYVVTKIPRFAFEKFPQADARLTTQMKSVGEVMAMGRTFQESLQKALRGLETGKIGLDPTGLDLGSEDDMAALKRELKAPGPERLFYVGDAFRAGMSVADVYALSFIDPWFLDQIEELISLEQQLADDGMAALDAPRLRLLKRAGFSDARLGELIGTNEEAVRTLRRALKVRPVYKRVDSCAAEFATSTAYLYSTYEDECEALPSNRDKIMILGGGPNRIGQGIEFDYCCVHAALALRDDGFETIMVNCNPETVSTDYDTSDRLYFEPLTLEDVLEIVELEQPKGVIVQYGGQTPLKLARALEANGVPVIGTSPDSIDLAEDRERFQQLVDKLGLKQPPNRIARNADEALVLAREIGYPLVVRPSYVLGGRAMEIVYGESDLARYVRDAVKVSNDSPVLLDRFLDNAVEVDVDIIADKDGNVLIGGVMEHIEEAGVHSGDSSCSLPPYSLSAETQAELRRQVVMLAEGLNVVGLMNTQFAVQVNDAGDDIVYLLEVNPRASRTVPFVSKATGMPLAKIAARCMAGKTLAEQGATKEIVPDYYSVKEAIFPFAKFQGVDPILGPEMRSTGEVMGVGRSFGAAFARAQEAGGIKAPPLGKAFVSVRDPDKQRVLPVAQALVERGFTLVATRGTGAWLQQHGLSCEIVNKVAEGRPHIVDSIKNGEIVYIVNTTEGRAAISDSFSIRREALQHRVTYSTTVAGAKALVHSLEFRGTGPVWSLQELHKELE

SEQ ID NO: 15476 - protein, 677 aa, Xanthomonas campestris
MATWLILVGELLVSLGLMVAILLRPQVSHTRRLIGMLLDYTCTGAIMAIQGEPASPLYAVCMWVTIGNGLRYGSNYLRAATAMGSLCFLGAILISPYWKANPYLSWGLLLGLIAVPLYFDSLLRAMTRAVREARHANQAKSRFLANMSHEFRTPLNGLSGMTEVLATTRLDAEQKECLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVVAAKLLDTLADLAVSTRQLATPATTVQVATSFEGVLDSSVLDELAALGMGEEFERQFVRQCLDDAQNCVGDIERDGTCSDWEQLRESAHALRGVASNLGLAQVASSGGELMRMADWQLQAEWRLRLSTLREQLKAGKDALDARVQGVKDGECSPRSNE

SEQ ID NO: 15477 - protein, 556 aa, Xanthomonas campestris
RPWLQSYPAGVAAEIDLEQFRTVAEVFATSVARFADRPAYHSFGKTITYREADQLVDQFAAYLLGELQLKKGDRVALMMPNCLQYPIATFGILRAGLTVVNVNPLYTPRELKHQLIDSGASVLVVIDNFGTTVQQVIADTQVKQVITTGLGDMLGFPKAALVNFVVKYVKKLVPEYRINGAIRFRDALALGRKHRVPTLQIEPDDIAFLQYTGGTTGVAKGAMLTHRNLVANMQQAHQWLAGTGKLEEGHEVVITALPLYHIFALTANGLVFMKIGGCNHLISNPRDMPGFIKELKKTRFTAFTGVNTLFNGLLNTPGFDQIDFSSLKMTLGGGMAVQRSVAERWKQVTGLTLVEAYGLTETSPAACINPMDLVDYNGSIGLPIPSTDACIKDDDGKVLALGEIGELCIKGPQVMKGYWKKADETAKVMDAEGWLHTGDIARMDERGFVYIVDRKKDMILVSGFNVYPNEIEDVIATMPGVLEVAAVGVPDEKSGEIVKVVIVKKDQALTAEDVKAHCRTNLTGYKQPRVIEFRKELPKTNVGKILRRELRDAAKA

SEQ ID NO: 15478 - protein, 914 aa, Xanthomonas campestris
DSFSTRTSLEVNGQRYDYYSLPKLGERFDVARLPYSMKILLENLLRHEDGGVTVGKDHIEAVAKWDPAAEPDIEIAFMPARVVLQDFTGVPCVVDLAAMRDAVVKLGGNADQINPQIPSELVIDHSVQVDVFGKPEALDLNGKIEFQRNQERYGFLRWGQKAFDNFKVVPPNTGIVHQVNLENLARVVMSADKDGTQIAYPDTVFGTDSHTTMINGIGVLGWGVGGIEAEAAMLGQPSSMLIPQVVGFKLTGKLPEGATATDLVLTVTQMLRKHGVVGKFVEFYGEGLQHLPLADRATIGNMAPEYGATCGIFPVDNESLTYLRLSGRSEEQIALVETYAKAQGLWHDADTPHAQYSATLELDMGDVKPSLAGPKRPQDRVLLEDMQSNYRESLKPFAEARSKRLADTKQEDRLKNEGGGGTAVGAKASQAESAGDSGAGWQLRDGSVVIAAITSCTNTSNPAVMLGAGLLARNAAAKGLKAQPWIKTSLGPGSRVVTDYLTKAGVLADLEKLGFYVVGYGCTTCIGNSGPLPEDVSAAIAKDDLVVTSVLSGNRNFEGRVHPEVKMNYLASPPLVVAYAIAGTTDIDLTRDPLGTGSDGQPVYLRDIWPSNKEIGDTIAATVGPEMFKQNYADVFKGDTRWNTIASPDGALYEWDAASTYIKNPPYFEGMTMQVGHVDDVHGARIMGLFGDSITTDHISPAGNIKKDSPAGRFLQERGVQPADFNSYGSRRGNDDVMVRGTFANIRIKNLMFGGEEGGNTLYFGKDGAAPEKLAIYDAAMKYKADGVPLVVLAGKEYGTGSSRDWAAKGTNLLGVKAVVAESFERIHRSNLVGMGVLPLQFLEGENAQTLGLDGSEVLDITGLQDGASRRATIDAKKSDGSVKQFQVKVLLLTPKEVEYFKHGGLLQYVLRQL

SEQ ID NO: 15479 - protein, 711 aa, Xanthomonas campestris
  unsure (1)..(711): unsure at all Xaa locations
AKTLYDKLWEMHEVTRRDDGSSLIYIDRHILHEVTSPQAFEGLRLAGRKPWRIDANIATPDHNVPTTRAERQGGLESISDEVSRLQVQTLDENCDDFGILEFKMNDTRQGIVHVVGPEQGATLPGMTVVCGDSHTSTHGAFGALAHGIGTSEVEHVLATQCLIAKKMKNMQVRVEGTLPFGVTAKDIVLAVIGKIGTAGGNGHALEFAGSAIRALSMEGRMTICNMSIEAGARVGMVAVDEKTIAYVKGRPFAPKGADWDAAVALWRTLVSDADASFDTVVELRAEDIKPQVSWGTSPEMVVAIDQQVPDPAAEQDPTKRDSIQRALKYMGLRANQPITEIHLDRVFIGSCTNSRIEDLRAAAAVAKGRKVASTIKQALVVPGSGLVKAQAEAEGLDKIFLDAGFEWREPGCSMCLAMNPDKLGSGEHCASTSNRNFEGRQGAGGRTHLVSPAMAAAAAVSGHFVDVRELQGIETREXGIATSRLHPATPFSTPNSRYSMTPFTQHTGLVAPLDRANVDTDQIIPKQFLKSIKRTGFGPNLFDEWRYLDIGEPGRDNSTRPLNQEFVLNFPRYQGASVLLARENFGCGSSREHAPWALDEYGFRAVIAPSFADIFYNNSFKNGLLPIVLAEAEMDALFEQCLGNEGYQLTVDLAAQRVRRPDGVEYAFEIDAFRKHCLLNGLDDIGLTLQDADAIGRFEQGHRAQQPWLFG

SEQ ID NO: 15480 - protein, 473 aa, Xanthomonas campestris
  unsure (1)..(473): unsure at all Xaa locations
RNAQRVVPMGYRPGLXRAARMPAPGAWLRRPPSSLGVVVMHISKPAGPLPAPVPFYRQLYFQVVVAIVLGALLGHFEPAFAESLKPLGDAFIKLVKMIIAPVIFLTIVTGIAGMTHLKTVGRVFAKSMTYFLFFSTLALIVGMVVAHAVQPGAGMNINPAELDQSAVNTYVQKSHELSLVGFLMDIIPATLISAFVDGNILQVLFVAVLFGIALALVGERGRPVLSFLEALTAPVFRLVHMLMKAAPIGAFGAIAFTIGKYGVESLVNLAWLVGSFYLTSLFFVLVILGIVCRLCGFSVLKLIRYLKAELLLVLGTSSSESALPSLMEKMEKAGCEKSVVGLVVPTGYSFNLDGTNIYMTLAALFIAQATNVDLTLGQQITLLAVAMLSSKGAAGVTGAGFITLAATLSVVPDVPVAGMALILGVDRFMSECRSLTNFIGNAVATVVVSRWENALDRDQLSLALDGRAPPLQA

SEQ ID NO: 15481 - protein, 324 aa, Xanthomonas campestris
KNQVVCFGEALIDMLALPPAGPDEARTFAQYAGGAPANVAVAVARLGGAAHFVGMLGRDMFGDFLLESLQQAGVVTDGIVRTDEAKTALAFVALDAAGERSFSFYRPPAADLLFRAEHFAADGFAQAAVLHVCSNSMTEPAIARCTLDGMRRARADGAIVSLDLNLRPMLWPQDVDPAPLLWEALALADVVKLSREELDYLAGTLDSDASAVTQKLWQGHARWLLVTDGGGPVHWQTRVDSGQVPAFHVQVRDSTAAGDAFVGGLLFQLAARASPLEQLCADPAAIAEVIRFAAAVGALAVTRKGAFAAMPSVDEVHSLIQEQS

SEQ ID NO: 15482 - protein, 446 aa, Xanthomonas campestris
MRVAIFGTGYVGLVTGTCLAEVGHHVICVDIDQAKVDGLNRGVIPIYEPGLEPMVKANHASGRLRFTTDAAEAIAHGEITFIAVGTPPDEDGSADLQYVLAVARTVGRHIDGPSVIVNKSTVPVGTADKVRAAIQEELDARGVDHEFDVVSNPEFLKEGDAVADCMRPDRIVIGAKKPAAIARMRRLYAPFNRNRDRIVEMDVRSAELTKYAANAMLATKISFMNEIANIAERVGADVEHVRNGIGSDPRIGWHFIYPAPVTAARASRRMAGAGQTAQQYGMQPTLLNAVESVNNAQKGHLFELVQRHYADGNGSIAGKTFAVWGMAFKPNTDDMRAASSRRLMAQLWKPVPRCARTTPKPRTKPSASSASATTWRSATTPSPHWKAPTRGRGHRVEAVPQPGFRQDQAGSEGRRRVRRPQPVRPAGDRSRRSGVLRHGRGRSLHA

SEQ ID NO: 15483 - protein, 452 aa, Xanthomonas campestris
MSESFRIEHDSMGELQVPADALWGAQTQRAVQNFPISGQPMPRGFIRALGLIKAAAAGVNADLGLLSKSVAKVVQEAALQVAQGTHDAHFPIDVYQTGSGTSSNMNANEVIATLATRAGKDAVHPNDHVNLGQSSNDVVPTAIRVSALLAVQEQLQPALKHLRKTIDKRAKGLDKIVKTGRTHLMDAMPLTFGQEFGAWSAQLSSAQERIDDSLKRLRRLPLGGTAIGTGINADARFGGKVAKALSTLSGVKFESAENKFEGLAAQDDAVELSGQLNALAVALIKIANDLRWMNAGPLAGLGEIELPALQPGSSIMPGKVNPVIPEATVMVCAQVIGHHTAITVAGQTGNFQLNVALPLIAANLLDSINLLSNVSRLLADTAIAGLKVRQERVREALDRNPILVTALNPIIGYEKAAAIAKRAYKEQRPVLDVAKEDSGLSEAELRRLLDPA

SEQ ID NO: 15484 - protein, 953 aa, Xanthomonas campestris
QSSPQQTRLTIVDNLLKQFAQSSQLAGGNAAYIEDLYEQYLVAPDSVDPKWKAYFDGFNGRDAGDVPHSAAIAHILSASKQAANAGTGVGASDERERNVGRLITAYRSRGHLGAQLDPLGLTPPVNPPDLDLPFHSLSQADLDSEFSTGGVGGQPRMKLKDLLARLKATYASTIGAEFMHIPEFDQRQWIYKRLEDAGGKIAADAASRKRTLERLTAAEGLERYLHTKYVGQKRFSLEGGDALIPMMDTIIRQSGNDQVKDIVIGMAHRGRLNVLVNTLGKNPRKLFDEFEGKFEHAHDDRAHTGDVKYHMGFSADIAVGDDKQVHLALAFNPSHLEIVDPVVVGSVRSRQERFGDADRKTVLPILIHGDAAFAGQGVVMELFQMSQARGFAVGGTVHIVVNNQIGFTTSARDDARSTLYCTDVAKMIGAPVFHVNGDDPDAVMFVSKLAYEFRQQFKKDVVIDLVCYRRWGHNEADEPAATQPVMYQTIRKHKTTRELYATKLESDGVLSADEAKALVDGYRNKLDSGEYTTELAKRKPDEFAIDWSKYLVGTAADPVDTRVKRNELDRLAKLITTIPAGVELHARVAKIYEDRVKMAAGNQDGDWGFAENLAYATLLAEGHKLRLVGQDAGRGTFFHRHAILHDQKTDSYYLPLRQLVENPEDATIIDSLLSEEAVMGFEYGYSTTDPNALCVWEAQFGDFANGAQVVIDQFIAAGEAKWGRIAGLSLFLPHGYEGQGPEHSSARLERFLQLCALENMLVCVPTTPAQCFHMIRRQMRMTTRKPLVVMTPKSLLRHKLAVSTLEELADGQFQHLIPDAKADASKVKRVVLCSGKVYYDLLEDQTKRGQDDVAILRVEQLYPFPRAQLAAELKRFGNAADVVWCQEEPQNQGAWYQIRHHLNFCLASGQSLHYAGRARSPSPAAGHMADHIAEQQKLVADALLNPFNDQVAE

SEQ ID NO: 15485 - protein, 404 aa, Xanthomonas campestris
MATEVKVPVLPESVSDATIASWHKKAGEAVKRDENLVDLETDKVVLEVPSPVDGVLKEIKFEAGSTVTSNQILAIIEEGAVAAAAPAEEKKADATAAAAAPAAAPAPAAAAAAAPVASKSSADSLPPGARFSAITQGVDPSQVDGPGRRGAVTKEDIVNFAKAGGVGKASGARPEERVAMTRVRKTIAKRLMESKNSTAMLTTFNEVNLAKVSAARKELQDEFQKAHGIKLGFMSFFVKAAANALQRFPLVNASIDGDDIIYHGYSDISIAVSTEKGLVTPVLRNVERQSFAEVEQGIADYAAKARAGKLGLDDLQGGTFTITNGGTFGSLLSTPIINPPQSAILGMHAIKERPIAENGQVVIAPMMYLALSYDHRIIDGKDSVQFLVDIKNQLENPGRMLFGL

SEQ ID NO: 15486 - protein, 478 aa, Xanthomonas campestris
  unsure (1)..(478): unsure at all Xaa locations
MSEQFDVVVIGAGPAGYHAAIRAAQLGMKVACIDAAIGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIELKGTNVILAAGSESIELPFAKFDGDTIVDNVGGLDFTAVPKRMAVIGAGVIGLELASVWKRLAAKDTILEALPDFLALAEAEVAKTALKEFTNQALYIKLGPXVTKTEITGSVDPKQVVLRYTDARGEQTLTVDKLLVAVGRKAATKNLLADGTGVKLTERGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFSGSADDLARICHAHPTLSEAIHDAAMAVSKRAIHKAN

SEQ ID NO: 15487 - protein, 376 aa, Xanthomonas campestris
MSKRDYYEVLGVARGASDEELKKAYRRCAMKYHPDRNPGDAAAEATFKECKEAYEVLSDGNKRRAYDAHGHAAFEHGMGGGGGGPGGPDMGDIFGDIFGNIFGGGAAGPRAARRGADVGYVLELDLEEAVAGIERRIEIPTLIECEPCHGSGSEDGKVEVCATCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLKQFEATFTGEDARKHSPKSATFIDGVKGFWDRMTS

SEQ ID NO: 15488 - protein, 641 aa, Xanthomonas campestris
MGKIIGIDLGTTNSCVAIMDGGKARVIENSEGDRTTPSIVAYTKDGEVLVGASAKRQAVTNPKNTFYAVKRLIGRKFTDGEVQKDISHVPYGILAHDNGDAWVQTSDSKRMAPQEISARVLEKMKKTAEDFLGEKVTEAVITVPAYFNDSQRQATKDAGRIAGLDVKRIINEPTAAALAYGLDKNGGDRKIAVYDLGGGTFDVSIIEIAEVDGEKQFEVLATNGDTFLGGEDFDNRVIEYLVDEFNKDQGIDLRKDPLALQRLKDAAERAKIELSTSQQTEVNLPYVTADASGPKHLNIKLTRAKLEALVEDLVKKSIEPCRTALNDAGLRASDINEVILVGGQTRMPKVQQAVADFFGKEPRKDVNPDEAVAVGAAIQGGVLAGDVKDVLLLDVTPLSLGIETMGGVFTKIIEKNTTIPTKASQTFSTAEDNQSAVTVHVLQGEREQARFNKSLAKFDLSGIEPAPRGMPQVEVSFDIDANGILHVSAKDKKTNKEQKVEIKAGSGLSDEEIQRMVADAEANREEDKKFQELVQTRNQADGLIHATRTAITEHGSKVGGDVIGKVEAALADLETAMKGDDKAQIEARSKTLEEAGQSLYAAAAAAEQGGNADAASGNAQASKAADDVVDAEFTEVKDDKK

SEQ ID NO: 15489 - protein, 428 aa, Xanthomonas campestris
MSFESLGLAPFLLRALAEQGYETPTAIQQQAIPLVLAGHDLLAGAQTGTGKTAAFGLPLLQHLGTTPQPVNGPRKPRALILTPTRELATQVHDSLRGYSKYLRIPSAVIYGGVGMGNQLDALRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRALRKSHARRPHGDAPRQAHAHAGPEEAG

SEQ ID NO: 15490 - protein, 214 aa, Xanthomonas campestris
LELFSYWRSSAAYRVRIGLQLKALAYVAHPVHLVRDGGEQHAAAYAQLNPQELVPTLRHGQVVIPQSLAILEYLDEAFADSAPLLPTGPAARARVRALAQVIACDVHPLNNLRVTQFLEHTWDVSPAQRHHWTAHWMQQGLAALETHLAGDAQTGQFCHGDTPGLADCELVPQLYNARRFAVELAPYPTLQRIEQACLALPAFDAARPETQPDA

SEQ ID NO: 15491 - protein, 388 aa, Xanthomonas campestris
ANSHDGERALSLATLAIHGGQSPDPSTGAVMPPIYATSTYAQSSPGEHQGFEYSRTHNPTRFAYERCVAVLEGGTRGFAFASGMAATSTVMELLDAGSHVVATDDLYGGSFRLFERVRRRTAGLDFSFVDLTDPAAFEAAIRPTTKMVWIETPTNPMLKLVDIAAIAAIARKHGLLVVVDNTFASPMLQRPLELGADLVVHSATKYLNGHSDMVGGIAVVGENAELAEQMAFLQNSIGGVQGPFDSFLALRGLKTLPLRMRAHCENALALAQWLETHQAIEKVIYPGLASHPQHALAKQQMSGFGGIVSIVLKGGFEAAKRFCEKTELFTLAESLGGVESLVNHPAVMTHASIPVARREKLGISDALVRLSVGVEDVGDLRGDLERAL

SEQ ID NO: 15492 - protein, 347 aa, Xanthomonas campestris
MCEMKTALITGISGQDGAYLAQLLLDKGYRVFGTYRRTSSVNFWRIEELGIAAHPNLNLIEYDLTDLGSSIRMLESTGATEVYNLAAQSFVGVSFDQPTTTAQITGIGPVHLLEAIRQVNRDIRFYQASTSEMFGKVQAVPQIESTPFYPRSPYGVAKLYAHWMTVNYRESYDIFGCSGILFNHESPLRGREFVTRKITDSVAKIKLGQLDCMELGNLDAKRDWGFAREYVEGMWRMLQADEPDTFVLATNRTETVRDFVSMAFKGAGIDVEFRGKDAEETAVDTATGKVVMRINPKFHRPAEVELLIGDPEKAARILGWKPETTLEQLCQMMVEADLKRNERGFSF

SEQ ID NO: 15493 - protein, 348 aa, Xanthomonas campestris
TWLVTGGAGFIGGNFVLEAVSRGIRVVNLDALTYAGNLNTLASLEGNADHIFVKGDIGDGALVTRLLQEHQPDAVLNFAAESHVDRSIEGPGAFIQTNVVGTLALLEAVRDYWKALPDTRRDAFRFLHVSTDEVYGTLGETGKFTETTPYAPNSPYSASKAASDHLVRAFHHTYGLPVLTTNCSNNYGPYHFPEKLIPLVIAKALAGEPLPVYGDGKQVRDWLFVSDHCEAIRTVLAKGRVGETYNVGGNSERQNIEVVQAICALLDQHRPREDGKPRESQIAYVTDRPGHDRRYAIDASKLKDELGWEPAYTFEQGIALTVDWYLTNQTWVQGVLDGSYRLERIGAT

SEQ ID NO: 15494 - protein, 292 aa, Xanthomonas campestris
MTQRKGIILAGGSGTRLYPITKGVSKQLLPVYDKPMIYYPLSVLMLAGIRDILIINTPHEQALFQSLLGDGAQWGVNIQYAVQPSPDGLAQAYLIGRDFVGGKPSCLVLGDNIFHGHGLTDTLRRADAREQGATVFGYWVNDPERYGVAEFDQHGKVIDIAEKPEKPRSNYAVTGLYFYDGKASDYAAALKPSPRGELEITDLNRCYLDAGDLHLEPLGRGYAWLDTGTHQSLHEAANFIETIQMRQGLQVCCPEEIAFGQGWIDAEQLERLAAPLLKNDYGKYLTALAKRG

SEQ ID NO: 15495 - protein, 445 aa, Xanthomonas campestris
LPAFKAYDIRGRVPDELNEDLARRIGVALAAQLDQGPVVLGHDVRLASPALQEALSAGLRASGREVIDVGLCGTEEVYFQTDHLKAAGGVMVTASHNPMDYNGMKLVREQARPISSDTGLFAIRDTVAADTAAAGEPTAAEHSRTDKTAYLEHLLSYVDRSTLKPLKLVVNAGNGGAGLIVDLLAAHLPFEFVRVFHEPDGNFPNGIPNPLLPENRDATAKAVKEHGADFGIAWDGDFDRCFFFDHTGRFIEGYYLVGLLAQAILAKQPGGKVVHDPRLTWNTVEMVEDAGGIPVLCKSGHAFIKEKMRSENAVYGGEMSAHHYFREFAYADSGMIPWLLIAELVSQSGRSLADLVEARMQKFPCSGEINFKVDDAKAAVARVMAHYGDQSPELDYTDGISADFGQWRFNLRSSNTEPLLRLNVETRGDAALLETRTQEISNLLR

SEQ ID NO: 15496 - protein, 568 aa, Xanthomonas campestris
RFLWHYICQRPWHFGGLLVLIIGAAGCAVAVQYGMKLLVDAMSTDQRIQADVWTPLGLFIGLIAVENLFWRLGGWLGCRTVVASVVDIRVDLFRHLTGHPMRYFTEHFAGALGNRITALGTAAGQIYGGLAWKILPPIVDFIGAIVVLFTVDWRMAATLIGFVAVVAAIITGFGIRGRAKHQSFAAQAARVGGELVDAVSNVWTIKAFAARDRESARLAQEIGHEAVAHRRSWMYVEKARVIHDICLSIMAGGMLIWAISAWRGGAVSAGDVVLVSALTFRILHGSRDLALTLVDTTQQLGAIADTLQIILQPHALPDADAPLALAEGDVRFEGVRFAYPDRPAVIEALDLHIPAGQKVGIVGPSGAGKSTLIALIQRLDDVESGRVLIDGQDIRSVSQDSLRDRIAVVPQETALFNRSIADNIRYGRPEASDAEVHTAARHAFCDGFIRDLPQGYNTLVGERGVMLSGGQRQRLGIARAFLKDAPILILDEATSALDTESEAEIQSALDHLMRGRTVLAVAHRLSTVIGFDRIVVLQDGRIVEDGSPAELRGRGGVFDSLWQRQAAG

SEQ ID NO: 15497 - protein, 283 aa, Xanthomonas campestris
PVPNYPRPPFKPQQQGFPGKTDKMDPRPDHGEDSYVGHGQLKGKRALITGGDSGIGAAVAIAYAREGADVAIAFLPDEQEDASRIGALIEKAGVRALLVGCDISDPNQAASLIDKVNSEFGGLDILVNNAGYQKYFENFEEITLDEWRKTFDTNVHAVFNLVRLSVPLMKDGGSIINTASVQSKKPTPNILPYGATKGALANLTIGLAGVLAEKQIRVNAVLPGPIWTPFIPAGMDEDSVESFGSQTPMGRPGQPVELASAYVMLASDTASYTSGTLLTISGG

SEQ ID NO: 15498 - protein, 518 aa, Xanthomonas campestris
HSLRRDVGPFALMLTGLGSIIGSGWLFGAWRAAGLAGPGAIWAWILGAAIITTIALSYAELGAMFPESGGMVRYSHYSHGSLVGFIAGWANWIAIVSVIPVEAEASVQYMASWPWPWAQSLYVQAPGGAGELSVPGLLISAVLVLVYFLLNFWSVKLFARSNTLITVFKLVVPAATGVALIASGFHSENFSVGIHGDAHVIDLAAVLTAVATAGIVFSFNGFQSPVNLAGEARNPGRSIPFAVLGSIALATVVYLILQVAYIGAVPPELLAKAGWHGIDFRSPFAELAIIVNLHWLAMLLYIDAFVSPSGTGITYTATTARMVYGMEKNGTLPAALGKLHPVWGVPRMAMFFNLAVSYLFLFFFRGWGTLAAVISVATIISYLTGPISAMALRRHAPDMHRPLRIAFLPILAGVAFVMATELLYWARWPLTGEIILLMVVALPVYCYYQAKQGWPDLRRNLKGAAWMVCYLPIVALLSWAGSTDFGGHGYLSYGTDLAVVAAVGLVFYIWGVRSGWRT

SEQ ID NO: 15499 - protein, 653 aa, Xanthomonas campestris
GFDVAGMDRSVAPGDDFFGYANGTWVKTTQIPEDRSSFNSFTSITVKTEQHSRDIIEGDAANDRVTGEDKQIGDYYAAYMDEAGIEAKGVSPVQPALDAIAQLEDKQALARTLGGQLRADVDLLNSTDFYTDRLFGLWVSQDLHHPQRYVPYLVQGGLGMPERSFYLDGGRMAQMREAYRAYIVNVLELAGIADAAPKAERILALETAIARVHASAEQTNNVQDGANAWAQADFARKAPGLDWGAFFEAAGLKAQRDFIVWQPQAVTGLSALVQSQPLQTWKDYLSFRALDRAAPYLSKPFADARFGFYGTTLEGTPQQRQRWKRGIDATNAALGEAVGKRYVQKYVSAQTKTRAEAMAKNIIAAFGKRIDALAWMSPQTKQHAKAKIAGLTVAVGYPDTWRDYSALEVRRDDAVGNVERAELFEYRRNLAKLGKPVDHGEWYMLPQEVNALNVPLENRLIFPAAILQPPFFDPAADDAVNYGAIGAVIGHEISHSFDNMGALFDEHGELHNWWTPQDLKKFETASDALAAQFGSYKPFEDLSVNGKLTLGENIADVAGLATAYDAYQLSLQGKQPQTLDGFTPDQRFFLGFAQAWRGKYRDEALRNAVLTDVHAPGRFRAQTVRNLDAWYPAFEVTQGQQLYLAPEQRVKIW

SEQ ID NO: 15500 - protein, 354 aa, Xanthomonas campestris
MLKNDRLLRALRRQPVDRTPVWLMRQAGRYLPEYRATRARAGSFLGMAKNPDIACEVTLQPLERFPLDAAILFSDILTIPDAMGLELYFVEGEGPKFRHPVRDADAIHRLGVPDMETELRYVMDAVRLIRRELDGAVPLIGFSGSPWTLACYMIEGGGSKEYARIKAMAFNAPQLLHHLLSTVTDAVIAYLSAQRAAGAQALQVFDTWGGVLSPAMYREFSLPYLTRIAQELERGSGEERTPLVLFGKGNGAYVSELAASGAEAVGVDWTISLADAAERAGGRVALQGNLDPATLYGSPDAIRSEVGKTLDSYAYGNGGSREGHVFNLGHGMSPDMNPDHVGVLVEAVQTLSKR

SEQ ID NO: 15501 - protein, 343 aa, Xanthomonas campestris
  unsure (1)..(343): unsure at all Xaa locations
LALLGTGTVGRAFVTRYTALQQRQLAPAALXLAGQLAHRPRLWCRRGAGTAAGQCGAAWPCELQPWAETTALRAGDVLVDATASDVVADWHVEWLTRGVHVVTANKLGQGTALSRAQDLYAARHASGAYYGDSATVGAGLPLLSSVRALVAGGDQIHSIEGVLSGSLAWLFHRYDGSAPFSACVREAMAAGYTEPDPRIDLSGEDVRRKLLILARAAGQPLEAEQVHVESLVPAALASVAPEAVDAHLETLDALVRTRWQQARAAGRCLRFVGRVDEHGASVGLRELALDHPLAGGAGTDNRVAISSDRYRDQPLLIQGPGAGAEVTAAALLDDVLRIVAGXG

SEQ ID NO: 15502 - protein, 404 aa, Xanthomonas campestris
MSFRDPADAPCSAATAAVRAGIDRDTAYGAVTPPIVLSSNFSFDGFGNKRQYDYTRSGNPTRDLLGEALAELEGGAGGVITSTGMGAINLVLNALLQPGDTLVVPHDAYGGSWRLFNALAKKGHFALITADLTDPRSLADALAQSPKLVLIETPSNPLLRITDLRFVIEAAHKVGALTVVDNTFLSPALQKPLEFGADVVLHSTTKYVNGHSDVVGGAVIARDAELHQQLVWWANALGLTGSPFDAFLTLRGLRTLDARLRVHQENADAIAVLLDEHAAVNQVYFPGLASHPGHALAARQQKGFGAMISFELNGGEAAVRAFVDGLRYFTLAESLGGVESLIAHPASMTHAAMTAEARAAAGISDGLLRLSVGIESAEDLLIDLRAGLARAEAALSAVARKQVD

SEQ ID NO: 15503 - protein, 140 aa, Xanthomonas campestris
NPTFSRSTPMSEIPGDLKFLKSHEWARVEGNGRVTVGISDHAQGLLGDLVYVELPAVGDTVQAGNGAAVVESVKAASDVYSPVTGTVVEVNASLSDKPETINEDAYGEGWIFVVEIDDKEQLNELLAPDDYAELLEDDAH

SEQ ID NO: 15504 - protein, 523 aa, Xanthomonas campestris
MTRRQLLARIGMTAGGAMMYQAMSSLGMAAESTFTGPLQLDGDAKGASVLILGAGLAGMTAAFELRKAGYRVQVLEYNDRPGGRNWTLRGGDRYTELGGAAQHCQFDEGHYLNPGPWRIPHHHRAVLSYCKQFGVALEAFNQVNYNALLHSQHGFDGKPQRFRAIDADYKGHVSELLAKCTQQHALDSLVSTEDQQILLESLRTWGALDKRFGYVKGKDSSERRGFARYPGGGLSGKPEFSDPFSVQDVLRSRLWTTLAAGNNYEMQTTMFQPVGGMDQIGKAFARQLGNAITYNAKVTRIDQDGSGVRVSWQDAARGGAEQVASADWCICTIPLSVLSRIPVTASDAMTTAIGKVPYAASVKVGLQFKRRFWEEDEAIYGGISYTDLPITLISYPSTGYHSPGKGVLLGAYVWGLDAYQFTSMSPEQRVRKAVEYGTQLHPQYPREFETGIAVGWHRVPFTHGCFGMWSEAARAEHYAPLCQIDGRLALAGEHVSYIPAWQEGAILSAHDVIGRLHRKVLAQ

SEQ ID NO: 15505 - protein, 368 aa, Xanthomonas campestris
ALSRRRFLRDSALFAGAAGSALPLLASAAERSAAIAPATAGAMAPVMIGSNEFPDGPCAAAIKAITQIAPQGGRYLRELQMELMTTLAAELKLPVNHLMAYAGSTEPLDYTMLAFTSPSAALVTADPTYESGWRAASRNGAKLVKVPLRKDFSHDVQAMCAADTNAGVIYICNPNNPTGSVTARKDLDYPLAHKPKGSILVVDEAYIHFAQSTRSVVDMSVRGEDVVALFTFSKLYGMAGIRLGYAAARPDLLAKLMFYSVNSLPVTAAAAGLASLRDATLVPQRRARTAATRADVIDFLTKQGYACTASESNCFMVDVKQPAAGFKDAMATFGVFIGRSWPVWPTWSRITVGTPEEMARFKQAFVQV

SEQ ID NO: 15506 - protein, 429 aa, Xanthomonas campestris
MNHSRSHALFSQAQNLMPGGVNSPVRAFKSVGGEPFFVARADGAYLFDVDGNRYIDYVGSWGPMIAGHNHPAVREAVERAIRDGLSFGAPCEAEVTMAETITRLVPSCEMVRMVNSGTEATLSAIRLARGATGRNRIVKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGGRDLMEQISPAGPIYQAGTLSGNPVAMAAGLAMLQLVQEPGFHARLSETTSLLCEGLEDAARAAGVAVTTNQVGGMFGLFFTDQIVENYAQATACDVTTFNRFFHAMLQQGVYLAPSAYEAGFVSSAHDEAVIEATLAAAREAFADVMR

SEQ ID NO: 15507 - protein, 439 aa, Xanthomonas campestris
MKKLTGIGAAEYARRRKQLMQMAGEQAILILPAAPERVRSHDTHYPYRQDSDFWYLSGFPEPEAVLVLVPGRKHGEAILFCRERDAEREAWDGPRAGQEGAVAQYGMDDAYPIDDVDEILPGLLEGRSRVYYHFGRDVDFDLKLIGWLKRVREQVRHGAQPPHEFLELGHLLHEQRLFKSRDEIALMQQAADISVRAHRAAMQLARPGVHEYQLQAEIEREFRAADAWPAYGSIVGTGSNACVLHYRANNARSRDGELVLVDAGAEYRGYAADITRTFPVNGRFSAAQRALHDLVGAAQAAALAQAQPGIAYEAGHLAAVQTLTEGLLRLGLLKGTLERNLAEGHYKRFYRHKTGHWLGLDVHDVGEYRLAGESRLLEPGMVFTIEPGLYVSADDTSVDAKWRGIGIRTEDNVLITADGHRVLTDALARSADEIQGAMA

SEQ ID NO: 15508 - protein, 435 aa, Xanthomonas campestris
LSVLYSDHLRTLNERADQALQRGGFDSSGSFPSGTTHYQLFDARDYPFRVNPQFKAWVPLTRMPHSWLVYTPGKRPTVIFYQPFDYWHVVPDAPSGWWVEHCDIHIIRTPEAALPLLPARTERCAILGEAASALGACVPNNPAAVLDFLDYQRAFKTPYELAVMRLAQQLAVRGHRAAEAAFRAGQSEFGIHMAYCSAVGQDANELPYGNIIALNEHGAVLHYTELGRQAPQPLRSFLIDAGASAHGYASDITRTYAADAGSEFQALIDAVDAAQLRMGNAVCAGMDYKQLHVDAHLSLMGILHDFGIITVSPEAALATGVSAAFFPHGLGHLIGLQVHDVAGFAASDRGGRIERPDGHPYLRLTRVLEPGMVVTIEPGVYFIDMLLDEVKKNGHAASVNWDRVAQFAPYGGIRIEDEVVCTDGDPENLTRPVFA

SEQ ID NO: 15509 - protein, 299 aa, Xanthomonas campestris
SRYTPSEMAQALGAGLLSFPVTHFDADMAFDEPAYRSNLDWLSSHPAAGLFAAGGTGELFSLTLDEVDRAVRAAVTQTAGRMPVIAPAGYGTAIAVAMAQAAERNDADGILLFPPYLTECDADGVAEHVERVCKATSLGVIVYGRANARLDDVALARVAERCPNLVGYKDGIGDVERMTRIYARLGDRLLYVGGLPTAETFALPYLEMGVTTYSSAIFNFLPEWALSFYAAVRARDHATIYRELNDFVLPYTVLRNRRAGYAVSIVKAGMRAVGRPAGPVRTPLADLTEDEFAQLTQLI

SEQ ID NO: 15510 - protein, 432 aa, Xanthomonas campestris
RYLILLMLFVVTTINYADRATLSIAGSAVQDSLGIDALQMGFIFSAFGWAYVAGQIPGGWLLDRFGSRRVYGLSLLTWSLFTVLQGFIGWVPVAWAVTTLFVLRFLVGIAEAPSFPGNSRIVAAWFPTAERGLAASIFNSAQYFATVAFAPLMGWLVHAWGWEHVFLVMGAAGVLLAALWRKTIYAPREHPRLSAQELEYIQRNGALVDMEQRNTPSQHVKGAQWHYAKQLLGNRMLLGVYIGQYCITTLTYFFLTWFPVYLVKERGMSILEAGFVASLPAVCGFIGGVLGGYVSDRMVRRGYSLTVARKTPIVVGMLMSVTMIGCNYVQAEWMVVGLMALAFFGKGIGALGWAVVADTSPKEIAGLSGGLFNTFGNMAGITTPIVIGYIVSTTGTFEWALVFVGFNALLAVVSYLVVVGQIKRVELKAPPG

SEQ ID NO: 15511 - protein, 389 aa, Xanthomonas campestris
MSIVRMTDLDLSGKRVLIRQDLNVPIDNGQITSEQRITASVPTIKLALEKGAAVMVTSHLGRPKEGTWSEEDSLAPVAARLTTLLGLDVPLVRDWVEGVDVAPGQVVLLENCRMNVGEGKDDEALARKYAALCDVFVMDAFGTAHRAQASTHGVIRFAPVAAGGPLLMAELDALAKALDNPAKPLLAIVAGSKVSTKLELLANLVNKVDQLIVGGGIANTFIAAAGHDVGKSLSEPDLIPTANQIVADAKARGAEIPLPTDVVVAKQFLPDAEASVKSLDQVDADDLILDIGPQTAAHYAELIANAGTVVWNGPVGVFEFEPFSHGTETLARAIAASEAFSIAGGGDTLAAVDKYAIAKDVTYISTGGGAFLEFLEGKTLPAVAALEAR

SEQ ID NO: 15512 - protein, 488 aa, Xanthomonas campestris
MKERQRRTKILATLGPATDPPGVLDALFKAGVNVVRLNFSHGDPSGQAKRAAEVRAAAVRVGAEVGILADLPGPKIRIERFAGGKIKLTMGDRFDLVADINAPAGDQHQVGVSYLGLPQDVTAGDVLLLDDGLVQLQVTDVQGARIVTTVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRYLSRFRSNMPIYAFTRHDGARRQMAMMRGVFPIGFDSRGLTPREAARAAIRLLVENERMGPGDRVVFTSGEHMETHGATNTLRLLEVGEDGRASGLGEL

SEQ ID NO: 15513 - protein, 334 aa, Xanthomonas campestris
MSIEQLAETAQAMVAPGKGIIAIDESTSTIAKRFSGVGIENTEENRRAYRELLLTTPKLSDYISGAILFDETIRQKTKDGVPFAKYMADHGIIPGIKVDKGAQPLAGMPGELVTEGLDGLRARLEEYYTLGARFAKWRAVINIGEDIPSGTCIEANAHALARYAALCQEQGLVPMVEPEVIMDGDHDIETCYEVTEATLRSLFGALYEQNVVLEGTILKASMVISGKGCEEQASVEEVAESTVMCLKSTVPAILPGIVFLSGGQTDEQSTAHLNEMHQLGNLPWPLSFSYGRAMQQAALKLWSKDMTGNYAKAQQIIYERAKENGLAALGKWKG

SEQ ID NO: 15514 - protein, 241 aa, Xanthomonas campestris
MTALPATSIAAPSLDDLDALNAHLETLRADERVAWALQHGPQQAALSSSFGAQSAVTLHLLTQQRPDIPVILIDTGYLFPETYRFADALTERLSLNLQVYRPLVSRAWMEARHGRLWEQGMVGIDQYNNLRKVEPMRRALDELNVGTWFTGLRRSQSGGRAQTPIVQKRGDRYKISPIADWTDRDVWQYLQTHALPYHPLWEQGYVSIGDFHTTRRWEPGMREEDTRFFGLKRECGIHEDI

SEQ ID NO: 15515 - protein, 565 aa, Xanthomonas campestris
PIPMTHSVEDIKSTSRRLRGSLEQSLADPVTGALREDDQTLIKYHGSYQQDDRDIRDERRRQKLEPAYQFMIRTRTPGGVISPSQWLALDGIATRYANHSLRITTRQAFQFHGVIKRELKATMQAINATLIDTLAACGDVNRNVQVAANPLLSQAHATLYADAARVSEHLLPNTRAYYEIWLDEERVSGSGAEDEPIYGDRYLPRKFKIGFAAPPHNDVDVFANDLGFIAILREGQLLGYNVSIGGGMGASHGDAETWPRVANVIGFVTRDQLLDIATAVVTTQRDLGNRAVRKRARFKYTIDDHGLDTIVAEIERRAGFSLQPAQPFAFAHNGDRYGWVEGEQGDWHLTLSLPAGRIADTDTAAHLSGLRAIAQLQMGEFRMTPNQNLVIAGVPAEQRAQIDQLVAQYGLDAGNLAPTALARGAMACVALPTCGLAMAEAERYLPDFSAALQPLLERHGLAQTPIVLRLSGCPNGCSRPYLAEIALVGKAPGRYNLMLGGDRRGQRLNTLYRENINEADILAALEPLLARYAAERDQHADEGFGDFLHRSGLIALPPYPTHRHL

SEQ ID NO: 15516 - protein, 614 aa, Xanthomonas campestris
LQQHESKPLLRFITCGSVDDGKSTLIGRLLYDSKRLFDDQLAALESDSKRHGTQGDGIDYALLMDGLAAEREQGITIDVAYRYFDTDQRKFIVADCPGHEQYTRNMATGASTADVAVVLVDARKGVLVQTRRHSYIVSLLGIRHVVLAVNKMDLVDYDAQVFATIVDSYRALAAQLGIADVQCIPLSALAGDNLSSASTRMPWYQGPHLLQHLDSVQLETPDAVSGLRLPVQWVNRPSAQFRGYAGTIAAGQVRTGDAVVVVPSGRRAHVASVLDANGVVDSARAGQAVTLTLREEIDISRGDIIAAVDDPPEVADQFAAHVLWMDDAALLPGRPYWLKIGTRTVTASISEIKHKVDVNTQERLAAKRLELNEVGYCNLSLDEPIAFAPYARNRVLGGFILIDRQTNATVAAGALEFALRRAGNVHWQHLDVDRAARARIKGQAPRVLWFTGLSGAGKSTVANLVDKRLHALGYHTFILDGDNVRHGLNRDLGFTDEDRVENIRRVAEVARLMADAGLIVLVSFISPFRAERQLARERFDSGEFVEVFVDVPLAVAEARDVKGLYRKARAGQIPNFTGIDSPYEAPERPEIHLHADGENVEALARHVLEYLGLE

SEQ ID NO: 15517 - protein, 853 aa, Xanthomonas campestris
RLPTWAVPEHYSLAIKVDPEQAQFSGRTTIRVQLKQASDHLWLHGKELKVSKATVKPAKGKALTARYVDADAQTGVVRLDFGRTLKPQTLTVDITYSAPLNQQLQGLYQVKYQGKAYAMTQMEPISARYAFPGFDEPAFKTPFDLSLTVPAGDQALANTIATSTKPAGKGWKTVSFAPTLPLPTYLVAYAAGPWDVVDVPAMPATPQRPAATPLRGIAAQGQGPRITPALDQTPAIIAALEDYYAFGYPFDKLDLVAAPDFSAGAMENPGFVTFRDWLLLLDKDSPAENVQRSFNTNAHELAHQWTGDTVTMAWWDDLWLNEAFATWMQQKITMQLHPEYRANLDRIGGAQHAMDNDSLVSARKIRQPITGNGDIETAFDGITYQKGAAVLAMFEGFVGEDVFREGMRAYIAKHKFGSATADDLVDAIAEAAGKGEDFKAAFRSFLNQPGVPYLQTQVAREGGKTVVKLQQQRYLPLGSSGSTAQQWGVPVCVKYGKGKNQVGTACQLLESGSGSIVLEGAGKNTWVFPNARGAGYYRFSLPKKQLAALGKQVAQLDENEKLSYADAIDAAYRHGDADTEVVLAAMKQLAGAESADVSTALVDRFVWIWRHQATTDAQRATLRKAAEQAYLPRLRQLGYTRRAKESIDDTTLRASLAGLFGLWLQTPEVRSALLAQGDAVLAGGGNGLNFAAANPDLLGTVLAVTAQERGAAAVQTLIQALRTHADPAQRNAMIAALGAVQDPALLTQVRDFALTDAIKVGEMKSLLTRGHSYDASHASMWPWFTANFDRIVQRSGSFDGGGLPSLGASNGCSVEEADRLDAFFKPRLATLSGADRGLAQTGEAIRLCAALKQ

SEQ ID NO: 15518 - protein, 827 aa, Xanthomonas campestris
MTTNDTLAAIAAGTLAPTSAPASVTVPSPAHPELSDPSDVVPPPRQAIAMHAQTIEEQTVSTWITKEAGNRKIPFEPARLERAIDQIHAEFPQLDVGDYKRSVFGFVERKDSVNADDLVDHLIREAEARVDLTTPEWEHFAARLYLRRLYKRASRNRFYDAGQKYGSFVGLQESLADRNVYSNDILKSYSKEELIEAGKMIAPERDTLFAYNGLYLLATRYLATDNSRGVFELPQERWLTIALYLMQDEKPRERRMQLVGEAYWALSNLYMTVATPTLANAGKVGGQLSSCFIDTVDDSLQGIYDSNTDVARVSKHGGGVGAYLGYVRSSGSAIRGVSNSSGGVVPWIKQLNNTAVSVDQLGQRKGAIAVYLDIFHRDIESFLDLRLNNGDQRLRAHDVFTSVCIPDLFMEAVERRGDWYLFDPHEVKRIKGWYLQDFYDEKKGDANSSFRKKYEEVVADERITRKTVKAIEIFKRIMVSQLETGNPFMFYRDEVNRKNPNKHEGMVYSSNLCTEILQNMSPTRMMQEIISGNQIVTTKKAGDFVVCNLSSINLGRAITVQADQADLLGADVLERLIPIQVRMLDNVIDLNQLPVPQATITNQKYRAIGLGTFGWHHLLAQKAIHWNAKEAEDYSDELYERINYLTVQASMELAKEKGTYSVFRGSDWHTGEYFRARDYNSPQWLELSAQVAVNGVRNAWMLAVAPNMSTAQIAGSTASIDPIYSAFYYEEKKDFRRPVAAPGLSLDTWPYYEKGAYKVDQFASVRQNARRQRHIDQSISFNFYVPSTIRASTLLDLHMTAWREGLKTTYYVRSNDIDISECEWCSS

SEQ ID NO: 15519 - protein, 345 aa, Xanthomonas campestris
ATPLERIKILEPRHPNRSTAIINGQTSGILNWNDIPYPSFYRAYKELSTNFWIPDEVDMKGDARQYNELSAREKNAYDSIIGLLATLDSPQTRFIYNVAEYITDPAAHANAAIIGQQEVIHNESYSYVLASITGLADQNRVFEIARTHPTIIKRNAPIMGAYDDFMRDKTAETLIRALIQSSILEGINFYSGFAYFYNLVRQNRMTGTGKIISFINRDELAHSKFISELIRAIIGENQALQGDQLTDYVHKAFEHAIDLETVWTAEVLDGIDGIDVDEMIRYVKYRANKMAGMLGIEKLYEGANDNVMPWIKAYADNFTETKTDFFEMRNASYKKTNSDNGFDDL

SEQ ID NO: 15520 - protein, 309 aa, Xanthomonas campestris
LNSPSPTAAPALRVCDLRKTYDNGTQALKGVSLDVAPGDFFALLGPNGAGKSTLIGIISSLVNLSQGQVEVFGTDLVRHRSDAMRLIGLVPQEVNFNLFEKPFDILVNYAGFYGMPREQAAALAEAELRRAHLWEKAQVMSRTLSGGMKRRLMIARAMMTQPRLLILDEPTAGVDIEIRRDMWRVLKEINAAGTTIILTTHYLEEAEHLCRNLAIINHGQIVTQGPMRELLAKLDVEGFLFDIDGELPAQLPVIEGTTLTAIDGHTLDLDMPRAMDLNRVFATLGDAGIRVRSMRTKSNRLEELFVRLT

SEQ ID NO: 15521 - protein, 251 aa, Xanthomonas campestris
FPLKLVDRRMLAPTVAHCQFLRDDGQPLDFQPGQFIQIHFQYADGTDAKRSYSLATIHDHALGPGEAVEIAVSFVPGGSATALFEGLEIGDQLQASGPYGKFCLLPGDHNRRYLLIATGTGVTPYRSMLPLLAEAIASRGLEVVLLQGARTPAELLYGDDFRAFADAHPQFRYVPCFSRELPEHPHADVRHGYVQQHLAEFLPTADGDIAYLCGNPDMVDTCAVALREAGLPNAQIRREKYVSASPPKPAA

SEQ ID NO: 15522 - protein, 249 aa, Xanthomonas campestris
PRHGGARMIVVDSLHKSFKTKTGLVKAVNGVSFNAADGQITGLLGPNGAGKTTTLRMLYTLMTPDQGSVRVDGVDAAHDPVAVRRALGVLPDARGVYKRLSARENIAYFGQLHGMSRTQIAERTRLLSHALDMDDILDRQTEGFSQGQRTKTAIARALVHDPRNVILDEPTNGLDVMTTRAMRGFLQQLRAEGRCVIFSSHIMQEVAALCDRIVIIAKGTVVAAGTADELRAATGEDNLEDAFVKAIGS

SEQ ID NO: 15523 - protein, 275 aa, Xanthomonas campestris
MSLAILCPGQGGQHAGMFARIAQLPVASEVIATAASVLGADPIALAADPRRFDNAIAQPLVCAGTLAHWQALRAQLPTPTLVLGYSVGELTAHAVAGSIDIPTCLHLAATRARVMDAASPADAGLMAVVGLPITALDALCQSHGVALAIINGDDHAVLGGPRSALAALGNDASARGARVTHLPVSVPAHTHWLQPAADAFAAVLQDSAVRAPMHRVLAGIDARAVNTPQAVVSSLSAQIARTVRWHDVLVQAAERGARVFLELGPGSALARMARE

SEQ ID NO: 15524 - protein, 760 aa, Xanthomonas campestris
MFSKDLEQTIGQCYKRAREARHEFMTVEHLLLSLLDNPSAQAVLKACGADQVRLHTDLEQAIEASVSRLAEDDGRDTQPTLGFQRVLQRAVYHVQSSGKKEVTGANVLVAIFGEKDSHAVYFLNQQDITRLDIVNYLSHGIAKLGEDGEQPSASDGEPKSDAGEGEGKGDALAEYATNLNDHARNGKIDPLVGRADEIERTIQVLCRRRKNNPLYVGEAGVGKTAIAEGLAKRIVDADVPEVLADAVIFSLDLGALVAGTKYRGDFEKRLKGVLTALKKVPNAVLFIDEIHTIIGAGSASGGTMDASNLIKPALASGELRCIGSTTFQEYRGIFEKDRALARRFQKIDIVEPTVGETFEILQGLKPKYEAHHGVTYADDALQAAVDLSVKHIGDRLLPDKAIDVIDEAGARQRLLPEGQRKELIDIEEIETIVAKMARIPAKQVSATDKDVLQHLERNLKMVIFGQNPAIETLAGSIKLARSGLANPEKPIGNFLFAGPTGVGKTEVTKQLALQLGIELVRFDMSEYMEAHSISRLIGAPPGYVGFDQGGLLTEKIVKTPHCVLLLDEVEKAHPDIFNILLQVMDRGILTDTNGREANFKNVILVMTTNAGATQASRRSIGFTKQDHSTDAMESIRRGFTPEFRNRLDAIVQFQPLGFDHILRVVDKFIIELEMLLQEKHVSLSATPTARDWLAQHGFDPLMGARPMSRVIQEKIKRPLADELLFGKLVEGGRVNIDVKDGELVVEAHPEPERLLPATVD

SEQ ID NO: 15525 - protein, 395 aa, Xanthomonas campestris
IQEAYIVAATRTPVGKAPKGVFRNTRPDDMLAHVLRTVVAQAPGIDLSRIDDAIIGCAMPEGEQGMNVARIGVLLAGLPNTVAGQTINRFCSSGIQAVAMAADQIRLGNADLMLAGGTESMSMVPMMGNKVAMSPNVFADDHVAIAYGMGITAEKVAEEWKVSREDQDAFALASHQKAIAAIAAGEFRDEITPYEILSHQPDLAGNVIALRKRLVDTDEGPRPDSSLEGLAKLRPVFRNGQFGGSVTAGNSSQMSDGAGAVLLASEQAIKDYGLTPLARFVSFSVAGVRPEVMGIGPIAAIPKALKQAGLTKDQIDWIELNEAFAAQALAVIRDSELDPSKVNPLGGAIALGHPLGATGAIRAATLVHGLRRRQQKYGMVTMCIGTGMGAAGIIE

SEQ ID NO: 15526 - protein, 141 aa, Xanthomonas campestris
MALERTLSIIKPDAVAKNVIGEIYSRFEKAGLKVVAAKYKQLSRREAEGFYAVHRERPFFNALVEFMISGPVMIQALEGENAVAAHRDLLGATNPKDAAPGTIRADFADSIDANAAHGSDSVENAANEVAYFFAATEVVSR

SEQ ID NO: 15527 - protein, 272 aa, Xanthomonas campestris
KHRPLHQQVIVITGASSGIGLCTALTAAEAGASVVLVARSAGVLQEVADLLTAQGHQAIAVVADVTEPAQLQHAADTAIARFGRIDTWVNNAGVAIFGLLQDVDDHDSRRMFDINFWGVVYGSRIALPHLAASGGALINIGSEASEAVVPWQGMYSASKHAVKGFTDSLRIEIEGLAKQPVSVVLIQPTAVDTPYPQHARNYMQAEPQLPPPLIEPMRVANAILHAAEHGGRDVKVGAMANANITVTRLMPRVADALSAMRSKTQQQDRAAV

SEQ ID NO: 15528 - protein, 256 aa, Xanthomonas campestris
IATYNVNGIASRLPHLLQWLQREQPDIVGLQELKSTQEAFPEQAIRDAGYGVIWQGQRSWNGVALLARGAEPVEIRRGLPWDPADTQSRYLEAAIHGVIVGCLYLPNGNPQPGPKFDYKLKWFQRLLRHAATLVALPHPVALIGDFNVVPTDAHIYDPKGWRKDALLQPESRAAYAQLLAQGWTDSLQAIHGDAPVYTFWDYFRQHFARDRGLRIDHLLLNRTLAAGLRDAGVDKWVRALEKASDHAPPWITVDVP

SEQ ID NO: 15529 - protein, 907 aa, Xanthomonas campestris
SPMHRTTRSTCCYCGVGCGVLIHSTHDDAGERIVGIEGDPLHPANHGRLCSKGLALPQTAASQQGRVLAPELRRHRDASRTAVSWDQALTHVTGKLAAIIDQHGPDAVAFYVSGQLLTEDYYVFNKLAKGLLGTNNIDTNSRLCMSSAVTGYKLALGADGPPTCYEDLELAQTVLFAGSNMAYAHPVLFRRLEDARARNPEIRWIVIDPRRTDTAAMADLHLAIEPGTDVALFNGMLHHLIWEGLVDARFVAAQTEDFDALKHMLREYTPRMSAEICGISHEDLVQAAEWFGRSPAALSLYCMGLNQSAHGTDKNLALINLHLATGQIGKPGAGPFSLTGQPNAMGGREVGGMATMLAAHREIGNAQDRAEVERAWGVPAGRISSTPGAPAVQLFERLRAGTLKAVWIVCTNPVHSMPDIAGVRAALEQAELVIVQDAFSGTDTVPYADVLLPAASWGEKDGTVTNSERCITRVRKAVEPPGQARADWWIAREVARRLEARLAPQKGAGLFAFDTPAQIFDEHRALTVGRDLDIGGLDHAALDARGPQQWPFPAGATQGQARRYTDGVFATPNGRARFHATPYRKVAEPTSARFPMRLLTGRLRDQWHGMSRSGRVPGAFAHSPEPALRMHPDDAVRRGLQAGELVRVASKRGALVLPLELSDELRSGTVFAAMHWSAQTLASGGINEVSTPAVDTRSQQPELKHAAVRVEKAAFGWHLLAARRGDALALQQALQPLLRDCGYAGLRLHAEPGGDAGGQWAVLHAACERAPSAEWIDRLVAALQLPAGADVLEYRDLRRGLMRRVGWRLQDGHSHIDGVLLTAAQPSAANQSLLDTALRGQPWRGARLAVFAQTQGAPADPIVCTCMHVSSAAIHAAIDDGADLAQLKQRLGCGTVCGSCVPQLTRL

SEQ ID NO: 15530 - protein, 1380 aa, Xanthomonas campestris
SYSFTEKKRIRKDFGKQRSILEVPFLLAIQVDSYREFLQEDVEPNKRKDLGLHAALKSVFPISSYSGNAALEYVGYKLGEPVFDERECRQRGMSYGAPLRVTVRLVIYDRESSTKAIKYVKEQEVYLGEIPLMTENGTFIVNGTERVIVSQLHRSPGVFFDHDRGKTHSSGKLLYSARIIPYRGSWLDFEFDPKDALFTRIDRRRKLPVSILLRALGYNNEEMLAEFFEINTFHINPDEGVQLELVPERLRGETLNFDLADGDKVIVEAGKRITARHVKQLEAAGVAALAVPDDYLVGRILSHDVVDGSTGELLANANDEISEDQLAAFRKAGVDAVGTLWVNDLDRGPYLSNTLRIDPTKTQLEALVEIYRMMRPGEPPTKEAAQNLFHNLFFTFERYDLSTVGRMKFNRRVGRKEVLGESVLYDKKYFAERNDEESKRLVAEHADTSDILEVIKVLTEIRNGRGVVDDIDHLGNRRVRSVGEMAENVFRVGLVRVERAVKERLSMAESEGLTPQELINAKPVAAAIKEFFGSSQLSQFMDQNNPLSEVTHKRRVSALGPGGLTRERAGFEVRDVHPTHYGRVCTIETPEGPNIGLINSLAVFARTNQYGFLETPYRKVLDGKVSDDVEYLSAIEENEYVIAQANALTDAKNMLTEQFVPCRFQGESLLKPPAEVHFMDVSPMQTVSVAAALVPFLEHDDANRALMGANMQRQAVPTLRSQKPLVGTGIERAVARDSGVTVNARRGGVIEQIDAARIVVKVNEAEIGGGTDAGVDIYNLIKYTRSNQNTCINQRPLVNVGDVIARGDVLADGPSTDIGELALGQNMLIAFMPWNGYNFEDSILLSERVVEEDRYTTIHIEELTCVARDTKLGPEEISADIPNVSEQALNRLDESGVVYIGAEVRAGDIMVGKVTPKGESQLTPEEKLLRAIFGEKASDVKDSSLRVPPGMDGTVIDVQVFTRDGIEKDKRARQIEESEIKRVKKDFDDQFRILEAAIYARLRSQIVGKVANGGPNLKKGDNVTDAYLDGLKKSDWFQLRMKDDDAADAIERAQKQIQAHEKEFEARFADKRGKITQGDDLAPGVLKMVKVFLAVKRRIQPGDKMAGRHGNKGVVSNVVPVEDMPYMATGEPVDIVLNPLGVPSRMNIGQILEVHLGWAAKGLGRKIQRMLEAQTAVSELRKFLDDIYNHDSAINAERVDLSQFSDEELLNLGKNLIDGVPMATPVFDGASEAEIKRMLELAELPQSGQTQLYDGRTGEAFDRKTTVGYMHYLKLNHLVDDKMHARSTGPYSLVTQQPLGGKAQFGGQRFGEMEVWALEAYGAAYTLQEMLTVKSDDVQGRNQMYKNIVDGEHEMVAGMPESFNVLVKEIRSLAINMELE

SEQ ID NO: 15531 - protein, 274 aa, Xanthomonas campestris
MPLMKFKPTSPGRRSAVRVVTPDLHKGAPHAALLDSQSKSGGRNHHGRITVRHVGGGHKQHYRIIDFKRNKEGIPARVERIEYDPNRTAHIALLCYVDGERRYIIAPKGLKAGDQVIAGANAPIKTGNALPLRNIPVGTTVHGIELKPGKGAQIARAAGAAVQLVAREGIYATLRLRSGEMRKVPVECRATIGEVGNDEHNLEKLGKAGAKRRRGVRPTVRGAAMNANDHPHGGGEAKAGQGNPHPVTPWGVPTKGYKTRKNKRTQQFIVRDRR

SEQ ID NO: 15532 - protein, 477 aa, Xanthomonas campestris
RPAQVVLMGPAAAGVCDLLEYTMSASSHSTDHQPDAWSPQSWRQRTALQMPTYPDAAALEHTLDELRQLPPLVTSWEIFALKRQLAEAQEGKRFLLQGGDCAENFSDCESGTISNRLKVLLQMSLVLVHGLRLPVVRVGRFAGQYAKPRSADTETRDGVTLPSYRGDVINAPAFTEAARVPDPRRMITAHSRSAMTMNFVRALIDGGFADLHHPEYWNLQWVGYSPLAADYQKMVSSIGDAVRFMETLSGAEVYNLNRIDFYTSHEALLLPYEEGLTRQVPRQWGWFNLSTHYPWIGMRTAALDGAHVEYLRGVRNPIAIKVGPSVQPDQLLRLMDVLNPEDEPGRLSFIHRMGAAQIAEKLPPLLDAVKRDGRRVLWVCDAMHGNTESTGNGYKTRRFDNIRSEVELSFDLHAAAGTRLGGVHLELTGEDVTECTGGARELTERDLERAYRSSVDPRLNYEQSLEIAMAIVRKQQQ

SEQ ID NO: 15533 - protein, 330 aa, Xanthomonas campestris
KHPMKAPVRVAVTGAAGQIGYALLFRIASGEMLGKDQPVILQLLELSNEKAQAALKGVMMELEDCAFPLLAGMVGTDDAEVAFKDIDVALLVGARPRGPGMERKDLLLENAKIFTAQGAALNKVAKRDVKVLVVGNPANTNAYIAMKSAPDLNPKNFTAMLRLDHNRALSQLSLKLGKPVGGIEKLVVWGNHSPTMYPDYRFATSDGASIGDAINDQEWNAGTFIPTVGKRGAAIIEARGLSSAASAANAAIDHVRDWVLGSNGKWVTMGVPSDGSYGIPEGVIFGFPVTTENGQYTLVKDLPIDDFSQKYIDKTLAELEEERSGVSHLL

SEQ ID NO: 15534 - protein, 203 aa, Xanthomonas campestris
MKLYTKPGACSLADHIVLRWSGLPFELTVVDAATMKSPDYLRLNPAGAVPLLVVDQWALTQNAAILNYIADTAPLTGLGGDGTARSRAEINRWIAFVNADLHPTFKPLFGSTAYLQEDALIQRSHEDARTKLRTLYTRVDAHLQGRNWLAGDTHTGADAYLFVTLRWAHKAGVDLSGLSALDAFFQRMLADADVQAALQAEGL

SEQ ID NO: 15535 - protein, 494 aa, Xanthomonas campestris
  unsure (1)..(494): unsure at all Xaa locations
PPLXASPAMSESVPRVSLLIDGALVVSATTHWQDVVNPADQSVLAQVPFATPAEVDAAVAAAQQAFVGWRKTPIGTRARIFLKYQQLIREHMPELAAILSAEQGKTLADAEGDVFRGLEVVEHAAAIGNLQLGELANNVANGVDTYTLLQPLGVCAGITPFNFPAMIPLWMFPMAIATGNTFVLKPSEQDPMVTMRLVELALEAGIPKGVLNVVHGGEEVVNALCDHPDIKALSFVGSTKVGTHVYRRASLAGKRVQCMMGAKNHAVVLPDANQEQTLNAMVGAAFGAAGQRCMAASTLVLVGEARQWIPALVAKARGLKLGAGSTPGTDVGPLISCAARERVEGLIASGVAQGATLELDGRTPQVPGLEHGNFVGPTIFSGVTPGMRIYDEEIFGPVLVILEAATLEEAIALVNANPNGNGTALFTQSGAAARRFQEDIDVGQVGINVPIPVPVPLFSFTGSRASKLGDLGPYGKQVVMFYTQTKTITARWFD

SEQ ID NO: 15536 - protein, 374 aa, Xanthomonas campestris
DLNDEQQAFRAAARDFADKELAPHAARWDAESHFPREAIGKAAELGFCGLYTDEGVGGLGMRRLDAAIVFEELATVDPSTSAFITIHNMATWLIASYGNDGVRAQWGEAMTSGAKLGSYCLTEPGSGSDAASLKTRAQRDGDDYVLNGSKAFISGAGATDVLVVMARTGEDGARGISAFVVAADAPGISYGRKEEKMGWNSQPTRGITFTDVRIPAGNLLGKEGEGFKMAMKALDGGRINIAACSLGAAQGALDAARRYMGERRQFGKKLADFQALQFKLADMATQLVAARQMVHTAARKLDAGSHDATVWCAMAKRFATDAGFAICDEALQIHGGYGYIREYPIERLLRDSRVHRILEGTNEVMRMIIARHLL

SEQ ID NO: 15537 - protein, 185 aa, Xanthomonas campestris
LMSTLTISQALAQADLLVDRPAIDAAVATIADAIARDYAGEVPVYLTIMHGALPFSGQLALELGARGQDLQFDYLHATRYRGETTGGELVWKHRPATALFGRRVILVDDILDEGYTLQGVRQWCLEQGATDVRVAVLTVKRHDRCVPGVTADYVGVEVADRYVFGFGMDVNEQLRGIPAIYAMKQ

SEQ ID NO: 15538 - protein, 391 aa, Xanthomonas campestris
MSDIVIVAAKRTAIGSFLGQFNGVPAPTLAAAAIEGALAQSGVAAADVSEVIVGCVLPANLGQAPARQAAIAAGIPTSTGATTINKVCGSGMKAIMFGHDLIKAGSASIVVAGGMESMSNAPHLLPNSRTGNRYGNFQAVDHMAWDGLTNPYDGQAMGVFGEATAEKFGFSRADQDAYAIASVERAQAAQRNGAFADEIVPVKVATRKGEIVVDSDEQPGKSDVAKIPTLKAAFKKDGTVTAASSSSISDGAAITVLMAADEAQRRGITPLARIVGHVTHSQAPEWFTTAPVAAIQSLVGKIGWTLDDVDLFEINEAFAVVAMTPIKELGIAHEKVNVHGGACALGHPIGASGARLVVTLVNALRSRGGKRGIATLCIGGGEATAIAIELI

SEQ ID NO: 15539 - protein, 301 aa, Xanthomonas campestris
MSIAAFWHGVLPAITTPFTANGDIDHDFLAKHANQLVDAGCTAIVPLGSLGEAATLSVDDKLAILKTLVTALQGRVPVVPGIASLATGEAVALAKAAKELGCGGLMVLPPYVYSTDWREMGAHVRAVIAATDLPVILYNNPVAYKTDFGPAQIAELAAEFPNLQAVKESSGDVRRFAALQELLGDRLALLVGMDDAIVEGLSMGAKGWIAGLVNAYPKESVRLFELARDGGYPAAKELYDWFLPLLRLDTVPKFVQLIKLVQEKVGLGSERVRAPRLVVDGAEREAALKVIDHAIATAPSL

SEQ ID NO: 15540 - protein, 653 aa, Xanthomonas campestris
  unsure (1)..(653): unsure at all Xaa locations
LNRFACRAFAWGGQYGFSTLTRXMIDSTRYPRLSRIQTPDDLRTFEEADLTAVADELRAYLIESVGKSGGHFAAGLGVIELTVALHYLYQTPVDQLVWDVGHQTYPHKILTGRRDQIHTVKQKDGVAPFPKREESVYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLKTLKGPQLLHVITTKGKGYELAEGDQIGYHAVGPFDPSKGLVAKAGAKKPTYTDVFSDWVCDMAAADPKMLVITPAMREGSGLVRFSKEYPQRYFDVAIAEQHAVTLAAGMATQGAKPVVAIYSTFLQRGYDQLVHDVAVQKLDVLFAIDRGGVVGPDGATHAGNLDLSFLRCVPHMVVMAPADEAECRQMLTTGLRYEGPAAVRYPRGTGPGTALDASLTTLPIGKAQLRHSGARIALLGFGATVDAAEAVGRELGLTVVNMRFVKPLDKAMLLELAKCHEAFVSIEDNVVAGGAGSGVSELLNAESVLMPMLHLGLPDSFQHHASREDLLAEAGIDQAGIRAAVLKRWPQLMAKGQ

SEQ ID NO: 15541 - protein, 435 aa, Xanthomonas campestris
MHAARGDERRGRRASFSATPVSDVIAKTAARPTCALARHACARAARWAMPVSTRTKCRHPHPIATDGAVLAVQAPRLRQHCAGSWVCLAGHGMLRAFTNEADLLNALPLRILGTGCHVPATEVTSQELDARWQLPPGTTFARLGVATRHYAGEGETASSMGAAAAQAALVSAGIDSGEIDCLISACSVMEQPIPCQAVLIQRALGLGDSGIPAFDVNATCLSFLVALDMATNALALGRYRRVLIVSSEVASGGLDAAVPSTAGLFGDGAAAVVVGRSAPDEDSALLSSRLASYGSGAELCRIRGGGSRYPRGEDTTPEATRVFTMDGRGAYRFAARHLPAFWDQLLRDAGTETTALRCLIPHQASGGGLDHVVQALGLRPEQVVRILHAHGNQVAASLPHALHQARVTQQLQRGELFAMLGTGAGLSIGGMVLRY

SEQ ID NO: 15542 - protein, 335 aa, Xanthomonas campestris
MSEIQSLTAQALADVAAAHTPDQLETLRVALLGKNGSITAQLKQLGTLPADQRKAAGEAINLARDALTTALSERKQVLETAALDARLEGERIDVTLPGRRGERGGLHPVTRTLERIVEIFARLGYELSDGPEIEDDWHNFEALNFPPHHPARAMHDTFYFGDGRLLRTHTSGVQVRYMDTAVATKSGPPLRMIAAGKVYRSDSDQTHSPMFHQVEGLLVDEHSNFADLKGTLSEFVRAFFERDFEMRFRPSYFPFVEPGAEVDIAWQQPDGSTRWLEVLGCGMVHPNVLRSVGIDPERYTGFAFGLGVERFAMLRYGVNDLRAFFENDVRFLRQF

SEQ ID NO: 15543 - protein, 672 aa, Xanthomonas campestris
PLHYPQFDKIKDSDFAPAFDAGMAAQLKEVDAIANQKAKPTFDNTIIALEKSGATLDRATTVFFNLVGADTNDARKKLQADYSAKFAAHRDAISLNGKLFARIQTLYDQRSKLGLDAQGVRLVEKYYSDFVRDGAKLSDADKTTLKAMNAELANLGTTFSQNVLAEVNAAAVVVDDVKQLDGLSDEQIAAAAEAAKARKLDGKYVIALLNTTGQPPLTQLKNRELRKKIYAASVSRGSHGGQYDNTALVSRIMTLRANKAKLLGFPTYAAYSLENQTAKTPEAVNAMLGKLAPAAVANAKREAADLQAMIDKEQKAARKPTFKLEAWDWAYYSEKVRQAKYNFDESQLKPYFELKNVLENGVFYAANQEYGLTFKQRTDLPTYRDDITVYDVFDADGKQLAIFIADMYARESKRGGAWMNSYVSQSELTGFKPVVANHLNIPKPPAGQPTLLTWDEVTTMFHEFGHALHGMFSDVKYPYFSGTSVPRDFVEFPSQVNEMWADEPSILKNYAKHYQNGTPMPQALLDKVIAASKFNQGFATTEYLGAAMLDQNWHQISANQVPDAAGVMAFEAKALADDGIAYPPVPPRYKTPYFSHIMGGYAAGYYAYIWSEVLDANTQQWFKQHGGLSRANGDRFRQTLLSRGGSVDAMELFQNFAGHAPQIEPLLEKRGL

SEQ ID NO: 15544 - protein, 638 aa, Xanthomonas campestris
PTPPAHAAPGTLCPCQHPDPAPARPPPRTGPTLRERFDALRNLPPFLRQIWQTSRWLSASSIGLRVLRALMPIATLYIGKLIIDEAIHLVGQPPAFDSLTQALASGRLNRLLELLALELALAIGSDLLGRLVGYADALLSELFNNAASVRLMEHAAQLDLEDFEDPDRQDKLDRARRQTMNRMNLMSQLFGQVQDAITVASLAVGLLVYAPWLIVLLAIALIPAFIGEAHFNALGYSLNFQWTPERRQLDYLRQVGASVETAKEVKILNLHRFLITRYRRLADKFFQANRALARKRALWGALLAALGTLGYYAAYGYIAWRTVRGDFSIGDLTFLAGSFLRLRQLLEGLLIGFSQVAGQALYLDDLYSFFNIVPEIRSRPNALPVPRPIRQGFVFEDVGFRYPEAEHWTMRHLNFELRAGEVLALVGENGAGKTTLVKLLARLYDPDEGRILLDGRDLRDYDLDDVRANLGVIFQDFVRYHLSIGENIGVGQVDAMDDTDRIRTAAQRAMATELIDSLPDGYNQLVGRRFKNSVDLSGGQWQKIAIARAYMRDAQLMILDEPTAALDARSEFEVFQRFKELSDNRTAVLISHRFSSVRMADRILVLADGRIEASGTHAELMAQGGRYAELFELQAAGY

SEQ ID NO: 15545 - protein, 203 aa, Xanthomonas campestris
LYHAPSTAALVVHWMLIELQVPHVLHPLDFDRREQKSPAYLALNPAGVVPTLVLEGQVLTEAAAIVLHLADLHPQAGLAPPPGTPARAAYYQWMFFCANTLQPAYRAWFYPDEPAGAQQADAAQAQARRKLEAAWAQVDAHLQAHGPYLLGDTLSAADFLLTMLMRWSRNMPKPTDTWPALHAHAQRMKARPAFRETYRREGL

SEQ ID NO: 15546 - protein, 376 aa, Xanthomonas campestris
PPRPAPMSKHRTRPLMLIALAAAPLAHGQEIAPQPASPQACTSVTSDAARLACYDQALGYTPQAVQEADAAAQLAKQAAKSEDTRKISRMGDFFRADGQDQPKEEAVANAGRGSLLDRRWELAKDSKLGTFQLRGYKPVYLLPAFWTSDTNRTPQSPNPANSVSTPQQLDSAELKFQLSFKTKVVEDLFGDNGDIWMGYTQSSRWQAYNSDASRPFRETNYEPEAMLVFRNNYSIFGWKGRMSGISINHMSNGREDPLSRSWNRVILNIGLDRENWALTLRPWFRIKEDRADDNNPDIEDYMGRGDATLVYNKDGHEFALIARHSLRGGDRSHGSVQLDYGFPITNLLRGHVQVFDGYGESLIDYNHKATYVGVGV

SEQ ID NO: 15547 - protein, 371 aa, Xanthomonas campestris
PDDLFDVRAQLSDDERAVQDAVARFTDARVLPGIGEAFDAVRFPRELVPELAALGLLGASLPVSEGGAGLGAVAYGLICQELERGDSGLRSFVSVQSSLCMYPIHAYGSDAQRRQWLPEMAAGRVIGCFGLSEAQGGSDPAAMTTRAVRDGDGWRLRGAKMWITNGSIADLAIIWAHTDDGVRGFLVDTRSEGFRAQDIGHKMSLRASVTSAVFLDDVFVPEQQRLPDALGLKAPLGCLSQARFGIAWGAIGAAVACLREALAYSGERILFGRPLAATQSAQIKLADMARRIATAQLLALQLGRLKEAGTLRPEQISLAKWNNCRMALDVARECRDLLGAAGITTEHVAIRHALNLESVITCEGTETVHRF

SEQ ID NO: 15548 - protein, 658 aa, Xanthomonas campestris
KRPSSDKLIASEGAMADVYPVDPAFAADARITREQYATLYRESIEHPEQFWGKAAQRLDWFKQPTQIKDVSFALDDFHVRWFGDGELNASVNCLDRQLATRGDKTALLFEPDSPDSPSYPVTYRELYERVCKLGNALRNLGVKKGDRVTIYLPMIVDAAVAMLACARIGAVHSVVFGGFAANSIADRVIDCQSKLIITADEGLRGGKKIPLKANVDAALKIPGTNTVETVLVVRHTGGAVDMQAPRDRWFHDVVDGQPAECEPERMNAEDPLFILYTSGSTGKPKGVLHTTAGYLLFASYTHEVVFDLREDDIYWCTADVGWVTGHSYIVYGPLANGATAVMFEGVPNYPNVSRFWEVIDKHQVTIFYTAPTAIRALMREGEAPVKKTSRSSLRLLGSVGEPINPEAWRWYYEVVGDSRCPIVDTWWQTETGGILISPLAGAVDLKPGSATLPFFGVQPALVDAEGKILEGATEGNLVLLDSWPGQMRTVYGDHQRFIDTYFRTYPGSYFTGDGCRRDTDGYYWITGRVDDVINVSGHRIGTAEVESALVSHPKVAEAAVVGFPHDVKGQGIYAYVTLIAGETPSEELHKELVSWVRKEIGPIASPDHLQWAPGLPKTRSGKIMRRILRKIAENAPDQLGDTSTLADPSVVDSLVNER

SEQ ID NO: 15549 - protein, 257 aa, Xanthomonas campestris
MKIASWNVNSLNVRLPHLQQWLADFAPDVVGIQETKLEDHKFPDAALAALGYRSVFCGQKTYNGVAILSRSPALEVQMGIPGFDDVQQRVIAATVDGVRIINLYVVNGQDVGTDKYAYKLRWLEAVHDWIAQELQRHPQLVVLGDFNIAPDARDVYEPEVWSDNHILTSTAERGALHKLLALGLHDAFRLHHDDAGHFSWWDYRQAAYRRNLGLRIDLTLVSDALRARAVEAGIDREPRTWERPSDHAPAWVRLAEA

SEQ ID NO: 15550 - protein, 266 aa, Xanthomonas campestris
VVSVHVENRIAWVKFARPDKRNAMSPALNRRMLDVLDELEFDDNVGVLVLGGEGTAWSAGMDLKEYFRETEAQGLRGVRRSQRESYGWFRRLRWYQKPTIAMVNGWCFGGGFGPLFACDLAIAADEAQFGLSEINWGILPGGGVTKVAVELLSMRDAMWMTLTGELVDGRKAAEWRLVNESVPLERLETRTREVAELLLKKNPVALKYAKDAVRRVGTMTYDEAEDYLVRMQEAANSFDNNARKEGIRQFIDEKRYKPGLGAYEPD

SEQ ID NO: 15551 - protein, 461 aa, Xanthomonas campestris
PWGLFIDGQWRASTGSQTLDVIAPHTEERLLRYTEPSHADTEAAVAAARRAFDSGPWPQLPPPERGAALKRIAEHLRARMPELADAWTAQVGAVIGFSRRASKQAPDLFDYYGDLITTHPFVEPRTRSSGGRVHVVQEPVGVVVAITPWNAPLVLLCYKVAAALAAGCTVVAKPSPETPIDAYILAECISAAGLPDGVFNLLPAGREVGEQLIRHPSVDKVSFTGSTQAGRSIGVACAERLARVGLELGGKSAAIVLEDADIEKVLPSLVPYSMPITGQVCFALTRVLVPAHRREAILHAYCSALATLKLGDPFAADTGMGPLALGRQLERVQGYIAQGSAEGAKLVMGGGRPEHLPRGFFLEPTVFAGVTPEMTIAREEIFGPVVSFIDYHNEEDLIAKVNDSDYGLHGTVYSDDPERAYAIARRVRSGSHSINGMCVDIEMPFGGVKHSGIGREGGIEG

SEQ ID NO: 15552 - protein, 473 aa, Xanthomonas campestris
PQRLAARDLLLQQEWTYAELDDLIGRLAAVLQTRGCVDGERLAVLARNSVWQVALHFACARVGAIYVPLNWRLSGTELDALLQRAEPRLLLGDDVAAGRAQVEGFARFIDNAKQLAPAETPYIPPDRVSLILFTSGTSGQPKGVMLSEQNLQQVAHNFGVTTRVEAHSSFLCEAPMFHIIGLATNVRPVLAMGGSIQVSNGFEPKRTLGWLGNPALGITHYVGVPQMMQAFRSQPGFDPAALRHLTALVSGGAPHASEDLLGWLEDGIPMVCGFGMSEAGTVFGMSVDCEVIRSKLGAAGISSPTVQTRVVDNEGNDCEVGMPGELLLRGPNLSPGYWRDPQATAEMRDGAGWFRTGDIVRRDADGFFWVVDRKKDMFISGGENVYPAEIEAVLADHPEIRECAVVGMADAQWGEVGYLAIVPATETPDLERIRSYLSERLAKYKVPKHLRVVAALPRTATGKLQKARLKDAL

SEQ ID NO: 15553 - protein, 170 aa, Xanthomonas campestris
  unsure (1)..(170): unsure at all Xaa locations
VFALMKLSLIVAFDRNHAIGRDNDLPWKLPDDLKRFKALTLGKPILMGRKTAQSLGRALPGRLNLVLTRSGQVPFEGMHAVVSVDEAIERAAQEGAQELCVIGGGEVYRLTMERADLLAVTEVDTAVEGADTHFPPIDPAVWVPAERSAHAADARHAFAFSFVDYQRRXR

SEQ ID NO: 15554 - protein, 234 aa, Xanthomonas campestris
  unsure (1)..(234): unsure at all Xaa locations
MKQLSLRALLCALAIASSPLQAAAPPAAPQVPAQVSNAAWEQDMQRFVASDAQQPPPKHGIVFVGSSSIRFWETLAQDFPGKPVINRGFGGSEVRDSTWYADRIVIPYAPRQVVLYAGDNDLNSGRSPEQVRDDVVAFVTRIRSALPQARIGYLSIKPSPSRAQLLPAIVRANQLIKQALAKVPRTDYIDIYTPMLDATGKPRPELFREDMLHMKPEGYALWRKAVAPVLERKX

SEQ ID NO: 15555 - protein, 151 aa, Xanthomonas campestris
SHPIYELPIDVNQIQTLIPHRYPFLLIDRVIELDLEAKRIVGQKNVTINEPFFQGHFPTRPVMPGVLIIEALAQAGGVMTQLGLGRDALSKLFYMVKVDNARFNKQVVPGDVLILEVQMKRLIRNMGCYYGEAKVNGEIVASAEVMCAGAR

SEQ ID NO: 15556 - protein, 303 aa, Xanthomonas campestris
PFSDVLQRDGEVVLDGALATELEQRGCDLNDALWSARVLMEQPELIYQVHRDYFAAGAQCAITASYQATPQGFAARGLGLAQSQALIARSVALAAQARADHLAAHPQAAPLWVAGSVGPYGAYLADGSEYRGDYALPVAQMLDFHRPRIAALVDAGVDLLACETLPSASEITALRLLLEEFPQVHAWFSFTLRDAAHLSDGTPLAQVIPALDACPQVVAVGINCIAIEQVTAALQSLAALTSLPLVVYPNSGEHYDASDKRWHAGTTVACSLATQRAQWHAAGARLIGGCCRTTPADIAALVA

SEQ ID NO: 15557 - protein, 460 aa, Xanthomonas campestris
EPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMASARWFAEGEFWFSLIKVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARR

SEQ ID NO: 15558 - protein, 268 aa, Xanthomonas campestris
WLRALPFIALHLACFAVFWVGVSWFAVGMAVALYALRMFALTGFYHRYFSHRAFKTSRVVQFVFAAIAATCVQRGPLWWAAHHRNHHRHTDTGRDPHSPAQHGFWWSHTGWFLTPRNFRTDWEVIPDLRRFTELRFLDRFDIVMPVLLALGLYLLGDWLAAAAPGLQTNGAQLLVWGFVLSTVALFHATFTINSLAHRFGSRRFDTRDDSRNNWLLALLTFGEGWHNNHHFFPGSARQGVRWWEYDMTWYGLTVMSWVGLVWDLKPMP

SEQ ID NO: 15559 - protein, 645 aa, Xanthomonas campestris
TKRFAGQLHLSAADRARRSNVRGKPTGRPGSSSSRRNDGGRGSNQSNSGPHGFERPTAPVVREVAIGETITVADLAQKLALKGGDVVKALFKMGVMATITQSIDHDTAALVTEELGHKAVRADNADFEDALLAHAEDAQGETTSRPPVVTIMGHVDHGKTSLLDYIRRTKIASGEAGGITQHIGAYHVETGRGVISFLDTPGHAAFTSMRARGAKITDIVVLVVAADDGVMPQTKEAVAHAKAAGVPLIVAVNKIDKAGADPLRVKNELLAENVVAEDFGGDTQFIEVSAKVGTGVDTLLDAISLQAEVLELKAVADGRASGTVIESSLDKGRGPVATVLVQQGALKRGDYLVCGIQYGRVRALFDETGHQPASAGPSIPVQVLGLSGVPEAGDDFVVVDDERLAKDVAQQRETKRRESRLVASATNRMEDILAQMGKGEGQQVLNLVIKADVQGSVEALKQSLVALSNDDIRINVIHSGVGGITESDANSAAASKATIIGFNVRADASARKIVESNGIDLRYFSIIYDVIDQVKQVASGLLGVEIREEIIGIAQVRDVFRSSKFGAVAGCMIIEGVVKRSKPIRVLRDSVVVFEGELESLRRFKENVDEVRNGTECGIGVKAYNDVKAGDQIECFERIEVARTL

SEQ ID NO: 15560 - protein, 470 aa, Xanthomonas campestris
GDWVPGSGGTLQIHEPATGGLLHEVGKADLSDVEAAIAQAKHAQRAWAITSPRERAAVFHRAAQLMEAHRAEATLLIARETGGIMPKAEREVSEAIAYYQQAAGLPLQAMGQVLPTAAGQLSLARHLPLGIIAVISPFNFPLILSLRSVAPALAMGNAVILKPDPRTPYTGGVIIAQVLEEAGLPKGLLHVLHGGADIGQALVEAPDVPMIAFTGSTAAGRRIGELAGRHLKKVALELGGNNAVIVLDDADLERAASAIAFGAYLHQGQICMATGRVLVQRGVADALTKLLADKARHLPVGDPVSGTVALGPIIGQRQLQRVLDIVDDSIDAGAVVEAGATHDGLFYAATVLSNVRPGMRVFDEEVFGPVINITVFDTDEEAAVLANHGEYGLVAGIMSASVSRAMVLGEQLHTGLLHINDQTVADEVINPFGGTGASGNGTSVGGPADWEQYMHWQWLTIKHAVPQYPF

SEQ ID NO: 15561 - protein, 497 aa, Xanthomonas campestris
MEKKYVLAIDQGTTSSRAMLFDRQGKVAGVAQREFGQIFPQPGWVEHNPREIMTSVYTTITELLNNAQIDAREISGIGITNQRETAVVWDKATGQPIYNAIVWQSRQTKDICTQLKEAGHEQMVRDKTGLLIDAYFSGTKVKWILDHVDGARERARKGELAFGTIDSWLIWNLTGGKVHVTDYTNASRTMMYNIHTLEWDAELLEMLDVPAQMLPEVRSSSEVYGMTQTQYFYGEQVPIAGIAGDQQAALFGQACFEPGMAKNTYGTGCFMLMNTGDKAVASKAGLLTTIAWGIDGKVEYALEGAIFVAGSVVQWLRDGLRMFGKASDSQAYAERAGDNDGVYFVPAFVGLGAPYWRSDIRGAVFGLTRGTSKEHFVRAAVESMAYQTRDVLTAMQSDSGIELKELRADGGAIANDFMAQFQSDILNVPVLRPEVAETTALGAAYLAGLATGFWSSREEIAKQWAVDRRFEPNMPEERREQLYAGWQQAVEATMGFR

SEQ ID NO: 15562 - protein, 501 aa, Xanthomonas campestris
APMGETYDLLVIGGGINGVGIARDAAGRGLSVCLCEQDDLAAHTSSASTKLIHGGLRYLEQYEFALVGKALAEREVLLRLAPHIIWPLRFLLPHQPHLRPAWMIRAGLFLYDHLGGSKRSLPRSRRLSLRTHPVGQPLQESLRTGFVYSDAWVQDARLVVLNAMDAAKRGAQIHTRTRCVGAWRDAGFWYAELEGRDGRRRTVQARALANAAGPWAVSFLDKVAAVPHQHALRLVKGSHIVVPKLFDHDHAYIFQQPDRRIVFAIPYEHDFTLIGTTDVDYEADPSAPKIDPAEVQYLCDAVNLYFQQQITPQDVVWNYSGVRPLLDDAEDNAAEVTRDYQLEVLTDGAPLLNVFGGKLTTYRKLAEEAVDRLTQALGARKPAWTARGEALPGGEQRDIASLLERVRTARPWLPAATAQRLVRNYGTCAEQLLGDAQDMAALGQHFGADLYQAEVDYLCAREWAQTADDILWRRSKLGLRVDAEGRARLEAYLQTQPAAHA

SEQ ID NO: 15563 - protein, 400 aa, Xanthomonas campestris
EVYLVDGIRTPIGRYGGALSSVRADDLGAVPIAALLARHPQLDPAAIDDVYLGCANQAGEDNRNVARMSVLLAGLPSSVPGSTVNRLCGSGLEAVGIAARGIRAGELELAVAGGVESMSRAPWVMGKAESAFARNQHLHDTTMGWRFINPRLEATYGVELMGETAENVAQRYAISRDDQDAFALRSQQRTAAAQAAGFFDDEITAVAVAGRKGGEGVQVMRDEHPRADASAEALARLKPVFRQPGTVTAGNAAGLNDGAASLLLASARALHLHGLTPRARVLGFASAGVEPTYMGIGPIPATQRLLARLGLQIAQFDAIEFNEAFAAQALACTRAFGLADDAAHVNANGGAIALGHPLGMSGARLALTLLRQLDACNGRRGLASMCIGVGQGVALAIERV

SEQ ID NO: 15564 - protein, 654 aa, Xanthomonas campestris
KVLIANRGEIACRVIATCRRLGIATVAVYSDADRDARHVRLADEAIHIGASPAQQSYLRGDAILAAARASDAQAIHPGYGFLSENAGFADACAQAGVVFIGPPAQAIRAMGDKSAAKALMQRAGVPLTPGYHGDEQAPAFLRAQADAIGYPVLIKASAGGGGKGMRRVDASAAFEDALASCQREAQSAFGNAHVLVEKYVERPRHIEIQVFADTHGAVVHLFERDCSVQRRHQKVLDEAPAPGMTEQRRAAMGKAAVDAARAVGYVGAGTVEFIAGPDGDFYFMEMNTRLQVEHPVTELITGTDLVDWQLRVAAGLPLPKRQDELRIHGHALEARLYAEDADRGFLPSTGTLRQLRLPAASAHVRIDAGVEQGDTISPYYDPMIAKLIVWDHDRPAALARMRDALAHCHAIGVTTNSAFLARLVSTQAFANADLDTALIEREQAALFPAPQPPPMAWWCLAAVLVAKAAPHAAADPADPFSPWQLDDGWRIGAHAARTLVLEAAGGRRILAVRPTADGWQVDSADQTHTLRYHAHGEHLRVDMDGRQWRAQILRDGTAITVLSGAQRAHFQHHDALVEAEQPAQAEGGLTAPMPGRVVALVAPLGEPVRRGQALVVLEAMKMEHTLHAPADGTVQAYLVAEGDLVADGVALVEF

SEQ ID NO: 15565 - protein, 386 aa, Xanthomonas campestris
MHVPSLNFELGEDIDLLRESVAAFASHHIAPLAAAADHDNVFPAQLWRLFGEQGLLGLTVEEAYGGSGMGYLAHVVAMEEISRAGGAIGLSYGAHSNLCLNQLRKNATHEQKQRYLPKLCTGEHVGALAMSEAGSGSDVVSMKLRAEARGDRFVLNGSKMWITNGPDADVLVVYAKTDPSAGARGITAFIVEKGMPGFSTAQKLDKLGMRGSNTCELVFTDCEVPAENVLGTLNGGVRVLMSGLDFERVVLAGGPLGLMAAAMDVVLPYVHERKQFGEPIGTFQLMQAKLADMYVGLNACRAYVYAVARACDAGRTTRQDAAGAILYAAEKATWLTGQAIQVLGGNGYINEYPTGRLWRDAKLYEIGAGTSEIRRMLIGRELFERT

SEQ ID NO: 15566 - protein, 267 aa, Xanthomonas campestris
MTVPAFGLGTFRLKDQVVIDSVRNALALGYRAIDTAQIYDNEAQVGQAIADAGVPRDQLFVTTKIWVDRFSRDTLQPSLQESLRKLGTDYVDLTLIHWPSPKDQVPMREYLEALADAKAQGLTRAIGVSNFTIALTRQAIEILGADAIATNQIEVHPYLQNRTLIAFLREQGIHVTSYMTLAVGEVLKDPVIQAIAKRHDATPAQVTLAWALQQGYSVIPSSTKRANLESNLKAQSLHLSEQDMAEIAALDRGERLANPKAIAPDWD

SEQ ID NO: 15567 - protein, 255 aa, Xanthomonas campestris
HGMHSTTPITLITGGSRGLGRNAAHALAAAGHDIVLTYHRQADDAAAAVAHIQQLGRRAHALQLDTADVSTFADFAARLKDVLASWERNQFDALVNNAGTGLHAPIADTTADQFDALVNIHLKGPYFLTQTLLPLIADGGRILNVSSGLARFALPGSSAYAMMKGGIEVFTRYLAKELGARGISANTLAPGAIETDFNGGSVRDNAQVNAMVASVTALGRPGQPDDIGPVVAALLAPGTAWINAQRIEASGGMLI

SEQ ID NO: 15568 - protein, 666 aa, Xanthomonas campestris
MTQPTRRQLANAIRFLAADAVEAAKSGHPGMPMGMADIAEVLWNDFFRHNPNNPQWFNRDRFVLSNGHGSMLQYALLHLSGYDLPIEQLKQFRQLHSKTAGHPERSETPGVETTTGPLGQGFANAVGFALAEKLLAQRYNRPELEIVDHRTWVFMGDGCMMEGISHEAASLAGTWGLGKLVAFWDNNQISIDGNTAGWFSDNTPARFEAYGWHVIRDVDGHDAEKIKTAIEAALENSDKPTLICCRTKIGFGAPTKSGKESSHGAPLGKEELEGARKALEWPYGPFEIPEEIYAGWRAGGTGTLRQAEWEQLFDKYAKQYGEQADELTRRSRGELPADFIAQADAYIAKAQEDGQTIASRKASQLAIEAFAPLLPELVGGSADLAHSNLTLWKASKSVATDDPNANYVYYGVREFGMTAIANGLALHGGFIPFDATFLVFSDYARNGVRMSALNPAHAIHVYTHDSIGLGEDGPTHQPVEHLASLRYIPNNDVWRPGDAVESAVSWKAAITRKDGPSCLVFSRQNLQHQPRSAEQIKLIERGGYVLADAEGGTPDVILIGTGSEVGLAVEAKKTLDAAGLKTRVVSMPSTDVFDRQDAAYREQVLPNAVRKRVAVEAGVTGFWRKYVGLDGAVIGIDTFGASAPADQLYAYFKITAEHVVEAAKAL

SEQ ID NO: 15569 - protein, 431 aa, Xanthomonas campestris
  unsure (1)..(431): unsure at all Xaa locations
MTASPAARRPGLPLHWKMGIGFAIGLVLGLAVYYLAGSDAEWVRLVTKYVTTPFSQIFLNLIFMLIVPLLFSALVVGIAEMGDIRALGRVGWRTLGYTVVLSGIAVLLGLVLVNVLKPGAGVDPQLANQLIQENADRTREIISSSGNQPQGMDMLLSIVPNNVIAAASSNGAILSLMFFAVMFGVGMVLTADEKVATLKRGIEGIFEISMTLIGLVIRLAPYAVACFMFNLAALFGFDLLIRLGAYVGVVVLALGLHMVVSYGLAVKFAGRSPIGFFRQTQEATLMAFSTASSNATLPTALRVADEMGLPPRVSRFVLTVGATANQNGTALFEGVTVIFLAQFFNVDLSIGQQFMVMIVCILGGIGTAGVPSGSLPVVALICAMVGVNPVGIGMILGVNHFLDMCRTALNVTGDLALTTLVAKGEKXGIGN

SEQ ID NO: 15570 - protein, 679 aa, Xanthomonas campestris
MATRKFTQRSRIREGRPNPLGATWDGLGVNFALYSRNATRVELCLFDERGREQERIPLPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPENRGTFSALKTDELIDHISSLGVTAVELLPVHAFVDDQYLLEKGLRNYWGYNTLGFFAPQGRYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISANYGAEGETDNPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGNEMDEAAWHDPEARALMLRLDGRSPTTGLREIAANVTLLMLINAAPTSVAFTLPAMHDEHWRVLVDTAR

SEQ ID NO: 15571 - protein, 714 aa, Xanthomonas campestris
LQAIAAGLPGDAFAVLGPHVQADGRLRVRVLAPGAEALGLIDGRGKLLARMQASPIDGVFEGELPAEAAYRLRIVWPDVVQEIEDPYAFAPQIDESALLQIAAGDGQALRANLGARHVQVGEVPTVRFAVWAPHAQRVAVVGDFNGWEPRRHPMRQRSGGIWELVLPRVETGARYKYAITTADGRVLLKADPVARQSELPPATASVVASADAFAWTDAEWMARRSAAAEPAPLSIYEVHAASWRRDGHDQPLDWVSLAAQLIPYVQELGFTHIELLPITEHPFGGSWGYQPLGLYAPTARHGSPDGFAQFVDACHRAGIGVILDWVSAHFPDDAHGLSQFDGSATYEHADPREGMHRDWNTLIYNYGRPEVTAYLLGSAMEWIAHYHLDGLRVDAVASMLYRDYGRAEGEWVPNAHGGRENLEAVAFLRQLTGEIASQFPGVLTIAEESTAWPGVTAPISEGGLGFTHKWNMGWMHDTLHYMQRDPAARAQHHSQLTFGLVYAFSERFVLPLSHDEVVHGTGGLLGQMPGDDWRRFANLRAYLALMWAHPGDKLLFMGAEFGQWADWNHDRSLDWHLLDHAPHRGMQQLVRDLNRALRRVPALYRGNHRADGFEWSVADDARNSVLAFIRHDPDGGAPLLAVSNLTPQPHHDYRVGVPRAGGWREILNTDSAHYGGSNLGNGGRLLTEPTGMHGHAQSLRLTLPPLATIYLQAE

SEQ ID NO: 15572 - protein, 462 aa, Xanthomonas campestris
LFVVSEMADFIKAGGLGDVAAALPRALRHRYDVRVLIPGYRAVLARAGKVEIVGRVLAHAALPACDIGRIVQSDGLPIYILLSKELFERDGSPYVSTSGSEFEDNAIRFATLSHAAAQIAAGRAGLGWRPRLLHLNDWPCALAAAYVRWSGGTTPCLLTIHNLAYQGLVPYSMAAALGIPAERVSELEFYGQMSFLRGGIVHADHVNTVSVSYAQQITGPAQGCGLDRLLAGRAAKGALSGIVNGIDASWDPRTDEYLDSHFSVNHWQGRQANAAQVRKAFGLRESTGPLFAVVSRLVHQKGLDLICEVAPQIVAAGGQIAVIGGGEPEIEQQVAELTRRYPGQVGAFIGFEEGLARRMFAGADFLLMPSRFEPCGLSQMYAQRFGCLPIAHATGGLIDTVDDGVTGFLFQQASAEALRRCLERAFRTFRLPSLLSAMRRAAMLRPSGWDVAGKKYISLYER

SEQ ID NO: 15573 - protein, 395 aa, Xanthomonas campestris
MARPDLHERISSLRKLRVAQERVRVRRQVGRRDGVRLEIDGRWLTGFCSNDYLGLSQQFEVVAALQDAAARDGAGATASHLICGHHTAHETLERDIAEWLGYPSALLFGSGFIANLAVQQALLSEEDDVCVQDRLNHASLLDATRLAGCRLRRYPHLDVEGAMRQLKGAPEGAAMLASDGVFSMDGDVAPLRALSLVARMQEALFYVDDAHGVGVLGPQGRGCVADAGLGVAEVPLQLVTLGKALGGYGAVVVGEEALIRHLAETARPYIYTTALPPAQVAATLAAVRLARRDDWRRTRLTELIGTFRDGARRHGFELMASDTPIQPLLCGEEATVMAMSAALEQAGFLVGAIRPPTVPEGKARLRVTLSALHTPQQVQALVDAIVQARDVVSRQ

SEQ ID NO: 15574 - protein, 259 aa, Xanthomonas campestris
LKEHRMDLGIAGRWALVCAASKGLGLGCAQALAREGANVVIVARGREALEQSASNLRALPGAGEVRSVVADITTSEGRAAALAACPQVDILINNAGGPPPGDFRQWERADWLRALDANMLAPIELIRATVDAMRARRFGRIVNITSSAVKAPIDILGLSNGARAGLTGFVAGLARSTVADNVTLNNLLPGQFATDRLRGNFAAIAEQQGTSAEAVAAHKRAGIPAGRFGEPDEFGAACAFLCSAQAGYITGQNLLIDGG

SEQ ID NO: 15575 - protein, 197 aa, Xanthomonas campestris
MSQSDQPDSSVTQAQAEEAVRTLLRWAGEDPAREGLLDTPRRVAEAYGDWFSGYREEPRAYLERTFEEVAGYDELIVLRDISYESHCEHHMAPIIGKVHVGYLPRGKVVGISKLARVVESYARRFQVQEKMTAQIAQCIQDVLQPRGVGVVVEGAHECMTTRGIHKRGVSMVTSKMLGSFREDARTRAEFLQFIEVG

SEQ ID NO: 15576 - protein, 718 aa, Xanthomonas campestris
PGVTRALAEARHGDAFAVLGAHPSTNGRLLRTYHPGAEHVTAVLADGREVPLEAGPEPGLFAGELPAEGGYRLRIGWPGGTQDTADPYAFGPLLSDFDLHLISEGHHLQLADALGANVVEVDGVRGTRFAVWAPNASRVAVVGDFNSWDARRHPMRLRHQAGVWELFVPDVGPGAHYKYQLRGPHGHELPAKADPVARRAELAPGTASIVADPTPHQWSDDGWMATRARRQAHDAPMSIYEIHAGSWLREEGLDLDWDGLADRLIPYVADMGFTHVELMPVTEHPFGGSWGYQPLGLFAPTARFGSPDGFARFVDRCHREGIGVIVDWVPAHFPTDAHGLAHFDGTALYEHADPREGFHRDWNTLIYNHGRREVSGFLIASALEFLQRYHVDGLRVDAVASMLYRDYSRNAGEWVPNIHGGRENYETIAFLRRLNAVVREHAPGAVTIAEESTAWPGVTADVSHGGLGFHYKWNMGWMHDTLHYIGLDPIYRRYHHGELTFSMVYAYSERFVLPISHDEVVHGKGSLLGRMPGDDWQRFANLRAYLGFMFTHPGRKLLFMGCEFGQPTEWNHDAGLPWHLLDDARHRGVQTLVRDLNHLYAQYPALHAHDDDPSGFAWLVGDDAANSVVAFLRKGKRGDAPVLVVINYTPMVQQGYRLGVPQGGLWREVFNSDAGIYGGANLGNGGAVTAEPQSMHGHAQSLPLLLPPLGVIVLTPQG

SEQ ID NO: 15577 - protein, 249 aa, Xanthomonas campestris
NPFSLEGKVALVTGANTGLGQGIALALAEAGADIAAAGIQAPTETEEKVKAMGRRFVAIEANLISIEPVQRILDETLAGLGRLDILVNNAGLIRRTDAVDFSEQDWDDVMNVNLKSAFFMSQAAGRHFITQGSGKIINIASMLSFQGGIRVPSYTASKSGIAGITRLLANEWGSKGVTANAIAPGYMATDNTAQLRADQDRNKSILDRIPAARWGVPADLGGAAVFLASSASDYVNGAIIPVDGGWLAR

SEQ ID NO: 15578 - protein, 247 aa, Xanthomonas campestris
WGMLAVLLVFTQLTIFAVTLYLHRSQAHRGVDFHPVIAHFFRFWTWLTTSMITREWVAIHRKHHAKVETEEDPHSPQTKGIGQVFWRGVELYREARAQRADIEQYGKGAPNDWIERHLYTPHANAGPIALLVVNSVLFGLPGIALWAIQMAWIPFWAAGVVNGLGHWWGYRNFESADTSTNLTPWALWIGGEELHNNHHAFPSSARFSMRRWELDIGWIAIRCLQALGLAKVLRVAPSLDIRPNIAV

SEQ ID NO: 15579 - protein, 237 aa, Xanthomonas campestris
MSAFKDKSVLVLGGSRGIGAAIVRRFVSEGARVTFTYAGSVEAAQRLASDTGSTAVLADSADRDAVIETVRRSGPLDVLVVNSGIALFGDALDQDPDAVDRLLRINVHAPYHAAVEAARQMPPGGRIIVIGSVNGDRMPLPGMASYALSKSALQGLARGLARDFGPRGITINVVQPGPIDTDANPENGPMKDLMHSFMAIKRHGRADEVAGMVAWLAGPEASFVTGAMHTIDGAFGA

SEQ ID NO: 15580 - protein, 420 aa, Xanthomonas campestris
IFVNPQRRFQALLGIGGAITDSSAETFAKLPKQAQRQLLTAYYDPDKGIGYTLARTTIHSSDFSSGSYTYIKEGDAALKTFSVQHDAKYRIPMLRQAIAAAGGTLTTFASPWSAPAFMKDSNAMLKGGKLLPEYAQAWATYYTRFIAAYEKAGIPIWGISLQNEPMAVQTWESMLFSAEEERDFLKNHLGPTMAKAGYGDRKIIVWDHNRDMMVHRAHVIFDDPEASKYAWGMGFHWYETWAGFAPMVENVAAVAQAYPDKHLLLTEAAVEKFDPAKLQHWPNGERYGTAIINDLNHGAVGWTDWNILLDEHGGPNHVGNYCFAPVHANTRTGEVIYTPSYWYIGHFSKFIRPGAQRVSAASSRSNLATTAFVNSDGSLATVVMNATDVAIRYNLYVGDASSVLEIPAHAIQTVVWRSEA

SEQ ID NO: 15581 - protein, 287 aa, Xanthomonas campestris
MQNPLTQFPQPTFPEQTQEAPGTIHELQPKADHGEQSYQGFGRLQGRKALITGADSGIGRATAIAYAREGADIVLNYLPEEEQDAAEVVQLIQAEGRKAIAVPGDLKDEAFCNQLVERAVKELGGLDLLINIAGKQTAIKDIADITTEQFDATFKTNVYAMFWLCKAAIPHLPPGASIINTGSIQSYQPSPTLLDYASTKAAIVNFTKGLAQQVAEKGIRVNAVAPGPVWTPLQPSGGQPPEKIPEFGSETPMKRAGQPVEMAPLYVLLASQESSYVTGEVFGATGG

SEQ ID NO: 15582 - protein, 375 aa, Xanthomonas campestris
RQEHSSMKSRAAVAFGPGKPLEIVEIDVAPPQAGEVLVRITHTGVCHTDAFTLSGDDPEGIFPSVLGHEGGGIVEQIGEGVTGVKVGDHVIPLYTAECRKCKFCLSGKTNLCQAVRATQGKGLMPDGTTRFSYNGEPIFHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEQINEAFDLMHEGKSIRTVIHF

SEQ ID NO: 15583 - protein, 490 aa, Xanthomonas campestris
MPRFPDQLLYIGGRYVPARGGHTFEVVNPATGEVLANVHNAGADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLCGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 15584 - protein, 555 aa, Xanthomonas campestris
MQREYDYIIIGAGSAGNVLAARLTEDPGVSVLLLEAGGPDYRLDFRTQMPAALAFPLQGRRYNWAYETEPEPHMDNRRMECGRGKGLGGSSLINGMCYIRGNALDFDHWAKRPGLEDWSYRDVLPYFRKAETRDIGANDYHGGEGPVSVATPKNDNNVLFQAMVDAGVQAGYPRTDDLNGYQQEGFGPMDRTVTPQGRRASTARGYLDMAKPRDSLHIVTHATTDRILFAGKRAVGVHYLVGNSSEGIDAHARREVLVCAGAIASPQLLQRSGVGAPDLLRALDVQLVHDLPGVGQNLQDHLEVYMQYACTKPVSLYPALQWWNQPAIGAEWLFAGTGTGASNQFEAGGFIRTREEFDWPNIQYHFLPVAINYNGSNAVKEHGFQAHVGSMRTPSRGRVHARSRDPRQHPSILFNYQSTDQDWQEFRDAIRITREIIAQPALDPYRGREISPSADCKTDAELDAFVRARAETAYHPSCSCAMGTDDMAVVDGQGRVHGMEGLRVIDASIMPRIITGNLNATTIMIAEKIADRMRGRALLPRSTADYYVAGDAPVR

SEQ ID NO: 15585 - protein, 410 aa, Xanthomonas campestris
GKVVEVIGTMLKVAGVQVSLGEVCELRQRDGTLLQRAEVVGFSRTLALLAPFGELVGLSRQTRVIGLGRPLAVPVGSALLGRVLDGLGEPADGQGPLAGDDWVQIQAQAPDPMRRRLIEQPLPTGVRIVDGLMTLGEGQRMGIFAAAGVGKSTLIGMFARGTQCDVNVIVLIGERGREVREFIEMILGPDGLARSVVVCATSDRSSIERAKAAYVGTAIAEYFRDRGMRVLLMMDSLTRFARAQREIGLAAGEPPTRRGFPPSVFAELPRLLERAGMGETGSITAFYTVLAEDDTGSDPIAEEVRGILDGHLILSREIAARNQYPAIDVLGSLSRVMSQIVSAEQRQYAGQLRRLLAKHNEVETLLQVGEYRHGSDAVADEAIARIDAIRDFLSQPTDQLSDYDTILEQL

SEQ ID NO: 15586 - protein, 249 aa, Xanthomonas campestris
KHVLITGGAGGIGIELIRVFANASCRVTFTHRPGEDSRRRALDLVAAFGDDRVHAHALDVGDRRSHAAFMHALTMPVDIVIHNAGVGTKTVERAAATYKEQDEAFFRVNTIGPLWLSEDLIPGMQARGQGKILFMSSVDGGITHFPRFRAADGMSKAAVAFLGRQLAATLACTGIDVFTVCPGATDTPMFQASTLNALSPQQRQELEASLPGGRLIEPREIADLCFYLCRDEARILRGAVIDASLGLGV

SEQ ID NO: 15587 - protein, 351 aa, Xanthomonas campestris
YWDYIKVEQLLALQGGFDNDERGINNDEVLFISVHQIYELWFKLILRELSSSRNILAAHSSNSPEIVLAVRSLKRAISVFGQANQHFQLMETMTARDFLEFRERLAPASGFQSAQLREIEILLGLEDTQRISIGNGCSYRDALKLPGGAPSSSAQRVEARAADGPSFKHCLYDWLSRVPIDGSNAPADITRFLEAYLASLRAENDRRLKLASSGLAAAEIEQLRARYAAEDAGAQAFLLAEDDPQASDAERETRRAGRAAMLFIESYRELPQLAWPHALLESVLELEQAMLIWRQRHARMVERFIGRRIGTGGSSGVDYLDQTARYRIFTELWTVRSLLLRKAAVPQIRSS

SEQ ID NO: 15588 - protein, 874 aa, Xanthomonas campestris
FLQTADTKDKTKLSTGAAEHTPLMKQFFAAKSDYPDLLLFFRMGDFYELFYDDARKAARLLDITLTQRGSSGGAPIPMAGVPVHAYEGYLARLVALGESVAICEQIGDPALAKGLVERKVVRIVTPGTVTDEALLDERRDTLLMAISRSKQGYGLAWADLAGGRFLVNEVDSVDALEAEIARLEPAELLVPDEDNWPEFLRGRVGVRRRPPWLFDADSGRRQLLAFFKLHDLSGFGIDDKPCATAAAGALLGYVEETQKQRLPHLTSIAMEVASEAISMNAATRRHLELDTRVDGDTRNTLLGVLDSTVTPMGGRLLRRWLHRPLRLREVLVQRHHAVGSLIDTGADTDVREAFRALGDLERILTRVALRSARPRDFSTLRDGLALLPKVRTILAPLDSPRLQTLYAELGEHDATAHLLISAVAEQPPLKFSDGGVIATGYDADLDELRRLSTNADQFLIDLEQRERASSGIATLKVGYNRVHGYYIEISKGQAEKAPLHYSRRQTLTNAERYITEELKSFEDKVLSARERSLSREKLLYEGLLDALGGELEGLKRCASALSELDVLAGFAERAQALDWSQPELESAPCLHIERGRHPVVEAVRDQPFEPNDLDLHPDRRMLVITGPNMGGKSTYMRQNALIVLLAHIGSYVPASRAVIGPIDRILTRIGAGDDLARGQSTFMVEMAETSYILHHATPQSLVLMDEIGRGTSTYDGLALADAVARHLAHTNRCYTLFATHYFELTALADASHAGGGSGIANVHLDAVEHGERLVFMHAVKDGPANRSFGLQVAALAGLPKAAVQQARRRLAELEQRGGDSHAAEMAPAALDAPQQFGLFTAPSSAAQEALQALDPDELTPKQALEALYRLKALL

SEQ ID NO: 15589 - protein, 753 aa, Xanthomonas campestris
RTQVNAMTTEAKCPFNHSVVGAGTTNRDWWPKQLRVDLLNQHSARSNPLAASFNYAEAFKRLDLQTLKQELRALMTDSQDWWPADFGHYGPLFVRMAWHSAGTYRTGDGRGGGGRGQQRFAPLNSWPDNVSLDKARRLLWPIKQKYGQAISWADLMILTGNVALESMGFKTFGFAGGREDTWEPDQDLYWGRETKWLGGDDRYAHGSPGVDQAHGVLVKDDDSEVQHTRDLENPLAAVQMGLIYVNPEGPDGNPDPLLAAKDIRDTFGRMAMNDEETVALIAGGHTFGKTHGAADAAHVAAEPEASDLESQGLGWHNSFGSGKGGDTITSGLEVTWTTTPAQWSNDFFDHLFGFEWELSKSPAGAHQWVAKNAQAIIPDAHDASKKRLPTMLTTDLALRIDPAYEAISRRFHANPDQFADAFARAWFKLTHRDMGPRARYLGADVPAEELLWQDPIPALNHALIDAQDAAALKQTVLSSGLSVAQLVATAWASASSFRGSDKRGGANGARIRLAPQKDWASNEPAQLAQVLATLERIQADFNARQSGGKQISLADLIVLGGNAAVEQAAHAAGHAVTVPFAPGRMDASQAQTDVESFAVLEPVADGFRNYAKARYAVSAEALLIDKAQLLTLTAPEMTVLVGGLRVLGANTGQSHNGVFTTRPGVLSNDFFANLLDMRTEWKATSETKETYEGRDRATGEHKWTGTRVHLVFGSNSILRAVAEVYASPHDQQKFVQDFVPAWTKVMQLDRFDL

SEQ ID NO: 15590 - protein, 478 aa, Xanthomonas campestris
QVSRHLFGQFAEHLGTGVYGGLWVGPESSIPNTRGYRNDVLAALKAIAVPNIRWPGGCFADEYHWRDGIGAPGKRPISVNTHWGGVEESNRFGTHEFMDFTELLGTDAYVAGNVGNAAPDEIAQWVEYMTAGTRSSLAEQRRANGRQAPWKVPFFGVGNELWGCGGNMRVEYAADVYRRYQTFVKAPSDQKILKIAPGPNNDDYHWTEVMMREAGTLMDGLSLHYYTVPGGWPPRASSTDFDEAAWIETLSRTLVMDELITKHSAIMDRYDPAKKVALVVDEWGTWYAGLPGANPGFLHQQNSLRDALVAALNIDIFSAHADRVRMANIAQMINVLQAMILTDGDRMVLTPTYHVFAMYKPFQDATHLPLQLQPPDYRHGDIHVPAVHGSAVKAKDGHVYVALTNLDANSPATVSVAVDGVSVRGVEGQLLTAPTITAHNTFAAPRTVQPTAFTGARIQGNTLQVALPARAIVMLKLR

SEQ ID NO: 15591 - protein, 273 aa, Xanthomonas campestris
LRFTKMHGAGNDFVVLDLRNGTPPPDASLAARLADRHFGVGCDQILTIETPRSAEAVAAYRIWNSDGSHSQQCGNGARCVAAWLVREGTAQGDVFTIDSPFTAHRVERLDAGTYSVAMGVPQFEPTQIPLAGFAHARDEYALPVHGETVRFGAVSMGNPHAVVEVGRVDAAPVERVGALLQQNAAFPESVNVGFAQVVDPAHVRLRVYERGVGETLACGSGACAAAVVLMHRGRVERDVRVSLPGGELRIRWAGEQAQVVMSGPAVFVFDGEW

SEQ ID NO: 15592 - protein, 641 aa, Xanthomonas campestris
  unsure (1)..(641): unsure at all Xaa locations
SIALAGCSNESTPPASTAAAPAATAKAPVKADARNHDESSYAQPQLVVIKDLALDLKLDFDAKQIGGTATYTLDWKDKAAKQLVLDTRELSIAQVQADDGKGTLSPLQFVLAPADKTFGSMLTIETPDQPAKVVITYHTAPTASGLQWLEPAMTEGKQLPFMFSQSQAIHARSWVPLQDTPSVRFTYSAHVTSRPDVMVLMSADNDPKAARDGDYSFKMPEPIPSYLLAIAAGDVVFKPISARSGVWAEPSMADKAAKEFEDTEKMIGAAEKLYGPYRWGRYDMLVLPPSFPFGGMENPRLTFATPTVIVGDKSLVSLVAHELAHSWSGNLVTNASWKDIWLNEGFTTYVQGRITEALYGNEMAEMEREIDQGDLLAEVKGMAPADQALALPPLAERDPDEALSQVAYVKGAWFLQFLEQRFGREVFDPFLRGWFDDHAFQSATTDQFVDYLNKNLLAKHPNTVSAAEVDAWLKQPGIPAFAAKARSRSFSIVDTARIAWSGSGTLPNKQVTGEWGTQEWVHFLSGMGATLKPEQLKQLDDAYHFTGTPNGEIAMRWYPLAIRSGYIDARPAAGEFIERVGRRKLVLPIYAELLKTPDGITFAEQAFEKAKPSYHPITTASVAEMIAKAKAAPPAQPXWPG

SEQ ID NO: 15593 - protein, 593 aa, Xanthomonas campestris
AAVVDTDGEFTTNASNPDNWGGVGRDFALTRHSPLAEINRDNVKNLKMSWEMKTDATRGHEGQPLVIGSIMYMVSAYPNNVYAIDLASQDDGGKVLWKYTPQQDERSVAVACCDTVNRGASYADGKLVFGSLSGDVIALDAKTGKEVWKQKLGHPDKGETITMAPIIADGKVIAGISGNEFGVLGRVAAYNLADGKQAWSCDAAGTDKSICLGADFNKANPQHGQLGDLGVKTFPNDEWKRGGGAAWGWYSYDPKLKLLYYGTGNPGLWSPSYRCGKTSHEECNNGEHDNKWSMTLFARKIDTGEAVWGYQKTPFDQWDYDGINEPILVDLTIDGKEVPSVVQFDRNGFAYVLDRRDGTLLRAHKFVPANWAERIDMKTGRPVKVAAHSPLERGKKVQAFPSAMGGKDQQPCSVDPANSAVFFCGTNNWHMELEPQERGNTMMGLPYVFANVMMKPNEPGALGIVKAFDVVEGKSKWEIKEKFPVWSGTLVTDGGLVFYGTLDGWFRAVDKDTGKKLWEMKLPSGIIGNPIAYKANGHQYVAVFSGIGGWIGLPVAAGLDPADPYGALGAAGLAFGAGFDKIPLGGMVHTFRI

SEQ ID NO: 15594 - protein, 314 aa, Xanthomonas campestris
PTQRPDSMSALICGSLAYDTIMVFPDQFKNHILPDKVHILNVSFLVPRMRREFGGCAGNIAYNLHLLGGAPIPMGTVGQDFGPYREHFETLGIDLSRVKIIDDLFTPQAFITTDHDNNQITAFHPGAMMRSYENHVRDVSGVTLGLVGPDGREGMIQNAEEFAAGGIPFIFDPGQAMPLFNGPELREFIEQADYVVVNDYESNLLQERTGWNEQDIVSRVQAYITTQGPKGALVHTPEKTYDIPPAHERRVVDPTGCGDAFRAGLIYGIQHNYDWLTIGRMGNLMGALKVEHPGTQNQRFDFAEFNDQFKQQFG

SEQ ID NO: 15595 - protein, 405 aa, Xanthomonas campestris
LCLSLASQASAITQATGDGRAVSEPGIPATCQAVKAEHTASARQFAAALESAPPDTKNIQAALTACAGKNGSVLLTAGAGNAFLTGPLSIPTGVTLVVDQGVTVYGSRNPADYGSGCGTAGSKSGGCLPLISVKGTRSGVMGVRIGGRQGTIDGRGDLTMLGKSTTWWEFGENAKKANQVQNSPDLIKVQNSSAFTLYNVNLINAAYFHFFAHIVDGLTIWGTRVKSPATSPNTDGLDLDSVVNATVFDNDVMGGDDCVAIKTIASKSGNITLRNNRCYGTHGISIGSEVMSGVSNVLVDSTAITASDDAGNRSTDNNGLRIKTSIGKGGPVSLITYRNTCLYGVTSPLVINPFYSSGGSGTAPTFSQIVVNGLRTTGDAGLKGKGWILEGYNEQTPLDLVLANV

SEQ ID NO: 15596 - protein, 791 aa, Xanthomonas campestris
GAALAYEGGRLVAVGGSWYYVLAGIAVLVAGVLLALGKRAGLWLFGATLAATIVWALWEVGLDGWGLIPRLAWISVLGLVLLPFWGVARRRMQPLSGLGYVVVTGVLPVLGAALILWPLLVPRNVELADASKQPADAATPFSRGSVPSPDGNVAANHDASNWTAYAGSNLSNHYTPGAQITPENVKGLKVAWEFHTGDLKPKDSKLGYAFQNTPLKVGDLLYICTPTQKVIAVEAANGKERWRFDPQTNPKAMAGVAATTCRGVSYYQAPEGTAECPTRIFWPMVDGRLGALDAQTGKLCASFGNNGYVDLNAGTGNTKPGFVGPTSPPVVMRGVVIQPTGQVRDGQERDAPSGVVRGFDALTGQLRWAWDLGNPAITAEPPAGQTYTRSTPNVWSLMAADDELGLVYLPTGNAAGDFFGKGRTPQEEEYTASLVAVDAATGKERWHFRTVNHDLWDYDIGPQPNLVDWPVAGGGTRPAVIQATKSGQVFVLDRATGQPIMPVKQIAVPQGTDHGDWTASTQPVSPGMPNTVGAPSRDYETIVESDAWGMTPFDQLACRIEFKKLRYEGMFTPPSLQGSLSFTGNHGGINWGGVSVDLQRGIMVMNSNRLPYTEHVYPRTVMNELGVVSVFNGSSKTKGYMAQEGLAYGARKEPWMSPLNTPCVAPPWGYISGVDLRTQQVIWRRPLGTGYDQGPMGIPSKTKFEIGTPNNSGSLATAGGVTFIGASLDNFIRGFDTRTGKQVWETRVPAGPQAAPLSYTIDGKQYIVAAVGGHVRMETKSKNSVFAWALP

SEQ ID NO: 15597 - protein, 452 aa, Xanthomonas campestris
MSRLVVVSNRVAVPGESRAGGLAVGLLAALKERGGVWFGWSGKTVRGDSGGMHEQTDGDIKFVTMDLNKRDIDSYYNGFANRTLWPLLHFRLDLVDYDRATREGYLRVNRLFAEKLAPLLKDSDTLWIHDYHMIPLGAMLRELGVGCKMGFFLHVPMPSADLMQAMPDHARLFSTFYAYDLVGFQTQRDAERFKAYVRLFGGGRVLEGDLVEGPGGRRFSAAAFPIGIDTDLIANQAKASVSKQAVRDLRESLRGRQLAIGVDRLDYSKGLPERFQGFERYLERYPDQSGSLTYLQIAPVSRGDVNEYRQLRGQLEQIAGHINGGHAEPDWTPLRYVNQNFSHATLTGFYRAAAVGLVTPLRDGMNLVAKEFVAAQDPENPGVLVLSLLAGAADEMKEALLVNPHDLDGVADAIATAASMPLATRVERWHAMMDHLRKNNINHWRQRYLQAL

SEQ ID NO: 15598 - protein, 240 aa, Xanthomonas campestris
PLPSPPLLDDACALFLDVDGTLIDFAHTPEAVQLLPEVRDAIARLSERLGGAVALVSGRPLSQLDALFAPLLLPAAGLHGHELRSDAAARAAMPQDTSEWLHGLHKRAAALTHQHPGVLVEDKGVSVALHWRAQPLAGPDVLAFAQQEIAALSGHRLQPGDHVVEFVPEGSNKGLAVEQLMQQQAFAGRTPVFVGDDLTDEFGFQAANRLGGWSVLVGDRAQTDARFRVSGTAAVHAWLQ

SEQ ID NO: 15599 - protein, 858 aa, Xanthomonas campestris
MRMDKLTSRFQQALADAQSLAVGRDHNIIEPVHVLAALLDQSGGSTRPLLSQSGVNVPALRERLGEALDTLPKVSGQEGNLSIGNDLNRLLNQTDKLAQQHGDAFIASEWFVLAAADDASPLGVALRAAGGDKKKIEAAIDKLRGGETVQSENAEEQRQALEKYTIDLTARAESGKLDPVIGRDEEIRRTIQVLQRRTKNNPVLIGEPGVGKTAIVEGLAQRIINGEVPEGLRGKRVLSLDMGALIAGAKFRGEFEERLKAVLSDLSKNEGQIILFIDELHTMVGAGKADGAMDAGNMLKPALARGELHCIGATTLDEYRKYIEKDAALERRFQKVFVGEPTVEDTIAILRGLKERYAVHHGVEITDPAIVAAATLSNRYITDRQLPDKAIDLMDEAASRIRMEIDSKPEELDRLERRLIQLKIQREMLKKEKDEASRQRLADLESDIDKLEREFSDLNEVWKSEKAALQGTTKIKEQIEHAKLELEAAQRRQDYAKMSEIQYGVLPQLEKQMLLANEVEHHDFKLVQDRVTAEEIAEVVSRWTGIPVNKMLEGERDKLLRMEDELHRRVVGQEEAIKVVSDAVRRSRAGLSDPNRPSGSFLFLGPTGVGKTELCKALADFLFDSTEAMIRIDMSEFMEKHSVSRLIGAPPGYVGYEEGGYLTEAVRRRPYSLILLDEVEKAHADVFNILLQVLDDGRLTDGQGRTVDFRNTVIVMTSNLGSHQIQELSGDGSAEAYTQMKAAVMGVVQAHFRPEFINRLDDIVVFHPLDKAQIKSIARIQLQGLEKRLAERGLKLDLDDPALELLGNVGFDPVYGARPLKRAIQSQVENPLAQQILSGQYTSGDTVRVRTEGGHLAF

SEQ ID NO: 15600 - protein, 422 aa, Xanthomonas campestris
KPETIAVHGGYRPDPTTRAVAVPIYQTVAYAFDDTQHGADLFDLKVQGNIYSRIMNPTNDVLEQRVAALEGGIGALALASGQAAVTYAIQTIAEAGDNIVSSSALYGGTYNLFAHTLPQFGITTRFADYRDPQAFAGLIDERTKAVFVESIGNPRGNITDIEAVAAVAHAHGVPLIVDNTVATPSLLRPIDFGADIVVHSLTKYLGGHGNSIGGAIVDSGRFPWAAHKARFACLNEPDVSYHGVVYTEALGEAAYIGRARVVPLRNTGAALSPFNAFLILQGIETLPLRMERINANTLAIARYLQEHARVAWVNYAALPDHPEHALAQKYLGGHGSGVLTFGLPGGRAAGARFLDALQLFTRLVNIGDAKSLATHPASTTHRQLGPAELEHAGVSEDTVRLSIGIEHIDDLLADLEQALQGA

SEQ ID NO: 15601 - protein, 383 aa, Xanthomonas campestris
RAAVAQLRAHSDAPLCAYVYDLAALDAHAAWMRAQLPPGCTLFYAAKANAEPQILQTLAPYVDGFEAASGGELAWLHQQQPDAPLLFGGPGKLESELAQAVRLPDCTVHVESLGELQRLAAIARQIAQPDRRRIPVFLRMNIAVPGAQTTRLMMGGQPSPFGLDPDDLDAALMQLRASLALELRGFHFHLMSHQRDAAAQLHLIAAYLRTVQHWRQRHGLGPLLVNAGGGFGVDYLTPEASFDWAGFCAGLPAVLHAHGDGLQLRLEPGRYVSASCGWYLMEVLDIKRSHGAWFAIARGGTHHFRTPAAQGHDHPCVVVRGAHAPVLRDTPVTLVGQLCTPKDVLARNQRVAALAPGDCLAFPLAGAYAWNISHQQFLMHPPP

SEQ ID NO: 15602 - protein, 637 aa, Xanthomonas campestris
MISLRNFSMRRGERLLLSNVDLTMHAGYRVGVVGRNGTGKSSLFAAVKGELEADKGDVDLPGKVRTASVSQETPSLPDPALSFVLGGDIEVSAILQKEAEATAREDWEAVANAHQTMAELGAYDAEARAGKLLHGLGFPADTHHRAVSSFSGGWRVRLNLARALMMPSDLLLLDEPTNHLDMDAVLWLEQWLLKYPGTLLLISHDREFLDNVATHTLHLHGGTAKLYVGGYTDFERQRIEHLRQQQIAHDKEQAERAHLQSFIDRFKAQASKATQAQSRMKRLAKMAGTEAVRAEREFRIQFAQPNRLPFSLIRLNHLDAGYAASPRESGIGDGESQKRGSSDAITVLHDVGFGLEAGDRIGLLGPNGAGKSTLVKTLVGELAPLSGERSAHPDLRIGYFAQHTVESLHEGQSPMDHFRDLSPDGSNQAFRDFLGKWNFAGDRAFEVVDGFSGGERARLALALIAWQQPNVLLLDEPTNHLDLEMREALAEALSDFEGAIVMVSHDRHLIGLVCDSFWRVADGVVEPFDGDLDEYAAWLRSRPAAQGTKQKMAEVAPTPPPPTKPLPPKKAVNPHKLASAEKRVGELEAALADLDRQLANPANYPDADKMAVLGRERETTAQQLAAAEAAWMELLDG

SEQ ID NO: 15603 - protein, 698 aa, Xanthomonas campestris
MIDLPRRRMLQAGLAGGASTLLPSIARAAAIAPDRRSGTLEDLQHVVILMQENRAFDHYFGSLPGVRGFGDRFPIPAPPLPGAPARTVWLQPSEDGRQWLAPFALDTAAQFGYMRVQGTPHSWVDAQRAWDHGRLGNWPAAKHNHALGYYRRADIPFQFALADAFTVCDAYHAAIQTGTNSNRVFLWTGGNDPLARAGGPVIGNSHDNFPALGGFAEPYRWTTYVEQLQRAGVSWQIYQDMRDNFTDNPLAGFDVFRQAYSQTPGHDAQLRARGVSTRGVEQLREDVIGGRLPSVSFIIADAAGSEHPDPSSPAQGAAYTARVLDALTADPQVWSRTALLLMFDENDGFFDHMPPPAPPSPDPRAAGGFAGASSIATDDEYHRHPAPGEQKVDLPEWRGRPYGLGPRVPLYVLSPWSRGGWVDSQVYDHTSVLRLLERRFGVPCTAITPWRRAVCGDLTAAFDFSRTDTRPFVGTLPDISATATRAAALHQHTLPPLPPTLQPPEQAFGLRRSRAVPYRPRVQLDVVQARGEVVLRMANAGAAAVLHVYERYDLAAIPRRYTVGADAPLDGTWTTYDGRYDLWVLGPNGFHRHYRGDVGVAPLIADVAQDPGDAQALRLTLHNPGNVPVAVTLQPAAYANAQPREGVTIAPGQHHQRSWSAAATGGWYDLWIEHDGASQRLAGRVETGADSVSDPAMG

SEQ ID NO: 15604 - protein, 482 aa, Xanthomonas campestris
LVMVYHRLPYDEVVEHGELVRRAPRSPNGIIPSLLSFFEGGQRGSWVAWSVDDPKRGPFQTHTEVDAQRYPTLTAARVPLSKSEVDIFYKRFSKEAFWPMLHVFWERARFREDDWQVFLAVNRKFAQATSTEAAHGATVWIHDYNLWMVPAYLRELRPDLKIAFFHHTYFPSADVFNVVPWRREIIGSLMCCDYVGFHIPRQVENFVDVVRGVMPVERLAQESCAPRFLTYGCAVGLDTMTTCLRVADRDVALGAHPVGTDLRRIRAALSKPDVRNDIFKLRREIGARKLVLSVERLDYTKGTLAKLEAFERLLDSQRQLLGKVTLLMVCVPAAREMTIYRTLQTQIEQAVGRINGRFSRLDWTPVRFFAQALPFEQVVAHYAAAQVMWITPLRDGLNLVAKEFVAVQGIEGGSGVLVLSEFAGAAAELKGAVLTNPHDPADLAAGLLQALAMPDDEAAGRLRQLYDSVEYYNIDHWGRDFL

SEQ ID NO: 15605 - protein, 714 aa, Xanthomonas campestris
LAAAITLALAACSGKDSSGKESTTVPEKTATTQTPDAAPNPLLTASTLPFQAPPFDKIQDSDYLPAFEEGMRQHLADVRKIADNPEPANFDNTIEAMERSGETLTRVSRIFFGLVQADTSDARQKIQEEVAPKLAAHQDEINLDPKLFARVKAIYDQRDTLSLEPEQKRLVERHYEKLVRAGAQLSDADKTTLRKLNVEETTLSTQFHTKLVAASAAAAVVVDDKAKLDGLSEGDIAAAADAAKARKLDGKYLLTLQNTTQQPVLASLKDHDLRARVMKASQTRAEQGDANDTRQTIQRLAQLRAQKAKLLGFDSYAAYSLGDQMAKTPDAALKLLTDTVPAATAKARREVGEMQKVIDAQQGGFKLAAADWDFYAEQVRKAKYDLDESQIKPYFELDNVLQNGVFYAATQLYGITFKQRTDIPTYHADMKVYEVFDADGTSMALFYTDYFKRDSKSGGAWMDVFVEQDGLTGTKPVVYNVCNFTKPAAGQPALLSFDDVTTLFHEFGHALHGMFSKVKYPSIAGTSTSRDFVEFPSQFNEHWASDPKVFANYAKHYQTGAAMPDALVEKIKKAKTFNSGYATTEYLSAALLDLAWHTQPADAPLQDVSKFEADALKRFKVDLAEVPPRYRSTYFDHIWGGGYSAGYYAYFWSEVLDDDAFEWFKENGGLTRKNGDTFRAKILSRGNTVDLATLYRDFRGKDPSVKALLENRGL

SEQ ID NO: 15606 - protein, 328 aa, Xanthomonas campestris
MKILVTGGGGFLGQALCRGLVARGHEVVSFQRGDYPVLHTLGVGQIRGDLADPQAVRHALAGIDAVFHNAAKAGAWGSYDSYHQANVVGTQNVLDACRANGVPRLIYTSTPSVTHRATNPVEGLGADEVPYGEDLRAPYAATKAIAERAVLAANDAQLATVALRPRLIWGPGDNHLLPRLAARARAGRLRMVGDGSNLVDSTYIDNAAQAHFDAFAHLAPGAACAGKAYFISNGEPLPMRELLNRLLAAVDAPAVTRSLSFKTAYRIGAVCETLWPLLRLPGEVPLTRFLVEQLCTPHWYSMEPARRDFGYVPQISIEEGLQRLRSSS

SEQ ID NO: 15607 - protein, 338 aa, Xanthomonas campestris
MLFQNVSIAGLAHIDAPHTLTSKEINERLQPTYDRLGIKTDVLGDVAGIHARRLWDQDVQASDAATQAARKALIDANIGIEKIGLLINTSVSRDYLEPSTASIVSGNLGVSDHCMTFDVANACLAFINGMDIAARMLERGEIDYALVVDGETANLVYEKTLERMTSPDVTEEEFRNELAALTLGCGAAAMVMARSELVPDAPRYKGGVTRSATEWNKLCRGNLDRMFTDTRLLLIEGIKLAQKTFVAAKQVLGWAVEELDQFVIHQVSRPHTAAFVKSFGIDPAKVMTIFGEHGNIGPASVPIVLSKLKELGRLKKGDRIALLGIGSGLNCSMAEVVW

SEQ ID NO: 15608 - protein, 570 aa, Xanthomonas campestris
KKTVARFVAETLESAGVERIWGVTGDSLNGLTDALREMQSIEWMHVRHEEVAAFAAGAEAAVTGKLAVCAGSCGPGNLHLINGLFDCHRSRQPVLAIAAHIPSSEIGLSYFQETHPQELFRECSHFVELVTNPAQLPEVLHRAMRTAILQQGVAVVVIPGDIALMEVDKHLSAAWPVLRAPRLLPAAEDVQQLAEILQQSKAVTLLCGSGCAGAHDAVVALADTLGAPIVHALRGKEHVEWSNPFDVGMTGLIGFSSGYHAMLNCDTLIMLGTDFPYRQFYPKDATIVQVDRDPAALGRRTPLQLGIAADVGETIAALLPQLERREERGFLDKSLAHYRKAREGLDELAVPADEGEPLHPQFVTRLISQIADEDAVFTCDVGTPTVWAARYLRMNGQRRLLGSFNHGSMANAMPQALGVQAACPGRQVISLSGDGGFAMLMGDFISLAQLNLPVKVVVFNNASLGFVAMEMKAAGYLDTGTELRNPDFAAMSNAMGILGLRVETSSQLERALRQAFAHSGPALVDVRIATQELVVPPAIKLEQAKGMGLYLLKAVMSGRGDEVLALAKTN

SEQ ID NO: 15609 - protein, 340 aa, Xanthomonas campestris
MSDPTQKIAVLGAGSWGTALAALVARHGHPTVLWGRDAAMVDAIDRTHENPRYLPGIALPDSLRATTDLQQTIAGASWILVVVPSHAFTETIKLLAPLRPAGAGIAWATKGFEPGSGRFLHEVARDILGPSVPLAVVTGPSFAKEVTLGLPTAITVHGDDAAFAQVVADAMHGPTFRAYTGDDMVGAELGGAMKNVLAVATGVADGMQLGLNARAGLITRGLNEMLRLAAVIGARPETLMGLAGLGDLVLTCTGDLSRNRRLGLALGRGQSLSDAIREIGQVVESVQTADEVMRQAEQHGIELPISNAVRAVLHGEITPEAGLKELLARERKPEYPQTLF

SEQ ID NO: 15610 - protein, 250 aa, Xanthomonas campestris
MTHTRTNGTSWTLLSLRPSGEHAPLRRAVARHGGQLLAVSPWRLQINDTLQARDALRHALGAPIVVFTSPAAVHAAHRLLPLQRPGPAQWASVGEGTARALQACGIDAVVRPARMDSEGLLALPAFNPPLHAVGLVTAPGGRGMLAPALEQRGARILRADVYQRVALRLRASTVHVLETALPRSVMALSSSEALMLIVQQLPPSLATALKTRPVVASSDRMLEAARAAGFMQVHRAEGPLPAQLAAAAAA

SEQ ID NO: 15611 - protein, 432 aa, Xanthomonas campestris
SPMQGQPMPAARPVAILGGVRIPFCRQNTAYADVGNLGMSVRTLGALVERFGLHGQQLGEVAMGAVIKHSSDWNLAREAALSSGLSPLTPGITLQRACGTSLDSVITIANKIALGQIDSGIGGGSDTTSEVPIVYGKKLRARLLAANRAKATSDKLKALLRGFKLGELKPEFPGVAEPRTGKSMGEHCEDMAKEWNISRDSQDEWAVASHHKLAAAYERGFFDSLIAPFRGVSRDNILRADTSLEKLATLRPAFDKTSGRGTLTAANSTPLTDGAAAVLLSSEAWALAHGHTPMAYLRDAQVSAVDFVHGEGLLMAPTVAVPQMLARHGLTLQDFDIYEIHEAFAAQVLCTLRAWESEDYCRNRLGLDAPLGRIDPDKINPLGSSLATGHPFAATGARVVATAAKQLEERGGGRALISICTAGGMGVVAIVE

SEQ ID NO: 15612 - protein, 321 aa, Xanthomonas campestris
IYSRIAGTGSYLPEKVLTNDDMSKIVDTSDEWIRSRTGIRERHIVADDQTTSDLAYFASLKAMEAAGVTADEIDLIVVGTTTPDLIFPSTACLLQARLGNVGCGAFDVNAACSGFVYALSVADKFVRSGDAKTVLVVGAETLTRIVDWTDRTTCVLFGDGAGAVVLKADEDTGILSTHLHADGSKKELLWDPVGVSVGFGEGKNGGGALLMKGNDVFKYAVKALDSVVDETLAANGLDTHDLDWLIPHQANLRIIEATAKRLDLPMEQVVVTVDRHGNTSSASVPLALDEAVRSGRVQRGQLLLLEAFGGGFTWGSALLRY

SEQ ID NO: 15613 - protein, 312 aa, Xanthomonas campestris
VTESTLAFVFPGQGSQSLGMLAELAELHPQIRETFVEASDGAGVDLWALSQGGPEEMLNRTEYTQPALLAAGVAVWRLWNAQRGERPAVLAGHSLGEYTALVAAGALSLHDGAHLVRLRGQFMQAAAPAGVGAMAAVLGAEDALVREVCVEASGSQVVVPANFNSPGQIVIGGDAAAVDRALALLAERGVRKAVKLAVSVPSHTPLMREAANQLGEAMAGLTWHTPQIPVVQNVDAQVHAGHEAIRQALVEQLYLPVQWTGCVQALAAQGISRIAECGPGKVLSGLIKRIDKSLDARSLATPADYAGALDAW

SEQ ID NO: 15614 - protein, 247 aa, Xanthomonas campestris
MSKPLQGEIALVTGASRGIGAAIADTLAAQGATVIGTATSASGAAAIGERLAANGGHGRELNVTDAAAVDALIDAIGKEFGAVSILVNNAGITRDNLLMRMKDDDWQAIIDTNLTSVFRTSKAVMRGMMKARKGRIINIASVVGVTGNPGQTNYAAAKAGIIAFSKSLAKEIGSRGITVNVVAPGFIDTDMTKALPEDAKTALLQQIALGHLGQPDDIANAVAFLAGPTARYITGETLHVNGGMYMP

SEQ ID NO: 15615 - protein, 79 aa, Xanthomonas campestris
MSTIEERVKKIVVEQLGVKEEEVTTSASFVDDLGADSLDTVELVMALEEEFECEIPDEEAEKITSVQQAIDYVKAHVKS

SEQ ID NO: 15616 - protein, 409 aa, Xanthomonas campestris
RRVVVTGMGMVSPLGNDLATSWDGIIHGRSGIGPIRQIDASQFTTRIAGEIKNFDPTQFVSAKDVKKMDSFIHYGVGASFMALDDSGLEINESNAERVGAILGSGIGGLLGIEEQTIKLHEGGARKISPFYVPSTIINMLPGQVSLIKGLKGPTFSAVSACATSNHSIGTAMRMIQHGDADVMLAGGAERGSSPSSVGGFCAMKAMSTRNDDPTAASRPWDKQRDGFVLGDGAGVLVLEEYEHAKARGARIYAELVGFGASSDAFHMTAPSEDGEGAARSMAAAMRDAKLNPEQIGYLNAHGTSTPLGDMAETMAMKRALGDHAYKTMVSSTKSMTGHLLGAAGGVEAIFSVMALHTGIIPPTINLEEPSEGCDLDYVPNVAREVQVDAVMSNGFGFGGTNGTLVFKRI

SEQ ID NO: 15617 - protein, 204 aa, Xanthomonas campestris
ITLWGRRNSSNVRKVLWCLEEAGVAYTSIEVGGAFGGNDTPAYRALNPNGLVPALQDGALVLWESNAIVRYLAARYAPALYPHSPATRALGDRWMDWTTSTFAGVFRDLFWGVLRTPQAERDATRIATALQRCGELLAVADAALAQQPYLSGDDFAMGDIPLGSFIYAWVEIPIERPELPHLHAWYQRLRARPAYQRGVMTPLT

SEQ ID NO: 15618 - protein, 237 aa, Xanthomonas campestris
EGRIQLEPSWKARVGEWLLQPQMQELSAFLRQRKAANARVFPPGPQIFAAFDATPFEQVKVVVLGQDPYHGEGQAHGLCFSVLPGVPVPPSLLNIYKEIQDDLGIPRPDHGYLMPWARQGVLLLNAVLTVEQGRAGAHQNKGWEGFTDHVVETLNSEREGLVFLLWGSYAQSKGKVIDQARHRVFKAPHPSPLSAHRGFLGCKHFSKTNDHLQRRGLSPIDWSLPPRAALDLSLAGG

SEQ ID NO: 15619 - protein, 431 aa, Xanthomonas campestris
  unsure (1)..(431): unsure at all Xaa locations
MSDKPLTDLTFSSFDLHPALVAGLESAGFTRCTPIQALTLPVALPGGDVAGQAQTGTGKTLAFLVAVMNRLLIRPALADRKPEDPRALILAPTRELAIQIHKDAVKFGADLGLRFALVYGGVDYDKQRELLQQGVDVIIATPGRLIDYVKQHKVVSLHACEICVLDEADRMFDLGFIKDIRFLLRRMPERGTRQTLLFSATLSHRVLELAYEHMNEPEKLVVETETITAARVRQRIYFPSDEEKQTLLLGLLSRSEGARTMVFVNTKAFVERVARTLERHGYRVGVLSGDVPQKKRESLLNRFQKGQLEILVATDVAARGLHIDGVKYVYNYDLPFDAEDYVHRIGRTARLGEEGDAISFACERYAMSLPDIEAYIEQKIPGRAGDYRAADPVAAHTARNSVRXRGQRRRLATAWARSSPKHASSVRPTKR

SEQ ID NO: 15620 - protein, 1034 aa, Xanthomonas campestris
ITAAWLKDETEHVRELLEQARLPAAEQAKVQALAADLVTRVRARAQDQGAIEAFMRQYDLGSEEGVLLMCVAEALLRIPDQDTADKLIRDKLGEADWKKHVGGSDSVLVNASTWGLMLTGKLVQLNDLTRADVPGAFKRLIGRVGEPVIRLAVRQAMKIMGHQFVMGRTIGEALARSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIDGHPGYPVFTRKQNTDVSYLACARRMFAHSDALYPMFATHNAQTIAAVRAISAGKTYEHQKLHGMGDDLYAEVIPADRLGLPCRVYAPVGSHEDLLPYLVRRLLENGANSSFVNRITDEDVAIEDLIRDPVEAVSSFASIPHPKIPLPADLLRSQNQNRKNSMGANLANDNDLRQLADQLTAAIKPWNAAPLVPGAVITTPSEAVLNPADRRETVGHWQPADPATVQKALASAAAAQPAWNRTPAASRATILEHAADLLEARMPEFMAICVKEAAKTLPDAVAEVREALDFLRYYAAQARAQFGAPERLPGPTGESNELQLHGRGVFVCISPWNFPLAIFLGQVAAALAAGNAVIAKPAEQTNLVGFAAVKLLHEAGVPEAAVQFLPGDGATVGAALTNDPRVAGVAFTGSTDTARIINRTLAARDAAIGVLIAETGGQNAFIADSSSLPEAVVKDAISSAFISAGQRCSAARVLFVQEDIADKVMTMLAGAMGELKIGDPALLSTDVGPVIDADALKILEEHASRMDSEARLIGTTTLDSATAYGSFFAPRAYELKSLAQLQREIFGPVLHIIRWKADQLDSVIDQINATGYGLTLGVHSRIDETIDRITSRVAVGNVYVNRNQIGAVVGVQPFGGQGLSGTGPKAGGPHYLLRFATEKVVTVNTTAAGGNASLLTLGD

SEQ ID NO: 15621 - protein, 480 aa, Xanthomonas campestris
KNFHLPDLGEGLPDATIVEWFVKEGDPVRLDDPLVSMETAKAVVEVPSPFSGTVVKLAGAAGDVITTGAVLAQFALDASQPQRADGQDTGHGHGHGAPAAAPTPSTGESAAGPTTRVVASDEGGEIADADSDGGRDDAGTVVGAMQSSNAVQSEQAIAVGGVRAMPVVRALARKLRVDLTQVRATGPDGTVTLADVKQAAAAGTAQAVRGAVIAPIGGAAAASLGGDHGQRPAAAGTTSPQASNTTRTADQARSTLSASGKPMRTQSPGTLVKGQPEQLKGVRRNMARVMADAHTKVVPTTLNDDADLHAWQPGNDVTVRLVRGIVRACQAVPALNAWFDGEALSRTLHPQVDIGIAVDTEEGLFVPALRNADMLDAHGIRESINRLRQQVENRSIAASELSGYTISLSNFGMFAGRYATPVVVPPCVAIVAAGRARYQLTPVMGGVETHKVMPLSLTFDHRAATGGEAARFLRALIDDL

SEQ ID NO: 15622 - protein, 315 aa, Xanthomonas campestris
ITLIEAITQALAWELEHDPAVLVLGEDVGVNGGVFRATAGLQQRFGSARVLDTPLDETTIAGLSVGLAAQGMKPVAEAQFDGFVYPMVDHLICHAARLRNRTRGRLHCPMVLRVPWGGGIRAPEHHSEANEAIFTNVPGLRVVLPSSPQRAYGLLLAAIRDPDPVIYMEPKRIYRQYKEVVANDGEALPLDVCFVLRDGTDVTLVTWGAQVKEALEAADKLASEGISAEVIDVATLRPLDFDTIAESVAKTGRCVIVQEAPRTAGFGAEIAAQLAEKSMYDLLAPVERVTGYDTHIPLFRLEMKFLPSVERIVTA

SEQ ID NO: 15623 - protein, 358 aa, Xanthomonas campestris
VAAQFEIEYLQYMDADGQLVRDDLPADAANPQQLLALFKRMLFVRTFDSKSIALQRTGKLGTYAASLGHEATHVGIGASMRSGDVFAPSYREYGTMFERGVRPRDVLLYWGGDERGSDYPRDADAAIDFPICVPISTQCLHAAGAALSFKLQGKAQVAVACCGDGGSSKTDFYAALNSAGAYTLPLILCVINNGWAISVPRSAQTGAQTLAQKGLAGGLHCLQVDGNDLIAVLEAMRQARARALAGDGGTVIEFLTYRLTDHTTADDARRYRGEDEVKQAWTREPMLRLRRYLTAQGLWDEAQEEAWKAECGARIDEEVNAYLNTPVQPVEAMFDYLYGDPPAELLAQRAEVIALEAR

SEQ ID NO: 15624 - protein, 266 aa, Xanthomonas campestris
DLEGRLTYGGYLRLDQLLSAQQPLSEPAHHDEMLFIIQHQTSELWLKLLAHELRAAIVHLQRDEVWQCRKVLARSKQVLRQLTEQWSVLETLTPSEYMGFRDVLGPSSGFQSLQYRYIEFLLGNKNPQMLQVFAYDPAGQARLREVLEAPSLYEEFLRYLARFGHAIPQQYQARDWTAAHVADDTLRPVFERIYENTDRYWREYSLCEDLVDVETQFQLWRFRHMRTVMRVIGFKRGTGGSSGVGFLQQALALTFFPELFDVRTSV

SEQ ID NO: 15625 - protein, 349 aa, Xanthomonas campestris
NPMGIDGFEFVEFAAPAGQAAQLHDYFRKMGFTAVLRHRSRPITVYRQGGVNFLLNEDPDSFAADFAAAHGPCACGFAIRFRTPADTVLQTVLGNGGEAVQNKPDTRAVPAPVVKGIGDCMLYLVDRYGEAGSIYDADYEAIEGADQHPAGFGLTFIDHLTHNLYFGNMQQWSDYYERLFNFREIRYFDIKGAKTGLVSKAMTAPDGIVRIPLNESSDPKSQINEYLDAYQGEGIQHIACFTDDIYTSVERMRAAGVTFLDTPDTYFDVVDLRIPDHGEDVERLRRNKILIDADVDTKQRKLLQIFTSNCIGPIFFEIIQRKGNEGFGEGNFQALFESIERDQMKRGVL

SEQ ID NO: 15626 - protein, 422 aa, Xanthomonas campestris
YMTGFGNEFASEAVADTLPVGQNSPQRVAHGLYAEQLSGTAFTAPRGENRRSWLYRMRPAAVHGTFSLIEQSQFHNDFGHGPVPPDQLRWSPLPLPQTPTDFIDGLYTMAGNGSPEAMNGVAVHLYAANASMQDRFFYNADGELLLVPQLGRLRVHTELGMLELEPQQIGVIPRGVRFRVELRDGTARGYVCENFGGLLHLPDLGPIGSNGLANPRDFETPCAAFEQREGRFELVAKFQGHLWRADIGHSPLDVVAWHGNYAPYRYDLRRFNTIGSISFDHPDPSIFTVLTSPSDTHGTANMDFAIFPPRWLVAQHTFRPPWFHRNVASEFMGLVHGVYDAKADGFAPGGASLHNCMSGHGPDAATFDKASQADLSRPDVITETMAFMFETRAVLRPTAQSLHAPHRQGDYQQCWAGLRNAF

SEQ ID NO: 15627 - protein, 155 aa, Xanthomonas campestris
LQIRPATPADAALLHELVTALAVYEREPDAVKATPEDLRASLFGDGATAHALLCEQGGQVLGFAVYFFNYSTWLGRNGLYLEDLFVRPQARGQGAGLALLRHLAQLAVDKGCGRFEWSVLDWNQPAIKFYQAVGARPMECWTVYRLDGERLAAFA

SEQ ID NO: 15628 - protein, 663 aa, Xanthomonas campestris
RASRTLSALTRQLDDTNTAQARMQQELQRHGELEQELLRAKQAAEAASLAKGEFLATMSHEIRTPLNGIIPMLELISRGQLSLDQRDMLQTATGSSLQLLRIVDDILDYSKLEANKLELEITTFNLRELLDGVAQLMQRTAEGKQLRLGLDIEPSVRLLVRGDPIRLRQVLGNLIGNAIKFTERGSVDIQLRRLGETRAQHLLRFQVRDTGIGIAADQQARLFRSFAQADASTTRLYGGTGLGLAICKRIIDLMGGRIGVESEPGRGATFWFEIPLLKVIGDLQQTTGADAARVMVISSDARLSQRLKRLLDSWGISHVLMETTQEALERVRRHTDDEGFRCVIADHETLRYSARAVHRALARPEDLSGSRLIWLYGDEPVPDELQANATLVPRQSPDETLRALVLPPEPKPSVAPTLASAMIPEPLPPPVAHARDVRILLVEDNPVNLLVAQKLLGVLGFEADTATDGEAALSSMESTRYDMVFMDCQMPVLDGYAATRRWRAMETESGGRPIPIVAMTANAMAGDRERCLAAGMDDYLSKPVAREQLNACLQRWLPRQALLPGPSTGAPSADAESAASAAQARALPILESGVIDELYEVAGADTIRILQLFLEDAPGIIEGLEAAASNRDSMHLRDLAHTLKSSSANVGAQALANAARRIE

SEQ ID NO: 15629 - protein, 309 aa, Xanthomonas campestris
MHQQTLWLFSGIALVLVVATLISETLRWRARAQPSAVLDNLVARIRAWWVMAGVVGIAFVFGRAGVIGLFALVSLFALREFITLTPTRRGDYYALLAAFYIVLPWQYGLVWTGWYGMYTLLIPVYAFLVLPILATIGGDTTRYLERTAKVQWGLMICVFCISHVPALLNLEIPGYAGRNLLLIAFLVIVVQSSDVLQYVWGKLAGRHLIAPKLSPSKTVEGFIGGVLSASLLGMALWWITPFAPWHAFGLALVANLMGFFGGLVMSAIKRDRGIKDWGHMIEGHGGVLDRLDSVCFAAPVFFHLIRYGW

SEQ ID NO: 15630 - protein, 211 aa, Xanthomonas campestris
MIDLYYWPTPNGHKVTLFLEEAGLEYTLKPVNIGKGAQFEPAFLQISPNNKIPAIVDHAPAGGGAPLSVFESGAILLYLAEKTGRFLPRDARGRIAALEWLFWQMGGLGPMSGQMGHFTVYAPEKIPYAIERYNAEVRRLHGVLDKRLAEHAFLAGPEYGIADMASYPWIEVYGDLKPDYAAFPHVKRWHDAIAARPAAQRAYALKDKVNP

SEQ ID NO: 15631 - protein, 742 aa, Xanthomonas campestris
MRALFAALALMLSTVPMAHAEKLTLEAITGPLPLSGPTLMKPKVAPDGSRVTFLRGKDSDRNQLDLWEYDIASGQTRLLVDSKVLLPGTEILSDAEKARRERQRIAAFAGIVDYQWAPDAHALLFPLGGELYLYDLRKTGSAAVRQLTHGEGFATDAKLSPKGGFVSFVRARNLWVIDLASGKQLQLTRDGSDTIGNGVAEFVADEEMDRHTGYWWAPDDSAIAFARIDESAVPIQKRPEVYADHTEVIDQRYPQAGQPNVTVQLGVIVPRASATPQWIDLGKQADIYLARVDWRDAQRLTFQRQSRDQKTLQLIEATLASGKQRVLITETSPTWVPLTNDLRFLKDGRFLWNSERSGYEHLYVASEDGTTLTPLTSGAWVVDALLAVDEQAGLVYFAGSKDSPTQTHIYAVALGGGAIEKRSASNGTHAASFANNASVYVDTWSNTTTPPQIELFRANGEKIATLLQNDVADPQHPYAKYRQAQRPVEFGTLTAADGSTPLHYRLIKPAGFDPSKRYPVVVYVYGGPAAQTVVDAWPGRGDALFDQYLAQRGYVVFSLDNRGTPRRGRAFGGALYGKQGTVEVDDQLQGVAWLKTQRWVDAARIGVQGWSNGGYMTLMLLAKHSEAYACGVAGAPVTDWGLYDTHYTERYMDLPAGNAAGYREARIATHLDGLRAKLLLIHGMADDNVLFTNSTALMSGLQQRGTPFELMTYPGAKHGLSGKTALHRYKTAEAFLARCLQP

SEQ ID NO: 15632 - protein, 332 aa, Xanthomonas campestris
  unsure (1)..(332): unsure at all Xaa locations
MAHPHYRPRRMRHDAFSRRLMRENTLTTDDLIWPVFVHELPGRAPIASMPGVERLSLDELLREAENALELGIPVIDLFPVIDPAGKSLDAAEAWNPDGLAQRAVRALKARFPELGIMTDVALDPYTTHGQDGLIDAKGYVLNEITVEALVKQSLSHAQAGVDIISPSDMMDGRIGAIRRALDAEDHLNVRIMAYSAKYASAFYGPFRDAVGSAGNLGKADKTTYQMDPANSDEAMREIALDLEEGADMVMVKPGMPYLDVVRRVKEEFRVPTFAYQVSGEYAMLKAASANGWLDERKCVLEALMAFKRAGADGVLTYFAPQVARWLREDXAQ

SEQ ID NO: 15633 - protein, 283 aa, Xanthomonas campestris
MPVSRYAVFGHPVAHSLSPAIHADFGKQTGIALDYTAIDAAPEEFTAALERFAADGGKGANVTLPLKEAAFALSASLSDRARVAGAVNTLVRNDGQWQGDNTDGAGLVRDLTERHGLDLRGRRVLLLGAGGAARGVAPALLEAGITEMVVVNRSPERADALCDALGEPGRVVSRYLEDLRELGDFELIVNATAAGRDRDAGAFALPLGLVNSLTAAVDLNYGATAIAFLAWARSAQCRYAIDGLGMLVEQAAESFALWHGVRPQTDPVYDALRARDAVLVSAD

SEQ ID NO: 15634 - protein, 509 aa, Xanthomonas campestris
DAMRPGSLMVLALLAPTLIAPPVFAQSVLTRDNGAKVGDNQNSQTAGATGPTLLQDVQLIQKLQRFDRERIPERVVHARGTGVKGEFTATADLSNLTKAKVFSAGEKTPVFVRFSSVVHGNHSPETLRDPHGFATKFYTSEGNWDLVGNNFPTFFIRDAIKFPDMVHAFKPDPRTNLDDDSRRFDFFSHVPESTRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPDDLAKFDFDPLDATKIWPDVPEQKVGQMVLNKNVDNFFQETEQVAMAPANLVPGIEPSEDRLLQGRIFSYADTQLYRIGTNGLSLPVNRPRVAVNNGNQDGEANTGHTTSGVNYEPSRLEPHPQDTAARYSELPLSGTTQQAKITREQNFKQAGELYRSYSKKDRADLVQSFGESLATTDTESKHLVLSFLYKADPEYGAGVTRVAKGDLARVKQLASTLQD

SEQ ID NO: 15635 - protein, 180 aa, Xanthomonas campestris
LAVTANAASPAPVAAKAPTAAATPAQIKTQLQTYFFDAAREGRQDMLGEFIRSHYDLNTRDEKGYTALILAAYHGQAPAVEQLLQAGADPCAQDKRGNTALMGAIFKGELAIAKRLMQADCAPDQRNNAGQTAAMYAALFQRTDVLKDLAAKGADLSIKDAQGNEVTKLQRGEFATAPAR

SEQ ID NO: 15636 - protein, 166 aa, Xanthomonas campestris
NKLVFVGGMGAGKTTAVRAISDVEPVSTEMPLSQDAYGDKTYTTVALDYSSIELEDGELLHVYGVPGQKYLDFMWPLVCDGALGVIVLTSARDTQMRDTTLELLREFSRIAPEASLAVGVTMTDEVQEFLLPPFREALVAAGFRIPVMRVDARSATQITFLVKTLL

SEQ ID NO: 15637 - protein, 299 aa, Xanthomonas campestris
VSLIGVPTDIGAGHRGARMGPEALRIAGLQEALIGRGVEVRDLGNLDGPRNPWQAPQAGYRHLDEVVAWNQALMDASYAELCAGRMPVMLGGDHCLGIGSITAVAKYCREQHRPLRVLWLDAHSDFNTSEVTPSGNVHGMPVACLCGLGPQALTHLGGSAPAVLPEQIRQIGIRSVDPDEKRLIKQHRIDVYDMRYIDEAGMKRTMEAALQGMSADTHLHVSFDVDFLDPSIAPGVGTTVPGGPNYREAQLVMEMIADTGRMGSLDIVELNPVLDNRNATAELAVDLVESLFGKSTLMR

SEQ ID NO: 15638 - protein, 654 aa, Xanthomonas campestris
LNPPQSAAVLHCEGPLLVLAGAGSGKTRVIVEKIAHLIAIGRYPAKRIAAITFTNKSAKEMRERVAKRIRGDGADGLTICTFHALGLKFLQIEHAAAGLKRGFSIFDSDDAAAQIKDLMHGAKPDAIEDAKNLISRAKNAGMSPEQAMAAARSNREKEAASLYERYQARLTTFNAVDFDDLIRLPVQILEANEEIVMGWRERIGYLLVDECQDTNDAQYRLLKMLAGPRGNFTCVGDDDQSIYAWRGANPENLQQMGRDYPALEIIKLEQNYRCSNRVLRAANALIAHNPHEHLKTLWSDQADGERIRVWECRDSEHEAEKVAAEISFLGTAKQVPWSDFCILFRGNFQSRPLEKALQLLRVPYHLTGGTAFLERQEVKDVLSWLRLIVNPEDDAAFLRAVQSPKREVGATSLARLAELASAKSVPMSRAAESMGALQHLPPRAANGLSAFTDILRDMREHSATLPAGELVRTLADKSGLLNDLRNQSKDEAGFQRRKRNLDELAEWFEGGPRGASASDLAAQLALLSRNDKDDGGNQVRMMTMHASKGLEFRYVFIVGCEDGVLPHEVSLEEGNLQEERRLLYVGITRAKQQLWMSYSKLTRKFGEHVRLKPSRFFDEIPAAELQRDGADPVADAERKKERANAGLAAIQALF

SEQ ID NO: 15639 - protein, 792 aa, Xanthomonas campestris
RYDDGKPVVYVLEDYGLSNALILDKACREAGLPSPLVPLPGDPLERKRAYLALSRRSSSNSLIPEQRGGKTHSDSLAKLLQAHRVRADLDVHLVPVSIFVGRAPDKQSGWFAVLFSENWALVGRFRRLLSVLLNGRTTIVRFAPPISLRQTMAEGLPPERTLRKLQRVLRTHFRRIREAVIGPDLSTRRLLVDQVLAADSVREAIATQAKRDNSKPVDAWRKAHAYAWEIAADYSSPVVRSASFLLTHVWNRIYAGVLVHHLDKLKQAAPGHEVVYVPSHRSHMDYLLLSYLLYERGIVPPHIVAGINLNLPVVGTLLRKGGAFFIRRSIRGNALYSAVLSEYVAQLVAGGYSIEYFVEGGRSRTGRLLQPKGGMIAMTLRAYLRQPRKPVLFQPVYIGYEKLMEGNSYLDELTGRPKEKESIWGLLWSIPKVLKQNYGQVVVNFGEPIALNDVLAKHAPEWNDEPLPDDEKPTWLAPAVDTLATQIQTRINCAADVNPINLLALALLSTPKHAMGEADLIAQIELCKKLLAEMPYSDRVTVTPHTPARIITHAEEINVLTRVSHPLGDVLSVSGDTAVLLSYFRNNVLHLFTASSWVACCFQNNRRMSRAGLLRLGRTVYPFLQAELFLPWSEDRFAERIEQTIDMFVREGLLLNVTDDDGGILARNTGQTDEVFRLRAIGHSLQQAFERYYIAISVLVKNGPGVLGAGELESLCQQAAQRLSLLYAPAAPEFFDKTLFRSFIQKLRELRLVWPDENSKLMFDERLDAWAKDAKFILGRELRHTIERVSPE

SEQ ID NO: 15640 - protein, 837 aa, Xanthomonas campestris
  unsure (1)..(837): unsure at all Xaa locations
RHVRPPGHPGSAVAYVQPMFDDSAWQRVDLPHDWAIAGPFLADGPHGGMGRLPSWGVGWYRKALQIPASDRGRSLFLDLDGAMSYATVWLNGKLVGGWPYGYTSWRVDLTPYVVPGGHNQLTIRLDNPPDSARWYPGGGLYRNVWLTKTGPLRVAQWGTQLSTPQVSAERAQVQLAVQLDNAGAAPVQAQVSTALYALDDASGLRRGPAVAQIAAVQVQVAAGGNARVQGSTQIEAPRRWGPPPTQQPHRYVAVTEVSQGGRVVDRVETPFGVRSVVFDPDKGLVINGEHVPIRGVNNHHDLGALGAAFNVRAAERQLQLLQHMGANAIRMSHNPPAPELLELTDRMGLLVVDEVFDSWEMKKTPLDFHLIFPQWHEPDLRAMLRRDRNHPSIILWSVGNEVGEQYTGEAGAAIARRLHAIVHAEDPTRPATAAMNYASPEMPLPAALDVISLNYQGEGIRDTPEFEGTERIRKPPQYPAFHAKFPRKAILSSETASALSSRGVYLFPVSAQSSAPVRDGRGGDSVAHQVSAYELHAVDFGSSADKVFAALDRHPFVAGEFVWTGFDYLGGPTPYYSSRSSYSGILDLAGFPKDRYWLYQTRWRPELPMAHLLPHWSWPGREGQVTPVHVFTSGDEAELFVNGVSQGRKRKAPLQYRLRWDAVVYQPGELRVQAYKHGRPWASDRVQTAGRATRMQLSADRNQIRGDGKDLSFITVRLLDADGRPAPTAGDRLRFRVEGAGELVATDNGDPTNLEAFVLPERNAFNGLCLVIVRAKPGAQGPITVHVQSDTLQSASVQVLAEXAWCCPWSLAQLQRRPWPNARATAPAVTASLPGIT

SEQ ID NO: 15641 - protein, 372 aa, Xanthomonas campestris
MLLGLLGMAVSPIASAACAPGTTALKDAYAGGFLIGTAVNTDIVSGKDAASAALVGCHFNAVTAENVMKAEVVAPQPGVFDFTAADAFVADRQRRGMFIVGHTLVWHNQTPEWFFVDANGKPNTSQAQLERMRAHIARVAGRYVGKVQAWDVVNEIIDEDGSYRSTNWVQRVGDGDTVVRNAFAFAQRYAPDAQLYYNDFNAWRPAKRDGIVRMVKMLQQAGIRIDGVGMQGHWGLNYPSVQDIEAAIDAYAALGVKVMITELDIDVLPVTKEGQVIGTGFAHKQFQLPEFKHFLDPYPDGLPPQVQTQLRDRYAELFALFWRKRDKLARVSVWGVSDGMSWKNDYPVPGRTNYPLLFDRNHQPKPALDAVL

SEQ ID NO: 15642 - protein, 304 aa, Xanthomonas campestris
RLSLLMLLVIPLLALLSACTKSNAPPSRYPAIGHLESFHASFSDVVATDARIEKLTEGFTWSEGPTWVRQGGYLLFTDVPENKLYRWSDDSGLSVFLSPSGYAGTDVAALREAGANGLFAEPGGTVLLADSGTRIVARLDPATRTKTPLATSFDGKRFNSPNDVVRREDGVVFFTDPPYGLKGMNDSPVKELRFNGVYRLNTDGSVHLLDDSLSFPNGIALSPDQRTLYVANSDPARPIWMAYALDAQGAVTGKRVFADATDLVNKDTPGLPDGMAVSAEGRLFATGPGGVIVFDPDGRRLGRI

SEQ ID NO: 15643 - protein, 332 aa, Xanthomonas campestris
CIRQARQSSARMVAMNTTSDTALLVVNLGTPESPTAPAVRRYLAEFLSDRRVVAIPPLFWKPLLYGVILPIRGPKSAEKYAKVWLPDGSPLAVYTRRLTEGLQQVMPDWHVTWAMRYGAPALRKALDGLRARGIKRIVVLPLYPQYSTTTTASIQDVVDAWRPSAPEIAVEVIQDYCEDAGWVAAIADSIRTHWQVHGRSEKLMFSFHGLPQRVANAGDPYPQQCERSAQAIVTALGLGPDAWQMGYQSRFGAERWLQPYAEPTLWALAEGGVRSFDLVCPGFATDCLETLEEVALGFAETLAERGATLSYIPCLNDSTTHAQALAAVARRA

SEQ ID NO: 15644 - protein, 124 aa, Xanthomonas campestris
  unsure (1)..(124): unsure at all Xaa locations
ATLTDGXVSFKESVINDVIGVLGVKSGYNGGTKDNPTYKEVCSGSTGHAEAIRVRFDTDVVSYGEILDIFLATHDPTQLNRQGNDIGTQHRSAIFPHXAIQEREALKAIERARPDWRHPIXTTI

SEQ ID NO: 15645 - protein, 94 aa, Xanthomonas campestris
MNFRAMHDRVLVRRVEAEEKTVDGIIILDTAKEKPYEGEVATVGTVTKVVDGQVTPLDVKHGDRILFGKRAGTAVHVNGDDLLIMKESDILCIV

SEQ ID NO: 15646 - protein, 151 aa, Xanthomonas campestris
ARADNGRVGRDGQLPWRLPAHLKRFKAQTMGRPMIMGRKTFESFPAPLLGRRHIVLTRDTAWSASGAEIAHSVEEALALAGEDAAVIGGAEIFALFLDRATRIELTEVHLDAEGDASVPAFDPARWRETATEAYPAEGERPAYAFVTLERQ

SEQ ID NO: 15647 - protein, 508 aa, Xanthomonas campestris
  unsure (1)..(508): unsure at all Xaa locations
RPKRKRESTRGHERKERRQSGSERPTNRQRQQRGTPTHQRQRQKTPKHRTKNHRGRKKSDPLPRPKPNREQHNNGSKRATTRKKEAIDESHKDPRTQRGKHAQPTQSPTPTGRSAEPPRTTTDXRQTGKQEQPGGKKETREPGSGETRRWHKHSSSDKHGTTRRATSGKERSAQEKQQHRHKRAPANATESHAQKQKTRPRHGERRKQSRPNPHKLHPTARRDQSTRLPEPNTARTIHRRAGISPRRLETTQRNYRNKASHPQRLRARRSTTDRLEHRRRNRRQRRLDRKPEASTAIRQRETAYRQSTWKQQHKQRGYTEPTTRRQDQKPRMHARXKQQPARPKDRRNGXVSDARTQTVQTARTKRNHTHATTAEARRPHRRSDQRGQAKTPPTAKRAPERRESANTRRERNTSTHEIPPRPKRSQQDQHVTDRQTQQTMGGHSTSRRAHKKRPRAKKHNRRRRAAYTQRATRATRVNMKTTSNXPSRSTQQTRTKPQRHERRKTQPK

SEQ ID NO: 15648 - protein, 461 aa, Xanthomonas campestris
  unsure (1)..(461): unsure at all Xaa locations
RHRSSQSEEREDMRPTKTQSMXNTTRQEQAAHPNSTTFSKREEQYVIDRTTTPQTTDGSETTTGGGDHQRAEDRRGHGRAMRPPRTTEPPNGKRKKPRRQEPTQKETRTPGDTPKEPPKRTSRPARTPPEQRARHKRQARITNETTASGHRNKHEKAPRSTQPTRQTRTEHQRETEEHDRPHPETRQKSNERGRRQPTEHRXARRGKTNQGPDQKTMTEQPQPPRANRRGAQRTRPNTHQQAKNQHGATPNHTERTTTEPHTKREQRARHQKAENQRTQTHEEDHKQRHDEHGGTPDRERQNSRTHPQDKGNRPETRTNATARDRTATHTKQTRAPDRRKTQPETRNHNAKPCAHKQHHRANQSKKEAGIQITTRSQHTSGAQMTNPRTTQHSCYAKKRHGKXTRRPERQQGAQQRCPQPGICQDDKMTPKTHKRKDEEQKNRRDHTRKNQSKKPTQGTTK

SEQ ID NO: 15649 - protein, 369 aa, Xanthomonas campestris
  unsure (1)..(369): unsure at all Xaa locations
PXGTPEQAGXQVGRTSVPKSKYKRDTATPHGGQRPSIARWTPQRKNHETHEPTARIXSHRLHRPKQNPLPTDKHQGPDTGPGKKGLTTNDKQEPXNPCKSPRHCRRGRKHPSQKNADPQPKHKHEPRMVHNKREPRCIRRIYDTDPRGKRDGAKHTRERPDGEQHREKGQTGPRPSAHHPPKGGPRKTMNPEGQTGNEEHNDDATERPRTDTTHNDTRRKQRGCPELRVQRREPGTQNAPHRPKPTAHTPXGPEPGAHPRERPPPSXEGHKQTDKQSGSQKRTRNAPNNTNTDGQIHTPPPGKQTAKHPPAEHRMRGQSTETNPPDKCERGQLHDEHTTERGGTRTNQPIQKRQGPRAHQEXEDTDGLP

SEQ ID NO: 15650 - protein, 263 aa, Xanthomonas campestris
PKRRRHRKAAPRAGGPQNKPSETSAKKPGGRKTHGRGPAENERRKRATTADQSRAKKTHTQKNTKAQGKGDEQTPEPRDQNRAGTEPRSQQKATPHPRGQKRNREKSPGEPRGPHTKPRGGGRPTTKQRAPERTKRKGPANTRTPTRGQRPHQTKTRKRRTPNPGGKKRAQNKKKTNTHHKKAKHAKQNQKKQEPRHKTRQTQKRHKQHHTRKGRKTREGQPRPPQRKPHGKKKNPAAGTTPPKNPKKTHKNKKNTAQKRKNT

SEQ ID NO: 15651 - protein, 466 aa, Xanthomonas campestris
  unsure (1)..(466): unsure at all Xaa locations
QPRRPNQRGHWLIPRTTAPPQLTKAGRRNTKPAREQXTTGEGPDRPQRPNHARSTQKATKPARRETRNQNTKEPPRTHTGRQRETQGDQGPKQAKGRDATPAESRGHPPERNQADGYNRKPQHNPPQATPAKRQPNEQNPKPTYEKTQHTNRTRHGPCNHADAQGRERNRQSAEKRDAQRGTSHEQSVGRHXNTDHCEKNEHTEQQHQDVGSNRHRSQEEPPHQRPDGEHSRYTQRTPEQTSRQKHGHQHGGQHPGAEGTRHTKRIRKNTSRCPHTQPNPESRHNDHQQAQIDEERGNTRGRKPTAQHNTRTRPERGPKARRAQHHSATNTPHRRPXPQKATEPGAHNRPETNSTIPTKTTEQERRPKEHPPQTGTPTQEHDAQRRDEHEQKETRDATRAAGAQXDHANNDTTQEHDRDKHHQRKTQAANTEERKERQEEAQPGQTHHGGSEPNQARQLQETTEND

SEQ ID NO: 15652 - protein, 321 aa, Xanthomonas campestris
PTPEAKTTPKRTAANPTRNARGETHVSNIFTTTQPRKQTTKRTRREGGGKHARHQGTRGRNTTKKPKRHPPSKQGDPRTQRRNTNKRENRGANRETRQEEARTAGKDRKNKGGEQRQPPEQTRQHRGTTTHKRDKTPDNNPRRKTGKNTEQTRQQAETKRRQQKSGKGEKERRKTRTRPDHDGEKSTAHRNPQTQRSRNPSARQQRTKTHGRQNRGRTQRAEENQRRRSNRPRQCGGKQRGGATDAGSKNRPRSTSHGTNKQRDRKIHRRRNTTHAQIDTLARENRSARGRHRRTQNTYRRKRYTAERSKQNSGDSASHNP

SEQ ID NO: 15653 - protein, 341 aa, Xanthomonas campestris
  unsure (1)..(341): unsure at all Xaa locations
GNTAVDGEPPAPWPQPSCFRNHFPKSTPPEPTGPWGATLYYQDPKSVKPAVSKTSPTTXTKHREPPPGALGTPLVREPPHTQTTSHTPVNLXTPPHMKMXKTPQNRPXNRDEXAIINSPTSHHQRHHPNHDLLIITPNRRPLRPGNLYPLSCANPQKPAQLEICVLAHCLCQPLLTPAGAYEHVNQPPASPQILPNGPILPMKAPRAPQVKQDHQMANPPTCPXGXGRPAPHTSHMKCPWEDQRPDHLNHRPIXSPNEPAFPFTNPFTTAPKITTQSPPPCKYSRWPRHSPSPIDHSPPQTRKTDIQTXYYTSPLHSPTXNIPPTPQCGPLHPQQTNSLIP

SEQ ID NO: 15654 - protein, 200 aa, Xanthomonas campestris
  unsure (1)..(200): unsure at all Xaa locations
MANISHHKKIAGREGDENLAGRDPTGAPTKEKQLGQQGETRLAGKDSEEDEERQLTDTQWEKPGHKRQDRQEQKENQGERRPALQETDDKGTAGQTQVERHPQAKPGSAREHRRLQKKGSSENRPREGQKARQRAGSRRGRITRSATDRARHGENREGLPPETTSARGDRGERRPEPRGSHRPKHKGGAGTQQERDQTGX

SEQ ID NO: 15655 - protein, 446 aa, Xanthomonas campestris
  unsure (1)..(446): unsure at all Xaa locations
RXPVAGTAEHAGKETRQPRASIFVQERXHXXRAQQSWATEKSRPREARGPVQQPTRRDPKQPAEPQRKAAGDRPGKGAKGQAHGASVRHNGTKESGTPRRHNKGRKTERSGQGRPRGDPGTAREKNHAGAGTKGAKNETHAEAWKKATNGGRRGRTRGRKKPNRGPTGKRKKSRQGRAGRRGPDPTKHLARDRGESPPRRGRQTASHTPHNEQEDNNATPRRTLRKTQQEREDTQRTEHRRTAAKTGQDXTGATAHHPQRGRDRGARHRQQREEGTGGXGHDTRQPKNQTSGEGGATRNTAANRTRGKHASTATGQWRGRAQKADERKKDEPQQQAASGTAAALHPTRTQHAALDTDRRPQTHRAQREKARSGESGHTETPRGTKAKTHGRGPQRENRTPTRRKAGQDQRRTGNRRKTRRTTQAGHEKSGRPQPRNTASPPKNATS

SEQ ID NO: 15656 - protein, 466 aa, Xanthomonas campestris
  unsure (1)..(466): unsure at all Xaa locations
RKXRDEQSKQMRPRKGTFXQFLHTKEKPSTRDHRGAGGRKQKKKTATEEPHTNREPQGRPTTTNRKQRRPERNGKDTKRRRARRKTRPRSTTPRGTKTEPQETNERQPKQNRRTKHDERQNQRPNXYPNTRDREQSTKQERQNERENPXHRRQTPDARQPEKATQNSKKRTQRYARMAETTRPMPTQEKRRQKSDWKHQPHERQAHEPRNPPTKRTHTTQXQESRGNTTKNTQRRHTNERKQEXHDTHKKRHERIENSTIRKRRTREDKHSQEKDRKQTGNNEQQTEKDTTRRATKDKERDENRYAASARKQEHDQHDTAPEREGREEQSQQRGTEYHRHGKEEQTTDAEQMKRTKRLEHKYQATLRKENEKRMRQGRTGQKGRQREQDRADHMHRNCLNRERRTQATEGEAKTQKTRDAKTEQKERNDRHDPQSDAXEHMNNSTKRKENQQTQAKRKEPRNRHHR

SEQ ID NO: 15657 - protein, 156 aa, Xanthomonas campestris; identical to SEQ ID NO: 15292
  unsure (1)..(156): unsure at all Xaa locations

SEQ ID NO: 15658 - protein, 229 aa, Xanthomonas campestris; identical to SEQ ID NO: 15293
  unsure (1)..(229): unsure at all Xaa locations

SEQ ID NO: 15659 - protein, 319 aa, Xanthomonas campestris
MPKPLELFDCRPISCRLWSSRSPPVRTITSPPDTFAPTSLVSSPDAIVSRVPPSTTLLTLWVCEDVPEALLDDTLAVAEAVAPPTMPTPSERPRLAPALCEDQFWFACACAASISTSPVAVSATPFVPFTDEPRIERSPPVAMMPTVSPVTDAPTTVAASPEVFERELEMPRLTETPTVLVIAFITERTVLCAVEAVLIASAAAPPFALPSAEGRSASVCTAPEMFSYAPIDTPKLEDFELELLSRTSSVLAMVTDAPWSSTSPPAATVLPVIPSAPPETIVRSPFCVPITDPACVTSVVLPVVLVLATPRTARRRPRV

SEQ ID NO: 15660 - protein, 812 aa, Xanthomonas campestris
VHKFGGTSVADAERYRHVAQLLLARDETVQVTVVSAMKGVTDALIELAELAAQNRPEWRERWHETRARHRGAAVALLGEHSGPTVEWLDERFEHLSQILAALAVIGELPREVLDRVQGLGEVYSAQLLGDHFRALGEDCAVLDARDVLVVNRGELGVDVDWAVSAQRLDTWRQAHPQTRVVVTGFVARDRGDRITTLGRNGSDYSGAIFAALFDAHELHIWTDVDGVLSADPRVVPEAVQLETLSYDEACELAYFGAKVVHPQTMSPAIERGLPIIIRNTFQPEHPGTRITASSAVSGPIKGLTLSPDLAVLNLEGTGLIGVPGTAERVFAALRTAQVSVVMISQGSSEHSICCVVKQHESERARNALLQAFAHEITVGQVQRVQLTTGISVLAAVGDGMAGQPGVAARLFESLGRAQVNILAIAQGSSERNISVAIDAAHATKALRAAHAGFWLSPQTFSVGVIGPGNVGAALLDQLRTAQPQLLGKANLDLRLRGVVSRGRMLLEERSVTGDWRDAFAAASTPTDLERFTAHLLSAHLPHTVIIDCSGSAEVADRYAGWLAAGIHVVTPNKQAGSGPLARYEAIRAAADASGARFRYEATVGAGLPVITTLRDLVDTGDAVTSIEGIFSGTLAWLFNKYDGSVPFSELVTQARGMGYTEPDPRDDLSGVDVARKLVILAREAGRAISLDDVSVESLVPEALRQASVDDFMAQLQTVDAGFAQRLADAHARGNVLRYVAQLPPDRAPSVGLVELPAHHAFANLRLTDNVVQFTTRRYCENPLVVQGPGAGPEVTAAGVFADLLRVAAGEGA

SEQ ID NO: 15661 - protein, 459 aa, Xanthomonas campestris
NTRFIILISCVATIGGFLFGFDSGVINGTVDGLKQTFQSSAFFTGLEVASMLIGCAIGAFFAGSLADRWGRRAVLIISAALFLVSAIAAGAAHNSWFFIFARMMGGLAVGAASVISPAYIAEVASARYRGRLATMQQIAIISGLFCAFLSNYLLANAAGASTEPLWAGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQM

SEQ ID NO: 15662 - protein, 505 aa, Xanthomonas campestris
LPMTQESSAPLLFADLGLSDAVMKAVAAVGYETPSPIQAATIPALLAGRDVLGQAQTGTGKTAAFALPVLSNADLNQVKPQALVLAPTRELAIQVAEAFQKYAEAIPGFRVLPVYGGQPYAQQLSALKRGVHVVVGTPGRVIDHLDRGTLDLSQLKTLVLDEADEMLRMGFIDDVEAVLKKLPEKRQVALFSATMPPAIRRIAQTYLKDPAEVTIAAKTTTSANIRQRYWWVSGLHKLDALTRILEVEPFDGMIIFARTKAATEELAQKLQARGLAAAAINGDMQQAAREKTIAQLKDGKLDILVATDVAARGLDVERVSHVLNYDIPYDTESYVHRIGRTGRAGRNGDAILFVTPREKGMLRAIERATRQPIEEMQLPSVDAVNDTRVARFMTRITETLAGGQIEMYRDLLQRYESENNVPAIDIAAAMAKLLQGDAPFLLTPPVRGAREDFAPRERTDRADRGERPRFEPKFERGPRAPDGERGARPPRPDRPAYGEDAGAER

SEQ ID NO: 15663 - protein, 387 aa, Xanthomonas campestris
  unsure (1)..(387): unsure at all Xaa locations
KGAVLYDAGGYGMLGFGHTPEAVLDAMARPQVMANVMTPSLAQRKLDRALRAEIGHTRGGCPFARFMCLNSGSEAVGLAARIVDTNAKLHTDPGARHAGATIKRLVVKGSFHGRTDRPGLYSDSSRKTYSKYLPATATKTRXLRLRRMTSRHCSTPLTRPRANHWFIEAVFLEPVMGKDDPDRALPAEFYAAARTLTRNHGSLLLVDSIQAGLRAHGVLSVVDYPGFEQLDPPDLETYSKALNAAQYPLSVLAVTEQAAQVYRKGTYGNTMTTNPRALDVACATLALFTPQIRDNIRLRGAQALRKLEALQAELGGLITKVQGTGLLFSCELAPQYKCYGAGSTEEWLRHHGVNVIHGGENSLRFTPHFGMDEAELDLLVGLIAKAL

SEQ ID NO: 15664 - protein, 396 aa, Xanthomonas campestris
DFHAYPDAAGHFGKFGGRFVAETLIAPLQELSAAYDLARQDPAFIAEYDKDLKHYVGRPSPIYHAERLSREVGGAQILLKREDLNHTGAHKINNTIGQALLASRMGKTRIIAETGAGQHGVASATVAARLGLECVVYMGATDIERQKINVYRMQLLGAKVIPVTSGSATLKDALNEAMRDWVSNVQDTFYIIGTVAGPDPYPRMVRDFNAIVGREARAQMLEDYGRLPDAISACVGGGSNAIGLFHAFLNDPGVKIYGAEAAGDGIASGRHAASIAAGRPGVLHGNRTYVICDDDGQIIETHSVSAGLDYPGVGPEHAFLSDSGRAVYQGITDDEALAAFHLLAHTEGILAALESSHAVAQSIKLAREMPKDALVLCNLSGRGDKDVHTIAAREGM

SEQ ID NO: 15665 - protein, 166 aa, Xanthomonas campestris
MNPAPNLVMIGPMGAGKSCIGRRLAERFGLDFVDVDQAIVEQVGSSIPAIFEQHGEARFRQHEAEALHGLLAQSNKLVSTGGGAILDAGNRQRIRERGFVVYLHVSVPAQLTRLARDRNRPLLQRPDREQVLHGMAALRTPLYQEVADLTLETDHLSPAEATAQLV

SEQ ID NO: 15666 - protein, 363 aa, Xanthomonas campestris
RSVEVDGAQPYTISIAPGLLADGARLARHVRGRHVLLLSDTQVAPHYAAGVRAALLQARPDLQLGELVIAAGEASKTLDNFSLAITALAELGATRDACVFALGGGVVGDLAGFAAACWMRGVDCVQLPTSLLAMVDSSVGGKTAVDIPQGKNLVGAFHPPRAVIADTDTLRTLPTRELRAGLAEVIKYGAIGDPLFFQWLHAERRALLDGDPAALAQAIARSCEHKADIVARDPLEKGERALLNLGHTFGHAIETEQGYGAPGNDNLNHGEAVAVGMVLAARLSAALGMADAQDTEALRTLLHEFGLPTQIPTGLAPEALLGRMRLDKKNIAGRLRLVLWRGIGKAEVVPDVDEAAVLEILAD

SEQ ID NO: 15667 - protein, 488 aa, Xanthomonas campestris
MLKSLLRVKPIEPAGRVDAGEPVEGSLQGEATLQRTLTAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGNILNLPAVLIVAAVSGLCYVGITQSAFINAIVVAIKIAVICLFVGFGAAYIDPANWHPFIPENTAPGVFGWSGVFRAASIVFFAYIGFDAVSTSAGETKDPQRNMPIGILGSLAVCTIIYIIVCAVLTGLMPYTQLGTAKPVATALEAHPQLTWLKTAVEIGAIAGLSSVVLVMLMAQPRIFYTMAKDGLMPKLFGKVHPKFHTPYVGTVIVGVVAASLAGLIPLSVLGELVSMGTLLAFATVCAGVMVLRFTKPELERPFRVPLAMIVCPLGTLACLALFFQAFQEHWKVFVGWTVIGLVIYFGYGIHHSRLAR

SEQ ID NO: 15668 - protein, 450 aa, Xanthomonas campestris
LQRALGPWGLTALGIGAVIGGGIFVITGQAAADHAGPAIVLSFVLAAICCAFCAMAYAEFAAMVPVSGSAYTYTYATFGELAAWFIGWMLVLEYGVSASAVAVSWTGYFLSLLEHFGIHLPAALVSAPLDGKLQRTGAIANLPAAGIVLLLTWLCYVGIRKSSAMNMAMVILKTGLIILVIAAGWKYVDPANWHPFIPANEAPGKYGMEGVLRGAAMVFFAYIGFEAVSVAAQESHRPQRDLPIGMMLSLVICTVLYIAMAAVMTGLVPFTQLGTDEPVVTAVAAHPQLAWLRVVVEVGALIGLSSVVLVMIIGQPRIFMIIARDGLLPAVFTRIHPKYRTPHINTVITGIGIALLAAVFPLDVLGELTSMGTLIAFAAVCAGVLILRRTHPELPRPFRMPAAWLICSAGVLSCLALLSAMTLHNWMLMGLWTLVGLVVYFGYGYRHSRL

SEQ ID NO: 15669 - protein, 578 aa, Xanthomonas campestris
NAPQVSSWQTYRRLLAFAKPYRLLLVAALIAALIEAAGTTGFLALMKPITDETFIYKNAEVSRWLPVQIILLFVIRGAAGYITDMAMGKSARSIARDLRVKVMSKYLRLPGSRFDSEPVPSMLIRLGSDSDQVAQAAVDAVKVMIQQSLQVIGALALMLWHSWQVTLTILVLAPVLAWVMDKVARRYRRISHSIQESGAHLLQAADQTLSSHQEVKIYGAQQSEMERYSGLADRNLRLAMKVESTRGISTATVQMIGAIGLSALLFVAGAQALAGRLTAGDFVVLMTSMLTIIPGLKQLTNVQNMVQRGLASAERLFSVLDSPDEPDQGQVPLTRAKGLIEFRDVTARYPGQANPALADVSFVAQPGTVTAIVGRSGSGKSSLIKLIPRFYEAESGQILLDGHPVQAYALADLRRQIALVGQQVMLFDGSIAENVAYGEMRQCDAGQLERAIQGANAMEFVAQLPEGLQSHVGTKGGRLSGGQRQRLAIARAMLKDAPILILDEATAALDNESERLVQDALHKLMPDRTTLVIAHRLSTIEHADQVLVMDQGRIVERGTHQELLALGGLYSHLHGMQF

SEQ ID NO: 15670 - protein, 1001 aa, Xanthomonas campestris; identical to SEQ ID NO: 15304
  unsure (1)..(1001): unsure at all Xaa locations

SEQ ID NO: 15671 - protein, 197 aa, Xanthomonas campestris
LTIPTWLTLLRIVMIPVLVVVFYLPYKWTNFASAGVFALAAITDWLDGWVARRYHQYSAFGAFLDPVADKLMVAVALFLIVQGHPTPWMAFWAAVIVGREIAVSALREWMAEIGQRAKVRVAMIGKVKTTAQMVALLCLLYSVTPGQMPTHEIWLGNLIFQAGYWTLAIAALLTLWSGFQYLQAAWPSLRADEKAAI

SEQ ID NO: 15672 - protein, 243 aa, Xanthomonas campestris; identical to SEQ ID NO: 15306

SEQ ID NO: 15673 - protein, 313 aa, Xanthomonas campestris
QSPNRLKYAGVNISGAEIQSSKKPGVLNIDYRYPTASEYRYFAGKQMNIVRLPILWERMQPKAQGPLDQAQLALLKQAVANAKAANQYLIIDVHNYAKYYGQKIGSKRVPVRTFTDLWRRLAIAFKSDNAVIFGLMNEPYDISPESWAAAAQASIDSIRATGATNLILVPGALWSGAHSWYSTVAGQSNAVALANIRDPLNRYAIEVHQYLDTDSSGTSAGCVSRTIGAERLRSFTGWLRAQGKRGFLGEFGTANNATCTAALDGMLGYLETNHDVWIGWTFWAAGAWWNTSYPFNVQPDAQGRDKPQMKTLS

SEQ ID NO: 15674 - protein, 313 aa, Xanthomonas campestris
TRALKYAGVNLAGAEFASSKKPGVLNKDYMYPASTDYSYFAGTGMNVIRLPILWERLQPAARGELDPAQLALVQQAVARAKASGMYLVLDIHNYSKYYGYKMGGPEVPLATFADLWRRLAVIFNSDNAVIFGLMNEPNNISASEWAGAAQAGIDAIRATGANNLILVPGALWTGAHSWHSLTSDGYSNATALASISDPLNRYAFEVHQYLDADSSGTSSVCVSETIGADRLRAFTEWLRTNNKRGFLGEFGTANNAVCNTALQGMLAYMENYADVWLGWTWWAAGAWWNTSYAYNVHPNKDGTDKPQMVILSP

SEQ ID NO: 15675 - protein, 316 aa, Xanthomonas campestris
RLVLILAGLVLASSAHAGLSVSGTQLKESNGNTLILRGINLPHAWFADRTDAALAQIAATGANSVRVVLSSGHRWNRTPEAEVARIIARCKALGLIAVLEVHDTTGYGEDGAAGSLANAASYWTSVRTALVGQEDYVIINIGNEPFGNQLSASEWVNGHANAIATLRGAGLTHALMVDAPNWGQDWQFYMRDNAAALLARDSRRNLIFSVHMYEVFGSDAVVDSYLRTFRSNNLALVVGEFGADHRGAPVDEAAIMRRAREYGVGYLGWSWSGNDSSTQSLDIVLGWDPARLSSWGRSLIQGPDGIAATSRRARVF

SEQ ID NO: 15676 - protein, 624 aa, Xanthomonas campestris
  unsure (1)..(624): unsure at all Xaa locations
KQTLGFQTEVKQLLQLMIHSLYSNKEIFLRELVSNAADAADKLRFEALVKPDLLEGSGELRIRVDFDKDARTVTIDDNGIGMSREDAVSHLGTIAKSGTADFLKHLSGDQKKDANLIGQFGVGFYSAFIVADQVDVYSRRAGLPASDGVHWSSRGEGEFEVASVDKPERGTRIVLQLKEGEESFADGWTLRNILKKYSDHIGLPIEMRKEHYGEDADKPAEPEWEVVNRASALWTRPKSEIKDEEYQEFYKHVAHDAGNPLAWSHNKVEGKLDYTSLLFVPGRXPFDLYHRDSAKGLKLYVQRVFIMDQAEQFLPLYLRFIKGVVDSADLSLNVSREILQSGPVVDSMKSALTKRALDMLEKLAKDKPDDYATFWRNFGQALKEGPAEDYANREKVAGLLRFSSTHDTTGAQSVALADYVGRMTEGQDKLYYLTGESYAQIKDSPHLEVFRKKGIEVLLLTDRIDEWLMSYLTEFDGKSFVDVARGDLDLGKLDSEEDKKAQEEVAKSKEGLASRIKAALGDDVAEVRVSHRLTDSPAILAIGQGDLGLQMRQLLEASGQAVPETKPVFEFNPAHPLIEKLDAEQDMDRFGDLSRVLFDQAALAAGDSLKDPAGYVRRLNKLLL

SEQ ID NO: 15677 - protein, 221 aa, Xanthomonas campestris; identical to SEQ ID NO: 15311

SEQ ID NO: 15678 - protein, 242 aa, Xanthomonas campestris; identical to SEQ ID NO: 15312

SEQ ID NO: 15679 - protein, 375 aa, Xanthomonas campestris
VDFSFTEEQLMIQDVARRIAQEKIAPSAEQFDRSGEFPLENIQLLGENGLMGIEVPAEYGGAGMDPISYALAMIEIAAADGAHSTIMSVNNSLFCTGILKNGTEAQKQLYVRAIAEGTHIGAFALTEPQSGSDASAMRCRAIKQGDGSFVINGKKSWITSGPVAKYIVLFAVTEPDKGSRGITAFMVDTARAGFHRGKTEPKLGIRASATCEIEFADYVAQPDEVLGAEGEGFKTAMSVLDAGRIGIASQAVGVARAAYEATLAYVKERKAFGAAIGTFQMTQAKIADMKCKLDAALLLTLRAAWLKGQGQKFGTEAAVAKLIASEAAMWITHQAVQIHGGMGYSKEMPLERYFRDAKITEIYEGTSEIQRLVIA

SEQ ID NO: 15680 - protein, 311 aa, Xanthomonas campestris; identical to SEQ ID NO: 15314

SEQ ID NO: 15681 - protein, 193 aa, Xanthomonas campestris
DALDWNKGDGLLPVIVQDADNLRVLMLGYMNAEALAVTRARGEVTFFSRSKQRLWTKGESSGNVLRVVAIETDCDADTLLVQARPHGPTCHLGRTSCFPTAPSQFLGSLDALIAEREHERPHGSYTTKLFEQGIRRIAQKVGEEGVETALAGVVQGDAELLGESADLLYHLIVLLRARGLGLGDAVALLESRH

SEQ ID NO: 15682 - protein, 255 aa, Xanthomonas campestris
MLSRRIIPCLDVRDGRVVKGVKFRDHIDMGDIVELAMRYRDQGADELVFYDIGASPEGRSVDYAWVERVARLIDIPFCVAGGIRDVETARAVLHAGADKISINSPALGRPQLISELADAFGVQCVVVGIDSIREEDGQWRVRRYTGDPSKTQALPMRTLDWVAEAQRLGAGEIVLNCMDNDGVRHGYDIAQLRQVRALCRVPLIASGGAGEMQHFADVFDQADADGALAASVFHSGAIPIPELKRFLRAQQIEVR

SEQ ID NO: 15683 - protein, 371 aa, Xanthomonas campestris
LFVDRDGTLITEPADFQIDAYEKLRFVDGVIPAMLKLRDAGYQFVIVSNQDGLGSESYPQASFDGPNNLMLQIFASQGIVFREVLIDCSWPADNAPTRKPGVGLMVPYLQDRTIDWSRSAMVGDRITDIQFAQNLNIRGFQLRTEQFGGDWDWAGIAHELADAPRRAVVQRNTKETRIRVELDLDRVAEPHTATGLPFFDHMLEQIGKHGGFALDIRAEGDLHIDEHHTIEDTGLALGQALREALGDKRGIGRYGFDPDDSPWRVAGDTTQHGFTLPMDETIASAALDFSGRPYFVFDGDFKRERVGDMPTELVPHFFRSVCDASGLNLHLHVRGENDHHKVEGCFKALARALRQAIRREGTALPSTKGAL

SEQ ID NO: 15684 - protein, 359 aa, Xanthomonas campestris
MSTASVMDLVRDDLRAFAGYASARTSALQGDVWLNANESAWGNPADPDASTRRYPDPQPKGLRAALAQLYGCAPEQLLIGRGSDEAIDLLVRGLCVPERDAVVVTPPVFGMYAVCARLQSAPLVEVPLVDGADGLHADVPAIVQAALDAKAKLVFLCSPSNPAGSAIPLAEIEAALQALQGKALVVVDEAYGEFSDVPSAIGLLARYDNLAVLRTLSKAHALAAARIGSLIANAELIALLRRCQAPYPVPTPCAVMAEQALSAPALAVTQRRVTEIRAERARLHAALVQVAGVRQVYPSQGNFLLVRFDDAEAAFQALLEAGVVVRDQRAVPRLSDALRITIGTPDQNDRVLGALQRKQ

SEQ ID NO: 15685 - protein, 424 aa, Xanthomonas campestris
LDWTQLTADARTQALTRPVQTVATQTREAVATLIADVRARGDVALREITARFDGVTLESFAVSDAEFAAADAAIAPELRQAMQDAVARIDTFHRAGMSEGYAVETAPGVVCEKIVRPIGRVGLYVPAGSAPLPSTALMLGVPARLAGCREVVLCTPPRKDGSVDPAVLVAAQLTGVRRVFKLGGAQAIAAMAYGTDSIPSCDKLFGPGNSFVTEAKQQVAQSGAAAIDMPAGPSEVLVIADAGAQPAFVAADLLSQAEHGPDSQVLLLSDSDALITAVQEQLDLQLAQLSRADIARQALAQSRLIKVATLQDAFEISNRYAPEHLILALREPRAWLAQVEAAGSVFLGDYTPEALGDYCSGTNHVLPTSGAARAYSGVSVASFQNMVSVQAASKAGIDGIGACAVILARAEGLDAHANAVALRM

SEQ ID NO: 15686 - protein, 292 aa, Xanthomonas campestris
RLRIAIQKNGRLAEPARSLLAACGLSWRQSRDKLFCYGESLPVDLLLVRDDDIPGLIADGVCDLGIVGQNELDEQASARRRAGLPAAYHAVRGVGFGQCRLMLAVPEEWDWQGVAQLAGKRIATSYPAILADWLERQGIDASVVELSGSVEIAPRLGTADLICDLVSSGATLAANQLKPVELVMESEAVLAGAVREPADARAALLAMLLRRMDGVLKLRDSKLLMFRAEQGNVDALRRLLPDADPLVQLPDDGNGALRLQTMCHGAVTWQRLEELERAGAQGLMVLTVERSL

SEQ ID NO: 15687 - protein, 444 aa, Xanthomonas campestris
RQRDLAVVWHPCTQMREHPHTLPLVPIARGDGAWLIGHDGRHYLDAVSSWWTNLFGHAEPRIGAAIAQQAGRLEQVMLAGFTHAPAVQLAERLLAIAPRQPDRAPLAKVFYADNGSAGVEVALKMAFHYFHNRDEHRRTRFIALENGYHGETIGALSVGDIPLYRRVYAPLLLESIFAPSPDAYLAEPGQSAEDYALQAADALQHLLEQSPGEICALILEPRVQCAGGMRMYHPAYLRRARELCDAHGVFLIADEIATGFGRTGTLFACEQAGVMPDLLCLSKGLTGGFLPLSAVLATQQLYDAFLDDSRERAFLHSHSYTGNPLACAAALATLQIFADDDIIARNQRTAAHMTQLAAQIGEHSAVADVRQAGMIVAFELTQGGDKRTPFPAAARVGLQAYRAALARGVVLRPLGDVLYWMPPYCVDDAQLALLADTTRHAIAK

SEQ ID NO: 15688 - protein, 187 aa, Xanthomonas campestris
SGNCYKVRLLLEQLGSRYHWVEVDSVSGETRTPEYLAKNPNGKVPMVERDDGRVLTESNAILFWLAEGTPYLPTDTWQRAQALSWMFFEQYSHEPYVAVARFISLWTPRDAARRAELPQLRARGEQALTVMEQHLRQHAWFTGADYGIADIALFAYTHCAEDGGFDLERWPAIDGWLQRVRALPGFV

SEQ ID NO: 15689 - protein, 312 aa, Xanthomonas campestris
NLLVFSGNANKPLAQSICKELGVRMGKALVTRFSDGEVQVEIEESVRRQEVFVIQPTCAPSAENLMELLVLIDALKRASAASVTAVIPYFGYSRQDRRMRSSRVPITAKVAAKMICAMEADRVLTVDLHADQIQGFFDVPVDNVYASPLLLADIWRAYGTDNLIVVSPDVGGVVRARAVAKRLDDADLAIIDKRRPRANVATVMNIIGDVQGKTCVLVDDLVDTAGTLCAAAAALKQRGALKVVAYITHPVLSGPAVDNINNSQLDELVVTDTIPLSAAARTCPKIRQLSVAELLAETIRRIAFGESVSSLY

SEQ ID NO: 15690 - protein, 276 aa, Xanthomonas campestris
SAWPAPAKLNLFLQIVGRRADGYHLLQTVFRLLDWGDTVHVRLRTDGQIQRIGASLPGVAEDDDLMVRAARALQIHAGTALGAELRVDKRIPAGGGFGGGSSDAATVLVALNALWGLGLPVDTLAELGLRLGADVPVFVRGHNAWAEGVGEKLTPISLPQAAYVLVDPGIHVPTPVLFQSQELTRDAAPAKIADFASGSLLDNAFEPVLRRREPAIEAVFQALSRIGTPRLTGSGSGCFVEFATRAAAEQAMAHLPGNLRAWVVEGAAHSPLLDAL

SEQ ID NO: 15691 - protein, 425 aa, Xanthomonas campestris
MTLWVLGLNHQTAPVDLRERAAFAGDALPRALDSLRILPQVREAALLSTCNRTELYAMADDPQTLVAWLDMHAPGLSGYLYQHRDAEAVRHLFRVATGLDSMVLGEPQILGQVKDAWAVARAHGALGSGLDRLFQQTFSVAKRARTDTRVGANPVSVASTAVRLAQESFARLNESTVLLVGAGETIELAAKHLSEGRVRRLLIANRTLAHAQTLATQHGGVALPLTELDRHLAEADVVFSATAAREPVVTRVQVEQALRTRKRKPMLLFDLAVPRDIEASVAELSDAYLYTVDDLERAVEDNRRSRREAADQAEAIIDLQVARYVETLQANERQAPLKRLRAFGDSTRDELLAKARQQLSNGKPADEVLEQLAHALTNRLLHPPTAALRDAALNNDLDLTSAADRLFPEKPGLPPSPCSYPDRED

SEQ ID NO: 15692 - protein, 336 aa, Xanthomonas campestris
SMSLKHFLNTQDWSRAELDALLTQAALFKRNKLGSELKGKSIALVFFNPSMRTRTSFELGAFQLAGHAVVLQPGKDAWPIEFNLGTVMDGDTEEHIAEVARVLGRYVDLIGVRAFPKFVDWSKDREDQVLKSFAKYSPVPVINMETITHPCQELAHALALQEHFGTQDLRGKKYVLTWTYHPKPLNTAVANSALTIATRMGMDVTLLCPTPDYILDERYMDWAAQNVAESGGSLQVSHDIDSAYAGADVVYAKSWGALPFFGNWEPEKPIRDQYQHFIVDERKMALTNNGVFSHCLPLRRNVKATDAVMDLPNCIAIDEAENRLHVQKAIMAALVG

SEQ ID NO: 15693 - protein, 386 aa, Xanthomonas campestris
VLAFSGGLDTSFCIPYLQERGYAVHTVFADTGGVDAEERDFIEKRAAELGAASHVTVDGGPAIWEGFVKPFVWAGEGYQGQYPLLVSDRYLIVDAALKRAEELGTRIIAHGCTGMGNDQVRFDLAVKALGDYQIVAPIREIQKEHTQTRAYEQKYLEERGFGVRAKQKAYTINENLLGVTMSGGEIDRWEAPGEGARGWCAPRSAWPTEALTVTLKFVEGEAVALDGKALPGAQILAKLNTLFAQYGVGRGVYTGDTVIGLKGRIVFEAPGLISLLTAHRALEDAVLTKQQNRFKPDVARKWVELVYEGFYHDPLKTDIEAFLKSSQSKVNGEVTLETRGGRVDAVAVRSPHLLNAKGATYAQSADWGVEEAEGFIKLFGMSSTLY

SEQ ID NO: 15694 - protein, 963 aa, Xanthomonas campestris
  unsure (1)..(963): unsure at all Xaa locations
AQPHKQTRQTIVRLLSSMASAKEISQYLKRFSQLDAKRFAVVKVGGAVLRDDLEALTSSLSFLQEVGLTPIVLHGAGPQLDAELSAAGIEKQTVNGLRVTSPHALAIVRKVFQASNLKLVEALQQNGARATSITGGVFEAEYLDRDTYGLVGEVKAVNLAPIEASLQAGSIPVITSLGETPSGQILNVNADFAANELVQELQPYKIIFLTGTGGLLDAEGKLIDSINLSTEYDHLMQQPWINGGMRVKIEQIKDLLDRLPLESSVSITRPADLAKELFTHKGSGTLVRRGERVLRATSWDELDLPRLTSLIESSFGRTLVPDYFSNTKLLRAYVSENYRAGESLTDEGMLGASALIYLDKCAVLDDAHGEGLSRALCNVMREETPQLFWRSRDNNQVNIFYYAESDGCIKQEKWKVFWYGLDNFEQIQHCVAHCATRQPTLLGXVQXRPPHRKRSGARCPPCAASTSRWSHCALPTPMACVRQWPMARCRACGTPACPVLRKSMTTSPPRWQRRRTALRCRSWCAMRRARSPAARATTHWMRRCRSCRSATPGTRRGCSAPASIPRQNVCCLGMPLKARLPERGVRDQLVQSHLARGHRAAGCKAGRGAAQSHAPRRRHATRHRGVFHHQCGMGRGETPPAVPPGRTRMTVQPTTIGIVGARGHTGAELIKLIAAHPQLQLVFVSSRELAGQRVAEHSDGYQGELRYESLDADAVAAKAADVVILALPNGKAEPFVAAIDASRPQTLLIDLSADYRFDPAWYYGLPELTRHTYAGQRRISNPGCYATAMQLAITPLREQLAGPPQCFGVSGYSGAGTTPSDKNNPALLADNLMPYALTNHMHEREVSAQLGVPVEFMPHVAPHFRGITMTVNLWLQQPLTREQIHARYLERYAHEPLIEIVDEAPWVSRIAGTQGVQIGGFTMAPGNKRVVVVATLDNLLKGAATQAMQNLNLALGWDELTAI

SEQ ID NO: 15695 - protein, 368 aa, Xanthomonas campestris
DDVILDREFFLYDIAASKAHAQGLQHIGILSLEELGGLSEQLDLLADDFRSGAFVLDAHYEDCHSAIEARLTERLGDAGRKIHTGRSRNDQILVATRLWLKDKLQRVAALSTEVAKVALDRAQAEAELPVPGYTHIQRAVVSSAGMWWAGWAEAFIDNAVRANDTFKLVDTNPLGTAAGYGVNLPLDRAHTTAELGFARLQVSPIYAQLSRGKFELAALEALGGATLDLRRIAWDLSLFTSGEFAFVALPAQYTTGSSIMPNKRNPDVIELMRATHASVAAARTEIEQLLSLPSGYHRDLQSSKGAIVHGFARGLAALELLPALLANLEWRPDKLRAAIDSGMYATDVAVEAAVAGVPFRDAYKAAAA

SEQ ID NO: 15696 - protein, 495 aa, Xanthomonas campestris
PPCIIVVFGARGDLTRRLVMPALYNLRRAGALGEEFAIVGMDHGDITERAWRTNMGKAMTELLSSRDAEFQADGFDTDTWDWLRERMHYVRGDFTDLRAYQALDGVLEKLHKRYGTRGNVLFYLATAARFFEPVLLNLGEAGLVKQHEGAGWRRVIVEKPFGHDLPSAKHLNATVARVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVNRSAVPGYREEDTVPDESETETFVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWR

SEQ ID NO: 15697 - protein, 551 aa, Xanthomonas campestris
MAIRQLPEILINQIAAGEVVERPASVVKELVENALDAGATRVDIDLEEGGVRLIRIRDNGGGIAPEELPLAVSRHATSKIASLDDLETVATLGFRGEALPSIASVSRFTLASRRPDAEHGSALQIEGGRLGEVMPRAHAPGTTVEVRELFFNVPARRKFLRAERTELGHIEEWLRSLALARPDVELRVSHNGKPSRRYKPGDLYSDARLGETLGEDFARQALRVDHSGAGLRLHGWVAQPHYSRASTDQQYLYVNGRSVRDRSVAHAVKMAYGDVLFHGRQPAYVLFLELDPARVDVNVHPAKHEVRFREARLIHDFVYRTLQDALAQTRAGALPADVGLGGSAALGIGAGAAQGDGSYVADAGAGHPGAGSGSGYASWAPSQAPLGLRVDEARAAYAALYAPAAGSALRDDGQPVLSGTGLPATAHDSGVPPLGYAVAQLHGIYILAENAEGLIVVDMHAAHERIGYERLKQAHDSIGLHAQPLLVPMTLAVGEREADTAEREADTLASLGFEITRSGPQSLHVRSIPALLANADPEALLRDVLGDLREH

SEQ ID NO: 15698 - protein, 443 aa, Xanthomonas campestris; identical to SEQ ID NO: 15331
  unsure (1)..(443): unsure at all Xaa locations

SEQ ID NO: 15699 - protein, 253 aa, Xanthomonas campestris; identical to SEQ ID NO: 15332

SEQ ID NO: 15700 - protein, 445 aa, Xanthomonas campestris; identical to SEQ ID NO: 15333
  unsure (1)..(445): unsure at all Xaa locations

SEQ ID NO: 15701 - protein, 453 aa, Xanthomonas campestris
ILFGATGDLAQRYLFPSLLRLFVDGLLPEDFRIRALALSQHDTDAFREVLRPRLAQALPIATAAQIDALLQRIDYRSADLRNAESVAEAVRELASRQCVSYLAIPPGLYISTCQGLALGGALAAPHRLMLEKPIGHDSDSAREILQSIGALIDEDRVFRLDHYLGKAAVQNLVALRFGNTLLEAVWNRTYIESVQILVAESEGVDGRDAYYARSGALRDMVQSHILQLLCLVAMEPPASLEADRIRDEKVKVLRALRPMTAEHAAQDSVRGRYTAGSINGEPAQAYHPPEGSDVETFVAVTAHIDNWRWAGVPFHLCTGKRLAERSTRIVVTLKPVTHWLFERPDRQNAVPNRLTFQLQPLENIELGLMSSLAGPEWGAIELQPLELELSVPTGLHRRIAYERLFVDAFNGNPALFVRDDEVKAAWAWIDSVSDAWSDAQLPLQPYPAGSWGP

SEQ ID NO: 15702 - protein, 600 aa, Xanthomonas campestris; identical to SEQ ID NO: 15335
  unsure (1)..(600): unsure at all Xaa locations

SEQ ID NO: 15703 - protein, 249 aa, Xanthomonas campestris
KIGKGKHYPAQGAKNKRTFKVYRWDPDGDANPRTDSYEIDLDKCGPMVLDALIKIKNEIDPTLTFRRSCREGICGSCAMNIDGTNTLACTKAIAACGKAEVPIYPLPHMRVIKDLVPDLTHFYAQYASIKPWIRTQTPPPPDRERLQSPEDRKKLDGLYECILCACCSTSCPSYWWNGERYLGPAILLQAYRWIIDSRDEDTGARLDDLEDPFKLYRCHTIMNCARTCPKGLNPALAIAEIKKLMMARR

SEQ ID NO: 15704 - protein, 429 aa, Xanthomonas campestris
MTTIAKILAREILDSRGNPTLEAEVTLADGSFGRAAVPSGASTGTKEAVELRDGDKTRYLGKGVRKAVENVNGTIAETLKDFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFFASGKYNLVGENKRLTSEQFVDFLADWVAQYPIISIEDGLAEDDWAGWKLLTDRVGKKVQLVGDDLFVTNPKIFKEGIDSGTANAILIKVNQIGTLTETLEAIAMAHAANYASIVSHRSGETEDTTIADIAVATTATQIKTGSLCRSDRVAKYNQLLRIEQALGSGARYAGRDAFVSLK

SEQ ID NO: 15705 - protein, 419 aa, Xanthomonas campestris
ILTRGEGVYVWDADGNKLLDAFAGLWCVNVGYGRAELAQAAARQMEQLAYYNSFFQCTTEPTVHLAAKLAELAPGDLNHAFFANSGSEANDTILRLVRHFWAVQGQPQKHIFIGRHDGYHGTTMGGASLGGMRGMHRQGGLPNPGIEHIAATQSFWRGWRVWTRTTYGLLAARRLEEKILQLGPDTVAAFIGEPIMGAIGVYISPRSYWPEIERICRRYDVLLVADEVICGFGRTGAWFGAEYFGFQPDVMTLAKGITSGYIPLAAAMFNDRVAGVLKRQGGELAHGGTYAGHPVCAAVALENLRLLQDEGIVDTARTQIAPYLAQRWAELGAHRLVGEARIAGLVGALELVPDKRRRGVYFPERGRVGALCRDFALRRGLILRATYDAMLLSPPLIITWEQVDELFDKTWAALDDTAQ

SEQ ID NO: 15706 - protein, 677 aa, Xanthomonas campestris; identical to SEQ ID NO: 15339
  unsure (1)..(677): unsure at all Xaa locations

SEQ ID NO: 15707 - protein, 226 aa, Xanthomonas campestris
YYLPVYRPRQVVLERGQGSRVWDDQGREYLDLSSGIAVSGLGHNDPDLMAALTEQAGKLWHTSNVFFSAPPLKLAEELVTASRFAQKVFLCNSGTEANEAAIKLVRKWASSQGRPADKRVIVTFRGSFHGRTLASVTATAQPKYQEGYEPLPGGFRYVDFNDVPALESAMASGDVAAVMLEPIQGEGGVMPAAPGFLARVRALCDQHDALLVLDEIQCGMGRTDSL

SEQ ID NO: 15708 - protein, 712 aa, Xanthomonas campestris
  unsure (1)..(712): unsure at all Xaa locations
PSPMTYRDAGVDIDAGNALVERIKPLVKRSFRPEVMGGLGGFGALFDLSGKYKEPVLVSGTDGVGTKLKLAQQLGRHDTIGIDLVGMCVNDVLVQGAEPLFFLDYFATGKLDIDTAAAVVGGIARGCELSGCALIGGETAEMPDMYPPGEYDLAGFTVGAVEKSQLLDGAQVREGDVLIGIASSGPHSNGYSLIRKIYERAGAPADLVLDDGVALIDALMAPTALYVKPILALLKSHGEAIHAMAHVTGGGLTENIIRVIPDGLGLDIDATAWILPPVFAWLQREGAVADAEMWRTFNCGIGFVLVAAPAQAAALEQALDAQSLAHWRIGQVVTAQGDERVRIGXPKEHPHGSRARLRLYNCHRRGSAAAEVAVDLPLRAGRHHRAVFVIPVDPPVHGAGDRHRPPADDHDQCRRARDGSPLVRLVLRGVRGRLHRLRPDIGRLHGVCGSLHRPAQTASALPDRRRHFLLVHAVRHRGRRVYAGGSAAAAGSRRCLSPTRQPLELRLRYNDGRDCMSLRLAVLASGRGSNLQAILDAIAAGQLAAEVAGVFSDREQAPALQKVDASRRWSASPRAFADRAAFDSALGDAIAAVQPDWVICAGYMRILGEPLVRRFTGRMLNIHPSLLPKYRGLHTHARALEAGDAEHGASVHLVVPELDAGPVIAQAHVPVLPDDTAESLAARVLDREHPLLLATLRLLASGRVTTPDGRVH

SEQ ID NO: 15709 - protein, 785 aa, Xanthomonas campestris
ILWLHELRLVDLARVGGKNSSLGEMIGNLAGLGVSVPGGYATTAEAFKDFIAHNDLSKRIFDKLETLDVEDVTALTVAGKEIRGWVIDAPLQPELDRDIRSAYEKLCAENGGGEVAVAVRSSATAEDLPDASFAGQQETFLNVTGADDVVHKVKEVLASLYNDRAIAYRVHHGFKHEDVFLSAGVQLMVRSGVGSSGVLFTLDTESGFRDVVFVTSSFGLGEMVVQGAVNPDEFYVYKPTLTAGKPAILRRSLGSKAIRMVYSDVPGERVRIEDTPVELRNTFSISDEDVQELSKQALVIEKHYGRPMDIEWAKDGVSGKLFIVQARPETVKSRSHATQIERFSLEAKDAKILVEGRAVGAKIGSGVARVVRSLEDMNRVQAGDVLIADMTDPDWEPVMKRASAIVTNRGGRTCHAAIIARELGVPAVVGSGNATDVISDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYINRLAEGIATLTASVAPNTVIVRLSDFKSNEYANLIGGSRYEPHEENPMIGFRGASRYVDPSFTKAFSLECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLK

SEQ ID NO: 15710 - protein, 251 aa, Xanthomonas campestris; identical to SEQ ID NO: 15343

SEQ ID NO: 15711 - protein, 201 aa, Xanthomonas campestris; identical to SEQ ID NO: 15344

SEQ ID NO: 15712 - protein, 852 aa, Xanthomonas campestris; identical to SEQ ID NO: 15345

SEQ ID NO: 15713 - protein, 430 aa, Xanthomonas campestris
MGQSVVVLGAQWGDEGKGKIVDLLTEEIGAVVRFQGGHNAGHTLVINGKKTVLHLIPSGILRDDALCLIGNGVVISPAALIKEIGELESAGVEVRSRLKISPAAPLIMPYHIALDQAREKAAGGKAIGTTGRGIGPAYEDKVARRGIRIADLHYPAQLEELLRTALDYHNFVLTKYLGVEAVDFQKTFDEALAFGEYVQPMKSDVAGILHDLRKQGKRVLFEGAQGALLDIDHGTYPYVTSSNTTVGGALAGTGVGADAIDYVLGIAKAYATRVGGGPFPTELDDEVGQGIRDRGAEYGASTGRPRRCGWMDIVALKRAVAINGISGLCITKLDVLDGMEKLKVCIAYEYRGKRTEYAPLDAQGWEECTPVYLEFPGWTENTHGITEWDKLPVAARAYLRALEELAGCPISIVSTGPDRDHTMVLQDPFA

SEQ ID NO: 15714 - protein, 289 aa, Xanthomonas campestris
KDYYATLGVEPSAGEAEIKTAYRRLARKYHPDVSKEAGAEDKFKAINEAYEALRDPQKRAAYDQLKAQGYRPGDEFQTPPNFNGGQGFDYEEVFGNGGAGGGFSDFFESLFAGQRGGRPRGPGAGAGPGAQTRGDTRAKLAVPLEAVYSGDSVRITITGKQLDVRVPKGIQPGQVIRLSGQGNGGGNLLLEIEHAAHPQFEVDGRNILYTLQVMPWQAALGTTISVPTLGGAVELKVPADSEAGRKLRLRGRGLPGATPGDQIVELEILAPAPTDEAQKKAYRTLAKAF

SEQ ID NO: 15715 - protein, 838 aa, Xanthomonas campestris; identical to SEQ ID NO: 15348

SEQ ID NO: 15716 - protein, 461 aa, Xanthomonas campestris
MTCRTRFAPSPTGYLHIGGARTALYCWLEARHRGGQFVLRIEDTDRERSTQVAIDAILEAMEWLGLGYDEGPIYQTQRIARYQEVAEQLLAQGKAYYAYETREELDAMREAAMAKQEKPRYNGAAREQQLPYRDDPNRVIRFKNPLAGTVVFDDLIKGRIEIANSELDDMVIFRPDGYPTYNFAVVVDDWDMGITEVIRGDDHINNTPRQINIYKALGAPVPKFGAMPMILDEQGAKLSKRTGAADVMQYKDAGYLPHALINYLARLGWSHGDQELFSQQELLDLFDVKDVNSKAARLDMAKLGWVNQHYLKTDDPASIAPQLEYQLRKLGIDVAAGPAAADVVVALRERVQTLKEMAEKAVVWYQPLETYDEAAVIKHLKLGAEVPLGKAREMLAALNEWSVENVSAALHAAAAALELGMGKVAQPLRVAITGTQVSPDISQTVYLAGREGALKRIDAAL

SEQ ID NO: 15717 - protein, 254 aa, Xanthomonas campestris
RWRLDGQTALITGASAGIGLAIARELLGFGADLLMVARDADALAQARDELAEEFPERELHGLAADVSDDEERRAILDWVEDHADGLHLLINNAGGNITRAAIDYTEDEWRGIFETNVFSAFELSRYAHPLLTRHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRHGF

SEQ ID NO: 15718 - protein, 562 aa, Xanthomonas campestris
ISLNGGASAPRAGGRSDHRGRVCRHERRRSQDLQAQSGICGRAQRDLPHQPQHPHSGRMTHTNGFDALHAHAQRLRGVAIPTLLAAEPQRPTQYARQVGPLYFNFARQKYDRAALDALFAIARERDLAGAFQRLFRGEQVNVTEKRAALHTALRGDLTDAPVASDAYATAAEVRHRMGALIQQLEGTDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLDGAAQFDAHALNTPLEENVAVLHGLTAVWNRNLLGSATHAVMTYDQRLALLPAYLQQLVMESLGKRVKLDGSAVDSDTVAVWWGGAGTDVQHSFFQALHQGTSVVPADFIGTVHNDDPYAENHVALMANVLAQTEALANGQDSSDPHRSYPGGRPSTVILLDALTPQALGALISMYEHSVYVQSVMWGINAFDQFGVELGKQLASQLLPALKGEAADVADPVTRELLAKLRG

SEQ ID NO: 15719 - protein, 701 aa, Xanthomonas campestris; identical to SEQ ID NO: 15352

SEQ ID NO: 15720 - protein, 266 aa, Xanthomonas campestris
SVPALGMGSWNLGQGRHAPQQEIEALQTGQALGMRLIDTAEMYGNGRSEQLISQVIARGQPPYLVSKVLPSNASARGIARACEASLQRLGVRTLDLYLLHWRGGSDLAEVVAAFETLRDAGKIRDWGVSNFDVDDMQELWQIDGGQHCLVNQVLYRAGSRGIEFDLLPWCAQHAVTVMAYSPLGSRALLDHPVLHAIGARRGVAATAVALAWAIRSGQVIAIPESGTPAHVRANADACTLQLDARDLADLDNAFPPPTRKQPLDLL

SEQ ID NO: 15721 - protein, 368 aa, Xanthomonas campestris
EFSALPLSPALAPGIDALGYTTLTPIQAQSLPPILQGLDVIAQAPTGSGKTAAFGLGLLQKLDPALTRAQALVLCPTRELADQVGKQLRKLATGIPNMKLLVLTGGMPLGPQLASLEAHDPQVVVGTPGRIQELARKRALHLGGVRTLVLDEADRMLDMGFEEPIREIASRCDKHCQSLLFSATFPDIIRTLARELLKDPVEITVEGADNAPEIDQQFFEVDPTYRQKAVAGLLLRFNPESSVVFCNTRKEVDEVAGSLQEFGFSALALHGDMEQRDRDEVLVRFVNRSCNVLVASDVAARGLDVEDLAAVVNYELPTDTETYRHRIGRTARAGKHGLALSLVAPRESARAQALEAEHGQPLKWSRAP

SEQ ID NO: 15722 - protein, 152 aa, Xanthomonas campestris
IRDIADFPKPGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEIVGAAVLVELLALQGRSK

SEQ ID NO: 15723 - protein, 289 aa, Xanthomonas campestris
MSSLPYRGRFAPSPTGPLHFGSLLAALGSWLLARHAGGEWHVRIEDIDPPRAEPGASERQLHTLAAFGLHPDGPVLYQSDRDAHYEAALSRLLRTGAAFECSCSRAELAVMGGIHHVCVAPLGIRRAVRLRVPPNTQASFQDALQGRITQDVYAEVGDVVLRRADGYWAYQLAVVVDDAAQGITDVVRGADLLDSTPRQLVLQQALGVAPPRYLHLPLILGADGRKLSKSHAAQPVDDSDPLPALRAAWRALGQAPAALPARASVAGVLQHAVQHFSPQRLPRVASLDA

SEQ ID NO: 15724 - protein, 221 aa, Xanthomonas campestris
SRVALVTGGTGGIGTAICKRLADQGHRVASNFRNEEKAREWQQRMQVQGYEFALFRGDVASSDHARALVDDVEAALGPIEVLVNNAGITRDTTFHRMTAEQWHDVINTNLNSVFNVTRPVIEGMRKRGWGRVIQISSINGLKGQYGQANYAAAKAGMHGFTISLARENAAFGITVNTVSPGYVATDMVMAVPEEVRAKIVADIPTGRLGRPEEIAYAVAFL

SEQ ID NO: 15725 - protein, 508 aa, Xanthomonas campestris; identical to SEQ ID NO: 15358
  unsure (1)..(508): unsure at all Xaa locations

SEQ ID NO: 15726 - protein, 314 aa, Xanthomonas campestris
GGLKYVGVNISGAEFNSRKKPGTLYKDYTYPAAADFSYFASKGMNTIRLPFLWERLQPTLNGELDAAQLALIKKSVAAAKANKQFLILDLHNYAKYNGKRIGTDEVPPAALADLWRRLALEFKDDKQVIFGLMNEPNGISSTDWAAAAQAAINTIRKTGANNLILVPGTAYTGAHSWRSTSYGVSNAKALQILKDPGNNLAFEAHQYLDGDYSGTKPECTSATVGADKLRGFTDWLRENKQKGFLGEFGTANNAVCNDALKGMLSYMEKNSDVWLGWTWWAAGAWWKPDYPFNVQPGKDGSEKPQMSILSEHAR

SEQ ID NO: 15727 - protein, 346 aa, Xanthomonas campestris
KAHAYAAQTADQPLAPFVFERRAPGPDDVQIDIAYCGVCHSDLHTARNEWHNTVYPSVPGHEIVGRVTAVGSAVTNFKVGDLAGVGCMVDSCRSCSSCQEGEEQYCEQGFTGTYNGPMFGGGENTYGGYSDHIVVDQKYVLHISHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAMVLVGVPEHSHPSPAVFNLVMKRRTLAGSLIGGIRQTQEMLDFCAKHNIVSDIETIRADQINEAYERMLKGDVKYRFVIDMDTL

SEQ ID NO: 15728 - protein, 535 aa, Xanthomonas campestris; identical to SEQ ID NO: 15361

SEQ ID NO: 15729 - protein, 378 aa, Xanthomonas campestris; identical to SEQ ID NO: 15362

SEQ ID NO: 15730 - protein, 246 aa, Xanthomonas campestris
KLVLLRHGQSQWNLDNRFTGWVDVDLTEQGRQEAAAAGKLMKDEGLQFDVAYTSVLKRAIHTLQGALKELDQDWLPVHKSWRLNERHYGGLQGLDKAETAAKHGEEQVKIWRRSYDIPPPAMDVTDPGHPGHDRRYATLDRNALPGTESLATTLVRVLPYWHDAIAPQLKAGQTVLVTAHGNSLRALYKYLNDISNAQILELNIPTGIPLLFELDDNLRVQSYRYLGDPEAAKRAAEAVANQGKAK

SEQ ID NO: 15731 - protein, 663 aa, Xanthomonas campestris
AAPTRVDVSKLDAPIVAFGSGDLDPAIAACQDLNGFVNAKWLKANPVPSDRTSWGSFEVLAERSLTIQHALVEQLARGNLSAGSVDAKIADLWRTGSDEAAIDKAGITPLQPQLKAIDVLSDAPAIAAWLRDSYAKGQGFLFSFGANADYKNSEQMIAYAGQGGLGLPEKGYYTDPAQAKIREQYVAYIARVLELSGIPAAQAAEQAKAVMAFETQLANASLSRIELRDPAKRYNPVDVAGANAITPHFDWQAFFNALKVPAGTFSLSQPEYFRALDGMLVNTPADTWKAYLRFHSIDEAAPYLAKPFEQANFDFYAKTLRGQQDMLPRWKRTLNAVNEAMGEALGQLYVQSAFPAESKAQMQQLVQNLSNALKARLEKLDWMSAQTKQRALEKWASFTPKIGYPDQWRDWSGLETRGDGFLANMQAAQAFNYRYMLDKIGKPVDKREWHMTPQTVNAYYNATRNEIVFPAAILQPPFFDPKADPALNYGGIGAVIGHEMMHGYDDSGSQFDAKGNFDTWWTDADRKLFTQRTDQLVAQFDGYEAIPGVHVKGKLTLGENIGDLGGLTVAYDALQMALQEQPAANKEIDGHSQDQRFFMNWATVWRRNFTDGELRVRLNTDPHAPANFRANGAPSNMPAFAQAFQCKPGDAMVRGDKDRVAIW

SEQ ID NO: 15732 - protein, 280 aa, Xanthomonas campestris
CTHGEGVLWCEQREALYWVDISEKRLWRHHPGSAQTRFWTLPDRPGCIGLMDDGRLLIALAKAICIADPDNADGDTLPLDHLADVEADNPLTRSNDGRADRHGNFVFGTMDEHEDKAGRGAMYQFSLRHGLRRLPLPGVSIPNSICFSPDGRTLYYCDSVRPQILRCDYHPDTGQTTNTRVYTTLDRDDAQPDGSIINNAGHLWNAHWPSWRVLRYHPDSSVKRIVHMPVKHPTCSAFGGPALDRLHVISSRLDHSDAELAQTPQAGGLYLCDLPVRGLP

SEQ ID NO: 15733 - protein, 353 aa, Xanthomonas campestris
IALATLIPVTAPAMQVSTQAPLVDATGQTLHIRGVTWPGFDRAGLAAVGMRNNTLAQLLDRMQASDINAVRVPVCAAVLQRAPVAAAEVAGDSTLRGLDSLQLLDAVVHAASQRGMQVMFAFADGGCDDRAPLLGAQQQAWTRGLVTLARRYGGNANVLGIDLGSSGYRNASWAGNAADQDWNRVASRAVARVLAQAPRWVVGVEGVGSNAVCSDPERKAPGSNLQPFACVPLDIARRHLVLMPKLAGPDRDTTDAFAAPGFAQALPAMWQRDFGQFAIDHAVVPVSLGGGLGDGDPRDPAWQTALSGYLANAGIRSAFLGSWETGNANNGGLLAPDGSPRADKLLILRHAWG

SEQ ID NO: 15734 - protein, 448 aa, Xanthomonas campestris; identical to SEQ ID NO: 15367

SEQ ID NO: 15735 - protein, 535 aa, Xanthomonas campestris
MSAAAPPCCTSLLGLSLSMFVAPCALAATPLEGAVVSAPAPTPPTPDLAYPELFQAVQRGELFDDQKHFVDFLPLRDPALINADYLAQHEHAGFDLRKFVDANFEESPPVQTDAIRQDTALREHIDALWPKLVRSQTNVPAHSSLLALPHPYVVPGGRFREVYYWDSYFTMLGLVKSGETTLSRQMLDNFAYLIDTYGHIPNGNRTYYLSRSQPPLFSYMVELQAGVEGEAVYQRYLPQLQKEYAYWMQGGDDLQPGQAARHVVRLADGSVLNRYWDERDTPRPEAWLHDTRTAAEAHDRPAADVYRDLRAGAESGWDYTSRWLADGKTLSTIRTTAIVPIDLNSLLYHLERTLAQACAHTGTACSQDYAALAQQRKQAIDAHLWNAAGYYADYDWQTRTLSNQVTAAALYPLFAGLASDDHAKRTATSVRARLLRPGGLATTALKTGQQWDEPNGWAPLQWVAVDGLRRYGEDGLARTIGERFLTQVQALFAREHKLVEKYGLDADAAGGGGGEYALQDGFGWTNGVTLMLLNL

SEQ ID NO: 15736 - protein, 304 aa, Xanthomonas campestris; identical to SEQ ID NO: 15369

SEQ ID NO: 15737 - protein, 246 aa, Xanthomonas campestris; identical to SEQ ID NO: 15370

SEQ ID NO: 15738 - protein, 301 aa, Xanthomonas campestris
LRIATRKSPLALWQSEHVATALRQHHPGLEVVLVPMSTRGDEVLDRSLAAIGGKGLFLKELELAMLRGEADCAVHSLKDVPMELDAPFVLPAILERGDPADALVSNLYATLQALPLGARVGTSSLRRQAQLRAARPDLELIDLRGNVNTRLAKLDNGGYDAIVLACAGLQRLGLEARITARLDAPEWLPAPAQGAVAVECRGDDARIHDLLAVLDAGRTRACVEAERAMNRALHGSCHVPVAAFARWEGEDLFLQGMVGSASDGRLIHAEAHGSPDATEDLGRRVADGLFEKGAAQLLAEL

SEQ ID NO: 15739 - protein, 197 aa, Xanthomonas campestris
VIWLHGLGADGSDFAPMVPELVRAQWPALRFVFPHAPIRPITINNGVRMRGWYDIVGMDFAQRADKVGIAESVAQVEALIANEQARGIAPERILLAGFSQGGAVTLAVGLQRRVPLAGLIAMSTYLPDPAAAASQLQPGALAQPLFMAHGSADPVVPYRAGEQSAQALQALGFMLEWHSYPMGHQVCVEEIDALRDW

SEQ ID NO: 15740 - protein, 501 aa, Xanthomonas campestris
  unsure (1)..(501): unsure at all Xaa locations
MSIFRTASTLALATALALAAGPAFSYSINNSRQIVDDSGKVVQLKGVNVFGFETGNHVMHGLWARNWKDMIVQMQGLGFNAVRLPFCPATLRSDTMPASIDYSRNADLQGLTSLQILDKVIAEFNARGMYVLLDHHTPDCAGISELWYTGSYTEAQWLADLRFVANRYKNVPYVLGLDLKNEPHGAATWGTGNAATDWNKAAERGSAAVLAVAPKWLIAVEGITDNPVCSTNGGIFWGGNLQPLACTPLNIPANRLLLAPHVYGPDVFVQSYFNDSNFPNNMPAIWERHFGQFAGTHALLLGEFDGKYGEGDARDKTWQDALVKYLRSKGINQGFYWSWNPNSGDTGGILRDDWTSVRQDKMTLLRTLWGTAGNTTPTPTPTPTPTPTPTPTPTPTPTPGTSTFSTKVIVTTAGTAAIATACRXPTPAPPAAPGRSRCRSPVRSTTPGMRPGRRAAARSEPAAWTSPHPGSRRHRRVRLLRRELSALWRVRLPCPLPLQHA

SEQ ID NO: 15741 - protein, 382 aa, Xanthomonas campestris; identical to SEQ ID NO: 15374

SEQ ID NO: 15742 - protein, 311 aa, Xanthomonas campestris; identical to SEQ ID NO: 15375

SEQ ID NO: 15743 - protein, 182 aa, Xanthomonas campestris
LYFVRHGESLANEQNYFAGSQNSPLTRLGRHQAQQAALRQQRALHFDQVHVSTLERAQATAAIILHDVAPMPEVVSSAALVERNFGIFAGKNKTLIKKSVGHAVFERYFHDADGAPPDGEHWMDMYARCKTYYETVLAPLDQQAKHVLVVAHKYIVEVLALIASGLPPAEYIDFRLPNSRPL

SEQ ID NO: 15744 - protein, 475 aa, Xanthomonas campestris; identical to SEQ ID NO: 15376

SEQ ID NO: 15745 - protein, 469 aa, Xanthomonas campestris
DYKIADISLADWGRKELDIAEHEMPGLMSIRRKHAQTKPLKDVRITGSLHMTIQTAVLIETLKDIGANVRWASCNIFSTQDHAAAAIAATGTPVFAWKGETLEEYWDCTLDALTFTLPDGTLTGPELVVDDGGDVTLLIHKGYELENGSTWVDEPASSHEEGVIKALLKRVAVERPGYWARVVKDWKGVSEETTTGVHRLYQIAEAGKLLIPAINVNDSVTKSKFDNLYGCRESLADGLKRAMDVMLAGKVAVVCGYGDVGKGSAASLRAYGARVIVTEIDPICALQASMEGFEVNTIESTLGRGDIYVTTTGNKDIITVEHLQAMKDQAIVCNIGHFDNEIQVDALNALKGVEKINIKPQVDKYVFGNGNAIFLLADGRLVNLGCATGHPSFVMSNSFANQTLAQIDLWEKRDSYEKKVYILPKHLDEEVARLHLEKIGVKLTTLTKDQADYLGVDVAGPYKPDHYRY

SEQ ID NO: 15746 - protein, 172 aa, Xanthomonas campestris; identical to SEQ ID NO: 15378

SEQ ID NO: 15747 - protein, 505 aa, Xanthomonas campestris; identical to SEQ ID NO: 15379

SEQ ID NO: 15748 - protein, 335 aa, Xanthomonas campestris
YSLARPFLFAFDAERAHALALRAIDTAYRTGTTALVATRPVPLPTPAFGLMFPNPVGLGAGLDKNGEHIDALLALGFGFVEIGTVTPKPQEGNPKPRMFRLPEYQAVINRMGFNNLGVDVLVKNVQRARRRGGLLGINIGKNKDTPNEEATSDYRYCMERVYPLADYITVNISSPNTAGLRELQEEQALRRLIADLRETQEALAAQHGKRVPMLVKVAPDLNDRDIDAAARVLADLAVDGVIATNTTVTRTLVASHPMAEQAGGLSGAPLLGQSTLVLRRLRARLPESIPLIGVGGITSGADAVAKMAAGASLVQCYSGLVYRGPRLIGECVDAI

SEQ ID NO: 15749 - protein, 201 aa, Xanthomonas campestris; identical to SEQ ID NO: 15381

SEQ ID NO: 15750 - protein, 418 aa, Xanthomonas campestris; identical to SEQ ID NO: 15382

SEQ ID NO: 15751 - protein, 408 aa, Xanthomonas campestris
LQGSLTIPGDKSVSHRAVMFAALADGTSKIDGFLEGEDTRSTAAIFAQLGVRIETPSASQRIVHGVGVDGLQPPQGPLDCGNAGTGMRLLAGVLAAQRFDSVLVGDASLSKRPMRRVTGPLAQMGARIETESDGTPPLRVHGGQPLQGITFASPVASAQVKSAVLLAGLYAAGETSVSEPHPTRDYTERMLSAFGVDIAFSPGQARLRGGQRLRATDIAVPADFSSAAFFIVAASIIPGSDVTLRAVGLNPRRTGLLAALRLMGADIVEDNHAEHGGEPVADLRVRYAPLQGAQIPEALVPDMIDEFPALFVAAAAARGDTVVSGAAELRVKESDRLAAMATGLRALGIVVDETPDGATIHGGTLGSGVIESHGDHRIAMAFAIAGQLSTGTVQVNDVANVATSFPGF

SEQ ID NO: 15752 - protein, 265 aa, Xanthomonas campestris
LMRIISFNANGLRSAASKGFFEWFATQDADVLCIQETKAQEHQLAGPEFLPAGYKAWFRDASTKKGYSGVAIYAKREPDEVRTALGWPEFDEEGRYIEARFGNLSVVSFYIPSGSSGELRQGYKFQVMEWLRPILSEWLASGRQYVLCGDWNIVRSALDIKNWKSNQKNSGCLPPERDWLNGLCADLLDEADASNGRGWVDSYRVLHPQGEDYTWWSNRGAARANNVGWRIDYQLVTPGLRDKVQACSIYREQRFSDHAPYIVDY

SEQ ID NO: 15753 - protein, 467 aa, Xanthomonas campestris
VPAVQVAAEMFRAYDIRGVVGKDLNPGIAALIGQAIGSVMQAQGLRDIVVGRDGRLSGPELTNGLIEGLRRAGCNVTDIGLAPTPVVYFGAYELRAGSCVAVTGSHNPPDYNGFKIVIGGETLSGAAITELHQRITEGRLHTAASPGELEQRDISDAYIQRIADDVQLDRPIKVVVDAGNGAAGEIAPRLLEAIGAEVVPLYCEIDGTFPNHHPDPSEPHNLGDLVQMVQRFDADIGVAFDGDADRLGVVTKEGAIVFPDRLLMLFAADVLQRNPGALVIYDVKCTGKLSDYVLRNGGSPLMWKTGHSLIKAKMRETDAELAGEMSGHFFFKERWYGFDDGIYAAARLLEILAQREETPSDVLGELPESVSTPEIKVPLDGDAHALVARFVERAQAGEESPFEAARLSTIDGLRADFGDGWGLVRASNTTPILVLRFEADTAVALERIRALFRSELQALLPDHPLAF

SEQ ID NO: 15754 - protein, 545 aa, Xanthomonas campestris; identical to SEQ ID NO: 15386

SEQ ID NO: 15755 - protein, 559 aa, Xanthomonas campestris; identical to SEQ ID NO: 15387

SEQ ID NO: 15756 - protein, 973 aa, Xanthomonas campestris; identical to SEQ ID NO: 15388

SEQ ID NO: 15757 - protein, 790 aa, Xanthomonas campestris
ERPMAQSQPEILDLPVLPLRDVVVFPHMVIPLFVGRDKSMRALEKAMEADKRILLVAQKSAETDDPAAGDLYTVGTLAQVLQLLKLPDGTIKVLVEGLSRVTVDKVAEQDGALQGRGTEVEASDAREPRELEAIARSLMSLFEQYVKTNRKLPPELLQTLAGIDEPGRLADTIAAHIGVRLADKQRLLEITEIGDRLELLVGLVDGEIDVQQLEKRIRGRVKSQMEKSQREYYLNEQMKAIQKELGDLDDAPGELEELARKIAEAGMPKPVETKAKAELNKLKQMSPMSAEAAVVRNYLDWLLGVPWKKRTKVRKDLKVAQDTLDADHYGLDKVKERILEYLAVQSRVKQMKGPILCLVGPPGVGKTSLGQSIAKATNRKFVRMSLGGVRDEAEIRGHRRTYVGSMPGRLVQNLNKVGSKNPLFLLDEIDKMSMDFRGDPSSALLEVLDPEQNHTFNDHYLEVDLDLSEVMFVATSNSLNIPGPLLDRMEVIRIPGYTEDEKLNIAMRYLVPKQIKANGLKPEEIEIGSDAIQDVVRYYTRESGVRNLEREVAKICRKVVKEIALAGPQPAAKKAVAKKAKPKALVTVTSRNLDKYLGVRRFDFGRAEEENEIGLVTGLAWTEVGGELLQIESTLVPGKGNLILTGQLGNVMKESASAALSVVRSRAERLGIDVDFLQKQDVHVHVPDGATPKDGPSAGIAMVTSLVSILTKVPIRADVAMTGEITLRGRVSAIGGLKEKLLAALRGGIRTVLIPDENRKDLADIPANVTRDLKIVPVKWIDEVLDLALE

SEQ ID NO: 15758 - protein, 330 aa, Xanthomonas campestris
TVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQEVSADGEVAVSGARVTRKGSERIVRYAFDLARATGRKKVTAVHKANIIKSTSGLFLKVARDVATQYPEIEFQEMIVDNTCMQLVMRPEQFDIIVTTNLFGDIISDLCAGLVGGLGLAPGANIGVDAAIFEAVHGSAPDIAGQGKANPCALLLGAAQMLDHIGQPQNAERLREAIVATLEAKDSLTPDLGGTGNTMGFAKAIASRL

SEQ ID NO: 15759 - protein, 688 aa, Xanthomonas campestris; identical to SEQ ID NO: 15391

SEQ ID NO: 15760 - protein, 340 aa, Xanthomonas campestris; identical to SEQ ID NO: 15392

SEQ ID NO: 15761 - protein, 386 aa, Xanthomonas campestris
ELESIQSQGLFKSERIITGPQSAQITLADGRRVLNFCANNYLGLADHPDIIQAAKDALDTHGFGMASVRFICGTQDLHKQLERTIADFFGTEDTILYAACFDANGGLFEPLLGEHDAIISDALNHASIIDGVRLCKAKRFRYANCDMADLETQLQAADAAGCKTKLITSDGVFSMDGFIAPLDEITALARKYNALVHIDECHATGFLGATGRGSAEVKGVMDQIDIFTGTLGKAMGGALGGFTTAKREVIELLRQRSRPYLFSNSLPPHVVAAGIKAFEMLDAAGELRTQLVENTRYFRERMTAAGFDVKPGVHPISPVMLYDAPLAQRFAERLLEEGIYAIGFFFPVVPKGQARIRTQISAAHTREQLDQAIDAFTRIGHELKVI

SEQ ID NO: 15762 - protein, 246 aa, Xanthomonas campestris
  unsure (1)..(246): unsure at all Xaa locations
TDSSKVVLITGAARRIGAQIATTLHGAGYRVALHAHRSGDALAARVAALCAQRAGSACALQADLRTPEAPAQLVDACVAAFGRLDAVVNNASAFYPTVLGEATPAQWDELFAVNARAPFFIAQAAAAQLRAHHGAIVNLTDLHAEQPMRQHPLYGASKSALEMLTRSLALELAPQVRVNAVAPGAILWPEDGKADAAKQALLARTPLARIGTPEEVAEAVRWLLDDASFITGHTLRVDGGRRLSXA

SEQ ID NO: 15763 - protein, 306 aa, Xanthomonas campestris
VTMELGMVGLGRMGANMAERLVRGGHRVHGFDLGAAARTSAQSKGIQTTDALATLVSALPSPRVVWLMVPAGKIVDDTLAQLLPLLQAGDIVIDGGNSYYKDSQRRAAQLQSSGIAFVDCGTSGGVWGLQEGYSLMVGGDEAAVTTLHPVLATLAPAPDKGWGRVGPSGAGHFTKMVHNGIEYGMMQAYAEGFALLQHKTDFALDLHQVAEIWRDGSVVRSWLLDLTADALAHNPTMGGIAPYVADSGEGRWTVAEAIDLEVSAPVITLSLMERLRSRDKDSFTDKLLAAMRNQFGGHAVLTTTPT

SEQ ID NO: 15764 - protein, 299 aa, Xanthomonas campestris
LDITRFDSDREAFVAELGAAYRQWGFAGIRNHGIAQSDIDAAYEVFKAFFALPDEVKRSYHVPGSGGARGYTAFGVETAKDSKHFDLKEFWHIGREIPDDSPYRAVMAPNLWPTEVPGFRERGYHLYQQLDQLGSRVLSALALHIGLPQDYFADKTDHGNSILRPIHYPPITSDDIPNVRAGAHGDINFITLLVGASAAGLEVRSNEGEWVPFTADADTIVVNIGDMLQRLTNHVYPSTIHRVVNPPGEEARKPRYSVPFFLHPNPDFLIDVLPSCISADNPSRYPEPITAHGFLEERL

SEQ ID NO: 15765 - protein, 250 aa, Xanthomonas campestris; identical to SEQ ID NO: 15397

SEQ ID NO: 15766 - protein, 593 aa, Xanthomonas campestris
  unsure (1)..(593): unsure at all Xaa locations
VTVEIDGQSLVVPKGSMIIQAADKAGIPIPRFCYHEKLPIAANCRMCLVDVEKSPKPSPACATPVMDGMKVTTRSEKALKXQRSVMEFLLINHPLDCPICDQGGECELQDVSLGYGRSVSRFNERKRVVPDEDIGPLVATEMTRCIQCTRCVRFTADIAGTYELGGMYRGENLQIGTYDGKPLTTEISGNVIDVCPVGALTNKVFQFRARPWELMARESLGYHDAMGSNLFLHVRRGEVLRTVPRENEAVNECWLSDRDRYSHQGLYAEDRAVKPLKKVNGEWTEVSWAEGLAAATQILRDNAGDQLGVLVHPATSNEEGALLARLAEGLGSGNLDHRLLNRDFSDAAVAEAFATPLAEIEQADVVVLFGTNVRHELPLLHARLRKASIQNRTQIHSVNPVDSISPSPRPAGRWSRRLSWLARWTTPRCVDAVKGASRAVIVVGALAENHPQAATLRAAARAFAAATGASLCRIPQGANAVGLVSQGVLPTARTVAGMFAEPRQAYVVYGIEPGLDFADAAAARSALAGAKVVAFSQFACASTRDVADVILPIGALPEIDASLTNLDGRVQTARAAGRLPVEAREGWRVLRAL

SEQ ID NO: 15767 - protein, 374 aa, Xanthomonas campestris; identical to SEQ ID NO: 15399

SEQ ID NO: 15768 - protein, 829 aa, Xanthomonas campestris
ATLPYTARVHAENLVRRADPQHVDAYLRQLIERKRDLDFPWFPARVVCHDILGQTALVDLAGLRDAIAEQGGDPAQVNPVVPVQLIVDHSLAVEYAGFDKQAFAKNRGVEDRRNADRFHFIEWTKRAFENVEVIPPGNGIMHQINLEKMSPVIYVQDGVAFPDTCVGTDSHTPHVDALGVIAVGVGGLEAENVMLGRASWMRLPDIIGVELLGRPAPGITATDIVLALTEFLRQQRVVGAYLEFYGAGASALTIGDRATISNMTPEFGATAAMFYIDQQTLDYLRLTGREDTQIALVETYARQTGLWADDLVTAQYERMLQFDLSSVVRNMAGPSNPHKRVATSELASRGIAAAWEQVPGQMPDGAVIIAAITSCTNTSNPRNVIAAGLLARNANARGLTRKPWVKSSLAPGSKAVQLYLEEAGLLGELEQLGFGIVAFACTTCNGMSGALDPVIQQEIIERDLYATAVLSGNRNFDGRIHPYAKQAFLASPPLVIAYAIAGTVRFDIEKDVLGVDAEGVPVTLKDLWPSDAEIDAVVARSVKPEHFRSVYEPMFRRSGLQGARVSPLYDWRAQSTYIRRPPYWEGALAGARTLQGMRPLAVLGDNITTDHLSPSNAILASSAAGEYLTQMGVPEEDFNSYATHRGDHLTAQRATFANPKLVNEMAVVDGQVTAGSLARLEPEGQVLRMWEAIETYMQRKQPLIIIAGADYGQGSSRDWAAKGVRLAGVEAIVAEGFERIHRTNLIGMGVLPLEFKPGTDRKMLGIDGSETFDVVGERTPGATLTLSVHRRDGEQLQVPVTCRLDTAEEVSIYEAGGVLQRFAQDFLEA

SEQ ID NO: 15769 - protein, 278 aa, Xanthomonas campestris
ARLLDGRRIAEELLDGLKLRVDARLAAGKTRPGLAVVLVGGDPASSVYVRNKRRAAEKVGIEAFDYDLPQGTTEAELAALIDQLNTDPKIHGILIQLPLPGIPDANRLIQRIDPRKDVDGFHPQNVGHLALREFGLRPCTPRGIVTLLAHTDQPVRGRNATIVGVSYHVGRPMGLELLIAGCTVTSCHKFTPPDVLEASVRNADILVVAVGRPGLIPGEWVKPGAVVIDVGINRLDDGRLVGDVGFEAAAQRAGWITPVPGGVGPMTVATLMQNTLEA

SEQ ID NO: 15770 - protein, 328 aa, Xanthomonas campestris; identical to SEQ ID NO: 15402
  unsure (1)..(328): unsure at all Xaa locations

SEQ ID NO: 15771 - protein, 276 aa, Xanthomonas campestris
SLVTSLTYVLPHRLLSSLARALAYSKTPATKQWLIDTVTRKFGVDLSEAQEPDPHAYPTFNAFFTRALKPGARVPDADPQALLMPADGRISQLGPIENGRIFQAKGQSFTAAELLGDESAAVPFHNGLFATVYLSPKDYHRVHMPWSGTLRETVHVPGRLFSVGPDAVRNVPRLFARNERLVCHFDTDFGPMASVMVGALLVSGVETVWSGVEIPRYGDRITRKDYRGKGITLERFAEMARFNYGSTVIVLLPPGVAALEGGLAAESSVRLGQALA

SEQ ID NO: 15772 - protein, 364 aa, Xanthomonas campestris
DAVMGSNSFGRLFTVTTFGESHGPAIGCIIDGCPPGLEIAPEEFTHDLQRRATGKSRHTSARREADEIEILSGVYEGRTTGTPIGLLIRNTDQRSKDYTNIAQQFRPGHADYTYWQKYGIRDPRGGGRSSARETTMRVAAGVIAKKWLKQRYGVLVRGFLSQLGEIRPTGFDWDAVEDNPFFWPHAAQVPELETYMDALRKSGDSVGARVDVVAGGVPPGWGEPIYGKLDSELAAALMSINAVKGVEIGDGFASAAQKGTEHRDLITPEGFLSNHAGGILGGISTGQAVTASMVLKPTSSLRLPGATVDADGAVVDVITTGRHDPCVGIRATPIAEAMMALVLMDQALRHRAQCGDVGEVSPLI

SEQ ID NO: 15773 - protein, 336 aa, Xanthomonas campestris
TRRFNVAVVGATGAVGETMLSILAERQFPVATLYALASARSAGGQVEFNGGKVDVLDLAEFDPTGVDIALFSAGGSVSKEYGPKFAAAGAVVIDNSSAFRYDDDVPLVVSEVNPEALKQRPRGIIANPNCSTMQMLVALGPIHRKYGIERINVATYQSVSGGGRSAMEELGKQTSELLSFQQIDPQRFPVQIAFNLIPHIDDFQDNGYTKEEMKLVWETRKILGDENIQVNPTAVRVPVFYGHSEAVAIETREKITVAEARALLAASPGVEVVDEHKAGGYPTPVTHASGQDAVFVGRIREDLSHPCGLNLWIVSDNIRKGAALNAVQLAELVAQE

SEQ ID NO: 15774 - protein, 206 aa, Xanthomonas campestris
RIKFCGMTRAGDIRLAGELGVDAVGFIFAHGSPRRVAPAEARAMRQATAPMVDVVALFRNNSKEEVREVVRTVRPTLLQFHGEEDDAFCRSFNLPYLKAVPMGASGVNGEDANARTLQLAYPNTAGFLFDSHAPGEGGGTGKTFDWSRLPTGLHRPFLLAGGITADNVFDAIVATLPWGVDVSSGVELAPGIKDGHKMRKFVEEVR

SEQ ID NO: 15775 - protein, 486 aa, Xanthomonas campestris
MHNYVVRQSLAFFHNDFAGRIANRVMQTGTSLRESAVQMVDALWYIVVYTGSALWLFAQADPWLMVPLLCWLVVYVGLMAFFVPRMKARAWVASDARSKATGRIVDGYTNIATLKLFSHARREEAYVRDAIDELAVKHRLQTRVTTAMDTAIAIANGFLIVGTCGLALWLWSRGQISVGAITLATGLVIRIHNMSGWIMWTVNGIFEDIGSVQDGMQTIAQPLTVQDQPTALPLQVTRGAVHFDQIHFHYGKRGGVIAGLDLRVRAGEKIGLVGPSGAGKSTLVNVLLRLYDLEQGRILIDGQDIAQVTQESLRGQIGLVTQDTSLLHRSIRDNLLYGRPQATEAQLLDAVHKARADGFIDTLVDGEGRRGFDAHVGERGVKLSGGQRQRIAIARVLLKDAPILILDEATSALDSEVEAAIQDSLDALMSDKTVIAIAHRLSTIARMDRLVVMDGGRIVETGTHAELIAHGGLYARLWARQTGGFV

SEQ ID NO: 15776 - protein, 344 aa, Xanthomonas campestris
DDLRIRKIEPLTPPSQLLSLLPCDERASETVTNARAALHEILHGRDDRLAVVIGPCSIHEPVAAMEYAQRLRPLREQFGDALEIVMRVYFEKPRTTIGWKGLINDPDLDGSFQINKGLRVARGLLRDINNLGLPAGVEFLDIISPQYIADLVAWGAIGARTTESQVHREMASGLSCPVGFKNGTGGDVKIAVDAVGAASHPHHFLAVTKDGHTAVAATAGNPDCHVILRGGKQPNFDAANVEASSQVLNKAGLPARLMIDASHANSGKNPDNQPKVIDDIATQLEGGETRIVGVMVESHLVGGRQELVPGGTLTYGQSITDGCLDWDTSLQVLERLASAVRARR

SEQ ID NO: 15777 - protein, 270 aa, Xanthomonas campestris
GDARLLTLYDQATWSEGPTWWEAQRTLVWSDLVGRRVLGWREDGAVDVLLDATAFTNGNAVDAQQRLVHCEHGRRAITRSDADGQAHLLVGRYAGKRLNSPNDLIVARDGAIWFTDPPFGLRKPSQGCPADPELAHHSVYRLPPDGGPLQRMADLDHPNGLAFSPDEQTLYVSQTPEQGHGSVEITAFAWRDGALHDRRHFASVPDGLPDGFCVDRGGWLWSSSGTGVCVFDSDGQLLGHIPTPGTASNCTFDQAQQRLFITGGPCLWML

SEQ ID NO: 15778 - protein, 441 aa, Xanthomonas campestris
LDARNLRLATRLGGLGLDPAAGRTLIREGILRRAVGLTLEATGCEAPMGATCKVEVDGGWVDAEVVGFSGERTYLMPSAELHGLLPNARVVPSRRRGGVEVGEGLLGRVIDSDGTPLDGKGPIRAEGSVGMAGVSINPLAREPITTSLDVGVRAINAMLPIGRGQRVGLFAGSGVGKSTLLGMMTRFTSADVIVVGLIGERGREVRDFVETTLGEEGLRRAVVVAAPADRPPLARLHGAYRATAIAEWFRDQGLNVLLLMDSLTRFAQAQREIGLSVGEPPTTRGYPPSVFAKLPALVERAGNGAKGRGSITAFYTVLTEGDDPQDPIADAARAILDGHILLSRRVADSGLYPAIDLESSVSRVVQDIADDTWRLRIRKLKRLLSAYTANRDLIAIGAYQRGSDPATDEALARWPEIVDFLGQDVHKASDLTDSLSALQRL

SEQ ID NO: 15779 - protein, 1160 aa, Xanthomonas campestris
MGLSTIKLSGSKSFGRTRPRCTCPTNMTGIVGPNGCGKSNIIDPVRWVMAQSSASRLRGDSLTDVIFSGSSARKPVSQATVELIFDNSDHTISGEFASFNEISVKRLVSRDGTSAYYLNGTKCRRRDITDLFLGTGLGPRSYSIIEQGMISQIIEARPEDLRVYLEEAAGISKYKERRKETETRIRHTRENLDRLGDLREEITKQLAHLQRQARQAEQYQALQEERRIKDAEWKALEYRGLDGRLQGLREKLNQEETRLQQLIAEQRDAEARIETGRVRREEAAEAVAKAQADVYQVGGALARIEQQIQHQRELSHRLHKARDEAQSQLQELTQHISGDSAKLAVLREAVADAEPQLEQLREDHEFRQDALREAEARLADWQQRWETHNRDTGEASRAGEVERTRVDYLDRQSLEADRRREALVNERAGLDLDALAEAFEQIELRHETQKASLDGLTEQVEARKHALGGLQEQQRASQGELAEVRKQAQAARGRLSSLETLQQAALGQEQGAAVAWLKARGLDSAVRVGERISVESGWENAVEGALGQLIEGVLVEAPEQLVDALGELGDGRIALVSSATDNVQFAPTSLAAKVQGPIAIRRLLARLHAAEDLDAARSLQCNLPDGDSVITRSGERLGEGWVRVSRSGAAKQGALLREREIQELRSQIDTLQEREGDLEEQLASFREQLLAAEQQREDAQRQLYMAHRSVSELAGQLQSQQGKVDAARGRIERIEAELGQLLETLDTSREQAREARAKLEDAVVRMGDLQGTREALESERRQLTDARDQARDAARGVRDAMHALALTLESQRTQITSLSQTLERMDSQRGQLDTRLEDLVAQLSEGDSPVETLEHEHQAALSERVRTERVLGEARTMLDSIDGELRSFEQTRQQRDEQALAQRERISQRKLDQQALVLNAEQLAAAVVKAGFVLEDVVNGLEEAANPAEWDAAVGQIDARMRRLEPVNLAAIQEYGEAAQRSEYLDAQNVDLTTALETLEEAIRKIDRETRGRFKDTFDRVNSGVQALYPRLFGGGHAYLELTGEDLLDTGVTIMARPPGKRVSSISLLSGGEKAMTAVALVFAIFQLNPAPFCLLDEVDAPLDEANVGRLANMVKEMSEKVQFLFVSHNKATMEAARQLSGVTMREPGVSRLVSVDLEE

SEQ ID NO: 15780 - protein, 311 aa, Xanthomonas campestris
VYLNFNEHPTGLSPAALDAASRSLARSGRYLFEMEQDLRNLMAGELQLPHDHLAFFPGSSDPLNRAGTLFTSPRAGLVMADPTFEALADLAAAQGVPVRKVPLRADGAHDVKAMAKADPSAGLIYLCNPNNPTGSITPRAEIEWLLANKPASAVLVVDEAYIHYSTEPSVADLVRQRQDLIVLRTFSKLYGMAGMRLGAALAPPGLLTKLASLGGNPLPVPAMAAGIASLRDPMLVPSRRADNARVRDDTIAWLKSKGYTCLPSQANCFMVDVKRDGKVFADSMQKQGVIVGRSWPIWPKRVRVTVGSEAE

SEQ ID NO: 15781 - protein, 798 aa, Xanthomonas campestris; identical to SEQ ID NO: 15413

SEQ ID NO: 15782 - protein, 507 aa, Xanthomonas campestris; identical to SEQ ID NO: 15414

SEQ ID NO: 15783 - protein, 361 aa, Xanthomonas campestris
MTRAFNFSAGPATLPESVLRQAQEEMVEWNGVGASIVEISHRSADFMAVAAAAEADLRTLLSIPDDYAVLFTSGGATTIQALLPLNFAAPGQAVDYVVSGHWGKTAIKQATPYVDVRVAADGQPGGYVDIPPVASWTLSPHAAYVHITANETIHGVEFRDTPDVGTLPLFADFSSSIASEPLDIRRYGLIYAGAQKNLGPVGISVVIVRRELLERAGQPRADIFNYASHVARDSMLNTPPTWNWYLLGLTVKWMLEQGGVAAFAQRNAEKAALVYGAIDGSGGFYRNQVMPTVRSRMNIPFFLGDEQLDALFVSESKAAGLLALKGHKAVGGIRASLYNAMPVAGAQALVAFMHDFQQRHG

SEQ ID NO: 15784 - protein, 115 aa, Xanthomonas campestris
IFKVFTLEAAHRLPNVPPGHKCARLHGHSFRVELHVSGEPGAETGWIMDFGDIKAAFQPIYDRLDHHYLNDIEGLENPTSERLAIWIWQQLKPALPQLSEIVVHETCTSGCRYRG

SEQ ID NO: 15785 - protein, 401 aa, Xanthomonas campestris
MRRVVVTGMGINSCLGNDLDTVSSALRESRSGITALPDHAEAGLRSQVGGAVDIDLDGLIDRKLKRFMGDASAYAYLAMRDAIADAGLSPEQVSDLRTGVIAGSGGGSSQWQVETADLLRARGVRKVGPYMVPRTMCSAVSASLATAFKIRGLSYSLSAACATSAHCIGAAADLIRHGAQDVMFAGGGEELHWTMSVMFDAMGALSTGFNDRPAVASRPYDAQRDGFVIGSGGGMLVLEDYDHAIARGARIHAELLGYGVTSDGADMVAPSGEGAVRCMHMAMQGLDRPIDYLNTHGTSTPLGDATELGAVREVFGDNVPPLSSTKALSGHSLGAASVHEAIYSMLMLRDGFMAGSAHIDELDPRAEGFPILRATREATLNTVMSNSFGFGGTNGVLVFGR

SEQ ID NO: 15786 - protein, 674 aa, Xanthomonas campestris
MTNPLLDFSGLPSFDTIRPDHVGPAIDQLLADAEAAVKAAEQVSPVSWDSFVVPLDDATERLWRAWGQVGHLQAVMNTPELREAYNSNLPKVSRFGSALAQNLALYAQYKALAASPEAAHYDEARRKVLDNALRDFRLGGAELDDASKARFAQIQEELSGLAAKFSQNVLDATDAWAHVTQDETQLSGLPSEVVAAARAAAEKDGAAGWKFTLQMPCYLPVQSDADSRELRARLYRANAERASEFGDVALDNSATIQRILALRAELAQLLGFASYADYSIATKMAQSPDEVMGFLRDLAVRAKPYAQQDRAELEAFARDELGLEQLEAWDLAYAGEKLKQARYSFSEQEVKQYFTEPKVLAGLFDVIHSLYGLTVKPDSAPVWHPDVRFYRLEDAQGALVGQFYLDLYAREGKRGGAWMDDCRNRRETSQGVQTPLVYLVCNFGRGSGDAPATFRHGEVTTLFHEMGHGLHQLLTRIGELGVAGINGVEWDAVELPSQFMENFCWEWERVQAMTAHVQTGEPLPRNLFDRLLAARNFQSGMFTVRQLEFALFDMQLHSSFDPAQDSVLELIERVRDEVAVNRPPTWNRFPHQFSHIFAGGYAAGYYSYKWAEVLSADAYAAFEEAPEQVADTGARFRHEVLARGGSRSAADNFRAFRGRAPKIDALLRHNGMAG

SEQ ID NO: 15787 - protein, 625 aa, Xanthomonas campestris
MSDWSLDQARKTYSIPHWADGYFDVNDAGHVVVKPTADGPAVSLPEVVDAARAAGAKLPLLVRFPDILGQRLGKLQAAFAQAQADWDYAGGYTAVYPIKVNQHRGVAGTLASHHGEGFGLEAGSKPELMAVLALSRPGGLIVCNGYKDREYIRLALIGRKLGLQTFIVIEKPSELNLVLEEARALDVKPGLGVRMRLASLGAGKWQNSGGDKAKFGLSPRQVLDLWKSLRDTEYADSLNLLHFHMGSQISNVRDIANGMREATRYFVELSRLGAKISHVDVGGGLGIDYEGTRSRSYCSINYGLHSYASNIVQPLASACEEHGLPPPRIVTECGRAMTAHHAVLIANVSEVEQAPEGRVPDAHDDEPAAIRHLREIHDELDVRPAVELFQEAQHFHAEGLSAYALGQIDLTHRARIDDLFYAIAHGVRARLSFDEKSHRPVLDELNERLVDKYFVNFSVFESIPDVWAIDQVFPIVPIERLNEAPQRRGIIADMTCDSDGMVKTYVENESLDSSLPLHGLNPGESYRIGFFLVGAYQEILGDIHNLFGDTDAVEVAVDGTGYRIAQQRRGDTTDVMLDYVGYQLDTLRATYAERIAAAQLPPERAQEVHDALEAGLTGYTYLSDE

SEQ ID NO: 15788 - protein, 607 aa, Xanthomonas campestris; identical to SEQ ID NO: 15420
  unsure (1)..(607): unsure at all Xaa locations

SEQ ID NO: 15789 - protein, 511 aa, Xanthomonas campestris; identical to SEQ ID NO: 15421

SEQ ID NO: 15790 - protein, 287 aa, Xanthomonas campestris; identical to SEQ ID NO: 15422

SEQ ID NO: 15791 - protein, 464 aa, Xanthomonas campestris; identical to SEQ ID NO: 15423

SEQ ID NO: 15792 - protein, 609 aa, Xanthomonas campestris; identical to SEQ ID NO: 15424

SEQ ID NO: 15793 - protein, 391 aa, Xanthomonas campestris
VAITAFTATTALGAGLDAQASALRERRSGMRRNDFGPQPLECWIGRVAGVEDVVLPDALQGWDCRNNQLAWLALQQDGMAAAVQAAAQRYGAERVAVVMGTSTSSVGASEEAYTRLVEDAHGLRFPDDLQRPIVHTPHSLGDFVQHATGLRGPAITVATACSSSAKVFAQAARLMAAGVVDAAVVGGVDTLCGSVLFGFNSLQVVAPQLCQPFDARRVGLSLGEAGGFALLERPAAAPDAAQWLYGYGESSDAHHMSAPHPQGLGAQLAMRGALDTAGLDAAAVGYLNLHGTATPANDSVEAAAVAAIFPDTLHASSTKAWMGHTLGAAGIVESVIALLALRDGLLPGTLNSAVPDPACGPQIRFDNAHSRIQYAMNNSFGFGGNNCSLLF

SEQ ID NO: 15794 - protein, 238 aa, Xanthomonas campestris
QRRALVTGGSGDLGGAICRQLAAQGRHVIVHANRNLARAEEVVASIVAAGGSAEAVAFDVADAQASADALAALLEAGPIHIVVNNAGIHDDAPMAGMNAQQWHRVIDVSLHGFFNVTQPLLLPMARARWGRIVSVSSVAAVLGNRGQTNYAAAKAALHGASKSLAREMASRGIAVNVVAPGVIESEMVGDSFAPELIKQMVPAGRVGTPDEVAALVAFLCSDVAGYINGQVIGINGGM

SEQ ID NO: 15795 - protein, 893 aa, Xanthomonas campestris
TPDVPLRDDVRRLGALVGDLLAEQVSADFLEEIERIRTTAIARRESDTPPAGLLSLLEGREPRAAEALVRAFSTYFQVVNIAERVHRIRRRRDYQRSGTDTPQPEGLHDALRRLKAQGVTLDELSEWLPRIDVEPVFTAHPTEAVRRALLEKEQLMVASLVDNLDGMRTPNERATDAARFRMALTASWQTADSSPVRPTVEDEREHVGFYLTQVLYRVIPVMYETLEHAIEETYGSTLALPRLLRFGTWVGGDMDGNPNVDAHTIAGTLDAQRRAVLDRYLNELWQLASLLSQSTTLVAVSPALSAQLERYQALLPDAAARSRPRHGDMPYRLLNDLMRARLQATLDDADGAYAAPAELEHDLQLILDSLEVNKGLHAGWFAVRRLLWRVRSFGFHLARLDVRQESSVHARAVADALGQADWDSQDATHRAGLLGPYASGEQALPQVDDEGNARLDAVFAALADARTRHGADALGSYIISMAHNRADVLTVLALARRGGLVDDAGAVPLDIVPLFETVDDLRGGTGTVQDLLADPVYRQHLRARGDTQMVMLGYSDSGKDGGIAASRWGLQRAQVELLEAAAELGVRLTFFHGRGGSIVRGGDKTTRALDAAPRGSVDGRLRVTEQGEVIHRKYGIRALALRSLEQMTGAVLLSSLRPRAPEPREDAWRPVMDLVAERSTVAYRGFVGAPDFMQYFRLATPIDVIERMTLGSRPSRRLGQDAALSNLRAIPWVFAWSQARAVIPGWYGVGSGLQAAVEAGHEDSLREMAQDWPFFRTFLDDIAMVLSKGDLNIAELFSRLAGPLHARFFPRIRDELALTKHWVKTLLGQRSLLQHDPRLALSIRLRNPYIDPISVLQVDLLQRWRATDGEDEELLRALVACVNGVAQGVQNTG

SEQ ID NO: 15796 - protein, 403 aa, Xanthomonas campestris
MSSYLFTSESVSEGHPDKIADQISDAVLDAILAQDKRARVACETMVKTGVAIVAGEVTTSAWIDLEALTRKVILDIGYNSSDVGFDGETCGVLNLIGKQSPDINQGVDRKNPEQQGAGDQGLMFGYATNETDSYMPAAIHLSHRLVEQQAKIRKKKNSALSWLRPDAKSQVTLRYEDGVATAIDAVVLSTQHDPGVKQKDLIEAVREEILKPVLPAKWLHKGTKFHINPTGKFVIGGPVGDCGLTGRKIIVDTYGGWARHGGGAFSGKDPSKVDRSAAYAARYVAKNVVAAGLADRCEVQVSYAIGVAEPTSISVTTFGTGKIADELIEKLIRKHFDLRPFGIIQMLDLIHPMYQQTASYGHFGRKPKDFTYTDGTGAQHSATSFSWEKTDRAEALRAAAKLK

SEQ ID NO: 15797 - protein, 728 aa, Xanthomonas campestris; identical to SEQ ID NO: 15429

SEQ ID NO: 15798 - protein, 296 aa, Xanthomonas campestris
  unsure (1)..(296): unsure at all Xaa locations
VRDYLTDLQDRICAAVEAIDGKARFAEDLWQRAEGGGGRTRILRDGAVFEQAGIGFSDVSGARLPPSASAHRPELAGATWRACGVSLVFHPHNPHIPTTHANVRYFRAERDGEMVAAWFGGGFDLTPFYPVDEDVMHWHRTAQALCAPFGEERYAAHKRWCDEYFFLRHRNETRGVGGLFFDDLGQDFERDFAYQRAVGDGFLDAYLPIVERRKDTPYGEAERAFQLYRRGRYVEFNLVYDRGTLFGLQSGGRAESILMSLPPQVRWEYGFQPQPGSAEARLADYLIPRDWLGXFP

SEQ ID NO: 15799 - protein, 209 aa, Xanthomonas campestris
MTSQRVRDRLVERLRESGIQDEATLNAVRTVPRHLFIDEALASRAYEDTALPIGHGQTISQPWVVARMTEAVLQVAPKKVLEVGTGSGYQGAILAALGLEVYTVERIGDLLRQARKRFRHLGMNVRSKHDDGRIGWPEHGPYDAIVVTAAAPALVDALVDQLAVGGRLVAPVGGASSQSLVQLTRGADGEIAQEVLAPVTFVPLLSGML

SEQ ID NO: 15800 - protein, 632 aa, Xanthomonas campestris; identical to SEQ ID NO: 15431

SEQ ID NO: 15801 - protein, 272 aa, Xanthomonas campestris
LSGIITALATPFGPDGALDLDAWRRLLEQQLHGGVQGIVVAGSTGEAAALSDDEYDTLVRAAVAQVAGRVPVLAGTGLSGTAKTIAQTRRAATLGAQYALVVTPPYVRPTQAGLLAHFQAVADNGGLPVLLYNVPGRTGCDLLPETVAALVSHPNIVGIKEARSEPERVAALVAMRSDSFVVLSGDDGSAAQSMLAGADGLVSVASNALPSAYRRLCDLARTGQHEAANAWDTRLSEYHSFCGIESNPIPVKALLQRAGIGHGLRLPLLPLS

SEQ ID NO: 15802 - protein, 593 aa, Xanthomonas campestris; identical to SEQ ID NO: 15434

SEQ ID NO: 15803 - protein, 619 aa, Xanthomonas campestris
RLPSRLLVCCVAVSALLGCGQREAGTAPAVASAGAPAAAAANTPLPLIPAPAQVTRGSGSFHIGAGTVISIVGGDADARRSAEYLAELLKRTRGLSLEVRNETSASPGSIRLERSAQAPVAQKEGYSLDSDAKGLRIQARDGAGLFYGTVSAWQLMTPDARKGDVEVPAVAIRDWPRFSWRGQHLDVARHFHDVATVKHVLDTMAVHKLNVLHWHLTDDQGWRIEIKRYPKLTEVGAWRTPPGAGQHGTPERYGGFYTQEQISEVVAYAARLHITVLPELDMPGHAQAAVAAYPEEVGVPGVRTQVGVDWGVNPYLFNTSERSLTFITNVLDEVLTLFPSTYIHIGGDEAVKDQWEASPAVRAQMRKLGVKDAHAMQGWFNEQLAQYLTQHGRRMIGWDEILEGGVPASAAVMSWRGIEGAVTAAKQGHDVVLAPGDSLYLDNLQTTRSDEPNGRLTTLPLSKVYAFNPVPAALNAEQARHVLGAQGALWAEYIPSRWHVDHALFPRLAAVAEVTWSPMAARDWKNFLARMPAQLQRYQALGIDYSDGAFAADIDLDGDVNAVLAGGPAKVSLGNQSGAGSLHYTVDGSDPTPDAPRYTAPFAIQLPTTVKATAFTDDG

SEQ ID NO: 15804 - protein, 266 aa, Xanthomonas campestris
PVVAFVGGGNMARSLIAGLLRQGAPASAIRVAEPVAELRQALSADFGVQVFDDARSAVEGAALWVLAVKPQVMSTVCTQLADLAQQQHPLLLSIAAGITATQLERWCGGTAAVVRAMPNTPALLGAGVTGLYANARVSAAQRTQATRLLESAGVTVWLDDEAQMDAVTAVSGSGPAYVFLLAEAMEAAARAQGLPAETARTLVLHTLLGAARMLTESGEAPEVLRRRVTSPNGTTQAAIEEFQAGGFEALTATAIAAATERGRSLS

SEQ ID NO: 15805 - protein, 311 aa, Xanthomonas campestris
AMTTMQLDSDGRLRHLLTLEGLPRATLLQLLDRAGQIRDAAVGRVGKRSVLAGTAVCTLFFEPSTRTRSSFHLAAQRLGADVLNFDASTSSTRKGETARDTLKNLEAMGVRGFVVRHPEDGAVERLAEAAGEGTALINAGDGRSAHPTQGLLDMLTLRQAKGTDFSKLKVVIVGDVKHSRVARSDLHALRTLGAGEIRVCGPASLLPDDDMLDGCVVGEDFDAMLEGADALMMLRLQRERMEEGLVPSLEQYHADYGLTRERLARAGRDAAVLHPGPINRGVEITDEVADGAQSCVLRQVANGVAVRMAVL

SEQ ID NO: 15806 - protein, 300 aa, Xanthomonas campestris; identical to SEQ ID NO: 15438

SEQ ID NO: 15807 - protein, 451 aa, Xanthomonas campestris
IVLKFGGTSVSRRHRWDTIGKLASKRANETGGRVLVVVSALSGVTNELTAIADGAADSAQRVAALELRHREFLAELELDADAVLGARLAALHALVGDARAASRTLDWQAEVLGQGELLSSTIGAAYLHANGLDMGWLDAREWLSALPPQPNQSEWSKRLSVSCQWQSDAAWRARFDAQPTRLLITQGFISRHADGGTAILGRGGSDTSAAYFGALLGASRVEIWTDVPGMFSANPKEVPDARLLTRLDYYEAQEIATTGAKVLHPRSIKPCRDSGVPMAILDTERPDLPGTSIDGSAEPVLGVKAISRRNGIVLVSMEGIGMWQQVGFLADVFTLFKKHGLSVDLIGSAETNVTVSLDPSENLVNTDVLAALSADLSQICKVKIIVPCAAITLVGRGMRSLLHKLSDVWATFGQERVHMISQSSNDLNLTFVIDESDADGLLPILHAELID

SEQ ID NO: 15808 - protein, 359 aa, Xanthomonas campestris
GTPRYVYHLPTVRARAQALAQIAAVDQRYYAIKANSHPAILMALEQAGFGLECVSHGELRRVFDTLPELSPRRVLFTPSFAPRSEYEAAFALGVTVTVDNVEALKRWPELFRGRNVWLRIDLGHGDGHHEKVNTGGKASKFGLSSTRVDEFVELARTLEVTITGVHAHLGSGVETGEHWRMMYDELAGFARRIGTVETIDIGGGLPIPYSAEDEPFDLELWAKGLAEVKAVHPGFRLAIEPGRYLVAEAGVLLAQATQVIEKDGVHRVGLDAGMNSLIRPALYDAWHDIENLSQLGAPADGSFDVVGPICESSDVFGKRRRLPAATAPGNVMLIADAGAYGYSMASTYNQRELPREEVI

SEQ ID NO: 15809 - protein, 320 aa, Xanthomonas campestris
LGLPQIQSLAAPDMAAVDALIRRRLASDVVLINQIADHIISAGGKRLRPMLVMLAGHAAGGSGPEHHQLAAIIEFIHTSTLLHDDVVDESDLRRGRSTANALWGNAPSVLVGDFLYSRSFQLMVELDRMEVMQILADTTNRIAEGEVLQLLHVHNPDTDEAAYLRVIERKTAVLFAAGTRLGALASGADAQVQQCLYDYGMQLGFAFQIADDVLDYAADATDLGKNLGDDLAEGKATLPLIHAIAHSDAATQQRLRQIVEQGDAEAMPEVLTAIRATGGLDYSRQRAAEYAAAAEQALDGLPPSPAVAALRGLARYAVER

SEQ ID NO: 15810 - protein, 268 aa, Xanthomonas campestris; identical to SEQ ID NO: 15441

SEQ ID NO: 15811 - protein, 214 aa, Xanthomonas campestris
YELLISDCDGVLVDSEILADRVMRETLAAFVPAEPLEHLLETTFGQTTREVLRRVEEHFALQLPETLLAQIQARSEALIAAEVQPIAGVRQALEQIPLPLAVASNSRRHNVIASVERAGLTERAAGRIFSADMVERPKPAPDVYLLAARTAGVVPERCLVIEDSPTGATAALAAGMQVLGFTGASHIPARARRHPATDRRAGGVDDMRDLPALF

SEQ ID NO: 15812 - protein, 255 aa, Xanthomonas campestris; identical to SEQ ID NO: 15444

SEQ ID NO: 15813 - protein, 636 aa, Xanthomonas campestris
DLNGFVNSKWLAKTTIPPDETEVGSYPTLQDESDAAQREIVEALGRSKPVEGSVEQLVGTFYASGMDEATIQRLGDAPIRPRLAQIEALKTPQDVANFIAARNTQGAGLVFKFGAYPDFQDASKVIAYAEENGMTLPSKAYYTDPRYADIRKAYLDYITQSFVLAGATPEAATVQAKQVLQVETALAAASLSPVEARDPKTQYHLVSVAQADAVTPHFSWKAYLAAQGLSTDQRFSLSQPRFFAGFDHLLKTLPVSQWQAYLRFRAIDDAAFALSKPFVDNRFAFRYKTMDGQQAQRPRWKRVLFATDEAIGEGLGQLYVAKMFTPEAKQRATELIENIRQALKLRIQQADWMTAETKSAALKKWAGFVVKVGYPDHWRSWSGLHFERDAYLRNVETAAAFNYRYELAKVGKPADRTAWFTTPQTVNAFYFSLDNSINFPAAVLRPPFFDVTADDALNYGAIGAVMGHEATHGFDDQGSKFNAVGTNVNWWAPADLAAFTARASKLVTQFNAYTPLPNKPDVHVNGELTLGENIADLGGINIAFDALQANLQRHPERGADIDGFTPQQRFFLGWARLWRGTMREEKQLSLLSSDGHAPYAVRTNASPSNMPQFATAFGCKPGDAMVRSEQDRVVIW

SEQ ID NO: 15814 - protein, 469 aa, Xanthomonas campestris; identical to SEQ ID NO: 15446

SEQ ID NO: 15815 - protein, 406 aa, Xanthomonas campestris
PCKRDRMKLHTLYLSLLLAATTSAHAMEFSDAELARASALQKRLVTLDSHLDTPANLERGDFDVMQGHAGNRLSQVDYPRMLEGALDGGFWAVYTGQGNRSAAAHLDDRDAGLQRLMKIHNLLAAQPQRFALATTPADAARIKAAGKRVVYISMENASPLVADPSLLRFYYAQGLRLMSTVHFLNNEFADSATDPKGAEWKGLSPAGKQLVQQALGIVIDQSHASDAVFDQLIALSPVPIVLSHSGARAVYNHPRNIDDARLKVLAAHGGVIQVNSYGGYLIDSGASPERKAAEKALADQYGGWEHLKMSDGTALSEALKALDARYPVKRATEEDFFAHLEHVLAVAGPAHVGIGMDWDGGGGVVGLEDVSDLPRITAWLLRKGYSEPQIAGIWGGNLLRVMEQAQ

SEQ ID NO: 15816 - protein, 446 aa, Xanthomonas campestris
AARIDRLPASATLWRLVGLLALGGFFELYDLFQTAYISPGLIRDGIFASGNDGAFGMSDQAAFAAATFLGLFVGAALLSPFADRFGRRLVFTVALVWYTAATVAMGLQSTATAVIVLRFVVGIGLGIELVTIDTYLSELVPRHMRGAAFAFAFFLQFLAVPSVALSAWLLVPHAPLGVSGWRWVVLLSGVFALAIWWLRSRLPESARWLAAQGRHAEAEAVMAQLEAACSRDLGRALPPPEPVQRVAAPDSRLSALWRQPYRGRIGMLVVFQIFQAIGFFGFGNWLPALINAQGAGVTKSLAYAFAISLAYPLAPLLLLRVAHRWENKWQISASALGAVVFGVLFALQHAPLGMIACGAMIAFCNAWMSFAYHGYQAELFPTALRARAVGFCYSFSRLSTAGSSVLIGWLLAQTGSHGVLAFIVISMTIVASVIAAFGPRTRNRAL

SEQ ID NO: 15817 - protein, 284 aa, Xanthomonas campestris
FERWVARTERQLDACLPSPALAPQRLHAAMRHAVLGGGKRMRPLLVYASGALFGAEEGSLDAPAVAVELIHAYSLVHDDLPAMDDDALRRGHPTVHIAFDEATAILAGDALQARAFELLAEAPADAALRVGWLQSLASAAGAAGMCGGQALDIDATGQVQALEALQRMHALKTGALIRAAVRMGVLTGGAGIADQQRLDAFADALGLAFQVRDDILDVESSSAQLGKTAGKDAAQSKSTYPALLGMDGAKTKLAELASHMHALLLPYGESGATLASLGRFAVDR

SEQ ID NO: 15818 - protein, 428 aa, Xanthomonas campestris
VVAGFVLGAIAGAAMGPAAEVWFGPLGDLYVTLIKMIAVPLVFFAVINAISSLHGQKSVAALGGRTFLWFVITAALAVGVGLAVGTIMQPGAGHFSLSVDSAWKPRDVPSPIKVLLDVVPSNPFYALTGIGTKTNAAGETVLAAGRGSILPVIFFAALLGFAMVKLGDRVAEARKLTGQMSDIMIQVTRFVLEMTPLGTFGLIAGLVGSYGFAKLLPFGNFVLALYVACALHIVVVYSSLLLLHGLNPWKFFRGAAPGMQVAFVSSSSFAAMPVAMRSITHNLGVNKDYAAFAVPLGASIKMDGCGAIFPALCAVFIAQYTGVPLTANQYFVVLIASVLGSFGTAGVPGTAVVMATVVLSAANLPLEVIGYLYAIDRILDMMRTMTNVTGQMLVPVLVAKETGLLDKTIYESASTNVGLEDPPTDRAA

SEQ ID NO: 15819 - protein, 625 aa, Xanthomonas campestris
DFYDYANAGWLKSNPVPQAGAVTALGQLSDRALQQQRELLDAAMNSPQGNVQKLLGDFWASGLDEAAVEKDGSNPIAPLLSRIDAIKKAKDVPASIAALHQVGIPVGFNFGPDVDLKALDRHIGYFMQGGMGMPDPAFYTRTDADTQALMGRYRAYVKQILALTGTPADKLDADAASVLQIETALARSAQSVQGINNPFNNYAPIATKELTKQYKNLRLGDFLEAQGVKDDLVSMADPAMFKQLDSMIVSIKPEQWKAYLRWRVGDAMAPYLSKSFHDAEYQFRGRLLRGDALPPQRWQQVLDAINVAAGPMLGREYVSRYLSSDTRRQAEAIADQIRDAQLAALERTGWGNGEVIAEAKAKLSAMKIEVGAPRRDLDYTVQPMGRGSFGGNMLIASTWRHREEMKRIGKGNADRRWDVLPQQPALAYDIAQNRLIITAAVLQPPVLSTGATPAAQYGAYGALVAHEMTRAIDAKGALVDAKGELRSWWTPAEKSSWTLLTGKVANQYGAYAYPGVPNAKVNGAQTAEENLADLAGVELAWQAFSKAQPAATQADKQAFFTAWAGLWAQQLSPNEAVQRASADIRAPGQWRTNGPLSNLPEFGATFSCKPGQPMQRVDADQLKIW

SEQ ID NO: 15820 - protein, 653 aa, Xanthomonas campestris
PAFDISELGPAASACQNLDEFVNGAWAKANPIPADHTSWGIDELLTEKSLLIQRELLEAAAKQAGTQAPSLEQKIGALYASGMDEAAIEAAGAKPIQPQLDKIAALHSGKDVAAYIISRHGEGDAQVFAFGAGADFHNADQQIAFTQEGGLGLPTKDYYTGAEHAPIRAAYLAYIAKSFELTGTPAALAKTQANDVLALETRLAAASLAPVDAREPKNQYRLVTLAEADKLTPHFPWEDFFATQGVPVGSGFSLAQPRFFAAFDQALASAPIAQWQAYLRFHAIDDASTRLSKAFADNRFAFYGKTLSGQPEQLPRWKRVLRSVNGAMGEGVGQLYVAKVFTPDAKQRASELVDNVRAALKTRIEQVDWMSAETKAKALAKWQTFLPKIGYPDTWRDWSGLQITPGDYYGNLQAADTFNYRYDIAQIGKPTDRGRWSMTPQTVNAYYDPMTNSINFPAAILQPPYFDATADDALNYGGIGAVIGHEATHGFDDQGSQFDGAGNNVNWWTAEDRRKFDQRSNQLVKQFDAYAPLPSHPTLHVNGKLTLGENIADLGGTNVAYDALQTALQQHPERAKAIDGYSPDQRFFLAFARSWRQRVRDQQQMVYLASDPHAPAKLRAIASPSNMPQFATAFACKPGDAMVRPEKDRVVIW

SEQ ID NO: 15821 - protein, 643 aa, Xanthomonas campestris
LDPNGNACTDLNAYANAKFLAANPVPGDRTSWGAFEMLDERSNAIQQQLAEQAAADTGATGVEKIVGDLWSTGMDEAKINAQGIEPLKPELAAIDAISDQAKLVDYLRSSAAKGNNELFSFGAEADFKKSSQNIAYAMQGGLGLPDPEYYTSAGNKAKLDAYQAHVAKVLELSGVAAADATAQAKQVVAFETRLAKVSKTSTQMSRDASLAYNPISPADADKLTPNWSWTEFFKSQGVATPEMFSLAIPAFHQEVSKMIADTDPAIWRAYLRFHTVDGASPYLSQPFVDESFAFYNKTMRGQKEIKPRWKRVLATINSQAGETLGQMYVKVAFPGDSKAKMETLVTNLRTALKARIEKLDWMSPETKAKAIAKWESFTPKIGYPEKWREWNGLSTSRDSYLGNVMAASEFNYKWNLSKIGKPVDKTEWGMSPQTVNAYYNPLQNEIVFPAAILQPPFFDPNAPEEMNYGGIGAVIGHEMTHGYDDQGSRFGADGNFIADPGWWTQKDLDAFKARTGKLVAQFDSYRTPAGDKVKGDLTLGENIADLGGLNTAYDAMKTATAGKDDPKSDGITRDQRFFLNWATVWRRNFTPEELVVRLKTDPHAPANFRAIGAPSNMPAFAAAFSCKAGDAMVRQGDQQVVIW

SEQ ID NO: 15822 - protein, 291 aa, Xanthomonas campestris; identical to SEQ ID NO: 15454

SEQ ID NO: 15823 - protein, 386 aa, Xanthomonas campestris
  unsure (1)..(386): unsure at all Xaa locations
MNFHEYQSKQLLAEYGIPVPAGKVASTPDEAVEVANSLGKGPWMVKAQIHAGGRGKAGGVKFCKTTDDVKAAADKMLGTKMSTYQTAGVELPVNLVLVTTAGEIVKELYLSILVDRGTKTITYIASSEGGVEIEQVAAETPXLIHSLNVDFVEGVQGYHGRDFGFKLGLNAKQAGQFASIMVNLYRLFNDKDLALVEINPLAILDDGNLYALDGKFDSDDNAAFRQKALVAMRDKTQEDETEVTASELDINYVTMDGNIGCMVNGAGLAMATMDVIKLNGGEPANFLDVGGGANKQRVIEAFKLILSSDKVEGIFVNIFGGIVRCDMIAEGIIAAVKEVGVKVPVVVRLEGTNVEEGKQLLRDSGMAIIPADNINDGAKKVVEAVK

SEQ ID NO: 15824 - protein, 705 aa, Xanthomonas campestris
  unsure (1)..(705): unsure at all Xaa locations
IRQGRPFPRGAIFDGKGTNFALFSAHATRVELCLFDEQGNESRVDLPEYTNEIWHGYLPDVKPGQRYGYRVHGPYAPTEGHRFNHNKLLLDPYARELDGDLVWADELYGYTVGHPDGDLSFDERDSAPFMPKCVVVEDTYDWEDDARLLKPWNETVIYETHVRGYTMRNAQVPEAVRGTFAGLAQPSVLQYIKDLGITAVELLPVHAYLDDQHLLDKGLRNYWGYNTISFFALKSRHLSSGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGETDNADILQLRERQMKNLLATLLLSQGTPMMLAGDERAQSQGGNNNTYCQDNEITWLDWENDPTDGRLTDFVKSLTALRKRYPILSRGRFLNGQYNEEAGLRDLTWLNPGGTEMDDAHWTDAGARSVGLLLEGKAQTSGVKERGNDATLLIVINAYHEGVTFTLPSSDEPVHWKLALSTDEALEVDSMPAGASEFLAPPRSITVFECKVGXLPEHALASP

SEQ ID NO: 15825 - protein, 675 aa, Xanthomonas campestris
KRRVPHIRQTESSECGLACIAMLLSYYGHETSLGELRNRFTVSTSGATLASLIEIADANGLTTRPLRLELYELPKLSLPCMVHLHHGHFVVLTAVRGGHVHISDPATGVKKIKLDEFDELFSGIALEAHPGPAFKKIKSVPSVSLRDLAGSLRSLVPAFWGVGILALFLEGCALIAPQYLRLTMDQVLSVKDDGLVTTLAIGFSIVLLVQLVLTVARKWTLLWISSTTGLRWSSNLFRHLVSLPQSYFVKRHTGDISSRFQSIYSIQQSLTTKMMEAVIDGVMSFLMLLLLMSYDAPLAFALLAFTIAYVGSRYAYYAKLKEANLDQINIDARRQSLLYETVRSIQPIKLFNKSALWASRFTNYSAKATNATIGAERIRIGFDSVQLLIQGLCRIFVIWEGTRLVLSGDMTIGVLTVFLIYATQFSQRSINLADYLMQLRLLRLHTERISDITHSEPESFLHGNGALEDAAPAIAIANGYFRYSSTDKWIMSALQLRAPAGQVIAIVGNSGVGKTTLIRVLAGLEDLQVGDFLVNGEDLRKVGKSSYRSKVSIVMQGDNLLSGTLSENISMFDEHIDQERLVQAAKLACIHDDIQRMPMGFNTRVGDLGNTLSGGQKQRIFLARAFYRRTKLLLMDEPTTGVDEQMGIQLMKNIKSIGATTVVVTHDKNISRMCD

SEQ ID NO: 15826 - protein, 253 aa, Xanthomonas campestris; identical to SEQ ID NO: 15458

SEQ ID NO: 15827 - protein, 495 aa, Xanthomonas campestris; identical to SEQ ID NO: 15459

SEQ ID NO: 15828 - protein, 397 aa, Xanthomonas campestris
VSFFANVEQVPGDPILGLTEAYNADSRPNKVNLGVGIYYDENGRIPLLRAVQKIEQQLALDAKPRGYLPIDGLAAYDKATQELLFGAESALVASGRVATSQTVGGSGALRVGADLLKKLLPTSTIAISNPSWENHRAVFGAAGFEVVDYTYFDAASHGLNFDGMLADLAKLEPGTVVLLHACCHNPTGADLSREQWKQLAGLLKERNLFPFVDIAYQGFDKGIEADAYAVRLLAAEGIDTYVVASSYSKSFSLYGERVGALSVVSATAAEAKAVQSQVKRIIRTIYSSPSTHGAALVAGVLTSPELRDVWEQELTEMRERIHALRAGLVAKLAALGAPEFEFIQRQAGMFSYSGLTKSQVDRLRDEFAIYAVGTGRICVAALSQRNLDYVAQAVATV

SEQ ID NO: 15829 - protein, 330 aa, Xanthomonas campestris
MSRPSLTRFLIEEQHAGRIDPELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQADMRVPEDTAEFAINMSNQRHWEPAMQAYVGDLLAGKDGARGKDFNMRWIASMVADVHRILTRGGIFIYPWDKKDAAKPGKLRLMYEANPMGMLVEQAGGAATTGRERILDIQPTQLHQRVPVFLGSKNEVAEATRYH

SEQ ID NO: 15830 - protein, 1332 aa, Xanthomonas campestris
ARQARQPAARQAFEQALAASQAQRQARAAQQPAITLDTQLPIAREADRIIALIRDHPVVVIAGETGSGKTTQLPKLCLAAGRGAAGMIGCTQPRRIAARAVAARVAEELNTPLGTTVGFQVRFTDRVGEDSRIKFMTDGILLAEIASDRWLSAYDTIIVDEAHERSLNIDFLLGYLKQLLRKRPDLKLIVTSATIDTERFSRHFDDAPVINVEGRTFPVEVRYRPLEGESGDGDTGDVGRDGERTVNDAIVAAIDEITRIDPRGDVLMFLPGEREIRDAHQSLERRKYRETEVVPLYARLSAADQDRVFNPGPRRRLVLATNVAETSLTVPRIRYVVDPGYARVKRYSPRQKLDRLHIEPISQASANQRMGRCGRIAEGICYRLYAEADFAARPAFTDPEIRRASLSGVILRMLQLGLGRIEEFPFLEAPDERAVADGWQQLLELGAIDAERRLTSIGRQMARLPVDVKLARMLVAAQQHGCLREMIIIAAFLGIQDPRERPPEAREAADNAHALFADARSEFVGILRLWDAYRQVHEDLTQSKLRDWCGRHFLGFLRMREWRELHRQLRLLCEELGWSEEPAGAMLAPLLAGASAPVREDGQAHRATRGQLHRAARLAREGKPDPAAPPAQAKAAAAKSSPADATDAAVRTTERERAAAYQALHRALLAGLPTQIGHRTEKGDFLAARQRRFVPFPGSALARKPPPWILAATLLDTQKVWGMTNAAIEPDWAIAELPHLLARKHFDPHWSRAQGQVVASEQISLFGLVLAPKKPVHFGKIDPATSHDLFVRQGLVPGEINTRAAFVADNLKVLEQAREEEAKLRRAGIVADEDWQARWYLDRIPAELHSASGLDAWWKTLPADKRRSLHWSLNDLLPGEGSEADRFPKYFALGDARLPLQYRFEPGAIDDGVTLEVPLHLLNALDPSRLSWLAPGFVADKASALIRSLPKAQRRNYVPAPDYGRAFYEAFSTPSADDMRGELARFLSKATGAPVAALDFDEEALDTHLLMNLRLRDEDGRVLAESRDLVGLRARFGERAGQAFAARAGRALAAEGLRDFPATPIPEQVAGEAGVPAYPALVDQGEDAALRIFADRNEALRAHPRGVRRLLEIALADKIKQARKQLPVSPKTGLLYAAIESQERLRGDLVDAALNAVLAEGLGAIRDPAAFAQRREDAVKRLFGEAMARLTLAESILGAVAELKPLLEAPLMGWARGNLDDMEQQLRALVHAGFLRDTPADALANYPRYLKAMILRTERAKRDPARDQARMLELKPFVDALNDAAARGLQQHPDWQALRWDLEELRVSVFAQELGAKSGVSAKKLSQRVAAL

SEQ ID NO: 15831 - protein, 430 aa, Xanthomonas campestris; identical to SEQ ID NO: 15462

SEQ ID NO: 15832 - protein, 559 aa, Xanthomonas campestris; identical to SEQ ID NO: 15463

SEQ ID NO: 15833 - protein, 423 aa, Xanthomonas campestris; identical to SEQ ID NO: 15464

SEQ ID NO: 15834 - protein, 275 aa, Xanthomonas campestris; identical to SEQ ID NO: 15465

SEQ ID NO: 15835 - protein, 251 aa, Xanthomonas campestris
APVKVAARNLDFYYDKYHALKGINIEIPEKRVTALIGPSGCGKSTLLRIFNRIYALYPKLEARGEVLLDGENILSPKYPMNRLRSKVGMVFQKPVPFPMTIFENVAYGIRHHEKLSKADMQNRVEHALRQGALWDEVKDKLGQSALGLSGGQQQRLCIARAVALRPDVLLLDEPTSALDPISTSRIEQLVEELKRDYTIVIVTHNMQQAARVSDYTAFMYLGDLIEHDRTETIFSQPSKQQTEDYITGRFG

SEQ ID NO: 15836 - protein, 444 aa, Xanthomonas campestris
MLDKVVIANRGEIALRILRACHTLGIRTVAVHSTVDRNLKHVAMADESVCIGPAASSDSYLNIPALIAAAEVTDAQAIHPGYGFLSENADFAERVEESGFIFIGPKADTIRLMGDKVEAIRAMKAAGVPCVPGSGGPLGDDIVANTKIAREIGYPVIIKAAGGGGGRGMRVVHSEAALKAAIETTKSEAKAAFSNDQVYMEKFLENPRHVEIQVLADGQGNAIHLGERDCSMQRRHQKVVEEAPAPGISEELRAEIGKVCVDACIRIGYRGAGTFEFLFEGGRFYFIEMNTRIQVEHPVTERITGIDLVCEQLRIAAGHKLSIKQSDIVLRGHAIECRINAEDPETFMPNPGLITAFHPPGGPGVRVDTHIYAGYKVPPNYDSMIGKLIVHGPDRETAIARMRVALSEMVVDGIKTNIPLQQRIMRDKGFQAGGQNIHYLEKRL

SEQ ID NO: 15837 - protein, 146 aa, Xanthomonas campestris
MAHLLLLHGPNLNLLGTREPEVYGRTTLAQIDAALVDRAQAAGHTLDCLQSNAEHVLVERIHAAREDGTAFILINPAAFTHTSVSLRDALLGVGLPFVEIHLSNPHTREPFRHHSYLSDKAAGVICGFGADSYRLALEAVIARLER

SEQ ID NO: 15838 - protein, 540 aa, Xanthomonas campestris
MAAKDIRFGEDARTRMVRGVNVLANAVKATLGPKGRNVVLEKSFGAPTITKDGVSVAKEIELADKFENMGAQMVKEVASRTNDNAGDGTTTATVLAQALIREGAKAVAAGMNPMDLKRGIDQAVKAAVIELKNISKPTTDDKAIAQVGTISANSDESIGNIIAEAMQKVGKEGVITVEEGSGLENELDVVEGMQFDRGYLSPYFINNQQSQSADLDDPFILLHDKKISNVRDLLPVLEGVAKAGKPLLIVAEEVEGEALATLVVNTIRGIVKVVAVKAPGFGDRRKAMLEDMAVLTGGTVISEEVGLALEKATIKDLGRAKKVQVSKENTTIIDGAGDSATIEARVGQIKTQIEDTSSDYDREKLQERVAKLAGGVAVIKVGASTEIEMKEKKARVEDALHATRAAVEEGVVPGGGVALVRALVAVGNLTGANEDQTHGIQIALRAMEAPLREIVANAGEEPSVILNKVKEGTGNYGYNAANGEFGDMVEFGILDPTKVTRSALQNAASIAGLMITTEAMVADAPKKDEPAMPAGGGMGG

SEQ ID NO: 15839 - protein, 585 aa, Xanthomonas campestris
MAEIKEALVPDIGDYSDVPVIEVLVSVGDTVSKDQSLVTLESDKATMEVPSSVAGVVKEIKVKVGDSLSQGALVALIEVADADAGAETAAAPAPAAAPAKAAPAAAPAPAAKAAPAAASDGGQVEARVPDIGDYSGVPVIEVLVAVGDTVAKDQSLVTLESDKATMEVPSSVAGVIKELKVKVGDSLSQGDLVAIIAASDGGAGAAQSPAKPTTDTAETAGKVEPVAVPAEPDKLAQREIAQVQSARSTAASAAGPGSARHPEQPAGDLRCRQRAAVQGAVCQPGGARVRARARRGSEPDQGQREGRRITREDVQRFVKAALSGGAPAAAGAAPAGGGNGLNLLAWPKVDFSKFGETETQPLSRIKKISGANLARNWAMIPHVTQFESADITDLEALRVALNKENEKAGIKLTMLAFLIKASAAALKKFPEFNASLDAAGENLTLKKYINIGFAADTPNGLVVPVIRDVDKKGVLQIAQESGELAKKARDGKLGPADMSGGCFSISSLGGIGGTAFTPIINAPEVAILGVSKSAMQPVWNGKDFAPKLMLPLSLSYDHRVIDGALAARFTTYLSQVLADMRRVLL

SEQ ID NO: 15840 - protein, 253 aa, Xanthomonas campestris
LQDRVVIITGGAQGIGRGIAQAVLGAGGSVVIGDLDADAGKACLQDWALPRRSAFVRADAAREPHAARLVATALKRFGRLDGLVNNAGVPDPHIAALAQLEWQEWQRRLSSLHGAFLCSKHALPALAKAADGGAIVNIASTRAWQSEPHSEAYAAAKGGLVAMTHALALSEGPQVRVNSISPGWISTDAWRAPARRRAPKLSRRDHAQHPVGRVGTPEDIAQLAVYLLAPQLSGFVTGQDFIVDGGMSRKMQY

SEQ ID NO: 15841 - protein, 194 aa, Xanthomonas campestris
MTAATPLPFWPQAVIFDMDGLMLDSERAITACLSQAADEHGLQIEPAFWLRMVGTGDAACRRLLGERIGTTAMEHVLARCQGLYDAAVSAGIAHRPGIIALLEFLIAHGMPRAVATSTQRPLALRKLAASDLLWRFDAVCTASDVAHPKPAPDIYLLAARTLGVDPAQCLVLEDSPTGVRAALAAGMTPIQVPD

SEQ ID NO: 15842 - protein, 435 aa, Xanthomonas campestris
DLEHYGRDWTRRWTPNPLAIALPGSVEEVQAVVRWANTHAVAVVPSGGRTGLSGGAVAANGELVLSLERLNKPLAFDAVDRTLTVQAGMPLEAVHNAAREHGLVYPVDFAARGSCSIGGNIATNAGGIRVIRYGNTPRMVAGLSVVTGTGELLHLNNALVKNSSGYDFRHLMIGSEGTLGIVVEATLRLTDLPPPSNVMLLALPSFDVLMQVFAAFRAQLRLEAFEFFTDRALEHVLAHGAQAPFAQVHPYYVVTEFAAGDEAQEAAAMAAFEACMEQGWVSDGVISQSDAQAAQLWRLREGITEALARYTPYKNDVSVRISAMPAFLAETQALLHDAYPHFDVVWFGHIGDGNLHINVLKPDATSQADFITACEQVTKLLAQSLQRFDGSISAEHGIGLVKKPYLWSTRSAAEIALMRGIKQVLDPHLLLNPGK

SEQ ID NO: 15843 - protein, 237 aa, Xanthomonas campestris
MTTSPVKVLIHGASGRMGKALLRLAAEDDALHVVGAVVGRSPSQRVVDGVPYFAANELGGAPAFDVAIDFSLPQGFAPILALCVQRGKPLVSGTTGLDEAQRAGLLQAAGQIPLVWASNFSLGVAVLTELVERAAGSLPGWDCDIIEAHHVHKQDAPSGTALTLGEAATGSGAQPRFASVRAGDIVGEHSVQFTGLGERVELIHRATNRDIFARGALHAAKRLLGKPPGSYRVRDLV

SEQ ID NO: 15844 - protein, 374 aa, Xanthomonas campestris
VTQPAILVLEDGTVFEGESVGANGLSVGEVVFNTAMTGYQEVLTDPSYARQMVTLTYPHIGNTGFNDQDDEAKQVWAAGLIVRDVPRRPSSWRNQVALPDWLQTRGVVAISGIDTRKLTRLLREKGAQNGALMAGEIDVEKALEAARKFPGLKGMDLAKVVSTETTYQWQEGQLDLNANAFLQAELKFKVVAYDYGVKINILRMLAERGCEVTVVPAQTPVAEVLALQPDGVFLSNGPGDPEPCDYAITAIQELIAKKVPTFGICLGHQLLALAAGAKTVKMATGHHGANHPVQDLEGGRVMITSQNHGFAVDETTLPANVRVTHRSLFDGTNQGIALTDAPAFSFQGHPEASPGPRDVGPLFDRFVASMAEAK

SEQ ID NO: 15845 - protein, 1080 aa, Xanthomonas campestris
MPKRTDLKTILIIGAGPIVIGQACEFDYSGAQACKALRDEGYRVVLVNSNPATIMTDPNMADAVYIEPINWQTVEKIIAKEKPDALLPTMGGQTALNCALDLADHGVLEKYNVELIGAKREAIRMAEDRELFRVAMGEIGLDCPRAEVAHTLEEALDIQTRVGYPTIIRPSFTLGGSGGGIAYNREELIDIVGRGLELSPTTEVLVEESVLGWKEFEMEVVRDTADNCIIVCAIENLDPMGVHTGDSITVAPAQTLTDKEYQRLRDASIAVLRKIGVDTGGSNVQFGISPTTGRVVVIEMNPRVSRSSALASKATGFPIAKVAAKLAVGYTLDELKNEITGGLTPASFEPSIDYVVTKIPRFAFEKFPQADARLTTQMKSVGEVMAMGRTFQESLQKALRGLETGKIGLDPTGLDLGSEDDMAALKRELKAPGPERLFYVGDAFRAGMSVADVYALSFIDPWFLDQIEELISLEQQLADDGMAALDAPRLRLLKRAGFSDARLGELIGTNEEAVRTLRRALKVRPVYKRVDSCAAEFATSTAYLYSTYEDECEALPSNRDKIMILGGGPNRIGQGIEFDYCCVHAALALRDDGFETIMVNCNPETVSTDYDTSDRLYFEPLTLEDVLEIVELEQPKGVIVQYGGQTPLKLARALEANGVPVIGTSPDSIDLAEDRERFQQLVDKLGLKQPPNRIARNADEALVLAREIGYPLVVRPSYVLGGRAMEIVYGESDLARYVRDAVKVSNDSPVLLDRFLDNAVEVDVDIIADKDGNVLIGGVMEHIEEAGVHSGDSSCSLPPYSLSAETQAELRRQVVMLAEGLNVVGLMNTQFAVQVNDAGDDIVYLLEVNPRASRTVPFVSKATGMPLAKIAARCMAGKTLAEQGATKEIVPDYYSVKEAIFPFAKFQGVDPILGPEMRSTGEVMGVGRSFGAAFARAQEAGGIKAPPLGKAFVSVRDPDKQRVLPVAQALVERGFTLVATRGTGAWLQQHGLSCEIVNKVAEGRPHIVDSIKNGEIVYIVNTTEGRAAISDSFSIRREALQHRVTYSTTVAGAKALVHSLEFRGTGPVWSLQELHKELEA

SEQ ID NO: 15846 - protein, 677 aa, Xanthomonas campestris; identical to SEQ ID NO: 15476

SEQ ID NO: 15847 - protein, 553 aa, Xanthomonas campestris
WLQSYPAGVAAEIDLEQFRTVAEVFATSVARFADRPAYHSFGKTITYREADQLVDQFAAYLLGELQLKKGDRVALMMPNCLQYPIATFGILRAGLTVVNVNPLYTPRELKHQLIDSGASVLVVIDNFGTTVQQVIADTQVKQVITTGLGDMLGFPKAALVNFVVKYVKKLVPEYRINGAIRFRDALALGRKHRVPTLQIEPDDIAFLQYTGGTTGVAKGAMLTHRNLVANMQQAHQWLAGTGKLEEGHEVVITALPLYHIFALTANGLVFMKIGGCNHLISNPRDMPGFIKELKKTRFTAFTGVNTLFNGLLNTPGFDQIDFSSLKMTLGGGMAVQRSVAERWKQVTGLTLVEAYGLTETSPAACINPMDLVDYNGSIGLPIPSTDACIKDDDGKVLALGEIGELCIKGPQVMKGYWKKADETAKVMDAEGWLHTGDIARMDERGFVYIVDRKKDMILVSGFNVYPNEIEDVIATMPGVLEVAAVGVPDEKSGEIVKVVIVKKDQALTAEDVKAHCRTNLTGYKQPRVIEFRKELPKTNVGKILRRELRDAAK

SEQ ID NO: 15848 - protein, 915 aa, Xanthomonas campestris
SDSFSTRTSLEVNGQRYDYYSLPKLGERFDVARLPYSMKILLENLLRHEDGGVTVGKDHIEAVAKWDPAAEPDIEIAFMPARVVLQDFTGVPCVVDLAAMRDAVVKLGGNADQINPQIPSELVIDHSVQVDVFGKPEALDLNGKIEFQRNQERYGFLRWGQKAFDNFKVVPPNTGIVHQVNLENLARVVMSADKDGTQIAYPDTVFGTDSHTTMINGIGVLGWGVGGIEAEAAMLGQPSSMLIPQVVGFKLTGKLPEGATATDLVLTVTQMLRKHGVVGKFVEFYGEGLQHLPLADRATIGNMAPEYGATCGIFPVDNESLTYLRLSGRSEEQIALVETYAKAQGLWHDADTPHAQYSATLELDMGDVKPSLAGPKRPQDRVLLEDMQSNYRESLKPFAEARSKRLADTKQEDRLKNEGGGGTAVGAKASQAESAGDSGAGWQLRDGSVVIAAITSCTNTSNPAVMLGAGLLARNAAAKGLKAQPWIKTSLGPGSRVVTDYLTKAGVLADLEKLGFYVVGYGCTTCIGNSGPLPEDVSAAIAKDDLVVTSVLSGNRNFEGRVHPEVKMNYLASPPLVVAYAIAGTTDIDLTRDPLGTGSDGQPVYLRDIWPSNKEIGDTIAATVGPEMFKQNYADVFKGDTRWNTIASPDGALYEWDAASTYIKNPPYFEGMTMQVGHVDDVHGARIMGLFGDSITTDHISPAGNIKKDSPAGRFLQERGVQPADFNSYGSRRGNDDVMVRGTFANIRIKNLMFGGEEGGNTLYFGKDGAAPEKLAIYDAAMKYKADGVPLVVLAGKEYGTGSSRDWAAKGTNLLGVKAVVAESFERIHRSNLVGMGVLPLQFLEGENAQTLGLDGSEVLDITGLQDGASRRATIDAKKSDGSVKQFQVKVLLLTPKEVEYFKHGGLLQYVLRQL

SEQ ID NO: 15849 - protein, 710 aa, Xanthomonas campestris
  unsure (1)..(710): unsure at all Xaa locations
TAKTLYDKLWEMHEVTRRDDGSSLIYIDRHILHEVTSPQAFEGLRLAGRKPWRIDANIATPDHNVPTTRAERQGGLESISDEVSRLQVQTLDENCDDFGILEFKMNDTRQGIVHVVGPEQGATLPGMTVVCGDSHTSTHGAFGALAHGIGTSEVEHVLATQCLIAKKMKNMQVRVEGTLPFGVTAKDIVLAVIGKIGTAGGNGHALEFAGSAIRALSMEGRMTICNMSIEAGARVGMVAVDEKTIAYVKGRPFAPKGADWDAAVALWRTLVSDADASFDTVVELRAEDIKPQVSWGTSPEMVVAIDQQVPDPAAEQDPTKRDSIQRALKYMGLRANQPITEIHLDRVFIGSCTNSRIEDLRAAAAVAKGRKVASTIKQALVVPGSGLVKAQAEAEGLDKIFLDAGFEWREPGCSMCLAMNPDKLGSGEHCASTSNRNFEGRQGAGGRTHLVSPAMAAAAAVSGHFVDVRELQGIETREXGIATSRLHPPHHSLLPIPGIPMTPFTQHTGLVAPLDRANVDTDQIIPKQFLKSIKRTGFGPNLFDEWRYLDIGEPGRDNSTRPLNQEFVLNFPRYQGASVLLARENFGCGSSREHAPWALDEYGFRAVIAPSFADIFYNNSFKNGLLPIVLAEAEMDALFEQCLGNEGYQLTVDLAAQRVRRPDGVEYAFEIDAFRKHCLLNGLDDIGLTLQDADAIGRFEQGHRAQQPWL

SEQ ID NO: 15850 - protein, 414 aa, Xanthomonas campestris
PFYRQLYFQVVVAIVLGALLGHFEPAFAESLKPLGDAFIKLVKMIIAPVIFLTIVTGIAGMTHLKTVGRVFAKSMTYFLFFSTLALIVGMVVAHAVQPGAGMNINPAELDQSAVNTYVQKSHELSLVGFLMDIIPATLISAFVDGNILQVLFVAVLFGIALALVGERGRPVLSFLEALTAPVFRLVHMLMKAAPIGAFGAIAFTIGKYGVESLVNLAWLVGSFYLTSLFFVLVILGIVCRLCGFSVLKLIRYLKAELLLVLGTSSSESALPSLMEKMEKAGCEKSVVGLVVPTGYSFNLDGTNIYMTLAALFIAQATNVDLTLGQQITLLAVAMLSSKGAAGVTGAGFITLAATLSVVPDVPVAGMALILGVDRFMSECRSLTNFIGNAVATVVVSRWENALDRDQLSLALDGR

SEQ ID NO: 15851 - protein, 314 aa, Xanthomonas campestris
SIAASAVLAMSALGSTAAFAADPVYTVAKQGNAGYRTVQAAVDAAVQGGKRAQISVGAGVYQELLVVPANAPALKMVGAGTTQTVITYDNYAARINPATGKEYGTSGSSSVIIAGNDFTAEQLSFGNHAGPVGQAVAVRVDGDRAAFRNVRFLGYQDTLYLRGAKLSYFLDCYVEGTVDFVFGAGTALFENVQLHSLGDGYLTAASTPQESARGFVFRNARITAASGVSRVFLGRPWRPYASVSFITSQLGAHIVPEGWNNWGNAANEATARYSEYQNTGAGANPSRRVKWSRQLTAAQAAALDRSTVLGSWRP

SEQ ID NO: 15852 - protein, 323 aa, Xanthomonas campestris
KNQVVCFGEALIDMLALPPAGPDEARTFAQYAGGAPANVAVAVARLGGAAHFVGMLGRDMFGDFLLESLQQAGVVTDGIVRTDEAKTALAFVALDAAGERSFSFYRPPAADLLFRAEHFAADGFAQAAVLHVCSNSMTEPAIARCTLDGMRRARADGAIVSLDLNLRPMLWPQDVDPAPLLWEALALADVVKLSREELDYLAGTLDSDASAVTQKLWQGHARWLLVTDGGGPVHWQTRVDSGQVPAFHVQVRDSTAAGDAFVGGLLFQLAARASPLEQLCADPAAIAEVIRFAAAVGALAVTRKGAFAAMPSVDEVHSLIQEQ

SEQ ID NO: 15853 - protein, 442 aa, Xanthomonas campestris
MRVAIFGTGYVGLVTGTCLAEVGHHVICVDIDQAKVDGLNRGVIPIYEPGLEPMVKANHASGRLRFTTDAAEAIAHGEITFIAVGTPPDEDGSADLQYVLAVARTVGRHIDGPSVIVNKSTVPVGTADKVRAAIQEELDARGVDHEFDVVSNPEFLKEGDAVADCMRPDRIVIGAKKPAAIARMRRLYAPFNRNRDRIVEMDVRSAELTKYAANAMLATKISFMNEIANIAERVGADVEHVRNGIGSDPRIGWHFIYPGAGYGGSCFPKDVQALAKTAQQYGMQPTLLNAVESVNNAQKGHLFELVQRHYADGNGSIAGKTFAVWGMAFKPNTDDMRAASSRRLMAQLWEAGAKVRAYDPEATHEAKRIFGERDDLAFCDDAFAALEGADALVVVTEWKQFRSPDFGKIKQALKDDVVFDGRNLYDPQEIEAAGLAYYAIGR

SEQ ID NO: 15854 - protein, 459 aa, Xanthomonas campestris
MSESFRIEHDSMGELQVPADALWGAQTQRAVQNFPISGQPMPRGFIRALGLIKAAAAGVNADLGLLSKSVAKVVQEAALQVAQGTHDAHFPIDVYQTGSGTSSNMNANEVIATLATRAGKDAVHPNDHVNLGQSSNDVVPTAIRVSALLAVQEQLQPALKHLRKTIDKRAKGLDKIVKTGRTHLMDAMPLTFGQEFGAWSAQLSSAQERIDDSLKRLRRLPLGGTAIGTGINADARFGGKVAKALSTLSGVKFESAENKFEGLAAQDDAVELSGQLNALAVALIKIANDLRWMNAGPLAGLGEIELPALQPGSSIMPGKVNPVIPEATVMVCAQVIGHHTAITVAGQTGNFQLNVALPLIAANLLDSINLLSNVSRLLADTAIAGLKVRQERVREALDRNPILVTALNPIIGYEKAAAIAKRAYKEQRPVLDVAKEDSGLSEAELRRLLDPAALTRGGI

SEQ ID NO: 15855 - protein, 931 aa, Xanthomonas campestris
DNLLKQFAQSSQLAGGNAAYIEDLYEQYLVAPDSVDPKWKAYFDGFNGRDAGDVPHSAAIAHILSASKQAANAGTGVGASDERERNVGRLITAYRSRGHLGAQLDPLGLTPPVNPPDLDLPFHSLSQADLDSEFSTGGVGGQPRMKLKDLLARLKATYASTIGAEFMHIPEFDQRQWIYKRLEDAGGKIAADAASRKRTLERLTAAEGLERYLHTKYVGQKRFSLEGGDALIPMMDTIIRQSGNDQVKDIVIGMAHRGRLNVLVNTLGKNPRKLFDEFEGKFEHAHDDRAHTGDVKYHMGFSADIAVGDDKQVHLALAFNPSHLEIVDPVVVGSVRSRQERFGDADRKTVLPILIHGDAAFAGQGVVMELFQMSQARGFAVGGTVHIVVNNQIGFTTSARDDARSTLYCTDVAKMIGAPVFHVNGDDPDAVMFVSKLAYEFRQQFKKDVVIDLVCYRRWGHNEADEPAATQPVMYQTIRKHKTTRELYATKLESDGVLSADEAKALVDGYRNKLDSGEYTTELAKRKPDEFAIDWSKYLVGTAADPVDTRVKRNELDRLAKLITTIPAGVELHARVAKIYEDRVKMAAGNQDGDWGFAENLAYATLLAEGHKLRLVGQDAGRGTFFHRHAILHDQKTDSYYLPLRQLVENPEDATIIDSLLSEEAVMGFEYGYSTTDPNALCVWEAQFGDFANGAQVVIDQFIAAGEAKWGRIAGLSLFLPHGYEGQGPEHSSARLERFLQLCALENMLVCVPTTPAQCFHMIRRQMRMTTRKPLVVMTPKSLLRHKLAVSTLEELADGQFQHLIPDAKADASKVKRVVLCSGKVYYDLLEDQTKRGQDDVAILRVEQLYPFPRAQLAAELKRFGNAADVVWCQEEPQNQGAWYQIRHHLNFCLASGQSLHYAGRARSPSPAAGHMADHIAEQQKLVADAL

SEQ ID NO: 15856 - protein, 401 aa, Xanthomonas campestris
EVKVPVLPESVSDATIASWHKKAGEAVKRDENLVDLETDKVVLEVPSPVDGVLKEIKFEAGSTVTSNQILAIIEEGAVAAAAPAEEKKADATAAAAAPAAAPAPAAAAAAAPVASKSSADSLPPGARFSAITQGVDPSQVDGPGRRGAVTKEDIVNFAKAGGVGKASGARPEERVAMTRVRKTIAKRLMESKNSTAMLTTFNEVNLAKVSAARKELQDEFQKAHGIKLGFMSFFVKAAANALQRFPLVNASIDGDDIIYHGYSDISIAVSTEKGLVTPVLRNVERQSFAEVEQGIADYAAKARAGKLGLDDLQGGTFTITNGGTFGSLLSTPIINPPQSAILGMHAIKERPIAENGQVVIAPMMYLALSYDHRIIDGKDSVQFLVDIKNQLENPGRMLFGL

SEQ ID NO: 15857 - protein, 478 aa, Xanthomonas campestris; identical to SEQ ID NO: 15486
  unsure (1)..(478): unsure at all Xaa locations

SEQ ID NO: 15858 - protein, 498 aa, Xanthomonas campestris
AFISWRCWGEKVVADLRGRLYAHLIGLDAGFHDRSRSGELVSRLSADSELLRGVVGTTMSVALRSSVTVIGSLVMLFVTSPRLAGFTLIGIPLAVLPIVLGARRLQKISRASQDRVADANTLAAETLGAVRTVQAHAREGYESNRFSQALQAAIGTARVRIRTQATVTAVAIMLIFGAIVAVLWLGAHDVIAGQMTPGTLGQFVLYALIGGGSVGALAEVWNELQRAAGGMGRIGELLDEQSAIVAPATPQPLPVPVRGAIHFDQVVFHYPQRPDMPALDGFDLHVQPGETVALVGPSGAGKSTVLAMLLRFHDPLSGSVRIDDVDLRQTDPVLLREQIALVPQQPTLFAASAADNIRYGRLDASDAQVEAAATAAEADIFLRALPQGYASELGERGTRLSGGQQQRVAIARALLKDAPILLLDEATSALDAQSERAVQQALDRLMQGRTTLVIAHRLATVLKADRIVVMDAGRIVAQGTHAQLVAEGGLYAELAKLQ

SEQ ID NO: 15859 - protein, 375 aa, Xanthomonas campestris
MSKRDYYEVLGVARGASDEELKKAYRRCAMKYHPDRNPGDAAAEATFKECKEAYEVLSDGNKRRAYDAHGHAAFEHGMGGGGGGPGGPDMGDIFGDIFGNIFGGGAAGPRAARRGADVGYVLELDLEEAVAGIERRIEIPTLIECEPCHGSGSEDGKVEVCATCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLKQFEATFTGEDARKHSPKSATFIDGVKGFWDRMT

SEQ ID NO: 15860 - protein, 641 aa, Xanthomonas campestris; identical to SEQ ID NO: 15488

SEQ ID NO: 15861 - protein, 430 aa, Xanthomonas campestris
MSFESLGLAPFLLRALAEQGYETPTAIQQQAIPLVLAGHDLLAGAQTGTGKTAAFGLPLLQHLGTTPQPVNGPRKPRALILTPTRELATQVHDSLRGYSKYLRIPSAVIYGGVGMGNQLDALRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRALRKSHARRPHGDATASGARPCRPRRSRVG

SEQ ID NO: 15862 - protein, 215 aa, Xanthomonas campestris
LELFSYWRSSAAYRVRIGLQLKALAYVAHPVHLVRDGGEQHAAAYAQLNPQELVPTLRHGQVVIPQSLAILEYLDEAFADSAPLLPTGPAARARVRALAQVIACDVHPLNNLRVTQFLEHTWDVSPAQRHHWTAHWMQQGLAALETHLAGDAQTGQFCHGDTPGLADCELVPQLYNARRFAVELAPYPTLQRIEQACLALPAFDAARPETQPDAA

SEQ ID NO: 15863 - protein, 336 aa, Xanthomonas campestris
KTALITGISGQDGAYLAQLLLDKGYRVFGTYRRTSSVNFWRIEELGIAAHPNLNLIEYDLTDLGSSIRMLESTGATEVYNLAAQSFVGVSFDQPTTTAQITGIGPVHLLEAIRQVNRDIRFYQASTSEMFGKVQAVPQIESTPFYPRSPYGVAKLYAHWMTVNYRESYDIFGCSGILFNHESPLRGREFVTRKITDSVAKIKLGQLDCMELGNLDAKRDWGFAREYVEGMWRMLQADEPDTFVLATNRTETVRDFVSMAFKGAGIDVEFRGKDAEETAVDTATGKVVMRINPKFHRPAEVELLIGDPEKAARILGWKPETTLEQLCQMMVEADLKR

SEQ ID NO: 15864 - protein, 348 aa, Xanthomonas campestris; identical to SEQ ID NO: 15493

SEQ ID NO: 15865 - protein, 290 aa, Xanthomonas campestris
MTQRKGIILAGGSGTRLYPITKGVSKQLLPVYDKPMIYYPLSVLMLAGIRDILIINTPHEQALFQSLLGDGAQWGVNIQYAVQPSPDGLAQAYLIGRDFVGGKPSCLVLGDNIFHGHGLTDTLRRADAREQGATVFGYWVNDPERYGVAEFDQHGKVIDIAEKPEKPRSNYAVTGLYFYDGKASDYAAALKPSPRGELEITDLNRCYLDAGDLHLEPLGRGYAWLDTGTHQSLHEAANFIETIQMRQGLQVCCPEEIAFGQGWIDAEQLERLAAPLLKNDYGKYLTALAK

SEQ ID NO: 15866 - protein, 448 aa, Xanthomonas campestris
MTLPAFKAYDIRGRVPDELNEDLARRIGVALAAQLDQGPVVLGHDVRLASPALQEALSAGLRASGREVIDVGLCGTEEVYFQTDHLKAAGGVMVTASHNPMDYNGMKLVREQARPISSDTGLFAIRDTVAADTAAAGEPTAAEHSRTDKTAYLEHLLSYVDRSTLKPLKLVVNAGNGGAGLIVDLLAAHLPFEFVRVFHEPDGNFPNGIPNPLLPENRDATAKAVKEHGADFGIAWDGDFDRCFFFDHTGRFIEGYYLVGLLAQAILAKQPGGKVVHDPRLTWNTVEMVEDAGGIPVLCKSGHAFIKEKMRSENAVYGGEMSAHHYFREFAYADSGMIPWLLIAELVSQSGRSLADLVEARMQKFPCSGEINFKVDDAKAAVARVMAHYGDQSPELDYTDGISADFGQWRFNLRSSNTEPLLRLNVETRGDAALLETRTQEISNLLRG

SEQ ID NO: 15867 - protein, 503 aa, Xanthomonas campestris
WLGCRTVVASVVDIRVDLFRHLTGHPMRYFTEHFAGALGNRITALGTAAGQIYGGLAWKILPPIVDFIGAIVVLFTVDWRMAATLIGFVAVVAAIITGFGIRGRAKHQSFAAQAARVGGELVDAVSNVWTIKAFAARDRESARLAQEIGHEAVAHRRSWMYVEKARVIHDICLSIMAGGMLIWAISAWRGGAVSAGDVVLVSALTFRILHGSRDLALTLVDTTQQLGAIADTLQIILQPHALPDADAPLALAEGDVRFEGVRFAYPDRPAVIEALDLHIPAGQKVGIVGPSGAGKSTLIALIQRLDDVESGRVLIDGQDIRSVSQDSLRDRIAVVPQETALFNRSIADNIRYGRPEASDAEVHTAARHAFCDGFIRDLPQGYNTLVGERGVMLSGGQRQRLGIARAFLKDAPILILDEATSALDTESEAEIQSALDHLMRGRTVLAVAHRLSTVIGFDRIVVLQDGRIVEDGSPAELRGRGGVFDSLWQRQAAGFEQPVAEDA

SEQ ID NO: 15868 - protein, 290 aa, Xanthomonas campestris
QEITMPVPNYPRPPFKPQQQGFPGKTDKMDPRPDHGEDSYVGHGQLKGKRALITGGDSGIGAAVAIAYAREGADVAIAFLPDEQEDASRIGALIEKAGVRALLVGCDISDPNQAASLIDKVNSEFGGLDILVNNAGYQKYFENFEEITLDEWRKTFDTNVHAVFNLVRLSVPLMKDGGSIINTASVQSKKPTPNILPYGATKGALANLTIGLAGVLAEKQIRVNAVLPGPIWTPFIPAGMDEDSVESFGSQTPMGRPGQPVELASAYVMLASDTASYTSGTLLTISGGAV

SEQ ID NO: 15869 - protein, 518 aa, Xanthomonas campestris; identical to SEQ ID NO: 15498

SEQ ID NO: 15870 - protein, 653 aa, Xanthomonas campestris; identical to SEQ ID NO: 15499

SEQ ID NO: 15871 - protein, 353 aa, Xanthomonas campestris
LKNDRLLRALRRQPVDRTPVWLMRQAGRYLPEYRATRARAGSFLGMAKNPDIACEVTLQPLERFPLDAAILFSDILTIPDAMGLELYFVEGEGPKFRHPVRDADAIHRLGVPDMETELRYVMDAVRLIRRELDGAVPLIGFSGSPWTLACYMIEGGGSKEYARIKAMAFNAPQLLHHLLSTVTDAVIAYLSAQRAAGAQALQVFDTWGGVLSPAMYREFSLPYLTRIAQELERGSGEERTPLVLFGKGNGAYVSELAASGAEAVGVDWTISLADAAERAGGRVALQGNLDPATLYGSPDAIRSEVGKTLDSYAYGNGGSREGHVFNLGHGMSPDMNPDHVGVLVEAVQTLSKR

SEQ ID NO: 15872 - protein, 389 aa, Xanthomonas campestris
NAWQLAVHKQELAEQASLAKTRFLATLGHEVRTPMTGVLGMSELLLKTQLDHKQRSYTESIRRAGSHLLRLVNDALDLARIESGRLELDLQPFSVRQLVAEVEALMAPLAQERGLRFSLEVGLLGDITASGDPTRIRQILLNLLSNAIKFTERGVVGLKLSTLGSYQGLRFEVADTGPGINADQKVRLFQRFEQGDGAKTTSRYGGSGLGLAICQELAMAMGGHIEVISRLGAGTRFVVDLPLRWVASNAVLAGEVARDSANVAPLRILLVEDEPTIAEVIVGLLRAQGHSVVHAPHGLAALTEAADNAFDLALLDLDLPGLDGFALARQLRVFGYDMPLIAVTARSDEAAEPTAQQAGFDSFLRKPLTGDMLADTIAEALRRVRPREE

SEQ ID NO: 15873 - protein, 338 aa, Xanthomonas campestris
LALLGTGTVGRAFVTRYTALQQRQLRLPRFDWLANSRIAHDCGAGAEQALQLVNAAPRGRAELQPWAETTALRAGDVLVDATASDVVADWHVEWLTRGVHVVTANKLGQGTALSRAQDLYAARHASGAYYGDSATVGAGLPLLSSVRALVAGGDQIHSIEGVLSGSLAWLFHRYDGSAPFSACVREAMAAGYTEPDPRIDLSGEDVRRKLLILARAAGQPLEAEQVHVESLVPAALASVAPEAVDAHLETLDALVRTRWQQARAAGRCLRFVGRVDEHGASVGLRELALDHPLAGGAGTDNRVAISSDRYRDQPLLIQGPGAGAEVTAAALLDDVLRI

SEQ ID NO: 15874 - protein, 378 aa, Xanthomonas campestris
ATAAVRAGIDRDTAYGAVTPPIVLSSNFSFDGFGNKRQYDYTRSGNPTRDLLGEALAELEGGAGGVITSTGMGAINLVLNALLQPGDTLVVPHDAYGGSWRLFNALAKKGHFALITADLTDPRSLADALAQSPKLVLIETPSNPLLRITDLRFVIEAAHKVGALTVVDNTFLSPALQKPLEFGADVVLHSTTKYVNGHSDVVGGAVIARDAELHQQLVWWANALGLTGSPFDAFLTLRGLRTLDARLRVHQENADAIAVLLDEHAAVNQVYFPGLASHPGHALAARQQKGFGAMISFELNGGEAAVRAFVDGLRYFTLAESLGGVESLIAHPASMTHAAMTAEARAAAGISDGLLRLSVGIESAEDLLIDLRAGLARA

SEQ ID NO: 15875 - protein, 129 aa, Xanthomonas campestris
MSEIPGDLKFLKSHEWARVEGNGRVTVGISDHAQGLLGDLVYVELPAVGDTVQAGNGAAVVESVKAASDVYSPVTGTVVEVNASLSDKPETINEDAYGEGWIFVVEIDDKEQLNELLAPDDYAELLEDD

SEQ ID NO: 15876 - protein, 523 aa, Xanthomonas campestris; identical to SEQ ID NO: 15504

SEQ ID NO: 15877 - protein, 324 aa, Xanthomonas campestris
VMIGSNEFPDGPCAAAIKAITQIAPQGGRYLRELQMELMTTLAAELKLPVNHLMAYAGSTEPLDYTMLAFTSPSAALVTADPTYESGWRAASRNGAKLVKVPLRKDFSHDVQAMCAADTNAGVIYICNPNNPTGSVTARKDLDYPLAHKPKGSILVVDEAYIHFAQSTRSVVDMVSAVEDVVALFTFSKLYGMAGIRLGYAAARPDLLAKLMFYSVNSLPVTAAAAGLASLRDATLVPQRRARTAATRADVIDFLTKQGYACTASESNCFMVDVKQPAAGFKDAMATFGVFIGRSWPVWPTWSRITVGTPEEMARFKQAFVQVM

SEQ ID NO: 15878 - protein, 429 aa, Xanthomonas campestris; identical to SEQ ID NO: 15506

SEQ ID NO: 15879 - protein, 441 aa, Xanthomonas campestris
LTGIGAAEYARRRKQLMQMAGEQAILILPAAPERVRSHDTHYPYRQDSDFWYLSGFPEPEAVLVLVPGRKHGEAILFCRERDAEREAWDGPRAGQEGAVAQYGMDDAYPIDDVDEILPGLLEGRSRVYYHFGRDVDFDLKLIGWLKRVREQVRHGAQPPHEFLELGHLLHEQRLFKSRDEIALMQQAADISVRAHRAAMQLARPGVHEYQLQAEIEREFRAADAWPAYGSIVGTGSNACVLHYRANNARSRDGELVLVDAGAEYRGYAADITRTFPVNGRFSAAQRALHDLVGAAQAAALAQAQPGIAYEAGHLAAVQTLTEGLLRLGLLKGTLERNLAEGHYKRFYRHKTGHWLGLDVHDVGEYRLAGESRLLEPGMVFTIEPGLYVSADDTSVDAKWRGIGIRTEDNVLITADGHRVLTDALARSADEIQGAMAGGNRE

SEQ ID NO: 15880 - protein, 435 aa, Xanthomonas campestris; identical to SEQ ID NO: 15508

SEQ ID NO: 15881 - protein, 295 aa, Xanthomonas campestris
PSEMAQALGAGLLSFPVTHFDADMAFDEPAYRSNLDWLSSHPAAGLFAAGGTGELFSLTLDEVDRAVRAAVTQTAGRMPVIAPAGYGTAIAVAMAQAAERNDADGILLFPPYLTECDADGVAEHVERVCKATSLGVIVYGRANARLDDVALARVAERCPNLVGYKDGIGDVERMTRIYARLGDRLLYVGGLPTAETFALPYLEMGVTTYSSAIFNFLPEWALSFYAAVRARDHATIYRELNDFVLPYTVLRNRRAGYAVSIVKAGMRAVGRPAGPVRTPLADLTEDEFAQLTQLI

SEQ ID NO: 15882 - protein, 432 aa, Xanthomonas campestris; identical to SEQ ID NO: 15510

SEQ ID NO: 15883 - protein, 391 aa, Xanthomonas campestris
MSIVRMTDLDLSGKRVLIRQDLNVPIDNGQITSEQRITASVPTIKLALEKGAAVMVTSHLGRPKEGTWSEEDSLAPVAARLTTLLGLDVPLVRDWVEGVDVAPGQVVLLENCRMNVGEGKDDEALARKYAALCDVFVMDAFGTAHRAQASTHGVIRFAPVAAGGPLLMAELDALAKALDNPAKPLLAIVAGSKVSTKLELLANLVNKVDQLIVGGGIANTFIAAAGHDVGKSLSEPDLIPTANQIVADAKARGAEIPLPTDVVVAKQFLPDAEASVKSLDQVDADDLILDIGPQTAAHYAELIANAGTVVWNGPVGVFEFEPFSHGTETLARAIAASEAFSIAGGGDTLAAVDKYAIAKDVTYISTGGGAFLEFLEGKTLPAVAALEARGQ

SEQ ID NO: 15884 - protein, 476 aa, Xanthomonas campestris
MKERQRRTKILATLGPATDPPGVLDALFKAGVNVVRLNFSHGDPSGQAKRAAEVRAAAVRVGAEVGILADLPGPKIRIERFAGGKIKLTMGDRFDLVADINAPAGDQHQVGVSYLGLPQDVTAGDVLLLDDGLVQLQVTDVQGARIVTTVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRYLSRFRSNMPIYAFTRHDGARRQMAMMRGVFPIGFDSRGLTPREAARAAIRLLVENERMGPGDRVVFTSGEHMETHGATNTLRLLEV

SEQ ID NO: 15885 - protein, 339 aa, Xanthomonas campestris
  unsure (1)..(339): unsure at all Xaa locations
EQLAETAQAMVAPGKGIIAIDESTSTIAKRFSGVGIENTEENRRAYRELLLTTPKLSDYISGAILFDETIRQKTKDGVPFAKYMADHGIIPGIKVDKGAQPLAGMPGELVTEGLDGLRARLEEYYTLGARFAKWRAVINIGEDIPSGTCIEANAHALARYAALCQEQGLVPMVEPEVIMDGDHDIETCYEVTEATLRSLFGALYEQNVVLEGTILKASMVISGKGCEEQASVEEVAESTVMCLKSTVPAILPGIVFLSGGQTDEQSTAHLNEMHQLGNLPWPLSFSYGRAMQQAALKLWSKDMTGNYAKAQQIIYERAKENGLAALGKWKGXSAAEAAS

SEQ ID NO: 15886 - protein, 228 aa, Xanthomonas campestris
PSLDDLDALNAHLETLRADERVAWALQHGPQQAALSSSFGAQSAVTLHLLTQQRPDIPVILIDTGYLFPETYRFADALTERLSLNLQVYRPLVSRAWMEARHGRLWEQGMVGIDQYNNLRKVEPMRRALDELNVGTWFTGLRRSQSGGRAQTPIVQKRGDRYKISPIADWTDRDVWQYLQTHALPYHPLWEQGYVSIGDFHTTRRWEPGMREEDTRFFGLKRECGIHE

SEQ ID NO: 15887 - protein, 552 aa, Xanthomonas campestris
EDIKSTSRRLRGSLEQSLADPVTGALREDDQTLIKYHGSYQQDDRDIRDERRRQKLEPAYQFMIRTRTPGGVISPSQWLALDGIATRYANHSLRITTRQAFQFHGVIKRELKATMQAINATLIDTLAACGDVNRNVQVAANPLLSQAHATLYADAARVSEHLLPNTRAYYEIWLDEERVSGSGAEDEPIYGDRYLPRKFKIGFAAPPHNDVDVFANDLGFIAILREGQLLGYNVSIGGGMGASHGDAETWPRVANVIGFVTRDQLLDIATAVVTTQRDLGNRAVRKRARFKYTIDDHGLDTIVAEIERRAGFSLQPAQPFAFAHNGDRYGWVEGEQGDWHLTLSLPAGRIADTDTAAHLSGLRAIAQLQMGEFRMTPNQNLVIAGVPAEQRAQIDQLVAQYGLDAGNLAPTALARGAMACVALPTCGLAMAEAERYLPDFSAALQPLLERHGLAQTPIVLRLSGCPNGCSRPYLAEIALVGKAPGRYNLMLGGDRRGQRLNTLYRENINEADILAALEPLLARYAAERDQHADEGFGDFLHRSGLIRPAALP

SEQ ID NO: 15888 - protein, 630 aa, Xanthomonas campestris
  unsure (1)..(630): unsure at all Xaa locations
SLLPNPGAISTYLQQHESKPLLRFITCGSVDDGKSTLIGRLLYDSKRLFDDQLAALESDSKRHGTQGDGIDYALLMDGLAAEREQGITIDVAYRYFDTDQRKFIVADCPGHEQYTRNMATGASTADVAVVLVDARKGVLVQTRRHSYIVSLLGIRHVVLAVNKMDLVDYDAQVFATIVDSYRALAAQLGIADVQCIPLSALAGDNLSSASTRMPWYQGPHLLQHLDSVQLETPDAVSGLRLPVQWVNRPSAQFRGYAGTIAAGQVRTGDAVVVVPSGRRAHVASVLDANGVVDSARAGQAVTLTLREEIDISRGDIIAAVDDPPEVADQFAAHVLWMDDAALLPGRPYWLKIGTRTVTASISEIKHKVDVNTQERLAAKRLELNEVGYCNLSLDEPIAFAPYARNRVLGGFILIDRQTNATVAAGALEFALRRAGNVHWQHLDVDRAARARIKGQAPRVLWFTGLSGAGKSTVANLVDKRLHALGYHTFILDGDNVRHGLNRDLGFTDEDRVENIRRVAEVARLMADAGLIVLVSFISPFRAERQLARERFDSGEFVEVFVDVPLAVAEARDVKGLYRKARAGQIPNFTGIDSPYEAPERPEIHLHADGENVEALARHVLEYLGLERXGQ

SEQ ID NO: 15889 - protein, 856 aa, Xanthomonas campestris
EPVPNGRLPTWAVPEHYSLAIKVDPEQAQFSGRTTIRVQLKQASDHLWLHGKELKVSKATVKPAKGKALTARYVDADAQTGVVRLDFGRTLKPQTLTVDITYSAPLNQQLQGLYQVKYQGKAYAMTQMEPISARYAFPGFDEPAFKTPFDLSLTVPAGDQALANTIATSTKPAGKGWKTVSFAPTLPLPTYLVAYAAGPWDVVDVPAMPATPQRPAATPLRGIAAQGQGPRITPALDQTPAIIAALEDYYAFGYPFDKLDLVAAPDFSAGAMENPGFVTFRDWLLLLDKDSPAENVQRSFNTNAHELAHQWTGDTVTMAWWDDLWLNEAFATWMQQKITMQLHPEYRANLDRIGGAQHAMDNDSLVSARKIRQPITGNGDIETAFDGITYQKGAAVLAMFEGFVGEDVFREGMRAYIAKHKFGSATADDLVDAIAEAAGKGEDFKAAFRSFLNQPGVPYLQTQVAREGGKTVVKLQQQRYLPLGSSGSTAQQWGVPVCVKYGKGKNQVGTACQLLESGSGSIVLEGAGKNTWVFPNARGAGYYRFSLPKKQLAALGKQVAQLDENEKLSYADAIDAAYRHGDADTEVVLAAMKQLAGAESADVSTALVDRFVWIWRHQATTDAQRATLRKAAEQAYLPRLRQLGYTRRAKESIDDTTLRASLAGLFGLWLQTPEVRSALLAQGDAVLAGGGNGLNFAAANPDLLGTVLAVTAQERGAAAVQTLIQALRTHADPAQRNAMIAALGAVQDPALLTQVRDFALTDAIKVGEMKSLLTRGHSYDASHASMWPWFTANFDRIVQRSGSFDGGGLPSLGASNGCSVEEADRLDAFFKPRLATLSGADRGLAQTGEAIRLCAA

SEQ ID NO: 15890 - protein, 753 aa, Xanthomonas campestris
FEPARLERAIDQIHAEFPQLDVGDYKRSVFGFVERKDSVNADDLVDHLIREAEARVDLTTPEWEHFAARLYLRRLYKRASRNRFYDAGQKYGSFVGLQESLADRNVYSNDILKSYSKEELIEAGKMIAPERDTLFAYNGLYLLATRYLATDNSRGVFELPQERWLTIALYLMQDEKPRERRMQLVGEAYWALSNLYMTVATPTLANAGKVGGQLSSCFIDTVDDSLQGIYDSNTDVARVSKHGGGVGAYLGYVRSSGSAIRGVSNSSGGVVPWIKQLNNTAVSVDQLGQRKGAIAVYLDIFHRDIESFLDLRLNNGDQRLRAHDVFTSVCIPDLFMEAVERRGDWYLFDPHEVKRIKGWYLQDFYDEKKGDANSSFRKKYEEVVADERITRKTVKAIEIFKRIMVSQLETGNPFMFYRDEVNRKNPNKHEGMVYSSNLCTEILQNMSPTRMMQEIISGNQIVTTKKAGDFVVCNLSSINLGRAITVQADQADLLGADVLERLIPIQVRMLDNVIDLNQLPVPQATITNQKYRAIGLGTFGWHHLLAQKAIHWNAKEAEDYSDELYERINYLTVQASMELAKEKGTYSVFRGSDWHTGEYFRARDYNSPQWLELSAQVAVNGVRNAWMLAVAPNMSTAQIAGSTASIDPIYSAFYYEEKKDFRRPVAAPGLSLDTWPYYEKGAYKVDQFASVRQNARRQRHIDQSISFNFYVPSTIRASTLLDLHMTAWREGLKTTYYVRSNDIDISECEWCSS

SEQ ID NO: 15891 - protein, 318 aa, Xanthomonas campestris
IINGQTSGILNWNDIPYPSFYRAYKELSTNFWIPDEVDMKGDARQYNELSAREKNAYDSIIGLLATLDSPQTRFIYNVAEYITDPAAHANAAIIGQQEVIHNESYSYVLASITGLADQNRVFEIARTHPTIIKRNAPIMGAYDDFMRDKTAETLIRALIQSSILEGINFYSGFAYFYNLVRQNRMTGTGKIISFINRDELAHSKFISELIRAIIGENQALQGDQLTDYVHKAFEHAIDLETVWTAEVLDGIDGIDVDEMIRYVKYRANKMAGMLGIEKLYEGANDNVMPWIKAYADNFTETKTDFFEMRNASYKKTNS

SEQ ID NO: 15892 - protein, 251 aa, Xanthomonas campestris; identical to SEQ ID NO: 15521

SEQ ID NO: 15893 - protein, 244 aa, Xanthomonas campestris
MIVVDSLHKSFKTKTGLVKAVNGVSFNAADGQITGLLGPNGAGKTTTLRMLYTLMTPDQGSVRVDGVDAAHDPVAVRRALGVLPDARGVYKRLSARENIAYFGQLHGMSRTQIAERTRLLSHALDMDDILDRQTEGFSQGQRTKTAIARALVHDPRNVILDEPTNGLDVMTTRAMRGFLQQLRAEGRCVIFSSHIMQEVAALCDRIVIIAKGTVVAAGTADELRAATGEDNLEDAFVKAIGSDE

SEQ ID NO: 15894 - protein, 275 aa, Xanthomonas campestris; identical to SEQ ID NO: 15523

SEQ ID NO: 15895 - protein, 736 aa, Xanthomonas campestris
MFSKDLEQTIGQCYKRAREARHEFMTVEHLLLSLLDNPSAQAVLKACGADQVRLHTDLEQAIEASVSRLAEDDGRDTQPTLGFQRVLQRAVYHVQSSGKKEVTGANVLVAIFGEKDSHAVYFLNQQDITRLDIVNYLSHGIAKLGEDGEQPSASDGEPKSDAGEGEGKGDALAEYATNLNDHARNGKIDPLVGRADEIERTIQVLCRRRKNNPLYVGEAGVGKTAIAEGLAKRIVDADVPEVLADAVIFSLDLGALVAGTKYRGDFEKRLKGVLTALKKVPNAVLFIDEIHTIIGAGSASGGTMDASNLIKPALASGELRCIGSTTFQEYRGIFEKDRALARRFQKIDIVEPTVGETFEILQGLKPKYEAHHGVTYADDALQAAVDLSVKHIGDRLLPDKAIDVIDEAGARQRLLPEGQRKELIDIEEIETIVAKMARIPAKQVSATDKDVLQHLERNLKMVIFGQNPAIETLAGSIKLARSGLANPEKPIGNFLFAGPTGVGKTEVTKQLALQLGIELVRFDMSEYMEAHSISRLIGAPPGYVGFDQGGLLTEKIVKTPHCVLLLDEVEKAHPDIFNILLQVMDRGILTDTNGREANFKNVILVMTTNAGATQASRRSIGFTKQDHSTDAMESIRRGFTPEFRNRLDAIVQFQPLGFDHILRVVDKFIIELEMLLQEKHVSLSATPTARDWLAQHGFDPLMGARPMSRVIQEKIKRPLADELLFGKLVEGGRVNI

SEQ ID NO: 15896 - protein, 403 aa, Xanthomonas campestris
  unsure (1)..(403): unsure at all Xaa locations
IQEAYIVAATRTPVGKAPKGVFRNTRPDDMLAHVLRTVVAQAPGIDLSRIDDAIIGCAMPEGEQGMNVARIGVLLAGLPNTVAGQTINRFCSSGIQAVAMAADQIRLGNADLMLAGGTESMSMVPMMGNKVAMSPNVFADDHVAIAYGMGITAEKVAEEWKVSREDQDAFALASHQKAIAAIAAGEFRDEITPYEILSHQPDLAGNVIALRKRLVDTDEGPRPDSSLEGLAKLRPVFRNGQFGGSVTAGNSSQMSDGAGAVLLASEQAIKDYGLTPLARFVSFSVAGVRPEVMGIGPIAAIPKALKQAGLTKDQIDWIELNEAFAAQALAVIRDSELDPSKVNPLGGAIALGHPLGATGAIRAATLVHGLRRRQQKYGMVTMCIGTGMGAAGIIEALXTAQLA

SEQ ID NO: 15897 - protein, 141 aa, Xanthomonas campestris; identical to SEQ ID NO: 15526

SEQ ID NO: 15898 - protein, 272 aa, Xanthomonas campestris; identical to SEQ ID NO: 15527

SEQ ID NO: 15899 - protein, 255 aa, Xanthomonas campestris
IATYNVNGIASRLPHLLQWLQREQPDIVGLQELKSTQEAFPEQAIRDAGYGVIWQGQRSWNGVALLARGAEPVEIRRGLPWDPADTQSRYLEAAIHGVIVGCLYLPNGNPQPGPKFDYKLKWFQRLLRHAATLVALPHPVALIGDFNVVPTDAHIYDPKGWRKDALLQPESRAAYAQLLAQGWTDSLQAIHGDAPVYTFWDYFRQHFARDRGLRIDHLLLNRTLAAGLRDAGVDKWVRALEKASDHAPPWITVDV

SEQ ID NO: 15900 - protein, 708 aa, Xanthomonas campestris
MHRTTRSTCCYCGVGCGVLIHSTHDDAGERIVGIEGDPLHPANHGRLCSKGLALPQTAASQQGRVLAPELRRHRDASRTAVSWDQALTHVTGKLAAIIDQHGPDAVAFYVSGQLLTEDYYVFNKLAKGLLGTNNIDTNSRLCMSSAVTGYKLALGADGPPTCYEDLELAQTVLFAGSNMAYAHPVLFRRLEDARARNPEIRWIVIDPRRTDTAAMADLHLAIEPGTDVALFNGMLHHLIWEGLVDARFVAAQTEDFDALKHMLREYTPRMSAEICGISHEDLVQAAEWFGRSPAALSLYCMGLNQSAHGTDKNLALINLHLATGQIGKPGAGPFSLTGQPNAMGGREVGGMATMLAAHREIGNAQDRAEVERAWGVPAGRISSTPGAPAVQLFERLRAGTLKAVWIVCTNPVHSMPDIAGVRAALEQAELVIVQDAFSGTDTVPYADVLLPAASWGEKDGTVTNSERCITRVRKAVEPPGQARADWWIAREVARRLEARLAPQKGAGLFAFDTPAQIFDEHRALTVGRDLDIGGLDHAALDARGPQQWPFPAGATQGQARRYTDGVFATPNGRARFHATPYRKVAEPTSARFPMRLLTGRLRDQWHGMSRSGRVPGAFAHSPEPALRMHPDDAVRRGLQAGELVRVASKRGALVLPLELSDELRSGTVFAAMHWSAQTLASGGINEVSTPAVDTRSQQPELKHAAVRV

SEQ ID NO: 15901 - protein, 1380 aa, Xanthomonas campestris
YSFTEKKRIRKDFGKQRSILEVPFLLAIQVDSYREFLQEDVEPNKRKDLGLHAALKSVFPISSYSGNAALEYVGYKLGEPVFDERECRQRGMSYGAPLRVTVRLVIYDRESSTKAIKYVKEQEVYLGEIPLMTENGTFIVNGTERVIVSQLHRSPGVFFDHDRGKTHSSGKLLYSARIIPYRGSWLDFEFDPKDALFTRIDRRRKLPVSILLRALGYNNEEMLAEFFEINTFHINPDEGVQLELVPERLRGETLNFDLADGDKVIVEAGKRITARHVKQLEAAGVAALAVPDDYLVGRILSHDVVDGSTGELLANANDEISEDQLAAFRKAGVDAVGTLWVNDLDRGPYLSNTLRIDPTKTQLEALVEIYRMMRPGEPPTKEAAQNLFHNLFFTFERYDLSTVGRMKFNRRVGRKEVLGESVLYDKKYFAERNDEESKRLVAEHADTSDILEVIKVLTEIRNGRGVVDDIDHLGNRRVRSVGEMAENVFRVGLVRVERAVKERLSMAESEGLTPQELINAKPVAAAIKEFFGSSQLSQFMDQNNPLSEVTHKRRVSALGPGGLTRERAGFEVRDVHPTHYGRVCTIETPEGPNIGLINSLAVFARTNQYGFLETPYRKVLDGKVSDDVEYLSAIEENEYVIAQANALTDAKNMLTEQFVPCRFQGESLLKPPAEVHFMDVSPMQTVSVAAALVPFLEHDDANRALMGANMQRQAVPTLRSQKPLVGTGIERAVARDSGVTVNARRGGVIEQIDAARIVVKVNEAEIGGGTDAGVDIYNLIKYTRSNQNTCINQRPLVNVGDVIARGDVLADGPSTDIGELALGQNMLIAFMPWNGYNFEDSILLSERVVEEDRYTTIHIEELTCVARDTKLGPEEISADIPNVSEQALNRLDESGVVYIGAEVRAGDIMVGKVTPKGESQLTPEEKLLRAIFGEKASDVKDSSLRVPPGMDGTVIDVQVFTRDGIEKDKRARQIEESEIKRVKKDFDDQFRILEAAIYARLRSQIVGKVANGGPNLKKGDNVTDAYLDGLKKSDWFQLRMKDDDAADAIERAQKQIQAHEKEFEARFADKRGKITQGDDLAPGVLKMVKVFLAVKRRIQPGDKMAGRHGNKGVVSNVVPVEDMPYMATGEPVDIVLNPLGVPSRMNIGQILEVHLGWAAKGLGRKIQRMLEAQTAVSELRKFLDDIYNHDSAINAERVDLSQFSDEELLNLGKNLIDGVPMATPVFDGASEAEIKRMLELAELPQSGQTQLYDGRTGEAFDRKTTVGYMHYLKLNHLVDDKMHARSTGPYSLVTQQPLGGKAQFGGQRFGEMEVWALEAYGAAYTLQEMLTVKSDDVQGRNQMYKNIVDGEHEMVAGMPESFNVLVKEIRSLAINMELEE

SEQ ID NO: 15902 - protein, 275 aa, Xanthomonas campestris
MPLMKFKPTSPGRRSAVRVVTPDLHKGAPHAALLDSQSKSGGRNHHGRITVRHVGGGHKQHYRIIDFKRNKEGIPARVERIEYDPNRTAHIALLCYVDGERRYIIAPKGLKAGDQVIAGANAPIKTGNALPLRNIPVGTTVHGIELKPGKGAQIARAAGAAVQLVAREGIYATLRLRSGEMRKVPVECRATIGEVGNDEHNLEKLGKAGAKRRRGVRPTVRGAAMNANDHPHGGGEAKAGQGNPHPVTPWGVPTKGYKTRKNKRTQQFIVRDRRG

SEQ ID NO: 15903 - protein, 477 aa, Xanthomonas campestris; identical to SEQ ID NO: 15532

SEQ ID NO: 15904 - protein, 327 aa, Xanthomonas campestris
KAPVRVAVTGAAGQIGYALLFRIASGEMLGKDQPVILQLLELSNEKAQAALKGVMMELEDCAFPLLAGMVGTDDAEVAFKDIDVALLVGARPRGPGMERKDLLLENAKIFTAQGAALNKVAKRDVKVLVVGNPANTNAYIAMKSAPDLNPKNFTAMLRLDHNRALSQLSLKLGKPVGGIEKLVVWGNHSPTMYPDYRFATSDGASIGDAINDQEWNAGTFIPTVGKRGAAIIEARGLSSAASAANAAIDHVRDWVLGSNGKWVTMGVPSDGSYGIPEGVIFGFPVTTENGQYTLVKDLPIDDFSQKYIDKTLAELEEERSGVSHLLG

SEQ ID NO: 15905 - protein, 203 aa, Xanthomonas campestris; identical to SEQ ID NO: 15534

SEQ ID NO: 15906 - protein, 494 aa, Xanthomonas campestris; identical to SEQ ID NO: 15535
  unsure (1)..(494): unsure at all Xaa locations

SEQ ID NO: 15907 - protein, 377 aa, Xanthomonas campestris
DPVDLNDEQQAFRAAARDFADKELAPHAARWDAESHFPREAIGKAAELGFCGLYTDEGVGGLGMRRLDAAIVFEELATVDPSTSAFITIHNMATWLIASYGNDGVRAQWGEAMTSGAKLGSYCLTEPGSGSDAASLKTRAQRDGDDYVLNGSKAFISGAGATDVLVVMARTGEDGARGISAFVVAADAPGISYGRKEEKMGWNSQPTRGITFTDVRIPAGNLLGKEGEGFKMAMKALDGGRINIAACSLGAAQGALDAARRYMGERRQFGKKLADFQALQFKLADMATQLVAARQMVHTAARKLDAGSHDATVWCAMAKRFATDAGFAICDEALQIHGGYGYIREYPIERLLRDSRVHRILEGTNEVMRMIIARHLL

SEQ ID NO: 15908 - protein, 165 aa, Xanthomonas campestris
LLVDRPAIDAAVATIADAIARDYAGEVPVYLTIMHGALPFSGQLALELGARGQDLQFDYLHATRYRGETTGGELVWKHRPATALFGRRVILVDDILDEGYTLQGVRQWCLEQGATDVRVAVLTVKRHDRCVPGVTADYVGVEVADRYVFGFGMDVNEQLRGIPAI

SEQ ID NO: 15909 - protein, 391 aa, Xanthomonas campestris; identical to SEQ ID NO: 15538

SEQ ID NO: 15910 - protein, 234 aa, Xanthomonas campestris
AFWHGVLPAITTPFTANGDIDHDFLAKHANQLVDAGCTAIVPLGSLGEAATLSVDDKLAILKTLVTALQGRVPVVPGIASLATGEAVALAKAAKELGCGGLMVLPPYVYSTDWREMGAHVRAVIAATDLPVILYNNPVAYKTDFGPAQIAELAAEFPNLQAVKESSGDVRRFAALQELLGDRLALLVGMDDAIVEGLSMGAKGWIAGLVNAYPKESVRLFELARDGGYPAAKEL

SEQ ID NO: 15911 - protein, 623 aa, Xanthomonas campestris
MMIDSTRYPRLSRIQTPDDLRTFEEADLTAVADELRAYLIESVGKSGGHFAAGLGVIELTVALHYLYQTPVDQLVWDVGHQTYPHKILTGRRDQIHTVKQKDGVAPFPKREESVYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLKTLKGPQLLHVITTKGKGYELAEGDQIGYHAVGPFDPSKGLVAKAGAKKPTYTDVFSDWVCDMAAADPKMLVITPAMREGSGLVRFSKEYPQRYFDVAIAEQHAVTLAAGMATQGAKPVVAIYSTFLQRGYDQLVHDVAVQKLDVLFAIDRGGVVGPDGATHAGNLDLSFLRCVPHMVVMAPADEAECRQMLTTGLRYEGPAAVRYPRGTGPGTALDASLTTLPIGKAQLRHSGARIALLGFGATVDAAEAVGRELGLTVVNMRFVKPLDKAMLLELAKCHEAFVSIEDNVVAGGAGSGVSELLNAESVLMPMLHLGLPDSFQHHASREDLLAEAGIDQAGIRAAVLKRW

SEQ ID NO: 15912 - protein, 435 aa, Xanthomonas campestris; identical to SEQ ID NO: 15541

SEQ ID NO: 15913 - protein, 337 aa, Xanthomonas campestris
SAMSEIQSLTAQALADVAAAHTPDQLETLRVALLGKNGSITAQLKQLGTLPADQRKAAGEAINLARDALTTALSERKQVLETAALDARLEGERIDVTLPGRRGERGGLHPVTRTLERIVEIFARLGYELSDGPEIEDDWHNFEALNFPPHHPARAMHDTFYFGDGRLLRTHTSGVQVRYMDTAVATKSGPPLRMIAAGKVYRSDSDQTHSPMFHQVEGLLVDEHSNFADLKGTLSEFVRAFFERDFEMRFRPSYFPFVEPGAEVDIAWQQPDGSTRWLEVLGCGMVHPNVLRSVGIDPERYTGFAFGLGVERFAMLRYGVNDLRAFFENDVRFLRQF

SEQ ID NO: 15914 - protein, 530 aa, Xanthomonas campestris
SVLMAAMLLYSGAACAAPAPGDYYGTLEPFAADAVYFVVTDRFVNGDTGNDHRDQGGAHRSFDVPTPCDGGVGDNIGYLGGDFKGIVDHADYIRGLGFGAVWITPIVDNPDEAFTGGKPITCESTLSDHGKTGYHGYWGVNFYRLDEHLPSPGLDFAGFTRAMHANDLKVVLDIVGNHGSPAYSMPVAQPGFGKLYDAQGRLVADHQNLAPAQLDPAHNPLHAFYNTSGGLAELSDLNEDNPAVLDYLAGAYLQWMEQGADAFRIDTIGWMPDRFWHAFVARIREKRPGVFMFGEAFDYDPAKIAGHTWARNAGVSVLDFPLKQQLSAVFGHKQAGFEQLATPLYLRKGPYGNPYELMSFYDNHDMARLDASDTGFIDAHNWLFTARGIPVIYYGSETGFMRGRAEHAGNRNYFGEERVSNAPQSPIFGPLQRIATLRRNTPALQRGVQVDLQLRGNQAAFLRVYQHAGMTQTALVLLNKGDAAADIAVSRLLQPGSWRDAFSGEQVQVQGRVTLQVPAHGVRVLLSDAP

SEQ ID NO: 15915 - protein, 684 aa, Xanthomonas campestris
TANPFFADSTLPLHYPQFDKIKDSDFAPAFDAGMAAQLKEVDAIANQKAKPTFDNTIIALEKSGATLDRATTVFFNLVGADTNDARKKLQADYSAKFAAHRDAISLNGKLFARIQTLYDQRSKLGLDAQGVRLVEKYYSDFVRDGAKLSDADKTTLKAMNAELANLGTTFSQNVLAEVNAAAVVVDDVKQLDGLSDEQIAAAAEAAKARKLDGKYVIALLNTTGQPPLTQLKNRELRKKIYAASVSRGSHGGQYDNTALVSRIMTLRANKAKLLGFPTYAAYSLENQTAKTPEAVNAMLGKLAPAAVANAKREAADLQAMIDKEQKAARKPTFKLEAWDWAYYSEKVRQAKYNFDESQLKPYFELKNVLENGVFYAANQEYGLTFKQRTDLPTYRDDITVYDVFDADGKQLAIFIADMYARESKRGGAWMNSYVSQSELTGFKPVVANHLNIPKPPAGQPTLLTWDEVTTMFHEFGHALHGMFSDVKYPYFSGTSVPRDFVEFPSQVNEMWADEPSILKNYAKHYQNGTPMPQALLDKVIAASKFNQGFATTEYLGAAMLDQNWHQISANQVPDAAGVMAFEAKALADDGIAYPPVPPRYKTPYFSHIMGGYAAGYYAYIWSEVLDANTQQWFKQHGGLSRANGDRFRQTLLSRGGSVDAMELFQNFAGHAPQIEPLLEKRGLS

SEQ ID NO: 15916 - protein, 638 aa, Xanthomonas campestris; identical to SEQ ID NO: 15544

SEQ ID NO: 15917 - protein, 203 aa, Xanthomonas campestris; identical to SEQ ID NO: 15545

SEQ ID NO: 15918 - protein, 248 aa, Xanthomonas campestris
FQLRGYKPVYLLPAFWTSDTNRTPQSPNPANSVSTPQQLDSAELKFQLSFKTKVVEDLFGDNGDIWMGYTQSSRWQAYNSDASRPFRETNYEPEAMLVFRNNYSIFGWKGRMSGISINHMSNGREDPLSRSWNRVILNIGLDRENWALTLRPWFRIKEDRADDNNPDIEDYMGRGDATLVYNKDGHEFALIARHSLRGGDRSHGSVQLDYGFPITNLLRGHVQVFDGYGESLIDYNHKATYVGVGVSL

SEQ ID NO: 15919 - protein, 370 aa, Xanthomonas campestris
DDLFDVRAQLSDDERAVQDAVARFTDARVLPGIGEAFDAVRFPRELVPELAALGLLGASLPVSEGGAGLGAVAYGLICQELERGDSGLRSFVSVQSSLCMYPIHAYGSDAQRRQWLPEMAAGRVIGCFGLSEAQGGSDPAAMTTRAVRDGDGWRLRGAKMWITNGSIADLAIIWAHTDDGVRGFLVDTRSEGFRAQDIGHKMSLRASVTSAVFLDDVFVPEQQRLPDALGLKAPLGCLSQARFGIAWGAIGAAVACLREALAYSGERILFGRPLAATQSAQIKLADMARRIATAQLLALQLGRLKEAGTLRPEQISLAKWNNCRMALDVARECRDLLGAAGITTEHVAIRHALNLESVITCEGTETVHRF

SEQ ID NO: 15920 - protein, 636 aa, Xanthomonas campestris
PAFAADARITREQYATLYRESIEHPEQFWGKAAQRLDWFKQPTQIKDVSFALDDFHVRWFGDGELNASVNCLDRQLATRGDKTALLFEPDSPDSPSYPVTYRELYERVCKLGNALRNLGVKKGDRVTIYLPMIVDAAVAMLACARIGAVHSVVFGGFAANSIADRVIDCQSKLIITADEGLRGGKKIPLKANVDAALKIPGTNTVETVLVVRHTGGAVDMQAPRDRWFHDVVDGQPAECEPERMNAEDPLFILYTSGSTGKPKGVLHTTAGYLLFASYTHEVVFDLREDDIYWCTADVGWVTGHSYIVYGPLANGATAVMFEGVPNYPNVSRFWEVIDKHQVTIFYTAPTAIRALMREGEAPVKKTSRSSLRLLGSVGEPINPEAWRWYYEVVGDSRCPIVDTWWQTETGGILISPLAGAVDLKPGSATLPFFGVQPALVDAEGKILEGATEGNLVLLDSWPGQMRTVYGDHQRFIDTYFRTYPGSYFTGDGCRRDTDGYYWITGRVDDVINVSGHRIGTAEVESALVSHPKVAEAAVVGFPHDVKGQGIYAYVTLIAGETPSEELHKELVSWVRKEIGPIASPDHLQWAPGLPKTRSGKIMRRILRKIAENAPDQLGDTSTLADPSVVDSLVNER

SEQ ID NO: 15921 - protein, 649 aa, Xanthomonas campestris
  unsure (1)..(649): unsure at all Xaa locations
GDSSPSFYQPRXRAGRHTVAPSHRSADAAIPVKYARDALARPPVCAMLRPSVSLAFASSLPRQSVAGRAVQRSPLPRPTSGHGATEARVKSSHCFIRFCCVVLLAITGCSPAAQSRYAPERNFTDPKALALALAAEQGDAEEVRRLMKVEGVNPDTIFSKDGYSTVVLADLHPQPDRAEGDAGQWGRSECGQALSPGAGTKSDQCQXCHGLGSRADDPLYLKLLLDHGGNPNTRNANNESLLFHAFIKQNKWDNIKLLVERGADINAVAGMGNSITAAYAIRGGFDFVYWLLQHGADPTIEFAYGNPCPSQRLWNNXGHLLASGQSQGSAVAAAVPAMAVEAGIXAPSIARELSEYAQGVPLPNGRKRYPAALTSMHKDXLHANAHPAGTATPRRRSAHEMQRRSCAASGQLAYHPVPMQSAATEARVKPSHCFIRFCCVVLLAITGCSPAAQSRYAPERNFTDPKALALALAAEQGDAEEVRRLMKVEGVNPDRIFSKDGYPLLFWPIFTHNPTGLKAMLENGADPNAGQLHPLQETTRFKGRYRNRAMVWAAEQDDSVYLKLLLDHGGDPNTYNSNGETLLFHALIKQDKWSNIQLLVKKGADVNALAGMGGTILENYSGSGGFERVFWLLEHGADPRIEYSGDIPL

SEQ ID NO: 15922 - protein, 254 aa, Xanthomonas campestris
MKIASWNVNSLNVRLPHLQQWLADFAPDVVGIQETKLEDHKFPDAALAALGYRSVFCGQKTYNGVAILSRSPALEVQMGIPGFDDVQQRVIAATVDGVRIINLYVVNGQDVGTDKYAYKLRWLEAVHDWIAQELQRHPQLVVLGDFNIAPDARDVYEPEVWSDNHILTSTAERGALHKLLALGLHDAFRLHHDDAGHFSWWDYRQAAYRRNLGLRIDLTLVSDALRARAVEAGIDREPRTWERPSDHAPAWVRL

SEQ ID NO: 15923 - protein, 264 aa, Xanthomonas campestris
VVSVHVENRIAWVKFARPDKRNAMSPALNRRMLDVLDELEFDDNVGVLVLGGEGTAWSAGMDLKEYFRETEAQGLRGVRRSQRESYGWFRRLRWYQKPTIAMVNGWCFGGGFGPLFACDLAIAADEAQFGLSEINWGILPGGGVTKVAVELLSMRDAMWMTLTGELVDGRKAAEWRLVNESVPLERLETRTREVAELLLKKNPVALKYAKDAVRRVGTMTYDEAEDYLVRMQEAANSFDNNARKEGIRQFIDEKRYKPGLGAYE

SEQ ID NO: 15924 - protein, 475 aa, Xanthomonas campestris
RGPWGLFIDGQWRASTGSQTLDVIAPHTEERLLRYTEPSHADTEAAVAAARRAFDSGPWPQLPPPERGAALKRIAEHLRARMPELADAWTAQVGAVIGFSRRASKQAPDLFDYYGDLITTHPFVEPRTRSSGGRVHVVQEPVGVVVAITPWNAPLVLLCYKVAAALAAGCTVVAKPSPETPIDAYILAECISAAGLPDGVFNLLPAGREVGEQLIRHPSVDKVSFTGSTQAGRSIGVACAERLARVGLELGGKSAAIVLEDADIEKVLPSLVPYSMPITGQVCFALTRVLVPAHRREAILHAYCSALATLKLGDPFAADTGMGPLALGRQLERVQGYIAQGSAEGAKLVMGGGRPEHLPRGFFLEPTVFAGVTPEMTIAREEIFGPVVSFIDYHNEEDLIAKVNDSDYGLHGTVYSDDPERAYAIARRVRSGSHSINGMCVDIEMPFGGVKHSGIGREGGIEGLHGFLETKTIYL

SEQ ID NO: 15925 - protein, 473 aa, Xanthomonas campestris; identical to SEQ ID NO: 15552

SEQ ID NO: 15926 - protein, 164 aa, Xanthomonas campestris
MKLSLIVAFDRNHAIGRDNDLPWKLPDDLKRFKALTLGKPILMGRKTAQSLGRALPGRLNLVLTRSGQVPFEGMHAVVSVDEAIERAAQEGAQELCVIGGGEVYRLTMERADLLAVTEVDTAVEGADTHFPPIDPAVWVPAERSAHAADARHAFAFSFVDYQRR

SEQ ID NO: 15927 - protein, 234 aa, Xanthomonas campestris; identical to SEQ ID NO: 15554
  unsure (1)..(234): unsure at all Xaa locations

SEQ ID NO: 15928 - protein, 143 aa, Xanthomonas campestris
ELPIDVNQIQTLIPHRYPFLLIDRVIELDLEAKRIVGQKNVTINEPFFQGHFPTRPVMPGVLIIEALAQAGGVMTQLGLGRDALSKLFYMVKVDNARFNKQVVPGDVLILEVQMKRLIRNMGCYYGEAKVNGEIVASAEVMCA

SEQ ID NO: 15929 - protein, 303 aa, Xanthomonas campestris; identical to SEQ ID NO: 15556

SEQ ID NO: 15930 - protein, 460 aa, Xanthomonas campestris; identical to SEQ ID NO: 15557

SEQ ID NO: 15931 - protein, 280 aa, Xanthomonas campestris
EARADRIDWLRALPFIALHLACFAVFWVGVSWFAVGMAVALYALRMFALTGFYHRYFSHRAFKTSRVVQFVFAAIAATCVQRGPLWWAAHHRNHHRHTDTGRDPHSPAQHGFWWSHTGWFLTPRNFRTDWEVIPDLRRFTELRFLDRFDIVMPVLLALGLYLLGDWLAAAAPGLQTNGAQLLVWGFVLSTVALFHATFTINSLAHRFGSRRFDTRDDSRNNWLLALLTFGEGWHNNHHFFPGSARQGVRWWEYDMTWYGLTVMSWVGLVWDLKPMPAMLT

SEQ ID NO: 15932 - protein, 631 aa, Xanthomonas campestris
RARRSNVRGKPTGRPGSSSSRRNDGGRGSNQSNSGPHGFERPTAPVVREVAIGETITVADLAQKLALKGGDVVKALFKMGVMATITQSIDHDTAALVTEELGHKAVRADNADFEDALLAHAEDAQGETTSRPPVVTIMGHVDHGKTSLLDYIRRTKIASGEAGGITQHIGAYHVETGRGVISFLDTPGHAAFTSMRARGAKITDIVVLVVAADDGVMPQTKEAVAHAKAAGVPLIVAVNKIDKAGADPLRVKNELLAENVVAEDFGGDTQFIEVSAKVGTGVDTLLDAISLQAEVLELKAVADGRASGTVIESSLDKGRGPVATVLVQQGALKRGDYLVCGIQYGRVRALFDETGHQPASAGPSIPVQVLGLSGVPEAGDDFVVVDDERLAKDVAQQRETKRRESRLVASATNRMEDILAQMGKGEGQQVLNLVIKADVQGSVEALKQSLVALSNDDIRINVIHSGVGGITESDANSAAASKATIIGFNVRADASARKIVESNGIDLRYFSIIYDVIDQVKQVASGLLGVEIREEIIGIAQVRDVFRSSKFGAVAGCMIIEGVVKRSKPIRVLRDSVVVFEGELESLRRFKENVDEVRNGTECGIGVKAYNDVKAGDQIECFERIEVARTL

SEQ ID NO: 15933 - protein, 477 aa, Xanthomonas campestris
WHGCIFNGDWVPGSGGTLQIHEPATGGLLHEVGKADLSDVEAAIAQAKHAQRAWAITSPRERAAVFHRAAQLMEAHRAEATLLIARETGGIMPKAEREVSEAIAYYQQAAGLPLQAMGQVLPTAAGQLSLARHLPLGIIAVISPFNFPLILSLRSVAPALAMGNAVILKPDPRTPYTGGVIIAQVLEEAGLPKGLLHVLHGGADIGQALVEAPDVPMIAFTGSTAAGRRIGELAGRHLKKVALELGGNNAVIVLDDADLERAASAIAFGAYLHQGQICMATGRVLVQRGVADALTKLLADKARHLPVGDPVSGTVALGPIIGQRQLQRVLDIVDDSIDAGAVVEAGATHDGLFYAATVLSNVRPGMRVFDEEVFGPVINITVFDTDEEAAVLANHGEYGLVAGIMSASVSRAMVLGEQLHTGLLHINDQTVADEVINPFGGTGASGNGTSVGGPADWEQYMHWQWLTIKHAVPQYPF

SEQ ID NO: 15934 - protein, 493 aa, Xanthomonas campestris
YVLAIDQGTTSSRAMLFDRQGKVAGVAQREFGQIFPQPGWVEHNPREIMTSVYTTITELLNNAQIDAREISGIGITNQRETAVVWDKATGQPIYNAIVWQSRQTKDICTQLKEAGHEQMVRDKTGLLIDAYFSGTKVKWILDHVDGARERARKGELAFGTIDSWLIWNLTGGKVHVTDYTNASRTMMYNIHTLEWDAELLEMLDVPAQMLPEVRSSSEVYGMTQTQYFYGEQVPIAGIAGDQQAALFGQACFEPGMAKNTYGTGCFMLMNTGDKAVASKAGLLTTIAWGIDGKVEYALEGAIFVAGSVVQWLRDGLRMFGKASDSQAYAERAGDNDGVYFVPAFVGLGAPYWRSDIRGAVFGLTRGTSKEHFVRAAVESMAYQTRDVLTAMQSDSGIELKELRADGGAIANDFMAQFQSDILNVPVLRPEVAETTALGAAYLAGLATGFWSSREEIAKQWAVDRRFEPNMPEERREQLYAGWQQAVEATMGFR

SEQ ID NO: 15935 - protein, 489 aa, Xanthomonas campestris
ETYDLLVIGGGINGVGIARDAAGRGLSVCLCEQDDLAAHTSSASTKLIHGGLRYLEQYEFALVGKALAEREVLLRLAPHIIWPLRFLLPHQPHLRPAWMIRAGLFLYDHLGGSKRSLPRSRRLSLRTHPVGQPLQESLRTGFVYSDAWVQDARLVVLNAMDAAKRGAQIHTRTRCVGAWRDAGFWYAELEGRDGRRRTVQARALANAAGPWAVSFLDKVAAVPHQHALRLVKGSHIVVPKLFDHDHAYIFQQPDRRIVFAIPYEHDFTLIGTTDVDYEADPSAPKIDPAEVQYLCDAVNLYFQQQITPQDVVWNYSGVRPLLDDAEDNAAEVTRDYQLEVLTDGAPLLNVFGGKLTTYRKLAEEAVDRLTQALGARKPAWTARGEALPGGEQRDIASLLERVRTARPWLPAATAQRLVRNYGTCAEQLLGDAQDMAALGQHFGADLYQAEVDYLCAREWAQTADDILWRRSKLGLRVDAEGRARLEAYL

SEQ ID NO: 15936 - protein, 490 aa, Xanthomonas campestris
  unsure (1)..(490): unsure at all Xaa locations
PACPVPAPPWWSPIYAXWNPTRSAASSPXPRCILAXPRRRSPRPPAGRCALPQRXPKLPHPPPPSCTPCVRCRHAPPQPTERKRRELRMSEVYLVDGIRTPIGRYGGALSSVRADDLGAVPIAALLARHPQLDPAAIDDVYLGCANQAGEDNRNVARMSVLLAGLPSSVPGSTVNRLCGSGLEAVGIAARGIRAGELELAVAGGVESMSRAPWVMGKAESAFARNQHLHDTTMGWRFINPRLEATYGVELMGETAENVAQRYAISRDDQDAFALRSQQRTAAAQAAGFFDDEITAVAVAGRKGGEGVQVMRDEHPRADASAEALARLKPVFRQPGTVTAGNAAGLNDGAASLLLASARALHLHGLTPRARVLGFASAGVEPTYMGIGPIPATQRLLARLGLQIAQFDAIEFNEAFAAQALACTRAFGLADDAAHVNANGGAIALGHPLGMSGARLALTLLRQLDACNGRRGLASMCIGVGQGVALAIERV

SEQ ID NO: 15937 - protein, 654 aa, Xanthomonas campestris; identical to SEQ ID NO: 15564

SEQ ID NO: 15938 - protein, 375 aa, Xanthomonas campestris
FELGEDIDLLRESVAAFASHHIAPLAAAADHDNVFPAQLWRLFGEQGLLGLTVEEAYGGSGMGYLAHVVAMEEISRAGGAIGLSYGAHSNLCLNQLRKNATHEQKQRYLPKLCTGEHVGALAMSEAGSGSDVVSMKLRAEARGDRFVLNGSKMWITNGPDADVLVVYAKTDPSAGARGITAFIVEKGMPGFSTAQKLDKLGMRGSNTCELVFTDCEVPAENVLGTLNGGVRVLMSGLDFERVVLAGGPLGLMAAAMDVVLPYVHERKQFGEPIGTFQLMQAKLADMYVGLNACRAYVYAVARACDAGRTTRQDAAGAILYAAEKATWLTGQAIQVLGGNGYINEYPTGRLWRDAKLYEIGAGTSEIRRMLIGREL

SEQ ID NO: 15939 - protein, 267 aa, Xanthomonas campestris; identical to SEQ ID NO: 15566

SEQ ID NO: 15940 - protein, 255 aa, Xanthomonas campestris; identical to SEQ ID NO: 15567

SEQ ID NO: 15941 - protein, 665 aa, Xanthomonas campestris
  unsure (1)..(665): unsure at all Xaa locations
TRRQLANAIRFLAADAVEAAKSGHPGMPMGMADIAEVLWNDFFRHNPNNPQWFNRDRFVLSNGHGSMLQYALLHLSGYDLPIEQLKQFRQLHSKTAGHPERSETPGVETTTGPLGQGFANAVGFALAEKLLAQRYNRPELEIVDHRTWVFMGDGCMMEGISHEAASLAGTWGLGKLVAFWDNNQISIDGNTAGWFSDNTPARFEAYGWHVIRDVDGHDAEKIKTAIEAALENSDKPTLICCRTKIGFGAPTKSGKESSHGAPLGKEELEGARKALEWPYGPFEIPEEIYAGWRAGGTGTLRQAEWEQLFDKYAKQYGEQADELTRRSRGELPADFIAQADAYIAKAQEDGQTIASRKASQLAIEAFAPLLPELVGGSADLAHSNLTLWKASKSVATDDPNANYVYYGVREFGMTAIANGLALHGGFIPFDATFLVFSDYARNGVRMSALNPAHAIHVYTHDSIGLGEDGPTHQPVEHLASLRYIPNNDVWRPGDAVESAVSWKAAITRKDGPSCLVFSRQNLQHQPRSAEQIKLIERGGYVLADAEGGTPDVILIGTGSEVGLAVEAKKTLDAAGLKTRVVSMPSTDVFDRQDAAYREQVLPNAVRKRVAVEAGVTGFWRKYVGLDGAVIGIDTFGASAPADQLYAYFKITAEHVVEAAKALXCV

SEQ ID NO: 15942 - protein, 412 aa, Xanthomonas campestris
LHWKMGIGFAIGLVLGLAVYYLAGSDAEWVRLVTKYVTTPFSQIFLNLIFMLIVPLLFSALVVGIAEMGDIRALGRVGWRTLGYTVVLSGIAVLLGLVLVNVLKPGAGVDPQLANQLIQENADRTREIISSSGNQPQGMDMLLSIVPNNVIAAASSNGAILSLMFFAVMFGVGMVLTADEKVATLKRGIEGIFEISMTLIGLVIRLAPYAVACFMFNLAALFGFDLLIRLGAYVGVVVLALGLHMVVSYGLAVKFAGRSPIGFFRQTQEATLMAFSTASSNATLPTALRVADEMGLPPRVSRFVLTVGATANQNGTALFEGVTVIFLAQFFNVDLSIGQQFMVMIVCILGGIGTAGVPSGSLPVVALICAMVGVNPVGIGMILGVNHFLDMCRTALNVTGDLALTTLVAKGE

SEQ ID NO: 15943 - protein, 677 aa, Xanthomonas campestris
IREGRPNPLGATWDGLGVNFALYSRNATRVELCLFDERGREQERIPLPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPENRGTFSALKTDELIDHISSLGVTAVELLPVHAFVDDQYLLEKGLRNYWGYNTLGFFAPQGRYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISANYGAEGETDNPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGNEMDEAAWHDPEARALMLRLDGRSPTTGLREIAANVTLLMLINAAPTSVAFTLPAMHDEHWRVLVDTARHGGRVVAGG

SEQ ID NO: 15944 - protein, 714 aa, Xanthomonas campestris; identical to SEQ ID NO: 15571

SEQ ID NO: 15945 - protein, 462 aa, Xanthomonas campestris; identical to SEQ ID NO: 15572

SEQ ID NO: 15946 - protein, 379 aa, Xanthomonas campestris
HERISSLRKLRVAQERVRVRRQVGRRDGVRLEIDGRWLTGFCSNDYLGLSQQFEVVAALQDAAARDGAGATASHLICGHHTAHETLERDIAEWLGYPSALLFGSGFIANLAVQQALLSEEDDVCVQDRLNHASLLDATRLAGCRLRRYPHLDVEGAMRQLKGAPEGAAMLASDGVFSMDGDVAPLRALSLVARMQEALFYVDDAHGVGVLGPQGRGCVADAGLGVAEVPLQLVTLGKALGGYGAVVVGEEALIRHLAETARPYIYTTALPPAQVAATLAAVRLARRDDWRRTRLTELIGTFRDGARRHGFELMASDTPIQPLLCGEEATVMAMSAALEQAGFLVGAIRPPTVPEGKARLRVTLSALHTPQQVQALVDAI

SEQ ID NO: 15947 - protein, 259 aa, Xanthomonas campestris; identical to SEQ ID NO: 15574

SEQ ID NO: 15948 - protein, 222 aa, Xanthomonas campestris
ASHNVASLDLSYLPLPRFPEQTYRFGHLQDMSIAGAGLLELPESISDLANLRTLTLSQNPIGALPASISRLGELQELTIFSCPNLTELPEHLAIRNTAGQREGLVKLRTLTLSRTGIRSLPSSLEYLKDLTHLKINSSPLTELNTSIHRLPLLEEVDLRGCTRLRHYPSISGQQWSLRKLSLQDCSSLQTLPSNIDALRNLQELDLRGCNNLRALPPSISGL

SEQ ID NO: 15949 - protein, 204 aa, Xanthomonas campestris
TMHAPFGCMRMSQSDQPDSSVTQAQAEEAVRTLLRWAGEDPAREGLLDTPRRVAEAYGDWFSGYREEPRAYLERTFEEVAGYDELIVLRDISYESHCEHHMAPIIGKVHVGYLPRGKVVGISKLARVVESYARRFQVQEKMTAQIAQCIQDVLQPRGVGVVVEGAHECMTTRGIHKRGVSMVTSKMLGSFREDARTRAEFLQFI

SEQ ID NO: 15950 - protein, 596 aa, Xanthomonas campestris
LDLDVCAREPIHIPGLIQPYGVLLVIDPADGRIVQASTTAADLLGVPMAALLGMPYTQVLTLPEAQPFAVDDQPQHLMHAEVRFPQRATPPDSAWVAAWHLYPQQWLVEMEPRDARLLDVTLREAMPLLRSVERDPGIAEAAVRVAKGLRSLIGFDRVMIYRFDEEWNGDIIAEARKPELEAYLGLHYPASDIPAQARALYLRNRVRQIADVGYQPSPIQPTVHPQLGTPVDLSDVSLRSVSPVHLEYLANMGVTATLVASIVVNDALWGLISCHHYSPHFTNHAMRDVTDAVARTLAGRIGALQAVARARLESVLLTVREKLITDFNDAEHMTVELLDDMAPDLMDVVDADGVAIFHGNDISRHGTTPDVAALRRIRDHIESEHHDALREDAVGALHVDAIGEVFPELADLAPLAAGFIFVPLMPQSRSALLWTRREQIQQIKWAGNPQLAKLEDIPNSRLSPRKSFDLWQQTVRGRARRWSPLHLESARSLRVLIELMERKRFQQDFTLLEASLSRLRDGVAIIERGTANAAHRLLFVNTAFADVCGSDVAELIGRELQTLYASDAPRANVELLQDALRNGRAAYVTLPLQVSD

SEQ ID NO: 15951 - protein, 537 aa, Xanthomonas campestris
WYKDAIIYQVHVKSFFDSNDDGIGDFPGLISKLDYIAELGVDTIWLLPFYPSPRRDDGYDIAEYMAVHPDYGTIADFEQLVAQAHARGIRIVTELVINHTSDQHPWFQRARNAPAGSPERDFYVWSDTDQEYEGTRIIFCDTEKSNWTWDPVAGQYFWHRFYSHQPDLNFDNPAVLESVLEVMRFWLDRGVDGLRLDAVPYLIERSGTSNENLPETHAILRKIRATLDAEYPDRMLLAEANMWPEDTQQYFGQNADECHMAFHFPLMPRMYMAIAREDRFPITDIMRQTPEIPETCQWAIFLRNHDELTLEMVTDSERDYLWQTYASDRRARINLGIRRRLAPLLERDRRRIELMTSLLLTMPGTPVLYYGDEIGMGDNIHLGDRDGVRTPMQWSIDRNGGFSRADPAALVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFQL

SEQ ID NO: 15952 - protein, 720 aa, Xanthomonas campestris
VTNRWDPGVTRALAEARHGDAFAVLGAHPSTNGRLLRTYHPGAEHVTAVLADGREVPLEAGPEPGLFAGELPAEGGYRLRIGWPGGTQDTADPYAFGPLLSDFDLHLISEGHHLQLADALGANVVEVDGVRGTRFAVWAPNASRVAVVGDFNSWDARRHPMRLRHQAGVWELFVPDVGPGAHYKYQLRGPHGHELPAKADPVARRAELAPGTASIVADPTPHQWSDDGWMATRARRQAHDAPMSIYEIHAGSWLREEGLDLDWDGLADRLIPYVADMGFTHVELMPVTEHPFGGSWGYQPLGLFAPTARFGSPDGFARFVDRCHREGIGVIVDWVPAHFPTDAHGLAHFDGTALYEHADPREGFHRDWNTLIYNHGRREVSGFLIASALEFLQRYHVDGLRVDAVASMLYRDYSRNAGEWVPNIHGGRENYETIAFLRRLNAVVREHAPGAVTIAEESTAWPGVTADVSHGGLGFHYKWNMGWMHDTLHYIGLDPIYRRYHHGELTFSMVYAYSERFVLPISHDEVVHGKGSLLGRMPGDDWQRFANLRAYLGFMFTHPGRKLLFMGCEFGQPTEWNHDAGLPWHLLDDARHRGVQTLVRDLNHLYAQYPALHAHDDDPSGFAWLVGDDAANSVVAFLRKGKRGDAPVLVVINYTPMVQQGYRLGVPQGGLWREVFNSDAGIYGGANLGNGGAVTAEPQSMHGHAQSLPLLLPPLGVIVL

SEQ ID NO: 15953 - protein, 249 aa, Xanthomonas campestris; identical to SEQ ID NO: 15577

SEQ ID NO: 15954 - protein, 247 aa, Xanthomonas campestris; identical to SEQ ID NO: 15578

SEQ ID NO: 15955 - protein, 237 aa, Xanthomonas campestris; identical to SEQ ID NO: 15579

SEQ ID NO: 15956 - protein, 416 aa, Xanthomonas campestris
SIFVNPQRRFQALLGIGGAITDSSAETFAKLPKQAQRQLLTAYYDPDKGIGYTLARTTIHSSDFSSGSYTYIKEGDAALKTFSVQHDAKYRIPMLRQAIAAAGGTLTTFASPWSAPAFMKDSNAMLKGGKLLPEYAQAWATYYTRFIAAYEKAGIPIWGISLQNEPMAVQTWESMLFSAEEERDFLKNHLGPTMAKAGYGDRKIIVWDHNRDMMVHRAHVIFDDPEASKYAWGMGFHWYETWAGFAPMVENVAAVAQAYPDKHLLLTEAAVEKFDPAKLQHWPNGERYGTAIINDLNHGAVGWTDWNILLDEHGGPNHVGNYCFAPVHANTRTGEVIYTPSYWYIGHFSKFIRPGAQRVSAASSRSNLATTAFVNSDGSLATVVMNATDVAIRYNLYVGDASSVLEIPAHAIQTVV

SEQ ID NO: 15957 - protein, 287 aa, Xanthomonas campestris; identical to SEQ ID NO: 15581

SEQ ID NO: 15958 - protein, 369 aa, Xanthomonas campestris
MKSRAAVAFGPGKPLEIVEIDVAPPQAGEVLVRITHTGVCHTDAFTLSGDDPEGIFPSVLGHEGGGIVEQIGEGVTGVKVGDHVIPLYTAECRKCKFCLSGKTNLCQAVRATQGKGLMPDGTTRFSYNGEPIFHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEQINEAFDLMHEGKSIRTVIHF

SEQ ID NO: 15959 - protein, 490 aa, Xanthomonas campestris; identical to SEQ ID NO: 15583

SEQ ID NO: 15960 - protein, 552 aa, Xanthomonas campestris
EYDYIIIGAGSAGNVLAARLTEDPGVSVLLLEAGGPDYRLDFRTQMPAALAFPLQGRRYNWAYETEPEPHMDNRRMECGRGKGLGGSSLINGMCYIRGNALDFDHWAKRPGLEDWSYRDVLPYFRKAETRDIGANDYHGGEGPVSVATPKNDNNVLFQAMVDAGVQAGYPRTDDLNGYQQEGFGPMDRTVTPQGRRASTARGYLDMAKPRDSLHIVTHATTDRILFAGKRAVGVHYLVGNSSEGIDAHARREVLVCAGAIASPQLLQRSGVGAPDLLRALDVQLVHDLPGVGQNLQDHLEVYMQYACTKPVSLYPALQWWNQPAIGAEWLFAGTGTGASNQFEAGGFIRTREEFDWPNIQYHFLPVAINYNGSNAVKEHGFQAHVGSMRTPSRGRVHARSRDPRQHPSILFNYQSTDQDWQEFRDAIRITREIIAQPALDPYRGREISPSADCKTDAELDAFVRARAETAYHPSCSCAMGTDDMAVVDGQGRVHGMEGLRVIDASIMPRIITGNLNATTIMIAEKIADRMRGRALLPRSTADYYVAGDAPVR

SEQ ID NO: 15961 - protein, 410 aa, Xanthomonas campestris; identical to SEQ ID NO: 15585

SEQ ID NO: 15962 - protein, 249 aa, Xanthomonas campestris; identical to SEQ ID NO: 15586

SEQ ID NO: 15963 - protein, 351 aa, Xanthomonas campestris; identical to SEQ ID NO: 15587

SEQ ID NO: 15964 - protein, 855 aa, Xanthomonas campestris
HTPLMKQFFAAKSDYPDLLLFFRMGDFYELFYDDARKAARLLDITLTQRGSSGGAPIPMAGVPVHAYEGYLARLVALGESVAICEQIGDPALAKGLVERKVVRIVTPGTVTDEALLDERRDTLLMAISRSKQGYGLAWADLAGGRFLVNEVDSVDALEAEIARLEPAELLVPDEDNWPEFLRGRVGVRRRPPWLFDADSGRRQLLAFFKLHDLSGFGIDDKPCATAAAGALLGYVEETQKQRLPHLTSIAMEVASEAISMNAATRRHLELDTRVDGDTRNTLLGVLDSTVTPMGGRLLRRWLHRPLRLREVLVQRHHAVGSLIDTGADTDVREAFRALGDLERILTRVALRSARPRDFSTLRDGLALLPKVRTILAPLDSPRLQTLYAELGEHDATAHLLISAVAEQPPLKFSDGGVIATGYDADLDELRRLSTNADQFLIDLEQRERASSGIATLKVGYNRVHGYYIEISKGQAEKAPLHYSRRQTLTNAERYITEELKSFEDKVLSARERSLSREKLLYEGLLDALGGELEGLKRCASALSELDVLAGFAERAQALDWSQPELESAPCLHIERGRHPVVEAVRDQPFEPNDLDLHPDRRMLVITGPNMGGKSTYMRQNALIVLLAHIGSYVPASRAVIGPIDRILTRIGAGDDLARGQSTFMVEMAETSYILHHATPQSLVLMDEIGRGTSTYDGLALADAVARHLAHTNRCYTLFATHYFELTALADASHAGGGSGIANVHLDAVEHGERLVFMHAVKDGPANRSFGLQVAALAGLPKAAVQQARRRLAELEQRGGDSHAAEMAPAALDAPQQFGLFTAPSSAAQEALQALDPDELTPKQALEALYRLKALL

SEQ ID NO: 15965 - protein, 749 aa, Xanthomonas campestris
NAMTTEAKCPFNHSVVGAGTTNRDWWPKQLRVDLLNQHSARSNPLAASFNYAEAFKRLDLQTLKQELRALMTDSQDWWPADFGHYGPLFVRMAWHSAGTYRTGDGRGGGGRGQQRFAPLNSWPDNVSLDKARRLLWPIKQKYGQAISWADLMILTGNVALESMGFKTFGFAGGREDTWEPDQDLYWGRETKWLGGDDRYAHGSPGVDQAHGVLVKDDDSEVQHTRDLENPLAAVQMGLIYVNPEGPDGNPDPLLAAKDIRDTFGRMAMNDEETVALIAGGHTFGKTHGAADAAHVAAEPEASDLESQGLGWHNSFGSGKGGDTITSGLEVTWTTTPAQWSNDFFDHLFGFEWELSKSPAGAHQWVAKNAQAIIPDAHDASKKRLPTMLTTDLALRIDPAYEAISRRFHANPDQFADAFARAWFKLTHRDMGPRARYLGADVPAEELLWQDPIPALNHALIDAQDAAALKQTVLSSGLSVAQLVATAWASASSFRGSDKRGGANGARIRLAPQKDWASNEPAQLAQVLATLERIQADFNARQSGGKQISLADLIVLGGNAAVEQAAHAAGHAVTVPFAPGRMDASQAQTDVESFAVLEPVADGFRNYAKARYAVSAEALLIDKAQLLTLTAPEMTVLVGGLRVLGANTGQSHNGVFTTRPGVLSNDFFANLLDMRTEWKATSETKETYEGRDRATGEHKWTGTRVHLVFGSNSILRAVAEVYASAHDQQKFVQDFVPAWTKVMQLDRFDL

SEQ ID NO: 15966 - protein, 492 aa, Xanthomonas campestris
DVQVRGTLQVEKPGAQVSRHLFGQFAEHLGTGVYGGLWVGPESSIPNTRGYRNDVLAALKAIAVPNIRWPGGCFADEYHWRDGIGAPGKRPISVNTHWGGVEESNRFGTHEFMDFTELLGTDAYVAGNVGNAAPDEIAQWVEYMTAGTRSSLAEQRRANGRQAPWKVPFFGVGNELWGCGGNMRVEYAADVYRRYQTFVKAPSDQKILKIAPGPNNDDYHWTEVMMREAGTLMDGLSLHYYTVPGGWPPRASSTDFDEAAWIETLSRTLVMDELITKHSAIMDRYDPAKKVALVVDEWGTWYAGLPGANPGFLHQQNSLRDALVAALNIDIFSAHADRVRMANIAQMINVLQAMILTDGDRMVLTPTYHVFAMYKPFQDATHLPLQLQPPDYRHGDIHVPAVHGSAVKAKDGHVYVALTNLDANSPATVSVAVDGVSVRGVEGQLLTAPTITAHNTFAAPRTVQPTAFTGARIQGNTLQVALPARAIVMLKL

SEQ ID NO: 15967 - protein, 271 aa, Xanthomonas campestris
LRFTKMHGAGNDFVVLDLRNGTPPPDASLAARLADRHFGVGCDQILTIETPRSAEAVAAYRIWNSDGSHSQQCGNGARCVAAWLVREGTAQGDVFTIDSPFTAHRVERLDAGTYSVAMGVPQFEPTQIPLAGFAHARDEYALPVHGETVRFGAVSMGNPHAVVEVGRVDAAPVERVGALLQQNAAFPESVNVGFAQVVDPAHVRLRVYERGVGETLACGSGACAAAVVLMHRGRVERDVRVSLPGGELRIRWAGEQAQVVMSGPAVFVFDG

SEQ ID NO: 15968 - protein, 588 aa, Xanthomonas campestris
DESSYAQPQLVVIKDLALDLKLDFDAKQIGGTATYTLDWKDKAAKQLVLDTRELSIAQVQADDGKGTLSPLQFVLAPADKTFGSMLTIETPDQPAKVVITYHTAPTASGLQWLEPAMTEGKQLPFMFSQSQAIHARSWVPLQDTPSVRFTYSAHVTSRPDVMVLMSADNDPKAARDGDYSFKMPEPIPSYLLAIAAGDVVFKPISARSGVWAEPSMADKAAKEFEDTEKMIGAAEKLYGPYRWGRYDMLVLPPSFPFGGMENPRLTFATPTVIVGDKSLVSLVAHELAHSWSGNLVTNASWKDIWLNEGFTTYVQGRITEALYGNEMAEMEREIDQGDLLAEVKGMAPADQALALPPLAERDPDEALSQVAYVKGAWFLQFLEQRFGREVFDPFLRGWFDDHAFQSATTDQFVDYLNKNLLAKHPNTVSAAEVDAWLKQPGIPAFAAKARSRSFSIVDTARIAWSGSGTLPNKQVTGEWGTQEWVHFLSGMGATLKPEQLKQLDDAYHFTGTPNGEIAMRWYPLAIRSGYIDARPAAGEFIERVGRRKLVLPIYAELLKTPDGITFAEQAFEKAKPSYHPITTASVAE

SEQ ID NO: 15969 - protein, 592 aa, Xanthomonas campestris
AVVDTDGEFTTNASNPDNWGGVGRDFALTRHSPLAEINRDNVKNLKMSWEMKTDATRGHEGQPLVIGSIMYMVSAYPNNVYAIDLASQDDGGKVLWKYTPQQDERSVAVACCDTVNRGASYADGKLVFGSLSGDVIALDAKTGKEVWKQKLGHPDKGETITMAPIIADGKVIAGISGNEFGVLGRVAAYNLADGKQAWSCDAAGTDKSICLGADFNKANPQHGQLGDLGVKTFPNDEWKRGGGAAWGWYSYDPKLKLLYYGTGNPGLWSPSYRCGKTSHEECNNGEHDNKWSMTLFARKIDTGEAVWGYQKTPFDQWDYDGINEPILVDLTIDGKEVPSVVQFDRNGFAYVLDRRDGTLLRAHKFVPANWAERIDMKTGRPVKVAAHSPLERGKKVQAFPSAMGGKDQQPCSVDPANSAVFFCGTNNWHMELEPQERGNTMMGLPYVFANVMMKPNEPGALGIVKAFDVVEGKSKWEIKEKFPVWSGTLVTDGGLVFYGTLDGWFRAVDKDTGKKLWEMKLPSGIIGNPIAYKANGHQYVAVFSGIGGWIGLPVAAGLDPADPYGALGAAGLAFGAGFDKIPLGGMVHTFRI

SEQ ID NO: 15970 - protein, 229 aa, Xanthomonas campestris
ADPNQELAHALDAGDALRAAWLLRHGADANQPNLLGEPPLHQAIRNQEPDLVGLLIDAGARLDARDGNGWTALMKAAWGNDADSVQRLLARRAPLDTVSSDGWNALELAVSYADVGVVEALLKAGAKARGANRTGFTPVMFAVPREDPAILDALLKHGADVRGANQAGVTALMLAAASGREATAKRLLAAGADPAARNRDGKTAATLAQERGDAALAALLAPGKRNTTQ

SEQ ID NO: 15971 - protein, 314 aa, Xanthomonas campestris; identical to SEQ ID NO: 15594

SEQ ID NO: 15972 - protein, 405 aa, Xanthomonas campestris; identical to SEQ ID NO: 15595

SEQ ID NO: 15973 - protein, 805 aa, Xanthomonas campestris
LLVAYAVVLAVLGAALAYEGGRLVAVGGSWYYVLAGIAVLVAGVLLALGKRAGLWLFGATLAATIVWALWEVGLDGWGLIPRLAWISVLGLVLLPFWGVARRRMQPLSGLGYVVVTGVLPVLGAALILWPLLVPRNVELADASKQPADAATPFSRGSVPSPDGNVAANHDASNWTAYAGSNLSNHYTPGAQITPENVKGLKVAWEFHTGDLKPKDSKLGYAFQNTPLKVGDLLYICTPTQKVIAVEAANGKERWRFDPQTNPKAMAGVAATTCRGVSYYQAPEGTAECPTRIFWPMVDGRLGALDAQTGKLCASFGNNGYVDLNAGTGNTKPGFVGPTSPPVVMRGVVIQPTGQVRDGQERDAPSGVVRGFDALTGQLRWAWDLGNPAITAEPPAGQTYTRSTPNVWSLMAADDELGLVYLPTGNAAGDFFGKGRTPQEEEYTASLVAVDAATGKERWHFRTVNHDLWDYDIGPQPNLVDWPVAGGGTRPAVIQATKSGQVFVLDRATGQPIMPVKQIAVPQGTDHGDWTASTQPVSPGMPNTVGAPSRDYETIVESDAWGMTPFDQLACRIEFKKLRYEGMFTPPSLQGSLSFTGNHGGINWGGVSVDLQRGIMVMNSNRLPYTEHVYPRTVMNELGVVSVFNGSSKTKGYMAQEGLAYGARKEPWMSPLNTPCVAPPWGYISGVDLRTQQVIWRRPLGTGYDQGPMGIPSKTKFEIGTPNNSGSLATAGGVTFIGASLDNFIRGFDTRTGKQVWETRVPAGPQAAPLSYTIDGKQYIVAAVGGHVRMETKSKNSVFAWALPDD

SEQ ID NO: 15974 - protein, 452 aa, Xanthomonas campestris; identical to SEQ ID NO: 15597

SEQ ID NO: 15975 - protein, 240 aa, Xanthomonas campestris; identical to SEQ ID NO: 15598

SEQ ID NO: 15976 - protein, 849 aa, Xanthomonas campestris
MRMDKLTSRFQQALADAQSLAVGRDHNIIEPVHVLAALLDQSGGSTRPLLSQSGVNVPALRERLGEALDTLPKVSGQEGNLSIGNDLNRLLNQTDKLAQQHGDAFIASEWFVLAAADDASPLGVALRAAGGDKKKIEAAIDKLRGGETVQSENAEEQRQALEKYTIDLTARAESGKLDPVIGRDEEIRRTIQVLQRRTKNNPVLIGEPGVGKTAIVEGLAQRIINGEVPEGLRGKRVLSLDMGALIAGAKFRGEFEERLKAVLSDLSKNEGQIILFIDELHTMVGAGKADGAMDAGNMLKPALARGELHCIGATTLDEYRKYIEKDAALERRFQKVFVGEPTVEDTIAILRGLKERYAVHHGVEITDPAIVAAATLSNRYITDRQLPDKAIDLMDEAASRIRMEIDSKPEELDRLERRLIQLKIQREMLKKEKDEASRQRLADLESDIDKLEREFSDLNEVWKSEKAALQGTTKIKEQIEHAKLELEAAQRRQDYAKMSEIQYGVLPQLEKQMLLANEVEHHDFKLVQDRVTAEEIAEVVSRWTGIPVNKMLEGERDKLLRMEDELHRRVVGQEEAIKVVSDAVRRSRAGLSDPNRPSGSFLFLGPTGVGKTELCKALADFLFDSTEAMIRIDMSEFMEKHSVSRLIGAPPGYVGYEEGGYLTEAVRRRPYSLILLDEVEKAHADVFNILLQVLDDGRLTDGQGRTVDFRNTVIVMTSNLGSHQIQELSGDGSAEAYTQMKAAVMGVVQAHFRPEFINRLDDIVVFHPLDKAQIKSIARIQLQGLEKRLAERGLKLDLDDPALELLGNVGFDPVYGARPLKRAIQSQVENPLAQQILSGQYTSGDTVRV

SEQ ID NO: 15977 - protein, 420 aa, Xanthomonas campestris
ETIAVHGGYRPDPTTRAVAVPIYQTVAYAFDDTQHGADLFDLKVQGNIYSRIMNPTNDVLEQRVAALEGGIGALALASGQAAVTYAIQTIAEAGDNIVSSSALYGGTYNLFAHTLPQFGITTRFADYRDPQAFAGLIDERTKAVFVESIGNPRGNITDIEAVAAVAHAHGVPLIVDNTVATPSLLRPIDFGADIVVHSLTKYLGGHGNSIGGAIVDSGRFPWAAHKARFACLNEPDVSYHGVVYTEALGEAAYIGRARVVPLRNTGAALSPFNAFLILQGIETLPLRMERINANTLAIARYLQEHARVAWVNYAALPDHPEHALAQKYLGGHGSGVLTFGLPGGRAAGARFLDALQLFTRLVNIGDAKSLATHPASTTHRQLGPAELEHAGVSEDTVRLSIGIEHIDDLLADLEQALQGA

SEQ ID NO: 15978 - protein, 698 aa, Xanthomonas campestris; identical to SEQ ID NO: 15603

SEQ ID NO: 15979 - protein, 482 aa, Xanthomonas campestris; identical to SEQ ID NO: 15604

SEQ ID NO: 15980 - protein, 675 aa, Xanthomonas campestris
NPLLTASTLPFQAPPFDKIQDSDYLPAFEEGMRQHLADVRKIADNPEPANFDNTIEAMERSGETLTRVSRIFFGLVQADTSDARQKIQEEVAPKLAAHQDEINLDPKLFARVKAIYDQRDTLSLEPEQKRLVERHYEKLVRAGAQLSDADKTTLRKLNVEETTLSTQFHTKLVAASAAAAVVVDDKAKLDGLSEGDIAAAADAAKARKLDGKYLLTLQNTTQQPVLASLKDHDLRARVMKASQTRAEQGDANDTRQTIQRLAQLRAQKAKLLGFDSYAAYSLGDQMAKTPDAALKLLTDTVPAATAKARREVGEMQKVIDAQQGGFKLAAADWDFYAEQVRKAKYDLDESQIKPYFELDNVLQNGVFYAATQLYGITFKQRTDIPTYHADMKVYEVFDADGTSMALFYTDYFKRDSKSGGAWMDVFVEQDGLTGTKPVVYNVCNFTKPAAGQPALLSFDDVTTLFHEFGHALHGMFSKVKYPSIAGTSTSRDFVEFPSQFNEHWASDPKVFANYAKHYQTGAAMPDALVEKIKKAKTFNSGYATTEYLSAALLDLAWHTQPADAPLQDVSKFEADALKRFKVDLAEVPPRYRSTYFDHIWGGGYSAGYYAYFWSEVLDDDAFEWFKENGGLTRKNGDTFRAKILSRGNTVDLATLYRDFRGKDPSVKALLENRGL

SEQ ID NO: 15981 - protein, 326 aa, Xanthomonas campestris
KILVTGGGGFLGQALCRGLVARGHEVVSFQRGDYPVLHTLGVGQIRGDLADPQAVRHALAGIDAVFHNAAKAGAWGSYDSYHQANVVGTQNVLDACRANGVPRLIYTSTPSVTHRATNPVEGLGADEVPYGEDLRAPYAATKAIAERAVLAANDAQLATVALRPRLIWGPGDNHLLPRLAARARAGRLRMVGDGSNLVDSTYIDNAAQAHFDAFAHLAPGAACAGKAYFISNGEPLPMRELLNRLLAAVDAPAVTRSLSFKTAYRIGAVCETLWPLLRLPGEVPLTRFLVEQLCTPHWYSMEPARRDFGYVPQISIEEGLQRLRSS

SEQ ID NO: 15982 - protein, 291 aa, Xanthomonas campestris
GIHARRLWDQDVQASDAATQAARKALIDANIGIEKIGLLINTSVSRDYLEPSTASIVSGNLGVSDHCMTFDVANACLAFINGMDIAARMLERGEIDYALVVDGETANLVYEKTLERMTSPDVTEEEFRNELAALTLGCGAAAMVMARSETGSRRAALQGRRDALGHRVEQAVPGQPGPHVHDTRLLLIEGIKLAQKTFVAAKQVLGWAVEELDQFVIHQVSRPHTAAFVKSFGIDPAKVMTIFGEHGNIGPASVPIVLSKLKELGRLKKGDRIALLGIGSGLNCSMAEVVW

SEQ ID NO: 15983 - protein, 570 aa, Xanthomonas campestris; identical to SEQ ID NO: 15608

SEQ ID NO: 15984 - protein, 334 aa, Xanthomonas campestris
MSDPTQKIAVLGAGSWGTALAALVARHGHPTVLWGRDAAMVDAIDRTHENPRYLPGIALPDSLRATTDLQQTIAGASWILVVVPSHAFTETIKLLAPLRPAGAGIAWATKGFEPGSGRFLHEVARDILGPSVPLAVVTGPSFAKEVTLGLPTAITVHGDDAAFAQVVADAMHGPTFRAYTGDDMVGAELGGAMKNVLAVATGVADGMQLGLNARAGLITRGLNEMLRLAAVIGARPETLMGLAGLGDLVLTCTGDLSRNRRLGLALGRGQSLSDAIREIGQVVESVQTADEVMRQAEQHGIELPISNAVRAVLHGEITPEAGLKELLARERKPE

SEQ ID NO: 15985 - protein, 432 aa, Xanthomonas campestris; identical to SEQ ID NO: 15611

SEQ ID NO: 15986 - protein, 259 aa, Xanthomonas campestris
  unsure (1)..(259): unsure at all Xaa locations
MTHTRTNGTSWTLLSLRPSGEHAPLRRAVARHGGQLLAVSPWRLQINDTLQARDALRHALGAPIVVFTSPAAVHAAHRLLPLQRPGPAQWASVGEGTARALQACGIDAVVRPARMDSEGLLALPAFNPPLHAVGLVTAPGGRGMLAPALEQRGARILRADVYQRVALRLRASTVHVLETALPRSVMALSSSEALMLIVQQLPPSLATALKTRPVVASSDRMLEAARAAGFMQVHRAEGPLPAQLAAAAAAIMTPPPPCX

SEQ ID NO: 15987 - protein, 321 aa, Xanthomonas campestris; identical to SEQ ID NO: 15612

SEQ ID NO: 15988 - protein, 307 aa, Xanthomonas campestris
STLAFVFPGQGSQSLGMLAELAELHPQIRETFVEASDGAGVDLWALSQGGPEEMLNRTEYTQPALLAAGVAVWRLWNAQRGERPAVLAGHSLGEYTALVAAGALSLHDGAHLVRLRGQFMQAAAPAGVGAMAAVLGAEDALVREVCVEASGSQVVVPANFNSPGQIVIGGDAAAVDRALALLAERGVRKAVKLAVSVPSHTPLMREAANQLGEAMAGLTWHTPQIPVVQNVDAQVHAGHEAIRQALVEQLYLPVQWTGCVQALAAQGISRIAECGPGKVLSGLIKRIDKSLDARSLATPADYAGALD

SEQ ID NO: 15989 - protein, 242 aa, Xanthomonas campestris
LQGEIALVTGASRGIGAAIADTLAAQGATVIGTATSASGAAAIGERLAANGGHGRELNVTDAAAVDALIDAIGKEFGAVSILVNNAGITRDNLLMRMKDDDWQAIIDTNLTSVFRTSKAVMRGMMKARKGRIINIASVVGVTGNPGQTNYAAAKAGIIAFSKSLAKEIGSRGITVNVVAPGFIDTDMTKALPEDAKTALLQQIALGHLGQPDDIANAVAFLAGPTARYITGETLHVNGGMYM

SEQ ID NO: 15990 - protein, 75 aa, Xanthomonas campestris
MSTIEERVKKIVVEQLGVKEEEVTTSASFVDDLGADSLDTVELVMALEEEFECEIPDEEAEKITSVQQAIDYVKA

SEQ ID NO: 15991 - protein, 409 aa, Xanthomonas campestris; identical to SEQ ID NO: 15616

SEQ ID NO: 15992 - protein, 204 aa, Xanthomonas campestris; identical to SEQ ID NO: 15617

SEQ ID NO: 15993 - protein, 214 aa, Xanthomonas campestris
SWKARVGEWLLQPQMQELSAFLRQRKAANARVFPPGPQIFAAFDATPFEQVKVVVLGQDPYHGEGQAHGLCFSVLPGVPVPPSLLNIYKEIQDDLGIPRPDHGYLMPWARQGVLLLNAVLTVEQGRAGAHQNKGWEGFTDHVVETLNSEREGLVFLLWGSYAQSKGKVIDQARHRVFKAPHPSPLSAHRGFLGCKHFSKTNDHLQRRGLSPIDW

SEQ ID NO: 15994 - protein, 489 aa, Xanthomonas campestris
  unsure (1)..(489): unsure at all Xaa locations
DGIMSDKPLTDLTFSSFDLHPALVAGLESAGFTRCTPIQALTLPVALPGGDVAGQAQTGTGKTLAFLVAVMNRLLIRPALADRKPEDPRALILAPTRELAIQIHKDAVKFGADLGLRFALVYGGVDYDKQRELLQQGVDVIIATPGRLIDYVKQHKVVSLHACEICVLDEADRMFDLGFIKDIRFLLRRMPERGTRQTLLFSATLSHRVLELAYEHMNEPEKLVVETETITAARVRQRIYFPSDEEKQTLLLGLLSRSEGARTMVFVNTKAFVERVARTLERHGYRVGVLSGDVPQKKRESLLNRFQKGQLEILVATDVAARGLHIDGVKYVYNYDLPFDAEDYVHRIGRTARLGEEGDAISFACERYAMSLPDIEAYIEQKIPGRAGDYRAADPVAAHTARNSVRXRGQRRRWRQRGHDLPQSTRAACGRRSASWRWPXRSRWRIAXRQWRRSSRRRRCRWQAAPAASQAARGRRGRSGRSAQRDAGG

SEQ ID NO: 15995 - protein, 1045 aa, Xanthomonas campestris
  unsure (1)..(1045): unsure at all Xaa locations
LRAAITAAWLKDETEHVRELLEQARLPAAEQAKVQALAADLVTRVRARAQDQGAIEAFMRQYDLGSEEGVLLMCVAEALLRIPDQDTADKLIRDKLGEADWKKHVGGSDSVLVNASTWGLMLTGKLVQLNDLTRADVPGAFKRLIGRVGEPVIRLAVRQAMKIMGHQFVMGRTIGEALARSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIDGHPGYPVFTRKQNTDVSYLACARRMFAHSDALYPMFATHNAQTIAAVRAISAGKTYEHQKLHGMGDDLYAEVIPADRLGLPCRVYAPVGSHEDLLPYLVRRLLENGANSSFVNRITDEDVAIEDLIRDPVEAVSSFASIPHPKIPLPADLLRSQNQNRKNSMGANLANDNDLRQLADQLTAAIKPWNAAPLVPGAVITTPSEAVLNPADRRETVGHWQPADPATVQKALASAAAAQPAWNRTPAASRATILEHAADLLEARMPEFMAICVKEAAKTLPDAVAEVREALDFLRYYAAQARAQFGAPERLPGPTGESNELQLHGRGVFVCISPWNFPLAIFLGQVAAALAAGNAVIAKPAEQTNLVGFAAVKLLHEAGVPEAAVQFLPGDGATVGAALTNDPRVAGVAFTGSTDTARIINRTLAARDAAIGVLIAETGGQNAFIADSSSLPEAVVKDAISSAFISAGQRCSAARVLFVQEDIADKVMTMLAGAMGELKIGDPALLSTDVGPVIDADALKILEEHASRMDSEARLIGTTTLDSATAYGSFFAPRAYELKSLAQLQREIFGPVLHIIRWKADQLDSVIDQINATGYGLTLGVHSRIDETIDRITSRVAVGNVYVNRNQIGAVVGVQPFGGQGLSGTGPKAGGPHYLLRFATEKVVTVNTTQPAAMLRCXPWVTEAGSAAS

SEQ ID NO: 15996 - protein, 462 aa, Xanthomonas campestris
KNFHLPDLGEGLPDATIVEWFVKEGDPVRLDDPLVSMETAKAVVEVPSPFSGTVVKLAGAAGDVITTGAVLAQFALDASQPQRADGQDTGHGHGHGAPAAAPTPSTGESAAGPTTRVVASDEGGEIADADSDGGRDDAGTVVGAMQSSNAVQSEQAIAVGGVRAMPVVRALARKLRVDLTQVRATGPDGTVTLADVKQAAAAGTAQAVRGAVIAPIGGAAAASLGGDHGQRPAAAGTTSPQASNTTRTADQARSTLSASGKPMRTQSPGTLVKGQPEQLKGVRRNMARVMADAHTKVVPTTLNDDADLHAWQPGNDVTVRLVRGIVRACQAVPALNAWFDGEALSRTLHPQVDIGIAVDTEEGLFVPALRNADMLDAHGIRESINRLRQQVENRSIAASELSGYTISLSNFGMFAGRYATPVVVPPCVAIVAAGRARYQLTPVMGGVETHKVMPLSLTFDHR

SEQ ID NO: 15997 - protein, 323 aa, Xanthomonas campestris
SSPITLIEAITQALAWELEHDPAVLVLGEDVGVNGGVFRATAGLQQRFGSARVLDTPLDETTIAGLSVGLAAQGMKPVAEAQFDGFVYPMVDHLICHAARLRNRTRGRLHCPMVLRVPWGGGIRAPEHHSEANEAIFTNVPGLRVVLPSSPQRAYGLLLAAIRDPDPVIYMEPKRIYRQYKEVVANDGEALPLDVCFVLRDGTDVTLVTWGAQVKEALEAADKLASEGISAEVIDVATLRPLDFDTIAESVAKTGRCVIVQEAPRTAGFGAEIAAQLAEKSMYDLLAPVERVTGYDTHIPLFRLEMKFLPSVERIVTAARRAV

SEQ ID NO: 15998 - protein, 353 aa, Xanthomonas campestris
EIEYLQYMDADGQLVRDDLPADAANPQQLLALFKRMLFVRTFDSKSIALQRTGKLGTYAASLGHEATHVGIGASMRSGDVFAPSYREYGTMFERGVRPRDVLLYWGGDERGSDYPRDADAAIDFPICVPISTQCLHAAGAALSFKLQGKAQVAVACCGDGGSSKTDFYAALNSAGAYTLPLILCVINNGWAISVPRSAQTGAQTLAQKGLAGGLHCLQVDGNDLIAVLEAMRQARARALAGDGGTVIEFLTYRLTDHTTADDARRYRGEDEVKQAWTREPMLRLRRYLTAQGLWDEAQEEAWKAECGARIDEEVNAYLNTPVQPVEAMFDYLYGDPPAELLAQRAEVIALEAR

SEQ ID NO: 15999 - protein, 268 aa, Xanthomonas campestris
HTDLEGRLTYGGYLRLDQLLSAQQPLSEPAHHDEMLFIIQHQTSELWLKLLAHELRAAIVHLQRDEVWQCRKVLARSKQVLRQLTEQWSVLETLTPSEYMGFRDVLGPSSGFQSLQYRYIEFLLGNKNPQMLQVFAYDPAGQARLREVLEAPSLYEEFLRYLARFGHAIPQQYQARDWTAAHVADDTLRPVFERIYENTDRYWREYSLCEDLVDVETQFQLWRFRHMRTVMRVIGFKRGTGGSSGVGFLQQALALTFFPELFDVRTSV

SEQ ID NO: 16000 - protein, 349 aa, Xanthomonas campestris; identical to SEQ ID NO: 15625

SEQ ID NO: 16001 - protein, 423 aa, Xanthomonas campestris
YMTGFGNEFASEAVADTLPVGQNSPQRVAHGLYAEQLSGTAFTAPRGENRRSWLYRMRPAAVHGTFSLIEQSQFHNDFGHGPVPPDQLRWSPLPLPQTPTDFIDGLYTMAGNGSPEAMNGVAVHLYAANASMQDRFFYNADGELLLVPQLGRLRVHTELGMLELEPQQIGVIPRGVRFRVELRDGTARGYVCENFGGLLHLPDLGPIGSNGLANPRDFETPCAAFEQREGRFELVAKFQGHLWRADIGHSPLDVVAWHGNYAPYRYDLRRFNTIGSISFDHPDPSIFTVLTSPSDTHGTANMDFAIFPPRWLVAQHTFRPPWFHRNVASEFMGLVHGVYDAKADGFAPGGASLHNCMSGHGPDAATFDKASQADLSRPDVITETMAFMFETRAVLRPTAQSLHAPHRQGDYQQCWAGLRNAFQ

SEQ ID NO: 16002 - protein, 95 aa, Xanthomonas campestris
VLGFAVYFFNYSTWLGRNGLYLEDLFVRPQARGQGAGLALLRHLAQLAVDKGCGRFEWSVLDWNQPAIKFYQAVGARPMECWTVYRLDGERLAAF

SEQ ID NO: 16003 - protein, 663 aa, Xanthomonas campestris; identical to SEQ ID NO: 15628

SEQ ID NO: 16004 - protein, 293 aa, Xanthomonas campestris
VLVVATLISETLRWRARAQPSAVLDNLVARIRAWWVMAGVVGIAFVFGRAGVIGLFALVSLFALREFITLTPTRRGDYYALLAAFYIVLPWQYGLVWTGWYGMYTLLIPVYAFLVLPILATIGGDTTRYLERTAKVQWGLMICVFCISHVPALLNLEIPGYAGRNLLLIAFLVIVVQSSDVLQYVWGKLAGRHLIAPKLSPSKTVEGFIGGVLSASLLGMALWWITPFAPWHAFGLALVANLMGFFGGLVMSAIKRDRGIKDWGHMIEGHGGVLDRLDSVCFAAPVFFHLIRY

SEQ ID NO: 16005 - protein, 202 aa, Xanthomonas campestris
MIDLYYWPTPNGHKVTLFLEEAGLEYTLKPVNIGKGAQFEPAFLQISPNNKIPAIVDHAPAGGGAPLSVFESGAILLYLAEKTGRFLPRDARGRIAALEWLFWQMGGLGPMSGQMGHFTVYAPEKIPYAIERYNAEVRRLHGVLDKRLAEHAFLAGPEYGIADMASYPWIEVYGDLKPDYAAFPHVKRWHDAIAARPAAQRA

SEQ ID NO: 16006 - protein, 742 aa, Xanthomonas campestris; identical to SEQ ID NO: 15631

SEQ ID NO: 16007 - protein, 326 aa, Xanthomonas campestris
AHPHYRPRRMRHDAFSRRLMRENTLTTDDLIWPVFVHELPGRAPIASMPGVERLSLDELLREAENALELGIPVIDLFPVIDPAGKSLDAAEAWNPDGLAQRAVRALKARFPELGIMTDVALDPYTTHGQDGLIDAKGYVLNEITVEALVKQSLSHAQAGVDIISPSDMMDGRIGAIRRALDAEDHLNVRIMAYSAKYASAFYGPFRDAVGSAGNLGKADKTTYQMDPANSDEAMREIALDLEEGADMVMVKPGMPYLDVVRRVKEEFRVPTFAYQVSGEYAMLKAASANGWLDERKCVLEALMAFKRAGADGVLTYFAPQVARWLR

SEQ ID NO: 16008 - protein, 271 aa, Xanthomonas campestris
VSRYAVFGHPVAHSLSPAIHADFGKQTGIALDYTAIDAAPEEFTAALERFAADGGKGANVTLPLKEAAFALSASLSDRARVAGAVNTLVRNDGQWQGDNTDGAGLVRDLTERHGLDLRGRRVLLLGAGGAARGVAPALLEAGITEMVVVNRSPERADALCDALGEPGRVVSRYLEDLRELGDFELIVNATAAGRDRDAGAFALPLGLVNSLTAAVDLNYGATAIAFLAWARSAQCRYAIDGLGMLVEQAAESFALWHGVRPQTDPVYDALR

SEQ ID NO: 16009 - protein, 501 aa, Xanthomonas campestris
MVLALLAPTLIAPPVFAQSVLTRDNGAKVGDNQNSQTAGATGPTLLQDVQLIQKLQRFDRERIPERVVHARGTGVKGEFTATADLSNLTKAKVFSAGEKTPVFVRFSSVVHGNHSPETLRDPHGFATKFYTSEGNWDLVGNNFPTFFIRDAIKFPDMVHAFKPDPRTNLDDDSRRFDFFSHVPESTRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPDDLAKFDFDPLDATKIWPDVPEQKVGQMVLNKNVDNFFQETEQVAMAPANLVPGIEPSEDRLLQGRIFSYADTQLYRIGTNGLSLPVNRPRVAVNNGNQDGEANTGHTTSGVNYEPSRLEPHPQDTAARYSELPLSGTTQQAKITREQNFKQAGELYRSYSKKDRADLVQSFGESLATTDTESKHLVLSFLYKADPEYGAGVTRVAKGDLARVKQLASTLQD

SEQ ID NO: 16010 - protein, 180 aa, Xanthomonas campestris; identical to SEQ ID NO: 15635

SEQ ID NO: 16011 - protein, 156 aa, Xanthomonas campestris
KLVFVGGMGAGKTTAVRAISDVEPVSTEMPLSQDAYGDKTYTTVALDYSSIELEDGELLHVYGVPGQKYLDFMWPLVCDGALGVIVLTSARDTQMRDTTLELLREFSRIAPEASLAVGVTMTDEVQEFLLPPFREALVAAGFRIPVMRVDARSATQ

SEQ ID NO: 16012 - protein, 299 aa, Xanthomonas campestris; identical to SEQ ID NO: 15637

SEQ ID NO: 16013 - protein, 654 aa, Xanthomonas campestris; identical to SEQ ID NO: 15638

SEQ ID NO: 16014 - protein, 772 aa, Xanthomonas campestris
WARLLGRLADPWLSLTIEPEQPGRYDDGKPVVYVLEDYGLSNALILDKACREAGLPSPLVPLPGDPLERKRAYLALSRRSSSNSLIPEQRGGKTHSDSLAKLLQAHRVRADLDVHLVPVSIFVGRAPDKQSGWFAVLFSENWALVGRFRRLLSVLLNGRTTIVRFAPPISLRQTMAEGLPPERTLRKLQRVLRTHFRRIREAVIGPDLSTRRLLVDQVLAADSVREAIATQAKRDNSKPVDAWRKAHAYAWEIAADYSSPVVRSASFLLTHVWNRIYAGVLVHHLDKLKQAAPGHEVVYVPSHRSHMDYLLLSYLLYERGIVPPHIVAGINLNLPVVGTLLRKGGAFFIRRSIRGNALYSAVLSEYVAQLVAGGYSIEYFVEGGRSRTGRLLQPKGGMIAMTLRAYLRQPRKPVLFQPVYIGYEKLMEGNSYLDELTGRPKEKESIWGLLWSIPKVLKQNYGQVVVNFGEPIALNDVLAKHAPEWNDEPLPDDEKPTWLAPAVDTLATQIQTRINCAADVNPINLLALALLSTPKHAMGEADLIAQIELCKKLLAEMPYSDRVTVTPHTPARIITHAEEINVLTRVSHPLGDVLSVSGDTAVLLSYFRNNVLHLFTASSWVACCFQNNRRMSRAGLLRLGRTVYPFLQAELFLPWSEDRFAERIEQTIDMFVREGLLLNVTDDDGGILARNTGQTDEVFRLRAIGHSLQQAFERYYIAISVLVKNGPGVLGAGELESLCQQAAQRLSLLYAPAAPEFFDKTLFRSFIQKLRE

SEQ ID NO: 16015 - protein, 837 aa, Xanthomonas campestris; identical to SEQ ID NO: 15640
  unsure (1)..(837): unsure at all Xaa locations

SEQ ID NO: 16016 - protein, 372 aa, Xanthomonas campestris; identical to SEQ ID NO: 15641

SEQ ID NO: 16017 - protein, 304 aa, Xanthomonas campestris; identical to SEQ ID NO: 15642

SEQ ID NO: 16018 - protein, 299 aa, Xanthomonas campestris
SDTALLVVNLGTPESPTAPAVRRYLAEFLSDRRVVAIPPLFWKPLLYGVILPIRGPKSAEKYAKVWLPDGSPLAVYTRRLTEGLQQVMPDWHVTWAMRYGAPALRKALDGLRARGIKRIVVLPLYPQYSTTTTASIQDVVDAWRPSAPEIAVEVIQDYCEDAGWVAAIADSIRTHWQVHGRSEKLMFSFHGLPQRVANAGDPYPQQCERSAQAIVTALGLGPDAWQMGYQSRFGAERWLQPYAEPTLWALAEGGVRSFDLVCPGFATDCLETLEEVALGFAETLAERGATLSYIPCLND

SEQ ID NO: 16019 - protein, 124 aa, Xanthomonas campestris
  unsure (1)..(124): unsure at all Xaa locations
ATLTDGXVSFKESVINDVIGVLGVKSGYNGGTKDNPTYKEVCSGSTGHAEAIRVRFDTDVVSYGEILDIFLATHDPTQLNRQGNDIGTQHRSAIFPHXAFQEREALKAIERARPDWRHPIXTTI

SEQ ID NO: 16020 - protein, 94 aa, Xanthomonas campestris; identical to SEQ ID NO: 15645

SEQ ID NO: 16021 - protein, 159 aa, Xanthomonas campestris
LGMISFHFARADNGRVGRDGQLPWRLPAHLKRFKAQTMGRPMIMGRKTFESFPAPLLGRRHIVLTRDTAWSASGAEIAHSVEEALALAGEDAAVIGGAEIFALFLDRATRIELTEVHLDAEGDASVPAFDPARWRETATEAYPAEGERPAYAFVTLERQ

SEQ ID NO: 16022 - protein, 293 aa, Xanthomonas campestris
  unsure (1)..(293): unsure at all Xaa locations
THNXHAQDHTQPXTRTPHATNELKRHTTTTRQAHTPTEQQTATRNQNPTTEPHRTSTAERQPTTHPNSDKQPTTKHHDHRERPRKLHKQPQPPQPNQDSHSTQHNTPHSHDHTDPQQPTRKDPNTTQNQPHLPTHEETNTTHHKPQTPHDHPRPTRPQHPNTTDNQTQQQRHNKPHRQTTQHKTQPNTTQNATHNEPPRPEHDTARERPPTHTQQGHKQYANRPHNTDRGTQTATHTPEHHSCQPRAQPQHNDERCATDTEHTHPSKRHHARNRRGRPTPTNKQTHRTQPRRP

SEQ ID NO: 16023 - protein, 490 aa, Xanthomonas campestris
  unsure (1)..(490): unsure at all Xaa locations
RENTTEKRHRERTHRQTHPHRKQQRTKNQHRKEKQPTHPHQEGAWKPMNTMEKAKQNSRKKRPRQKKTTTRTKTQQAEFAAKQVCKKTERHKHNTGEKNRGGGKQPQKERDTRKHTGQRKEHTQTKRPSQTRHKRQRQTTAPNRNTPKQKRQTGPETENKNNQRRRRGAKETRERNRTQGDGDHSYRQRKEPQHKGDKTTKEXRPKGKTPEKQTRNQQPKMTGEKRNHSTKQREEGPRRKRSEKTGAHDEKRSRHNTQNQRATTETEPPGRPKQEQQARHERRTTDTGRATQQQERQRRNNNESKREEETHKQHQETRKTATHTGTNRRTQKRRRNQKTQKTKEPRHHGKRNRQTRKKKEQRESTSKRTTKKRERAAHRQNNSGPQEQHREATTQQDTTRPKPDSKRKQRARAKKQRDKEKERNRHNRKTSNNTQQEKNKKQAPGQKTKTATETKNPNKTRTEEQQKQAREHKQNTESKQGKTENRERKN

SEQ ID NO: 16024 - protein, 508 aa, Xanthomonas campestris; identical to SEQ ID NO: 15647
  unsure (1)..(508): unsure at all Xaa locations

SEQ ID NO: 16025 - protein, 461 aa, Xanthomonas campestris; identical to SEQ ID NO: 15648
  unsure (1)..(461): unsure at all Xaa locations

SEQ ID NO: 16026 - protein, 454 aa, Xanthomonas campestris
  unsure (1)..(454): unsure at all Xaa locations
SIGCXVSXRGHRRXGAKEXSGDRRTXXRKSPDTRPXHQNNTFGESLYGKGREGAPRNPPHXXXXNXENNPSQSGRKHGTGETRSGTASTQNNRGPNEQDNDKSPGQPKDAHATNKKRANRGNGKHGAREGQTGRPRGAGTQRQNKARRETRESGEGHSQSKQEADTADHQPTGPQSPEHARPQSALQGRPPKTRAKQGRNNKARKTTTETQGKPPTKRNQQTRQGQNPKPPSRQAQRRGGQRTTHNKEPRTKKKRNEHETTTTKQRKEHPKTTRPANGREHRQREESDKTQQTPRKTRNSGKQKTNSPTRQHPKERQHAPTRKGAAGHKGRPNRRGTRTTSHESTHQRRKTDETDGXTTRVHGRNRHKNTTTQRGRHGHEEKDTPARTRQQRRYGRSETRERDTTHREERRRQLTSGSGQHRRQQKAQTRNDTDTEHQDPKETDRNTTHSNDQA

SEQ ID NO: 16027 - protein, 263 aa, Xanthomonas campestris; identical to SEQ ID NO: 15650

SEQ ID NO: 16028 - protein, 393 aa, Xanthomonas campestris
  unsure (1)..(393): unsure at all Xaa locations
SXAMAAPXARGPNGTGARGESRTENKHACSSPIKTRNPHDAKKTPQGEAGRTHETNGGREPPTKRRKGARQKTGAKTEESTTQRGEKRKRTTAKEQTRSPKRPTRERTTQNPGHKKAPKAPPPKERRKPKKKGGNGETRVNKQNAQKKQRRHTKRERTTTSNGRRRSAPEGRGRRTQPTPEGGNRRGHTEQPKRERNEKPQDQRPRRDNTDQEKREESNPQNKKGTRQKRRPGDRQRTKRTKQGSEGAHETNHAPSDTQKAQKSKKRATDERGEGTPTSNNGQTPGRRGAQRKPTHGRRTEKQTKEPTNTRERTRXRDDQRTKPQGREAEGHGKNTRKEPTRRRTRTEGSDPTKRAKDRREKQPHEDTGGDAGTTPCTRTETRANTTRQDEGA

SEQ ID NO: 16029 - protein, 411 aa, Xanthomonas campestris
  unsure (1)..(411): unsure at all Xaa locations
REKKAGEHGRGVHRRPNTLVENCSGEGQGRPPPRRGDKGGTNRPKRAKRDADPQVGAPHQETPNQPNQKPRKGAKRQDGKNPTTRTRGGKANKKARNQKQKRGQTPSTGGRNHQAGEPKEEKRAHKSHSPLKHQRQTETQRPRTKATARREQGRPTKRQGEHAEQDXNTPQGKPRERRTNKGRKNTPREQATATQTQGGEHNANGGRSETKTEHKNETAQNDPAKHKDDTDETSTAERNNEGRDSKTHRSAHKESYENGHLQHTRTRKRKAKEQEQNPTKNTTHTTDTRRRGTSAPEKATTRNETNHGTRQREQQTRNQREHKTDRDETSPGQRQARNPQHTQRNTQHHTRMNSPTKHHSHRAQERTEHNRAEPKQPNGQTKTRREAHPQKTNRPQETKSDVHPTQARGRP

SEQ ID NO: 16030 - protein, 466 aa, Xanthomonas campestris; identical to SEQ ID NO: 15651
  unsure (1)..(466): unsure at all Xaa locations

SEQ ID NO: 16031 - protein, 289 aa, Xanthomonas campestris
  unsure (1)..(289): unsure at all Xaa locations
QKKNPAGRNNATTQHAKHRRRFIXHQQQKTNKNGGETKEKTGSPNRGKQARKKRREAGDRGGRGQKPRSKQTERRGRKRHHRRPPPAGQERRTKRTSHTKEGREKPANKGKQNERQEEAPPNQRQREQEKKTHKAGRQANNGGAPRGEQNRQAPRPAHKKAPTTKGQKRKGRGAQPTQPKTRPSTGQGEETRKSKRRTGEQPGKPTGGKKKDQRKERRPGGKRNERDPPEGTQHQKKRQTGETTQPNQERKKPREQGKPQHTPRRRDPEKKTRRPSQQTQDKRQTGGTK

SEQ ID NO: 16032 - protein, 172 aa, Xanthomonas campestris
  unsure (1)..(172): unsure at all Xaa locations
PTGEGQRVERQRQPATGLXFRQRPEGSQPRGAGQTRQPKTPPTNKQKGPQARAEQNRAXEGAEQQGKKTTEPQARPETDQARPPEHPKKPARKEPEEGQTNNGEEDQNKAPRHGAVRRNTRSKPEGPREKTKTGGPEQRTPGAQPKQSSVRARNSTERGQAQSKXEGAPAAG

SEQ ID NO: 16033 - protein, 299 aa, Xanthomonas campestris
  unsure (1)..(299): unsure at all Xaa locations
PRPHPSFSFQSQEQGRPPRQDRTATRRRPPKQNKTTTQSNKDAEEQHPATQADEPPRNTRDPRQKENRAAXPTPEGTSRQQRQKTEHQTQRHRPEGDPRKERQTHHENEMPPARQNKITTNRGPEHPTEAEHAEDKPPEPTPHNRQETKPGPTADTTQRRKTRPQSAKTHQSQKDKPTMAYKTTHTLTEPRTSLQLQNRKHRQAPATKASHAQSKKDDPEDNVQQHSAIQETDDALQKYGXPPXXQSPSKRARTRQPRNTKESQRNKGSNTPQPXRTAMHQQPNGKPTDHKARGPXQET

SEQ ID NO: 16034 - protein, 513 aa, Xanthomonas campestris
  unsure (1)..(513): unsure at all Xaa locations
GRKNKAAAGDQGENNQTENIKXQGKHGTETPGTQRRGGTEKGTRGGDNHKATPATEPTTRNAKTGEQKRNKPPSKEQTAKTGRGEHTGETERTQGSAQHGDTRGKRAEASRSTQRRRAATEQNKTNKNRGHGTGNTGGTETKSRRSTQSRNRDKQTAERKNTHSGEPGHKQTPHGTKNKTKDTRQETREHQGHRSRSHGEKKAEKSAQNRRETNTRRSTTRTRRGRKGDQHTQEKRREDPPTQHSDKTPEQEGAHGQNDTRAHEQQREQKTHKTTESKHSLPTGKRGRQHEQHQASETHSNNMTRSPRDTGQNQREEERRRAKTSDIDEGNAPPTNEEQHRETTVTMRISRQNIDRAAAKNRRRHTHHMRTTQTXRSDDATGQDPRRMHSMPTHRQQSTHXDASTRHEHRQRTTRTATNEESGPHETRDQQGASAHNTDEENKEETGQHAIHNNERAAHMQTTSRNKHQGDERTRENEDRRLTTRHRTKTVRKRVHTGSRNEIRREQPAARER

SEQ ID NO: 16035 - protein, 568 aa, Xanthomonas campestris
  unsure (1)..(568): unsure at all Xaa locations
RIHXTQQGHTQNTISTSDKQNGHTKAKKNKRQXKNAHDTTKHKEEETLKXVPNXPXKAPXERHTERQSRAGEGRQQRSYKEXMKNSQEHXAHSPXRASNGQITHNKSDTGRENRTEKRQTNQXHNNXSXTRHTHRAREENTQRQNTDEQSRDTRNKXRETTERKANKSKHDSNNKKKYETEAHQRSRDETGRDRTSNSPTTTEXRKPARHTTSRDEAENPTRHQNKEGIKEQQNNKTWNNKSHRTTKAGTREKKEPNNQKTRSKTQRKNAQQARKKENQAAATHKATHEAEHRKKKRAQNGEQNGPKMTEAGQRNKKGKRRQHRVKANKTKKRREHKKRKRTSTDTGNKTSRNTIKQQGNTDEERKNNEEEGQQKDNHKGDPRKSGEDRHARETRGQKEQKKHAKGIHPPGDKSRLLHKTTKTXKQREETKTGAKTRTDERTHRSTKQKSQRNKRNQTYKQEEGGQKRPKHEHKQETQRGTRQAKTNKERTRGEDERDQNRRRAERRAKRRKLNNREKNKDKKKQQRRVHNVTDGGTKKQDKNTSNWTSYEKRKARQRDHKGGGRHTK

SEQ ID NO: 16036 - protein, 517 aa, Xanthomonas campestris
  unsure (1)..(517): unsure at all Xaa locations
NTAPRQQIHAQAKQGNQPRDKTPPTHPQSRENRQPMPKAHTPQCGKEQPQPRSKKNGHDETRRRPEESTINPQQGHAANKKTTRNRGEHREEQERGNRRPTPNTQRHRIRLRKEIQNRNRTRTDKHPKAGRPRQTANXHTPTRQKDPPPRHTAQKHXRHGQRRTQHDENQTTARTEAHHHKGAEQRHEKRERHEDKTTPHETKDDTPQTSETQKQSHAHDTADKHTRATAQQQHDDTCVNDRYTRIQRTESXRHHDKIXHKQKKRDTXRRDXARPQDKQKRQSTDTRQTEDTALRAHESHTPQTHTKSTRTQXRTDSMTHAXKRDRKDQRQQRHTRTRQNAHRTNANEEEDTQTKQERQLNIPTSDRRVEXHNETTPTXREEIQTKRTTDDKQIEQDTSARCREQTRESTQXGHAHDRERHNTNDEDDHAHTDSTRREXLRQDEKKXRKIHNRRERPQHHKQQQRNTXENHKRRKTTHGQGKHNNTMQKPTQSATTTTXPEXDTPRNARPLHVKSKP

SEQ ID NO: 16037 - protein, 321 aa, Xanthomonas campestris; identical to SEQ ID NO: 15652

SEQ ID NO: 16038 - protein, 341 aa, Xanthomonas campestris; identical to SEQ ID NO: 15653
  unsure (1)..(341): unsure at all Xaa locations

SEQ ID NO: 16039 - protein, 200 aa, Xanthomonas campestris; identical to SEQ ID NO: 15654
  unsure (1)..(200): unsure at all Xaa locations

SEQ ID NO: 16040 - protein, 199 aa, Xanthomonas campestris
  unsure (1)..(199): unsure at all Xaa locations
PGGTPRGRTPWRPRPQQRPPRPDDNGPHWPNTRQSATHQETPRPRRETGNTTXTGPQRXTPKKRAPTHTRAPRTPRRPHPHQEQSARTTTTEQGHHTPPTQASPDRDPQHKGNPAPQQPGPTHRTDQGNRSRPTTPRTQQPKQRGHQEQPQRPPASHPGARHGPTPEQKTPHEPKNKAQQPPEKRPHQQRSPQDRPAKP

SEQ ID NO: 16041 - protein, 446 aa, Xanthomonas campestris; identical to SEQ ID NO: 15655
  unsure (1)..(446): unsure at all Xaa locations

SEQ ID NO: 16042 - protein, 434 aa, Xanthomonas campestris
  unsure (1)..(434): unsure at all Xaa locations
SEPDQEPTKPNTRARKGTCYSHDDQRKPSKRQQARRGATKTQRQHGEPPQPKPQNTKHTIKKRHTDTPDENDRTRTQTPQNQNRRAKSDKHTTRAAHQERTKENETHQSKHKTKDTQHTGRTTTRNLPDTDSQRQQGTPKTAHSEHKRTQTRAPPTHNKRPHSNKEKSHHTNTPQKHQGPEPAHTTAQKPRHHNKNDDAAKHTDSRTHQSTXTNQGHTTGDGRTANHTNPQNTTPETAQTPQHKRKTQRPNTTHTETTTRRQTRTPKRTAHAKGTHRQRRPNSTXAHTKHNTRKNREHHTRTRNATNNKTRRHSTHTELDKYQTQDNSTTREETNEKDHEKNQRHQQAQHKRPEGHTRTDESSSQHKTQKATTRNNNPNNQTRHEQTRHRRTDRHEPSQQKTTKDKQRXERHSGRDSTERTKQNHRRHQGHHET

SEQ ID NO: 16043 - protein, 382 aa, Xanthomonas campestris
  unsure (1)..(382): unsure at all Xaa locations
PRESPPQHRAPAPPQPQQKTQGWHLAVAGPSGLPXYTGSDPQRAAPSNGSRLPPVRRPLQTKGSPEAPNHRTTPSXXRPAGFMAGTFPPPXRPPGPSAEHAIPVRTTSQPPPNGRHWMGQLPKLGPKDPXHTPANRAPDGVPPAKPVEPPEFAHPRCPPETTTSPRERPGERPMPPSKGSPNARVDPPPTRVALGASPPLXDTHSASDKNTPPRPTMVPKQKNTPLTWVITTYRAPAPIISPKKPRPRHPPNTQRMAPHLVTQALSLGHTKRWVRAPLXTTTTNPAVGAXQQPRHPHPLEDSPNPPXAEAPRTTRGPPKPPELTRSAPTPQPQAGLLSVLGXSRSRPSTPIRKPQLRLXGEPTPKKAPRPGRVPQNPAAXGP

SEQ ID NO: 16044 - protein, 354 aa, Xanthomonas campestris
  unsure (1)..(354): unsure at all Xaa locations
DGXQSXSSVDXXPXXXXAIRGRGPPPGQTAQGPKPARQMMNNAQTPPRHHGVVWDPDQETPHNNAXSPSKAERHPRAKGQPHTKDRGATREQGAPPTRRSQQTGKESEQRQVEQPKERRGEPETTKRNNSAAPNRGEDSSIGGPNNQGNENTETERAERPAPPKPSGTHQQNKTEPPRNNPKTKQQPPETKRKAQPTKRARQKIKPTKRSEQGHHHNKRHTQTRRRPENHXDTEAPRTTGQEPHERDEHPSTSRAPQHHTNTARHKXTQHGHKRHNTQAHTTDNRQRHNRTQQSDXYTTRHTQMNEKPHNHGHNNNTTTKPKXRTTHNKTERHIHQRHKKTHPTSDTKNARNTP

SEQ ID NO: 16045 - protein, 466 aa, Xanthomonas campestris; identical to SEQ ID NO: 15656
  unsure (1)..(466): unsure at all Xaa locations

SEQ ID NO: 16046 - protein, 251 aa, Xanthomonas campestris
  unsure (1)..(251): unsure at all Xaa locations
RATEAHQRTHGDEDLRDRQTRQSARSRHNPQTPNDRRRDGEPDEGGIGQPRRHRPRGPPNEPSPGQGTRTEDTTGQGSRQPSTRNNEEGEQQGPERESTAGNRDRPGQETRTPRQGTGQEGQDSETGREHRKQDTRRERHKQGQPTXRGRQAKSPQSNKPAGGDGNPDRGTPAHRQRRQKEPRADTAQTRGDKGDQAHIKRRPAGPRKDTRGRSREGTHHTKKEHATPTTGPRAGHGNPTGTPRREDRETP

SEQ ID NO: 16047 - protein, 315 aa, Xanthomonas campestris
  unsure (1)..(315): unsure at all Xaa locations
RTRHRAGRAQAKRKQTKQTTQQETRAHKTRRAGGATGKSHAQRRTPKTGMEGRQKRPGAERGRRNRTKSPPRNKQPSPKNNNDRQTRHRNAGARETGKXXAPQRKETGAENKPERGGAPEEKKSPHEGPNNKHSPEARPEHKKQAGTRQRERPPGEGRPKGNRPERGEKAREQRRHTNPGGGNAQKKTKPDKRETEARGKKGRKPNTKRPRHPKGNTTTQAKRGGTQERRTPKKGQTATKRRDKGTARQENQRRQRGRKEAETRPKRGKKARRKREKAGNARKGKEAPREQPKKTPEKNPKRTKQPKTQARDGPP

SEQ ID NO: 16048 - protein, 138 aa, Xanthomonas campestris
VGRDGQLPWRLPAHLKRFKAQTMGRPMIMGRKTFESFPAPLLGRRHIVLTRDTAWSASGAEIAHSVEEALALAGEDAAVIGGAEIFALFLDRATRIELTEVHLDAEGDASVPAFDPARWRETATEAYPAEGERPAYAF

SEQ ID NO: 16049 - protein, 230 aa, Xanthomonas campestris
  unsure (1)..(230): unsure at all Xaa locations
AQLPFPAIRVNDSVTKSKFDNLYGCKESLVDAIRRAGDVMLAGKVACVAGFGDVGKGSAQSLRNGGARMMVTEIDPICALQAAMEGFEVVTMDEAVKRADIFVTATGNADVITADHMKAMKPMSIVCNIGHFDSEIQIAALSNYKWTEVKPGTDLVEFPDGKQIIILAKGRLVNMGXATGHPSFVMSASFTNQTLAHIELWTRGEHYKNEVYVLPKHLDEKVTALHLEKL

SEQ ID NO: 16050 - protein, 202 aa, Xanthomonas campestris
GGSRGLERSICERLLSKGQEVLALARSVKYVPYAALACDVSDYAQVKAVAKHLRQNNMKVSGVVNAAGIAAMNLAVTTPPDTTARVVQVNLLGTIYCCQVFAPLMMRQKGGCFINFSTIAVALGLKGEAVYAASKAGVEGFSRAFAREMADFNIRVNCIAPGPIDTALLRGITSDQIGKIVSQQILPWQFGPDAVSDVVELL

SEQ ID NO: 16051 - protein, 812 aa, Xanthomonas campestris; identical to SEQ ID NO: 15660

SEQ ID NO: 16052 - protein, 459 aa, Xanthomonas campestris; identical to SEQ ID NO: 15661

SEQ ID NO: 16053 - protein, 505 aa, Xanthomonas campestris; identical to SEQ ID NO: 15662

SEQ ID NO: 16054 - protein, 396 aa, Xanthomonas campestris; identical to SEQ ID NO: 15664

SEQ ID NO: 16055 - protein, 166 aa, Xanthomonas campestris; identical to SEQ ID NO: 15665

SEQ ID NO: 16056 - protein, 363 aa, Xanthomonas campestris; identical to SEQ ID NO: 15666

SEQ ID NO: 16057 - protein, 488 aa, Xanthomonas campestris; identical to SEQ ID NO: 15667

SEQ ID NO: 16058 - protein, 450 aa, Xanthomonas campestris; identical to SEQ ID NO: 15668

SEQ ID NO: 16059 - protein, 578 aa, Xanthomonas campestris; identical to SEQ ID NO: 15669

SEQ ID NO: 16060 - protein, 578 aa, Xanthomonas campestris
LTSLGRSDTSEWTYVSQDGRRLPVLLTLSTLRDDNDQVIGYLGVAVDLTEQKLHEKQLRLAMDAARSANQSKSDFLANMSHEIRTPMNAILGMLYLLQRSELPGAAQDMVTKIDRSARSLLEIINDILDFSKIEAGRIDLERAPFDLNQLFDNIADLMRSSLSAKPVEMIVEPLPRECRWLLGDALRINQVLVNLVGNAIKFTEQGEVVLSVRRFPSGDPNKIKLLFSVRDTGIGISKEKQSLIFSPFLQADTSTSRRYGGSGLGLTISRRLIELMGGALEVESVPGRGSEFYFVITLERTDPPKAQQEAALLPPESMPRVLIADDHDAALNNLVRIATELGWRVDAVASGQAAMQAIEDATEPYDIFLLDWRMPDIDGVAIARQVRARATPGRHPVIVMVTAYERRLLEQHPEQQDLDAVMTKPVTSAALHRLVEQLVDERPKARPSTPTFVARRLEGAQLLLVDDSEINCEVAQRILEGEGAMVTVAHDGEQAVNTLKRAPDLFHLVLMDVQMPVVDGYEATRRLRQIPSLASLPVIALTAGAFRPQQEKALEAGMNGFIAKPFNVEELVTAIRHF

SEQ ID NO: 16061 - protein, 197 aa, Xanthomonas campestris; identical to SEQ ID NO: 15671

SEQ ID NO: 16062 - protein, 243 aa, Xanthomonas campestris; identical to SEQ ID NO: 15306

SEQ ID NO: 16063 - protein, 313 aa, Xanthomonas campestris; identical to SEQ ID NO: 15673

SEQ ID NO: 16064 - protein, 313 aa, Xanthomonas campestris; identical to SEQ ID NO: 15674

SEQ ID NO: 16065 - protein, 316 aa, Xanthomonas campestris; identical to SEQ ID NO: 15675

SEQ ID NO: 16066 - protein, 566 aa, Xanthomonas campestris
LLIVESPAKAKTINKYLGKDFTVLASYGHVRDLVPKEGAVDPDNGFAMRYDLIEKNEKHVEAIARAAKSADDIYLATDPDREGEAISWHIAEILKERGLLKDKTMQRVVFTEITPRAIKEAMLKPRAIAADLVDAQQARRALDYLVGFNLSPVLWRKVQRGLSAGRVQSPALRMIVEREEEIEAFIAREYWSIDAHCRHPSQPFNARLIKLDGQKFEQFTVTDGDTAEAARLRIQQAAQGVLHVTDVASKERKRRPAPPFTTSTLQQEASRKLGFTTRKTMQVAQKLYEGVALGDEGSVGLISYMRTDSVNLSQDALSEIRDVIARDFGTASLPDQPNAYTTKSKNAQEAHEAVRPTSALRTPAQVARFLSDDERRLYELIWRRAVACQMIPATLNTVSVDLSAGSEHVFRASGTTVVVAGFLAVYEEGKDTKSSEDEDEGRKLPLMKAGDNIPLDRIVTDQHFTQPPPRFTEAALVKALEEYGIGRPSTYASIIQTLQFRKYVEMEGRSFRPTDVGRAVSKFLSGHFTRYVDYDFTANLEDDLDAVSRGEAEWIPLMEKFWGPFK

SEQ ID NO: 16067 - protein, 624 aa, Xanthomonas campestris; identical to SEQ ID NO: 15676
  unsure (1)..(624): unsure at all Xaa locations

SEQ ID NO: 16068 - protein, 221 aa, Xanthomonas campestris; identical to SEQ ID NO: 15311

SEQ ID NO: 16069 - protein, 375 aa, Xanthomonas campestris; identical to SEQ ID NO: 15679

SEQ ID NO: 16070 - protein, 287 aa, Xanthomonas campestris
DLKGNNDLLLLSSPEIIAGIHRAYLDAGADLLETNTFNATSVSQADYHLEHLVYELNKAGAQVARACCDAVEELTPQKPRFVIGVLGPTSRTASISPDVNDPGYRNTSFDALRETYREAIDGLIDGGADTLMVETIFDTLNAKAALYAIEEVFEARGGRLPVMISGTITDASGRTLSGQTAEAFYASVAHGKPLSVGLNCALGAKELRPHVETLSQIADAYVSAHPNAGLPNAFGEYDETPAEMAETLREFAKSGLLNLVGGCCGTTPDHIRAIAEAVADLPPRQLP

SEQ ID NO: 16071 - protein, 315 aa, Xanthomonas campestris
SKLAQLRDLSVVVADTGDYDAIKRLKPVDCTTNPTLVKKALDLPVYADLIERELAWGRAHGGEDRNSTINEVADRLTVGVGTMLSELVPGRVSTEVDADLAHDTQATIAKARKFIAMYAERGVSKDKILIKIAATWEGIEAARQLQQEGIDCNLTLIFNRSQALACAEAGVFLISPFVGRILDFFVAKGQTPASIDEDPGVVFVRGVYDEFKRRGSSTVVMGASFRSTAQIEALAGCDRLTISPDLLEKLDADHGDLPRKLSPLNADNAAITPINSDSFATDLAADDMATEKLASGIDTFAKDLEALRKTIADKL

SEQ ID NO: 16072 - protein, 189 aa, Xanthomonas campestris
WNKGDGLLPVIVQDADNLRVLMLGYMNAEALAVTRARGEVTFFSRSKQRLWTKGESSGNVLRVVAIETDCDADTLLVQARPHGPTCHLGRTSCFPTAPSQFLGSLDALIAEREHERPHGSYTTKLFEQGIRRIAQKVGEEGVETALAGVVQGDAELLGESADLLYHLIVLLRARGLGLGDAVALLESRH

SEQ ID NO: 16073 - protein, 255 aa, Xanthomonas campestris; identical to SEQ ID NO: 15682

SEQ ID NO: 16074 - protein, 371 aa, Xanthomonas campestris; identical to SEQ ID NO: 15683

SEQ ID NO: 16075 - protein, 292 aa, Xanthomonas campestris; identical to SEQ ID NO: 15686

SEQ ID NO: 16076 - protein, 424 aa, Xanthomonas campestris; identical to SEQ ID NO: 15685

SEQ ID NO: 16077 - protein, 359 aa, Xanthomonas campestris; identical to SEQ ID NO: 15684

SEQ ID NO: 16078 - protein, 444 aa, Xanthomonas campestris; identical to SEQ ID NO: 15687

SEQ ID NO: 16079 - protein, 187 aa, Xanthomonas campestris; identical to SEQ ID NO: 15688

SEQ ID NO: 16080 - protein, 425 aa, Xanthomonas campestris; identical to SEQ ID NO: 15691

SEQ ID NO: 16081 - protein, 312 aa, Xanthomonas campestris; identical to SEQ ID NO: 15689

SEQ ID NO: 16082 - protein, 276 aa, Xanthomonas campestris; identical to SEQ ID NO: 15690

SEQ ID NO: 16083 - protein, 336 aa, Xanthomonas campestris; identical to SEQ ID NO: 15692

SEQ ID NO: 16084 - protein, 394 aa, Xanthomonas campestris
KDIVLAFSGGLDTSFCIPYLQERGYAVHTVFADTGGVDAEERDFIEKRAAELGAASHVTVDGGPAIWEGFVKPFVWAGEGYQGQYPLLVSDRYLIVDAALKRAEELGTRIIAHGCTGMGNDQVRFDLAVKALGDYQIVAPIREIQKEHTQTRAYEQKYLEERGFGVRAKQKAYTINENLLGVTMSGGEIDRWEAPGEGARGWCAPRSAWPTEALTVTLKFVEGEAVALDGKALPGAQILAKLNTLFAQYGVGRGVYTGDTVIGLKGRIVFEAPGLISLLTAHRALEDAVLTKQQNRFKPDVARKWVELVYEGFYHDPLKTDIEAFLKSSQSKVNGEVTLETRGGRVDAVAVRSPHLLNAKGATYAQSADWGVEEAEGFIKLFGMSSTLYAQVNR

SEQ ID NO: 16085 - protein, 957 aa, Xanthomonas campestris
  unsure (1)..(957): unsure at all Xaa locations
TRQTIVRLLSSMASAKEISQYLKRFSQLDAKRFAVVKVGGAVLRDDLEALTSSLSFLQEVGLTPIVLHGAGPQLDAELSAAGIEKQTVNGLRVTSPHALAIVRKVFQASNLKLVEALQQNGARATSITGGVFEAEYLDRDTYGLVGEVKAVNLAPIEASLQAGSIPVITSLGETPSGQILNVNADFAANELVQELQPYKIIFLTGTGGLLDAEGKLIDSINLSTEYDHLMQQPWINGGMRVKIEQIKDLLDRLPLESSVSITRPADLAKELFTHKGSGTLVRRGERVLRATSWDELDLPRLTSLIESSFGRTLVPDYFSNTKLLRAYVSENYRAGESLTDEGMLGASALIYLDKCAVLDDAHGEGLSRALCNVMREETPQLFWRSRDNNQVNIFYYAESDGCIKQEKWKVFWYGLDNFEQIQHAWRIARRVNPPCWGECNDGRRIANALARGAHLARPARHAGAIARCPRRWLACGSGRWRVVAPVVHQRAQCCASRXLHRRRVGSAGGRHCAAVRGARCGGRDRRQHALLRTGCVGAEAVDRLHLVRAAGAAHRPQYRGKTSAAWACLXNARLPERGVRDQLVQSHLARGHRAAGCKAGRGAAQSHAPRRRHATRHRGVFHHQCGMGRGETPPAVPPGRTRMTVQPTTIGIVGARGHTGAELIKLIAAHPQLQLVFVSSRELAGQRVAEHSDGYQGELRYESLDADAVAAKAADVVILALPNGKAEPFVAAIDASRPQTLLIDLSADYRFDPAWYYGLPELTRHTYAGQRRISNPGCYATAMQLAITPLREQLAGPPQCFGVSGYSGAGTTPSDKNNPALLADNLMPYALTNHMHEREVSAQLGVPVEFMPHVAPHFRGITMTVNLWLQQPLTREQIHARYLERYAHEPLIEIVDEAPWVSRIAGTQGVQIGGFTMAPGNKRVVVVATLDNLLKGAATQAMQNLNLALGWDELTAI

SEQ ID NO: 16086 - protein, 368 aa, Xanthomonas campestris; identical to SEQ ID NO: 15695

SEQ ID NO: 16087 - protein, 495 aa, Xanthomonas campestris; identical to SEQ ID NO: 15696

SEQ ID NO: 16088 - protein, 551 aa, Xanthomonas campestris; identical to SEQ ID NO: 15697

SEQ ID NO: 16089 - protein, 443 aa, Xanthomonas campestris; identical to SEQ ID NO: 15331
  unsure (1)..(443): unsure at all Xaa locations

SEQ ID NO: 16090 - protein, 253 aa, Xanthomonas campestris; identical to SEQ ID NO: 15332

SEQ ID NO: 16091 - protein, 420 aa, Xanthomonas campestris
MSFAHLSLSPTLQPCFDTALAKAGHHTPTPIQQQAIPAMLAGRDLIAMAQTGSGKTLAYALPLLQQRMQAPDQAPRVLGGLILVPTRELAAQVEQSLLQLAAHLPRRLKIVAATGGSSINPQLMALRGGADIVVATPGRLLDLVEHNALQLGTVATLVLDEADRLLDLGFGAELERILALLPAQRQSVLFSATFPPAITVLAKRRLRDPLRITIAATPEQAPAIAQRAIAVDAGLRTQLVRQLLQDHGWPQLLVFVASRHTAEKVAEKLEKTGITALPLHGDLSQGRRERTLHAFKQAEVQVLVATDLAARGIDIAALPAVLNYDLPRVTVDYTHRIGRTARAGANGTAISFVTPESRPQWRLIEKREDVRVPVEVLAGFEPVAAPQTDATAACAGRHRRHQGQAPEQEGQAARGPGRRG

SEQ ID NO: 16092 - protein, 594 aa, Xanthomonas campestris
  unsure (1)..(594): unsure at all Xaa locations
AYKITEHKYDMVVVGAGGAGLRATFGLAQKGLQTVCLTKVFPTRSHTVAAQGGISAALGNMGEDDWRYHFYDTIKGSDWLGDQDAIEYMCREAIPAIIELEHYGVPFSRTEEGKIYQRPFGGMTTKYGEGPSAQRTCAAADRTGHAMLHTLYQQSLAHNARFMIEYFALDLIFDEEGVCRGVLALDMAEGSLHLFRAHGVVLATGGYGRAYFSATSAHTCTGDGGGLMMRAGLPMQDMEFVQFHPTGIYGAGCLITQSLRCXGGILRNSNSERFMERYAPHYKDLASRDVVSRSMTIEIREGRGVGEHKDHILLDLTHLGPEVINDKLPGIAESAHIFAGVDVAKQPIPVLPTVHYNMGGIPTNYHGEVVRKQGDNPDAVVPGLYAIGEAACVSVHGANRLGSNSLLDLVVFGRAVANRCAETVKTNQPHKPLPSDACDKALGLLDKLRHANGSTPTSVIRDNMQRTMQSDAAVFRTSKTLKEGVDKMAEIFATFEDVKVSDRSLVWNSDLIETYELNNLLLNAVATINSAEQRKESRGAHAHEDFPDRDDVNWQKHTLVTVDDKGQCDFEYRPVHMYTLSKEVDVVPPKPRVY

SEQ ID NO: 16093 - protein, 258 aa, Xanthomonas campestris
MAEFTLPKNSKIGKGKHYPAQGAKNKRTFKVYRWDPDGDANPRTDSYEIDLDKCGPMVLDALIKIKNEIDPTLTFRRSCREGICGSCAMNIDGTNTLACTKAIAACGKAEVPIYPLPHMRVIKDLVPDLTHFYAQYASIKPWIRTQTPPPPDRERLQSPEDRKKLDGLYECILCACCSTSCPSYWWNGERYLGPAILLQAYRWIIDSRDEDTGARLDDLEDPFKLYRCHTIMNCARTCPKGLNPALAIAEIKKLMMAR

SEQ ID NO: 16094 - protein, 459 aa, Xanthomonas campestris
NTLILFGATGDLAQRYLFPSLLRLFVDGLLPEDFRIRALALSQHDTDAFREVLRPRLAQALPIATAAQIDALLQRIDYRSADLRNAESVAEAVRELASRQCVSYLAIPPGLYISTCQGLALGGALAAPHRLMLEKPIGHDSDSAREILQSIGALIDEDRVFRLDHYLGKAAVQNLVALRFGNTLLEAVWNRTYIESVQILVAESEGVDGRDAYYARSGALRDMVQSHILQLLCLVAMEPPASLEADRIRDEKVKVLRALRPMTAEHAAQDSVRGRYTAGSINGEPAQAYHPPEGSDVETFVAVTAHIDNWRWAGVPFHLCTGKRLAERSTRIVVTLKPVTHWLFERPDRQNAVPNRLTFQLQPLENIELGLMSSLAGPEWGAIELQPLELELSVPTGLHRRIAYERLFVDAFNGNPALFVRDDEVKAAWAWIDSVSDAWSDAQLPLQPYPAGSWGPETA

SEQ ID NO: 16095 - protein, 429 aa, Xanthomonas campestris; identical to SEQ ID NO: 15704

SEQ ID NO: 16096 - protein, 612 aa, Xanthomonas campestris
ADQFVARISAEYKAAYPEMTAAQWLSSTYINGDSQLLAAKANERALSQLDRWIDQSKQYAGTPMSADSARALQLLKLMSALPAPRDPTKLAELTRIAAKMEGDYGAGSACTGEGEQRRCRQLGELEQVLARSRGYDEQLQAWQGWHATAQPMRKDYQRFVELANDGARGMGFADVGAMWRSGYDMPPAQLASETDRLWEQLKPLYTQLQCYARGKLDTQYGKDKGEVAGGMLPAHLMGNMWQQDWSNLWDLLQPYPGAGDLDITSALEKQYQGNLSAALARNTGGDGGAAARFLAERDAQLRTAQQMTERAQDFYTSLGMPKLPDTYWQRSQFIKPLDRDVVCHASAWDMNMGGEPNAGIGPDVRTKMCIRPTEEDFTTIYHELGHIYYDMAYNPLPPLFQNGANDGFHEAIGDTIVLAMTPKYLQSIGMVGEQQSGREALINSQMRMALSKVAFLPFGLMIDRWRWGVFDGSIPPERYNQAWWELKATYQGVAPVSPRGEDFFDAGAKYHVPGNTPYTRYFLAHILQFQFYKGLCDAAGHQGPLYECSFYGNKEAGQKFWSMLQRGSSQPWQTTLKEVTGKDTLDAGPMLEYFAPMQEWLKQQNQGQMCGW

SEQ ID NO: 16097 - protein, 229 aa, Xanthomonas campestris
YYLPVYRPRQVVLERGQGSRVWDDQGREYLDLSSGIAVSGLGHNDPDLMAALTEQAGKLWHTSNVFFSAPPLKLAEELVTASRFAQKVFLCNSGTEANEAAIKLVRKWASSQGRPADKRVIVTFRGSFHGRTLASVTATAQPKYQEGYEPLPGGFRYVDFNDVPALESAMASGDVAAVMLEPIQGEGGVMPAAPGFLARVRALCDQHDALLVLDEIQCGMGRTDSLLAH

SEQ ID NO: 16098 - protein, 201 aa, Xanthomonas campestris; identical to SEQ ID NO: 15344

SEQ ID NO: 16099 - protein, 785 aa, Xanthomonas campestris; identical to SEQ ID NO: 15709

SEQ ID NO: 16100 - protein, 216 aa, Xanthomonas campestris
AAEQTTQQVRAAGGSAEALALDVTDEHSIAQALAAASRAPEVLVNNAGLQQVAPLEEFPMQRWALLVDVMLTGAARLSRAVLPGMRAGGYGRIVNIGSIHSLVASPYKSAYVAAKHGLIGLSKVLALETADCDITANTLCPSYVRTPLVERQIADQARTRGIAEDAVIREVMLKPMPKGAFIEYDELAGTVAFLMSHAARNLTGQAIAIDGGWTAQ

SEQ ID NO: 16101 - protein, 842 aa, Xanthomonas campestris
QLPRTARPSHYAIEITPHAETMTFDGKVSIDVEVLAPTDAIVLQAAQLTFGKATLAAAGRKPVAAKVTTDADAQTASIATGKPLAPGKYVLTLAYSGTINTQANGLFALDYTTAQGARRALFTQFENSDARRFVPSWDEPNFKATFDLVINAPAGQMAVSNMPVASSKPGTNGCTRVAFQTSPKMSTYLLFVSVGDFERATVKADNGTEIGVIAQKGKVGQAQFALESGRDVLHEYNDYFGIQYPLPKLDNIAAPGRSQFFSAMENWGAIFTFEYTLLLDPAVANVSTKQGVFTVAAHEIAHQWFGNLVTMAWWDDLWLNEALPTGWKHAPRQNCIPEWDIDKTGPAQKSRAAMRRDAYVTTHPVVQHVATVEQASQAFDSITYAKGEAVIAMLEDYVGEDAWRTGVRSYIRQHQYGNAVTDQLWQQIDTVAPGKQFIQVAHDFTLQPGVPLIKASSRCVGGQTTVTLEQGEFTLDRPDKQPLRWHVPVVLRGGDGKQVRVLVDGTAQVQLPGCKVPVVVNAGQKGYFRTAYAPMQFKALAAGFSALPVVDQLGVLNDTNALAGAGVQPETDLLNLAAQVKVGASPDIWEMVASIYDSVDGSFERDQAARAAWRAYAVPHLSAEFATLGWDNRDDDSAEIQQLRTRLIGSLSGMGDAAVIAEARRRFAGFQANPASLSPELRDSVLGAVALNADAATWDALHALAKQETSSMVRDTYYDFLSMADDQALAKRALELALTEEPGATTGASMIDRVASRHPELAFDFAVAHRAQVDMLVDSTSRARYYPSLGMDSADLATANKIKAYADTYIAPTSRQTADNAINTIQTRVKLRAASLPQIKAW

SEQ ID NO: 16102 - protein, 430 aa, Xanthomonas campestris; identical to SEQ ID NO: 15713

SEQ ID NO: 16103 - protein, 555 aa, Xanthomonas campestris
VAIGIVHCLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDADCVLGLATAQGGPTLHTGILSRTLGLAALVPAGGQLLDIQKGVTAIIDGSSGRLYINPSEQDLDAARTHIAEQQAIREREAAQRALPAETTDGHHIDIGANVNLPEQVAMALTQGAEGVGLMRTEFLFLERGSTPTEDEQYHTYLAMAQALNGRPLIVRALDIGGDKQVAHLELPHEENPFLGVRGARLLLRRPDLLEPQLRALYRAAKDGARLSIMFPMITSVPELISLREICARIRAELDAPELPIGIMIEVPAAAAQADVLARHADFFSIGTNDLTQYVLAIDRQNPELAAEADSLHPAVLRMIRSTIDGARKHDRWVGVCGGLAGDPFGASLLAGLGVQELSMTPNDIPAVKARLRGRALSALQQLAEQALHCETAEQVRALEAQREGQA

SEQ ID NO: 16104 - protein, 459 aa, Xanthomonas campestris
RTRFAPSPTGYLHIGGARTALYCWLEARHRGGQFVLRIEDTDRERSTQVAIDAILEAMEWLGLGYDEGPIYQTQRIARYQEVAEQLLAQGKAYYAYETREELDAMREAAMAKQEKPRYNGAAREQQLPYRDDPNRVIRFKNPLAGTVVFDDLIKGRIEIANSELDDMVIFRPDGYPTYNFAVVVDDWDMGITEVIRGDDHINNTPRQINIYESAGPHRYPSSAHMPMILDEQGAKLSKRTGAADVMQYKDAGYLPHALINYLARLGWSHGDQELFSQQELLDLFDVKDVNSKAARLDMAKLGWVNQHYLKTDDPASIAPQLEYQLRKLGIDVAAGPAAADVVVALRERVQTLKEMAEKAVVWYQPLETYDEAAVIKHLKLGAEVPLGKAREMLAALNEWSVENVSAALHAAAAALELGMGKVAQPLRVAITGTQVSPDISQTVYLAGREGALKRIDAAL

SEQ ID NO: 16105 - protein, 551 aa, Xanthomonas campestris
AGGRSDHRGRVCRHERRRSQDLQAQSGICGRAQRDLPHQPQHPHSGRMTHTNGFDALHAHAQRLRGVAIPTLLAAEPQRPTQYARQVGPLYFNFARQKYDRAALDALFAIARERDLAGAFQRLFRGEQVNVTEKRAALHTALRGDLTDAPVASDAYATAAEVRHRMGALIQQLEGTDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLDGAAQFDAHALNTPLEENVAVLHGLTAVWNRNLLGSATHAVMTYDQRLALLPAYLQQLVMESLGKRVKLDGSAVDSDTVAVWWGGAGTDVQHSFFQALHQGTSVVPADFIGTVHNDDPYAENHVALMANVLAQTEALANGQDSSDPHRSYPGGRPSTVILLDALTPQALGALISMYEHSVYVQSVMWGINAFDQFGVELGKQLASQLLPALKGEAADVADPVTRELLAKLRG

SEQ ID NO: 16106 - protein, 266 aa, Xanthomonas campestris; identical to SEQ ID NO: 15720

SEQ ID NO: 16107 - protein, 458 aa, Xanthomonas campestris
MNEFSALPLSPALAPGIDALGYTTLTPIQAQSLPPILQGLDVIAQAPTGSGKTAAFGLGLLQKLDPALTRAQALVLCPTRELADQVGKQLRKLATGIPNMKLLVLTGGMPLGPQLASLEAHDPQVVVGTPGRIQELARKRALHLGGVRTLVLDEADRMLDMGFEEPIREIASRCDKHCQSLLFSATFPDIIRTLARELLKDPVEITVEGADNAPEIDQQFFEVDPTYRQKAVAGLLLRFNPESSVVFCNTRKEVDEVAGSLQEFGFSALALHGDMEQRDRDEVLVRFVNRSCNVLVASDVAARGLDVEDLAAVVNYELPTDTETYRHRIGRTARAGKHGLALSLVAPRESARAQALEAEHGQPLKWSRAPLATARPAQLPLAAMTTLRIDGGKTDKLRAGDILGALTGEAGLSGAAIGKIAIYPTRSYVAIARAQVARALTHLQAGKIKGRRFRVTKL

SEQ ID NO: 16108 - protein, 289 aa, Xanthomonas campestris; identical to SEQ ID NO: 15723

SEQ ID NO: 16109 - protein, 221 aa, Xanthomonas campestris; identical to SEQ ID NO: 15724

SEQ ID NO: 16110 - protein, 508 aa, Xanthomonas campestris; identical to SEQ ID NO: 15358
  unsure (1)..(508): unsure at all Xaa locations

SEQ ID NO: 16111 - protein, 346 aa, Xanthomonas campestris; identical to SEQ ID NO: 15727

SEQ ID NO: 16112 - protein, 314 aa, Xanthomonas campestris; identical to SEQ ID NO: 15726

SEQ ID NO: 16113 - protein, 519 aa, Xanthomonas campestris
TAHSISTSWGVVQQPALPSQVCTTLKAALVPVAGSLDALDQDPTQSKRDTARLQAAIDDCPAGSAVRLVVGDGGESGLLSGPLTIKSGVTLWIDRGVTLFGSRNPQDYDNGLGTCGTATTDKAKSCNPLIHVADTAKSAIVGAGKIDGRGGSTLTAGPNAGKASWWDLAYLNVTKGLSQHVPRLLQIDDSTDFTLYDITLENSPNFHVTTDNVVGLTAWGIKILAPSLVYSRPGYHCPAGSTPDVNPHASCFTPETVKNTDGFDPGQSKNVLLAYSYIGTGDDGVAIKAHAKNKRSIASENMLFAYNQFYYTHGFSLGSETDSGMRHIAVRGLSIDGFNANDVQRDPYSANGLRIKSDASRGGQVYDIRFENICMRGVARPLVFDANYANPATRDQLPRFSGIALTNVHSLGSKAFGGGELSFYGYRDATTTLPITMSLDNVVLDGGPVAFAQPHFGGPASNPGAVHFTFKGGPVSFFDQLTESAANDVQLQGRPGPGAPLQCDDAFIAYHSVLPDSPI

SEQ ID NO: 16114 - protein, 366 aa, Xanthomonas campestris
TASRPQLTSSEASTYTISKALAKAGPITALVTDNWNPTAGVALLTADFAVAADGSTRYRTVQSAIDAAVAAGGSTRRYISVKAGTYNELVCVPSGAPPLTLFGLGSATTDTVIRYNNANPTPKPTGTASHPCASNASAATVGTSNSATVTVRASGFQARHLRFDNNYVEGTYADNNQSAVALAVRGDQASFEDVLVTGNQDTLLISATNAANVIRAYFKSSTIEGDVDFIFGSGIGVFDNAIIRSAGARLGSSRGGYIFAPSTRPGSGYGFLAINSRFVAGSGSPDNQTYLGRAWDEGVSGLSAYVNGTSPNGQVTIRDSTLGSHIRKTAPWNASTASRPFCSSNCTNSANRFFFEYGNSGAGSAD

SEQ ID NO: 16115 - protein, 246 aa, Xanthomonas campestris; identical to SEQ ID NO: 15730

SEQ ID NO: 16116 - protein, 663 aa, Xanthomonas campestris; identical to SEQ ID NO: 15731

SEQ ID NO: 16117 - protein, 280 aa, Xanthomonas campestris; identical to SEQ ID NO: 15732

SEQ ID NO: 16118 - protein, 448 aa, Xanthomonas campestris; identical to SEQ ID NO: 15367

SEQ ID NO: 16119 - protein, 353 aa, Xanthomonas campestris; identical to SEQ ID NO: 15733

SEQ ID NO: 16120 - protein, 489 aa, Xanthomonas campestris
DLAYPELFQAVQRGELFDDQKHFVDFLPLRDPALINADYLAQHEHAGFDLRKFVDANFEESPPVQTDAIRQDTALREHIDALWPKLVRSQTNVPAHSSLLALPHPYVVPGGRFREVYYWDSYFTMLGLVKSGETTLSRQMLDNFAYLIDTYGHIPNGNRTYYLSRSQPPLFSYMVELQAGVEGEAVYQRYLPQLQKEYAYWMQGGDDLQPGQAARHVVRLADGSVLNRYWDERDTPRPEAWLHDTRTAAEAHDRPAADVYRDLRAGAESGWDYTSRWLADGKTLSTIRTTAIVPIDLNSLLYHLERTLAQACAHTGTACSQDYAALAQQRKQAIDAHLWNAAGYYADYDWQTRTLSNQVTAAALYPLFAGLASDDHAKRTATSVRARLLRPGGLATTALKTGQQWDEPNGWAPLQWVAVDGLRRYGEDGLARTIGERFLTQVQALFAREHKLVEKYGLDADAAGGGGGEYALQDGFGWTNGVTLMLLNL

SEQ ID NO: 16121 - protein, 298 aa, Xanthomonas campestris
GLSKTYAGGFQALKRVDLDIQRGEIFALLGPNGAGKTTLISIICGLVNPSTGTVLADGHDIVRDYRAARASIGLVPQELATDAFETVWATVRFSRGLFGKPANPQYLESVLRQLSLWDKRNSKISTLSGGMKRRVLIAKALAHEPRILFLDEPTAGVDVELRHDMWQMVRRLREQGTTVILTTHYIEEAEDMADRVGVINRGELVLVEDKHTLMRKLGKKQLSLSLQAPLQVIPAPLADLPLELSADGTSLIYTFDTQAEQTGIGALLRRLNEQGIDFKDLHSSESSLEEIFVNLVHG

SEQ ID NO: 16122 - protein, 246 aa, Xanthomonas campestris; identical to SEQ ID NO: 15370

SEQ ID NO: 16123 - protein, 483 aa, Xanthomonas campestris
MSIFRTASTLALATALALAAGPAFSYSINNSRQIVDDSGKVVQLKGVNVFGFETGNHVMHGLWARNWKDMIVQMQGLGFNAVRLPFCPATLRSDTMPASIDYSRNADLQGLTSLQILDKVIAEFNARGMYVLLDHHTPDCAGISELWYTGSYTEAQWLADLRFVANRYKNVPYVLGLDLKNEPHGAATWGTGNAATDWNKAAERGSAAVLAVAPKWLIAVEGITDNPVCSTNGGIFWGGNLQPLACTPLNIPANRLLLAPHVYGPDVFVQSYFNDSNFPNNMPAIWERHFGQFAGTHALLLGEFDGKYGEGDARDKTWQDALVKYLRSKGINQGFYWSWNPNSGDTGGILRDDWTSVRQDKMTLLRTLWGTAGNTTPTPTPTPTPTPTPTPTPTPTPTPGTSTFSTKVIVDNSWNGGYCNRVQVTNTGTASGTWSIAVPVTGTVNNAWNATWSQSGSTLRASGVDFNRTLAPAPPPSSASAPR

SEQ ID NO: 16124 - protein, 301 aa, Xanthomonas campestris; identical to SEQ ID NO: 15738

SEQ ID NO: 16125 - protein, 202 aa, Xanthomonas campestris
VIWLHGLGADGSDFAPMVPELVRAQWPALRFVFPHAPIRPITINNGVRMRGWYDIVGMDFAQRADKVGIAESVAQVEALIANEQARGIAPERILLAGFSQGGAVTLAVGLQRRVPLAGLIAMSTYLPDPAAAASQLQPGALAQPLFMAHGSADPVVPYRAGEQSAQALQALGFMLEWHSYPMGHQVCVEEIDALRDWMQARF

SEQ ID NO: 16126 - protein, 382 aa, Xanthomonas campestris; identical to SEQ ID NO: 15374

SEQ ID NO: 16127 - protein, 311 aa, Xanthomonas campestris; identical to SEQ ID NO: 15375

SEQ ID NO: 16128 - protein, 475 aa, Xanthomonas campestris; identical to SEQ ID NO: 15376

SEQ ID NO: 16129 - protein, 469 aa, Xanthomonas campestris; identical to SEQ ID NO: 15745

SEQ ID NO: 16130 - protein, 159 aa, Xanthomonas campestris
MGVSGSGKTTIAQALATHYGFRFLDADDYHSVAARAQMASGQPLTDAMRLPWVELLSATLRDCVQSGESVVLAFSGLRGTHRQLLRRSGVPMRFVFLHAAPHVIAARLSARAGHFMPPSLLDSQLQTLELPLDEADVVSVDVDATVPEVVQDAIAQLAL

SEQ ID NO: 16131 - protein, 505 aa, Xanthomonas campestris; identical to SEQ ID NO: 15379

SEQ ID NO: 16132 - protein, 335 aa, Xanthomonas campestris; identical to SEQ ID NO: 15748

SEQ ID NO: 16133 - protein, 201 aa, Xanthomonas campestris; identical to SEQ ID NO: 15381

SEQ ID NO: 16134 - protein, 417 aa, Xanthomonas campestris
PGAVALPRDTDDVVAIVQACRAHGVPIVARGAGTGTTGAAVPFSGGVVVSMARMNRILALRPADRCAVVQPGVLNGDLQQALQPHGLFWPPDPSSAEICSVGGNLSTNAGGPRAVKYGATRDNVLGLVAVTGTGDVIHCGGAYTKNSTGYDLTHLLVGSEGTLAIIVEATLKLTPRAVAQAGVRALYRDAASAAAAVSRIMAQPTTPTMLEFMDASAIALLRRNGSDVPDAGAMLLIEADGDHDTLPYALQALHDAADGDGVLSLDIAADGSARDKLWAARRALSPALRTIKPGKINEDVVVPVSRIPELVAGVEALAVEFAVPIVAFGHAGNGNLHVNIMYDPDDADETARAQAALPRVFALVLALEGTLSGEHGIGVAKRDFMTQAFSAPTLAAMRAIKAALDPDGILNPGKVLP

SEQ ID NO: 16135 - protein, 408 aa, Xanthomonas campestris; identical to SEQ ID NO: 15751

SEQ ID NO: 16136 - protein, 264 aa, Xanthomonas campestris; identical to SEQ ID NO: 15384

SEQ ID NO: 16137 - protein, 458 aa, Xanthomonas campestris
MFRAYDIRGVVGKDLNPGIAALIGQAIGSVMQAQGLRDIVVGRDGRLSGPELTNGLIEGLRRAGCNVTDIGLAPTPVVYFGAYELRAGSCVAVTGSHNPPDYNGFKIVIGGETLSGAAITELHQRITEGRLHTAASPGELEQRDISDAYIQRIADDVQLDRPIKVVVDAGNGAAGEIAPRLLEAIGAEVVPLYCEIDGTFPNHHPDPSEPHNLGDLVQMVQRFDADIGVAFDGDADRLGVVTKEGAIVFPDRLLMLFAADVLQRNPGALVIYDVKCTGKLSDYVLRNGGSPLMWKTGHSLIKAKMRETDAELAGEMSGHFFFKERWYGFDDGIYAAARLLEILAQREETPSDVLGELPESVSTPEIKVPLDGDAHALVARFVERAQAGEESPFEAARLSTIDGLRADFGDGWGLVRASNTTPILVLRFEADTAVALERIRALFRSELQALLPDHPLAF

SEQ ID NO: 16138 - protein, 153 aa, Xanthomonas campestris
  unsure (1)..(153): unsure at all Xaa locations
ALECIHVYSLIHDDLPAMDDDDMRRGKPTVHKAFDEATAILAGDCLHDLAFELLAHEATHADPFVRVELISELARSSGPAGMAGGQMMDLEAEKASFDLATVTRLQALKTGALISCAVECSAILGRVQHAGRTGLRGYTRNIGLAFQIVXAIL

SEQ ID NO: 16139 - protein, 973 aa, Xanthomonas campestris; identical to SEQ ID NO: 15388

SEQ ID NO: 16140 - protein, 545 aa, Xanthomonas campestris; identical to SEQ ID NO: 15386

SEQ ID NO: 16141 - protein, 766 aa, Xanthomonas campestris
FPHMVIPLFVGRDKSMRALEKAMEADKRILLVAQKSAETDDPAAGDLYTVGTLAQVLQLLKLPDGTIKVLVEGLSRVTVDKVAEQDGALQGRGTEVEASDAREPRELEAIARSLMSLFEQYVKTNRKLPPELLQTLAGIDEPGRLADTIAAHIGVRLADKQRLLEITEIGDRLELLVGLVDGEIDVQQLEKRIRGRVKSQMEKSQREYYLNEQMKAIQKELGDLDDAPGELEELARKIAEAGMPKPVETKAKAELNKLKQMSPMSAEAAVVRNYLDWLLGVPWKKRTKVRKDLKVAQDTLDADHYGLDKVKERILEYLAVQSRVKQMKGPILCLVGPPGVGKTSLGQSIAKATNRKFVRMSLGGVRDEAEIRGHRRTYVGSMPGRLVQNLNKVGSKNPLFLLDEIDKMSMDFRGDPSSALLEVLDPEQNHTFNDHYLEVDLDLSEVMFVATSNSLNIPGPLLDRMEVIRIPGYTEDEKLNIAMRYLVPKQIKANGLKPEEIEIGSDAIQDVVRYYTRESGVRNLEREVAKICRKVVKEIALAGPQPAAKKAVAKKAKPKALVTVTSRNLDKYLGVRRFDFGRAEEENEIGLVTGLAWTEVGGELLQIESTLVPGKGNLILTGQLGNVMKESASAALSVVRSRAERLGIDVDFLQKQDVHVHVPDGATPKDGPSAGIAMVTSLVSILTKVPIRADVAMTGEITLRGRVSAIGGLKEKLLAALRGGIRTVLIPDENRKDLADIPANVTRDLKIVPVKWIDEVLDLALE

SEQ ID NO: 16142 - protein, 330 aa, Xanthomonas campestris; identical to SEQ ID NO: 15758

SEQ ID NO: 16143 - protein, 340 aa, Xanthomonas campestris; identical to SEQ ID NO: 15392

SEQ ID NO: 16144 - protein, 386 aa, Xanthomonas campestris; identical to SEQ ID NO: 15761

SEQ ID NO: 16145 - protein, 688 aa, Xanthomonas campestris; identical to SEQ ID NO: 15391

SEQ ID NO: 16146 - protein, 244 aa, Xanthomonas campestris
TDSSKVVLITGAARRIGAQIATTLHGAGYRVALHAHRSGDALAARVAALCAQRAGSACALQADLRTPEAPAQLVDACVAAFGRLDAVVNNASAFYPTVLGEATPAQWDELFAVNARAPFFIAQAAAAQLRAHHGAIVNLTDLHAEQPMRQHPLYGASKSALEMLTRSLALELAPQVRVNAVAPGAILWPEDGKADAAKQALLARTPLARIGTPEEVAEAVRWLLDDASFITGHTLRVDGGRRLS

SEQ ID NO: 16147 - protein, 304 aa, Xanthomonas campestris
MELGMVGLGRMGANMAERLVRGGHRVHGFDLGAAARTSAQSKGIQTTDALATLVSALPSPRVVWLMVPAGKIVDDTLAQLLPLLQAGDIVIDGGNSYYKDSQRRAAQLQSSGIAFVDCGTSGGVWGLQEGYSLMVGGDEAAVTTLHPVLATLAPAPDKGWGRVGPSGAGHFTKMVHNGIEYGMMQAYAEGFALLQHKTDFALDLHQVAEIWRDGSVVRSWLLDLTADALAHNPTMGGIAPYVADSGEGRWTVAEAIDLEVSAPVITLSLMERLRSRDKDSFTDKLLAAMRNQFGGHAVLTTTPT

SEQ ID NO: 16148 - protein, 299 aa, Xanthomonas campestris; identical to SEQ ID NO: 15764

SEQ ID NO: 16149 - protein, 251 aa, Xanthomonas campestris
LMRRKIVAGNWKLHGTRAFATELVAQVAAHMPLAGVDVVILPPLPYLGDLIEDFEAHHLAFGAQDVSSNEKGAYTGEVSASMLVDVGAEYGLVGHSERRQYHQESSELVARKFAAAMHAGLIPVLCVGESLEQREAGHTEAILRAQLEPVLSLVGSAGFARAVVAYEPIWAIGTGRTATPDQAQAVHAFIRGEVAKADARIADSLPILYGGSVKPDNASELFFQPDVDGGLVGGASLVAEDFLAIARAAAA

SEQ ID NO: 16150 - protein, 593 aa, Xanthomonas campestris; identical to SEQ ID NO: 15766
  unsure (1)..(593): unsure at all Xaa locations

SEQ ID NO: 16151 - protein, 374 aa, Xanthomonas campestris; identical to SEQ ID NO: 15399

SEQ ID NO: 16152 - protein, 820 aa, Xanthomonas campestris
ATLPYTARVHAENLVRRADPQHVDAYLRQLIERKRDLDFPWFPARVVCHDILGQTALVDLAGLRDAIAEQGGDPAQVNPVVPVQLIVDHSLAVEYAGFDKQAFAKNRGVEDRRNADRFHFIEWTKRAFENVEVIPPGNGIMHQINLEKMSPVIYVQDGVAFPDTCVGTDSHTPHVDALGVIAVGVGGLEAENVMLGRASWMRLPDIIGVELLGRPAPGITATDIVLALTEFLRQQRVVGAYLEFYGAGASALTIGDRATISNMTPEFGATAAMFYIDQQTLDYLRLTGREDTQIALVETYARQTGLWADDLVTAQYERMLQFDLSSVVRNMAGPSNPHKRVATSELASRGIAAAWEQVPGQMPDGAVIIAAITSCTNTSNPRNVIAAGLLARNANARGLTRKPWVKSSLAPGSKAVQLYLEEAGLLGELEQLGFGIVAFACTTCNGMSGALDPVIQQEIIERDLYATAVLSGNRNFDGRIHPYAKQAFLASPPLVIAYAIAGTVRFDIEKDVLGVDAEGVPVTLKDLWPSDAEIDAVVARSVKPEHFRSVYEPMFRRSGLQGARVSPLYDWRAQSTYIRRPPYWEGALAGARTLQGMRPLAVLGDNITTDHLSPSNAILASSAAGEYLTQMGVPEEDFNSYATHRGDHLTAQRATFANPKLVNEMAVVDGQVTAGSLARLEPEGQVLRMWEAIETYMQRKQPLIIIAGADYGQGSSRDWAAKGVRLAGVEAIVAEGFERIHRTNLIGMGVLPLEFKPGTDRKMLGIDGSETFDVVGERTPGATLTLSVHRRDGEQLQVPVTCRLDTAEEVSIYEAGGVLQ

SEQ ID NO: 16153 - protein, 274 aa, Xanthomonas campestris
DGRRIAEELLDGLKLRVDARLAAGKTRPGLAVVLVGGDPASSVYVRNKRRAAEKVGIEAFDYDLPQGTTEAELAALIDQLNTDPKIHGILIQLPLPGIPDANRLIQRIDPRKDVDGFHPQNVGHLALREFGLRPCTPRGIVTLLAHTDQPVRGRNATIVGVSYHVGRPMGLELLIAGCTVTSCHKFTPPDVLEASVRNADILVVAVGRPGLIPGEWVKPGAVVIDVGINRLDDGRLVGDVGFEAAAQRAGWITPVPGGVGPMTVATLMQNTLEA

SEQ ID NO: 16154 - protein, 296 aa, Xanthomonas campestris
MSKRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVLCAKAVVGDEPFAVLLPDDLMWNRGDAALTQMADVAEASGGSVIAVEDVPHDKTASYGIVSTDAFDGRKGRINAIVEKPKPEVAPSNLAVVGRYVLSPKIFEYLESTGAGAGGEIQLTDAIAELLKQEQVDAFRFEGRRFDCGAHIGLIEATVHFALEHDKHGAPAKEIIRSALAAADAR

SEQ ID NO: 16155 - protein, 364 aa, Xanthomonas campestris; identical to SEQ ID NO: 15772

SEQ ID NO: 16156 - protein, 336 aa, Xanthomonas campestris; identical to SEQ ID NO: 15773

SEQ ID NO: 16157 - protein, 206 aa, Xanthomonas campestris; identical to SEQ ID NO: 15774

SEQ ID NO: 16158 - protein, 276 aa, Xanthomonas campestris; identical to SEQ ID NO: 15771

SEQ ID NO: 16159 - protein, 578 aa, Xanthomonas campestris
VWRFYLHYLRPLWPILLATLIAGLLLALVEVAMFDFLGRIVDMLAEQPGPEFFRRHAGELVWMAAITLVARPFFTGLHNLLVNQAIVPGLSNRSRWLMHNYVVRQSLAFFHNDFAGRIANRVMQTGTSLRESAVQMVDALWYIVVYTGSALWLFAQADPWLMVPLLCWLVVYVGLMAFFVPRMKARAWVASDARSKATGRIVDGYTNIATLKLFSHARREEAYVRDAIDELAVKHRLQTRVTTAMDTAIAIANGFLIVGTCGLALWLWSRGQISVGAITLATGLVIRIHNMSGWIMWTVNGIFEDIGSVQDGMQTIAQPLTVQDQPTALPLQVTRGAVHFDQIHFHYGKRGGVIAGLDLRVRAGEKIGLVGPSGAGKSTLVNVLLRLYDLEQGRILIDGQDIAQVTQESLRGQIGLVTQDTSLLHRSIRDNLLYGRPQATEAQLLDAVHKARADGFIDTLVDGEGRRGFDAHVGERGVKLSGGQRQRIAIARVLLKDAPILILDEATSALDSEVEAAIQDSLDALMSDKTVIAIAHRLSTIARMDRLVVMDGGRIVETGTHAELIAHGGLYARLWARQ

SEQ ID NO: 16160 - protein, 344 aa, Xanthomonas campestris; identical to SEQ ID NO: 15776

SEQ ID NO: 16161 - protein, 441 aa, Xanthomonas campestris; identical to SEQ ID NO: 15778

SEQ ID NO: 16162 - protein, 1160 aa, Xanthomonas campestris; identical to SEQ ID NO: 15779

SEQ ID NO: 16163 - protein, 798 aa, Xanthomonas campestris; identical to SEQ ID NO: 15413

SEQ ID NO: 16164 - protein, 361 aa, Xanthomonas campestris; identical to SEQ ID NO: 15783

SEQ ID NO: 16165 - protein, 507 aa, Xanthomonas campestris; identical to SEQ ID NO: 15414

SEQ ID NO: 16166 - protein, 115 aa, Xanthomonas campestris; identical to SEQ ID NO: 15784

SEQ ID NO: 16167 - protein, 401 aa, Xanthomonas campestris; identical to SEQ ID NO: 15785

SEQ ID NO: 16168 - protein, 674 aa, Xanthomonas campestris; identical to SEQ ID NO: 15786

SEQ ID NO: 16169 - protein, 625 aa, Xanthomonas campestris; identical to SEQ ID NO: 15787

SEQ ID NO: 16170 - protein, 506 aa, Xanthomonas campestris
  unsure (1)..(506): unsure at all Xaa locations
PGTKCPATPSHRAAHESGGHNLSLASPYGCAIQCKISETTGLHLGRYTPPMTRCELCLNTVLIKRYARLMGIXLNVGCIPSKALLHAAAVIDEVAHAGDFGVDFGQPKITLDKLREYKEKVVGKLTGGLASMAKQRKVRTVTGVASFVSPNELEIVGDDGKTQLLRFEHCVIAAGSQAVKLPNFPWDDKRVMDSTDALELHDIPKTLLVVGGGIIGLEMATVYSALGSKVTVVEFMDQLMPGADKDLVKPLADRLKKQGVEVHLKTKATDVSADAKGITVSFEAASEGEKPGLQATAFDRVLVAVGRSPNGKKIGAEKAGVTVTERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEDTHRIIGGAIVGVHAGDLLAEIGLAIEMGAEAEDIGHTIHAHPTLSESVGMAAEVYDGTITDLYIPKKK

SEQ ID NO: 16171 - protein, 511 aa, Xanthomonas campestris; identical to SEQ ID NO: 15421

SEQ ID NO: 16172 - protein, 287 aa, Xanthomonas campestris; identical to SEQ ID NO: 15422

SEQ ID NO: 16173 - protein, 464 aa, Xanthomonas campestris; identical to SEQ ID NO: 15423

SEQ ID NO: 16174 - protein, 609 aa, Xanthomonas campestris
MCGIVGAIAGRDVVPVLIEGLKRLEYRGYDSSGIAVLDGTQVRRVRRTGRVAEMAQAAQAEQFGATLGIGHTRWATHGGVTEANAHPHISAGVALVHNGIIENHEEQREKLRALGYTFESQTDTEVIAHLIHHHLADAGDLLSALQRTVKELTGAYALAVMSQAEPERFVCARMGCPLLIGVGEGENFVASDVSAIVQATRQVIFLEEGDTAELRRDGVRVFDASDAAVERPLHLSDVSLASLELGPFRHFMQKEIHEQPRALADTIEAAIDAKGFPASLFGPTADAVLRDIEGVQILACGTSYYAGLTARYWIEAIAGLPCSVEIASEYRYRTAYANPKHLIVTISQSGETLDTMEALKYAKSLGHLHTLSICNVPESAIPRASELVCYTRAGAEIGVASTKAFTTQLAVLFQLTMVLGKAAGPHQRQRRSRLPGALRFLPGSVQHALNLEPQIMAWAERFSPKENALFLGRGLHYPIALEGALKLKEISYIHAEAYPAGELKHGPLALVDATMPVVVIAPNDRLLEKVKSNMQEVRARGGELFVFADQDSHFSESDGVHVIRTPRHAGVLSPVIHTIPVQLLAYHTALARGTDVDKPRNLAKSVTVE

SEQ ID NO: 16175 - protein, 391 aa, Xanthomonas campestris; identical to SEQ ID NO: 15793

SEQ ID NO: 16176 - protein, 235 aa, Xanthomonas campestris
ALVTGGSGDLGGAICRQLAAQGRHVIVHANRNLARAEEVVASIVAAGGSAEAVAFDVADAQASADALAALLEAGPIHIVVNNAGIHDDAPMAGMNAQQWHRVIDVSLHGFFNVTQPLLLPMARARWGRIVSVSSVAAVLGNRGQTNYAAAKAALHGASKSLAREMASRGIAVNVVAPGVIESEMVGDSFAPELIKQMVPAGRVGTPDEVAALVAFLCSDVAGYINGQVIGINGGM

SEQ ID NO: 16177 - protein, 893 aa, Xanthomonas campestris; identical to SEQ ID NO: 15795

SEQ ID NO: 16178 - protein, 403 aa, Xanthomonas campestris; identical to SEQ ID NO: 15796

SEQ ID NO: 16179 - protein, 728 aa, Xanthomonas campestris; identical to SEQ ID NO: 15429

SEQ ID NO: 16180 - protein, 292 aa, Xanthomonas campestris
VRDYLTDLQDRICAAVEAIDGKARFAEDLWQRAEGGGGRTRILRDGAVFEQAGIGFSDVSGARLPPSASAHRPELAGATWRACGVSLVFHPHNPHIPTTHANVRYFRAERDGEMVAAWFGGGFDLTPFYPVDEDVMHWHRTAQALCAPFGEERYAAHKRWCDEYFFLRHRNETRGVGGLFFDDLGQDFERDFAYQRAVGDGFLDAYLPIVERRKDTPYGEAERAFQLYRRGRYVEFNLVYDRGTLFGLQSGGRAESILMSLPPQVRWEYGFQPQPGSAEARLADYLIPRDWL

SEQ ID NO: 16181 - protein, 209 aa, Xanthomonas campestris; identical to SEQ ID NO: 15799

SEQ ID NO: 16182 - protein, 639 aa, Xanthomonas campestris
LTKNLLLWVVVAVVLMVVFQSFSPRMAGGVGPDSITYTQFLKEVDSGRVKSVDYTDETNLAVNAIRFKRTDGSEATVYGPRDDKLVDVLYSKNIEMTRQKPSTGPGFWSLVLNFLPVILIIGFWLFIMRQMQGGGGGAKGAMSFGKSRAKLQGEDQVKVTFADVAGCDEAKEEVGELVDFLRDPTKFTKLGGKIPRGVLMVGPPGTGKTLLAKAIAGEAKVPFFSISGSDFVEMFVGVGASRVRDMFEQAKKHAPCIIFIDEIDAVGRHRGAGLGGGHDEREQTLNQLLVEMDGFEGGEGVIVIAATNRPDVLDPALLRPGRFDRQVVVGLPDVKGREQILRVHMRKLPLADDVVPLVIARGTPGFSGADLANLANEAALFAARGNEKEVRMDHFDRARDKILMGAERRSMAMSEDEKTLTAYHEAGHAIVGRLVPEHDPVYKVTIIPRGRALGVTMYLPEGDRYSMNRVAIESQLCSLYGGRVAEELIFGGDKVTTGASNDIERATKMARNMVTKWGLSDELGPVAYGEEEDEVFLGRSVTQHKNVSDETARKIDEVVRSILDKAYSKTKTILTENLDKLHAMSQLLLQYETIDVPQIDAIMEGRDPPPPAGWGKSDKDGGNNNDKGSPRPLPPIAGP

SEQ ID NO: 16183 - protein, 234 aa, Xanthomonas campestris
VVAGSTGEAAALSDDEYDTLVRAAVAQVAGRVPVLAGTGLSGTAKTIAQTRRAATLGAQYALVVTPPYVRPTQAGLLAHFQAVADNGGLPVLLYNVPGRTGCDLLPETVAALVSHPNIVGIKEARSEPERVAALVAMRSDSFVVLSGDDGSAAQSMLAGADGLVSVASNALPSAYRRLCDLARTGQHEAANAWDTRLSEYHSFCGIESNPIPVKALLQRAGIGHGLRLPLLPLS

SEQ ID NO: 16184 - protein, 593 aa, Xanthomonas campestris; identical to SEQ ID NO: 15434

SEQ ID NO: 16185 - protein, 567 aa, Xanthomonas campestris
QVTRGSGSFHIGAGTVISIVGGDADARRSAEYLAELLKRTRGLSLEVRNETSASPGSIRLERSAQAPVAQKEGYSLDSDAKGLRIQARDGAGLFYGTVSAWQLMTPDARKGDVEVPAVAIRDWPRFSWRGQHLDVARHFHDVATVKHVLDTMAVHKLNVLHWHLTDDQGWRIEIKRYPKLTEVGAWRTPPGAGQHGTPERYGGFYTQEQISEVVAYAARLHITVLPELDMPGHAQAAVAAYPEEVGVPGVRTQVGVDWGVNPYLFNTSERSLTFITNVLDEVLTLFPSTYIHIGGDEAVKDQWEASPAVRAQMRKLGVKDAHAMQGWFNEQLAQYLTQHGRRMIGWDEILEGGVPASAAVMSWRGIEGAVTAAKQGHDVVLAPGDSLYLDNLQTTRSDEPNGRLTTLPLSKVYAFNPVPAALNAEQARHVLGAQGALWAEYIPSRWHVDHALFPRLAAVAEVTWSPMAARDWKNFLARMPAQLQRYQALGIDYSDGAFAADIDLDGDVNAVLAGGPAKVSLGNQSGAGSLHYTVDGSDPTPDAPRYTAPFAIQLPTTVKATAFTDDG

SEQ ID NO: 16186 - protein, 311 aa, Xanthomonas campestris; identical to SEQ ID NO: 15805

SEQ ID NO: 16187 - protein, 266 aa, Xanthomonas campestris; identical to SEQ ID NO: 15804

SEQ ID NO: 16188 - protein, 451 aa, Xanthomonas campestris; identical to SEQ ID NO: 15807

SEQ ID NO: 16189 - protein, 359 aa, Xanthomonas campestris; identical to SEQ ID NO: 15808

SEQ ID NO: 16190 - protein, 214 aa, Xanthomonas campestris; identical to SEQ ID NO: 15811

SEQ ID NO: 16191 - protein, 320 aa, Xanthomonas campestris; identical to SEQ ID NO: 15809

SEQ ID NO: 16192 - protein, 255 aa, Xanthomonas campestris
RGQQPQPQDRQFPELLQDLYATANQRREGGAETFAPLANGWSRMDDSALQQAGIDPALLHDAKSGFDAAFYRNDQGQVVFGFCGTDEGKDWKHNIGQGLGFDDAQYASAIQLGSQAKQAFGDQVVISGHSLGGGLASASAMVNDIPAVTYNAAGVNDRTLEREGLDASAAKQYASEELIRGYHVKNEILTHLQEDSIPLKWTMPNAAGHQIELPEPDPLSFGQRLVPGMMLKHRLDLHGMDSVIKAQDMQSPDQA

SEQ ID NO: 16193 - protein, 424 aa, Xanthomonas campestris
PFTANRQFKARPRLLASAAGMYYRDVEGRQILDGTAGLWCCNAGHARERIVAAIRAQAGTLDFAPTFQMGSPLPFALAERLAALAPPGLGHVFFTNSGSEAVDSAMKIVLAYHRLRGEGQRTRFIGREKAYHGVGFGGMSIGGLPNNRKWFGPLLAGTDHLRHTLDLQRNAYSRGLPAFGVELADDLERLITLHDASTIAAVFVEPVSGSAGVILPPEGYLQRLRAICDRHGIVLVFDEVITGFGRVGEAFAAQRFGVTPDLITAAKGLTSGTVPMGAVLVADAIHDAFMHGPQAAIELFHGYTYSGHPLACAAALATLDTYAEEQLFTRAITLGPQWEEALYSLRGLPHVIDIRNIGLIGAIELAPREGAPGARGYEVFERCFHEGGLLVRVTGDVIALSPPLIVTPDQIGQMLETLAAILRK

SEQ ID NO: 16194 - protein, 255 aa, Xanthomonas campestris; identical to SEQ ID NO: 15444

SEQ ID NO: 16195 - protein, 636 aa, Xanthomonas campestris; identical to SEQ ID NO: 15813

SEQ ID NO: 16196 - protein, 469 aa, Xanthomonas campestris; identical to SEQ ID NO: 15446

SEQ ID NO: 16197 - protein, 377 aa, Xanthomonas campestris
SDAELARASALQKRLVTLDSHLDTPANLERGDFDVMQGHAGNRLSQVDYPRMLEGALDGGFWAVYTGQGNRSAAAHLDDRDAGLQRLMKIHNLLAAQPQRFALATTPADAARIKAAGKRVVYISMENASPLVADPSLLRFYYAQGLRLMSTVHFLNNEFADSATDPKGAEWKGLSPAGKQLVQQALGIVIDQSHASDAVFDQLIALSPVPIVLSHSGARAVYNHPRNIDDARLKVLAAHGGVIQVNSYGGYLIDSGASPERKAAEKALADQYGGWEHLKMSDGTALSEALKALDARYPVKRATEEDFFAHLEHVLAVAGPAHVGIGMDWDGGGGVVGLEDVSDLPRITAWLLRKGYSEPQIAGIWGGNLLRVMEQAQ

SEQ ID NO: 16198 - protein, 444 aa, Xanthomonas campestris
RIDRLPASATLWRLVGLLALGGFFELYDLFQTAYISPGLIRDGIFASGNDGAFGMSDQAAFAAATFLGLFVGAALLSPFADRFGRRLVFTVALVWYTAATVAMGLQSTATAVIVLRFVVGIGLGIELVTIDTYLSELVPRHMRGAAFAFAFFLQFLAVPSVALSAWLLVPHAPLGVSGWRWVVLLSGVFALAIWWLRSRLPESARWLAAQGRHAEAEAVMAQLEAACSRDLGRALPPPEPVQRVAAPDSRLSALWRQPYRGRIGMLVVFQIFQAIGFFGFGNWLPALINAQGAGVTKSLAYAFAISLAYPLAPLLLLRVAHRWENKWQISASALGAVVFGVLFALQHAPLGMIACGAMIAFCNAWMSFAYHGYQAELFPTALRARAVGFCYSFSRLSTAGSSVLIGWLLAQTGSHGVLAFIVISMTIVASVIAAFGPRTRNRAL

SEQ ID NO: 16199 - protein, 428 aa, Xanthomonas campestris; identical to SEQ ID NO: 15818

SEQ ID NO: 16200 - protein, 284 aa, Xanthomonas campestris; identical to SEQ ID NO: 15817

SEQ ID NO: 16201 - protein, 650 aa, Xanthomonas campestris
DISELGPAASACQNLDEFVNGAWAKANPIPADHTSWGIDELLTEKSLLIQRELLEAAAKQAGTQAPSLEQKIGALYASGMDEAAIEAAGAKPIQPQLDKIAALHSGKDVAAYIISRHGEGDAQVFAFGAGADFHNADQQIAFTQEGGLGLPTKDYYTGAEHAPIRAAYLAYIAKSFELTGTPAALAKTQANDVLALETRLAAASLAPVDAREPKNQYRLVTLAEADKLTPHFPWEDFFATQGVPVGSGFSLAQPRFFAAFDQALASAPIAQWQAYLRFHAIDDASTRLSKAFADNRFAFYGKTLSGQPEQLPRWKRVLRSVNGAMGEGVGQLYVAKVFTPDAKQRASELVDNVRAALKTRIEQVDWMSAETKAKALAKWQTFLPKIGYPDTWRDWSGLQITPGDYYGNLQAADTFNYRYDIAQIGKPTDRGRWSMTPQTVNAYYDPMTNSINFPAAILQPPYFDATADDALNYGGIGAVIGHEATHGFDDQGSQFDGAGNNVNWWTAEDRRKFDQRSNQLVKQFDAYAPLPSHPTLHVNGKLTLGENIADLGGTNVAYDALQTALQQHPERAKAIDGYSPDQRFFLAFARSWRQRVRDQQQMVYLASDPHAPAKLRAIASPSNMPQFATAFACKPGDAMVRPEKDRVVIW

SEQ ID NO: 16202 - protein, 643 aa, Xanthomonas campestris; identical to SEQ ID NO: 15821

SEQ ID NO: 16203 - protein, 694 aa, Xanthomonas campestris
IRQGRPFPRGAIFDGKGTNFALFSAHATRVELCLFDEQGNESRVDLPEYTNEIWHGYLPDVKPGQRYGYRVHGPYAPTEGHRFNHNKLLLDPYARELDGDLVWADELYGYTVGHPDGDLSFDERDSAPFMPKCVVVEDTYDWEDDARLLKPWNETVIYETHVRGYTMRNAQVPEAVRGTFAGLAQPSVLQYIKDLGITAVELLPVHAYLDDQHLLDKGLRNYWGYNTISFFALKSRHLSSGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGETDNADILQLRERQMKNLLATLLLSQGTPMMLAGDERAQSQGGNNNTYCQDNEITWLDWENDPTDGRLTDFVKSLTALRKRYPILSRGRFLNGQYNEEAGLRDLTWLNPGGTEMDDAHWTDAGARSVGLLLEGKAQTSGVKERGNDATLLIVINAYHEGVTFTLPSSDEPVHWKLALSTDEALEVDSMPAGASEFLAPPRSITVFECKV

SEQ ID NO: 16204 - protein, 291 aa, Xanthomonas campestris; identical to SEQ ID NO: 15454

SEQ ID NO: 16205 - protein, 386 aa, Xanthomonas campestris; identical to SEQ ID NO: 15823
  unsure (1)..(386): unsure at all Xaa locations

SEQ ID NO: 16206 - protein, 660 aa, Xanthomonas campestris
GLACIAMLLSYYGHETSLGELRNRFTVSTSGATLASLIEIADANGLTTRPLRLELYELPKLSLPCMVHLHHGHFVVLTAVRGGHVHISDPATGVKKIKLDEFDELFSGIALEAHPGPAFKKIKSVPSVSLRDLAGSLRSLVPAFWGVGILALFLEGCALIAPQYLRLTMDQVLSVKDDGLVTTLAIGFSIVLLVQLVLTVARKWTLLWISSTTGLRWSSNLFRHLVSLPQSYFVKRHTGDISSRFQSIYSIQQSLTTKMMEAVIDGVMSFLMLLLLMSYDAPLAFALLAFTIAYVGSRYAYYAKLKEANLDQINIDARRQSLLYETVRSIQPIKLFNKSALWASRFTNYSAKATNATIGAERIRIGFDSVQLLIQGLCRIFVIWEGTRLVLSGDMTIGVLTVFLIYATQFSQRSINLADYLMQLRLLRLHTERISDITHSEPESFLHGNGALEDAAPAIAIANGYFRYSSTDKWIMSALQLRAPAGQVIAIVGNSGVGKTTLIRVLAGLEDLQVGDFLVNGEDLRKVGKSSYRSKVSIVMQGDNLLSGTLSENISMFDEHIDQERLVQAAKLACIHDDIQRMPMGFNTRVGDLGNTLSGGQKQRIFLARAFYRRTKLLLMDEPTTGVDEQMGIQLMKNIKSIGATTVVVTHDKNISRMCD

SEQ ID NO: 16207 - protein, 251 aa, Xanthomonas campestris
MTASESPVVQLSGVRIDRGGRAILRDVSLDVPRGSITAVLGPSGSGKSTLLAALTGELRPVAGRVTLFGQEIPRGSRALLEMRRNVGVLLQGNGLLTDLSVADNVALPLRTHTRLPAPVLQRLVQMKLHAVGLLAAADAWPRELSGGMARRVALARALALDPPLMIYDEPLTGLDPIASGVIMSLIQRLNDSLDLTSIIVSHHVHETLPICDQAVVIANGGIVFAGTPEQLQDSTDPLVQQFLHGQPDGPI

SEQ ID NO: 16208 - protein, 397 aa, Xanthomonas campestris; identical to SEQ ID NO: 15828

SEQ ID NO: 16209 - protein, 330 aa, Xanthomonas campestris; identical to SEQ ID NO: 15829

SEQ ID NO: 16210 - protein, 495 aa, Xanthomonas campestris; identical to SEQ ID NO: 15459

SEQ ID NO: 16211 - protein, 1332 aa, Xanthomonas campestris; identical to SEQ ID NO: 15830

SEQ ID NO: 16212 - protein, 430 aa, Xanthomonas campestris; identical to SEQ ID NO: 15462

SEQ ID NO: 16213 - protein, 423 aa, Xanthomonas campestris; identical to SEQ ID NO: 15464

SEQ ID NO: 16214 - protein, 553 aa, Xanthomonas campestris
GHAASRGNALGRARVRQSHTPEVAEQRVPANQVETQLQRLHAAIAAARTEMQQLRDRLHGALAREVGEFLELHALLLDDPELLQGLDDLIRTHRYSADYALRVQRDRLAAVFDGMEDAYLRSRMDDLDHVIGRIHAFLHKRAPDLKGVAGEILVCDNVAPSELAQLQAQGVVGIVTTAGSALSHSAILARSLHLPLVVGVADAVQRVNDGDVLIVDAGSGQVIVDPTPEHLRDYRERLRTLAKEQRELGRLRSKPTRTRDNVDITLLANAESLEDVAKAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILLVRKQLKKLTAQLRDEGHEIAEHIPLGAMIEVPAAALALDCFIDDIDFLSIGTNDLVQYLLAVDRNNEALGELYSPLHPAVLRLIAQVIATGRAHNKPVAVCGEIAGDPRFVAMLLALGLTEFSLHPATLLEVRRAVRDLHLGQLRVHGEKLLRARD

SEQ ID NO: 16215 - protein, 251 aa, Xanthomonas campestris; identical to SEQ ID NO: 15835

SEQ ID NO: 16216 - protein, 248 aa, Xanthomonas campestris
DYAQGHLPGAHFANLHDALADVSRPGQGRHPLPHSDVFAAQLGRWGITPDSQVVVYDAADGSMAAARAWWMLRLMGHRRVAVLDGGLAAWRAAGLPETTAVPSPADSGAYPGSFDADAVVDAEAILARLDAAPGWLLDARAGERFRGEVEPIDPVAGHVPGAVSRPLGMSLRDGRFKPAAELRAELGALLCDYAPEQAVVMCGSGVTACHLLLALEVAGLSGARVYAGSWSGWLQDRSRPVAVASQLQ

SEQ ID NO: 16217 - protein, 544 aa, Xanthomonas campestris; identical to SEQ ID NO: 15468

SEQ ID NO: 16218 - protein, 444 aa, Xanthomonas campestris; identical to SEQ ID NO: 15836

SEQ ID NO: 16219 - protein, 253 aa, Xanthomonas campestris; identical to SEQ ID NO: 15840

SEQ ID NO: 16220 - protein, 284 aa, Xanthomonas campestris
GSEKGGRITREDVQRFVKAALSGGAPAAAGAAPAGGGNGLNLLAWPKVDFSKFGETETQPLSRIKKISGANLARNWAMIPHVTQFESADITDLEALRVALNKENEKAGIKLTMLAFLIKASAAALKKFPEFNASLDAAGENLTLKKYINIGFAADTPNGLVVPVIRDVDKKGVLQIAQESGELAKKARDGKLGPADMSGGCFSISSLGGIGGTAFTPIINAPEVAILGVSKSAMQPVWNGKDFAPKLMLPLSLSYDHRVIDGALAARFTTYLSQVLADMRRVLL

SEQ ID NO: 16221 - protein, 436 aa, Xanthomonas campestris
LEHYGRDWTRRWTPNPLAIALPGSVEEVQAVVRWANTHAVAVVPSGGRTGLSGGAVAANGELVLSLERLNKPLAFDAVDRTLTVQAGMPLEAVHNAAREHGLVYPVDFAARGSCSIGGNIATNAGGIRVIRYGNTPRMVAGLSVVTGTGELLHLNNALVKNSSGYDFRHLMIGSEGTLGIVVEATLRLTDLPPPSNVMLLALPSFDVLMQVFAAFRAQLRLEAFEFFTDRALEHVLAHGAQAPFAQVHPYYVVTEFAAGDEAQEAAAMAAFEACMEQGWVSDGVISQSDAQAAQLWRLREGITEALARYTPYKNDVSVRISAMPAFLAETQALLHDAYPHFDVVWFGHIGDGNLHINVLKPDATSQADFITACEQVTKLLAQSLQRFDGSISAEHGIGLVKKPYLWSTRSAAEIALMRGIKQVLDPHLLLNPGKLF

SEQ ID NO: 16222 - protein, 237 aa, Xanthomonas campestris; identical to SEQ ID NO: 15843

SEQ ID NO: 16223 - protein, 374 aa, Xanthomonas campestris; identical to SEQ ID NO: 15844

SEQ ID NO: 16224 - protein, 1080 aa, Xanthomonas campestris; identical to SEQ ID NO: 15845

SEQ ID NO: 16225 - protein, 677 aa, Xanthomonas campestris; identical to SEQ ID NO: 15476

SEQ ID NO: 16226 - protein, 560 aa, Xanthomonas campestris
MSQARPWLQSYPAGVAAEIDLEQFRTVAEVFATSVARFADRPAYHSFGKTITYREADQLVDQFAAYLLGELQLKKGDRVALMMPNCLQYPIATFGILRAGLTVVNVNPLYTPRELKHQLIDSGASVLVVIDNFGTTVQQVIADTQVKQVITTGLGDMLGFPKAALVNFVVKYVKKLVPEYRINGAIRFRDALALGRKHRVPTLQIEPDDIAFLQYTGGTTGVAKGAMLTHRNLVANMQQAHQWLAGTGKLEEGHEVVITALPLYHIFALTANGLVFMKIGGCNHLISNPRDMPGFIKELKKTRFTAFTGVNTLFNGLLNTPGFDQIDFSSLKMTLGGGMAVQRSVAERWKQVTGLTLVEAYGLTETSPAACINPMDLVDYNGSIGLPIPSTDACIKDDDGKVLALGEIGELCIKGPQVMKGYWKKADETAKVMDAEGWLHTGDIARMDERGFVYIVDRKKDMILVSGFNVYPNEIEDVIATMPGVLEVAAVGVPDEKSGEIVKVVIVKKDQALTAEDVKAHCRTNLTGYKQPRVIEFRKELPKTNVGKILRRELRDAAKA

SEQ ID NO: 16227 - protein, 145 aa, Xanthomonas campestris
DAPLLLLPGRGTRLKGHADGLQLLAAVRAAGLPAWLWLPGAREPGREAYIRELEAEKARLGVADAVAFTEPTARIAEAYAASDLVLQLSRKPEAFGRTVIEALAVGRPVLGWAHGGAGELLAELQPAGAVPPFDAQALAQQALAL

SEQ ID NO: 16228 - protein, 421 aa, Xanthomonas campestris
PFYRQLYFQVVVAIVLGALLGHFEPAFAESLKPLGDAFIKLVKMIIAPVIFLTIVTGIAGMTHLKTVGRVFAKSMTYFLFFSTLALIVGMVVAHAVQPGAGMNINPAELDQSAVNTYVQKSHELSLVGFLMDIIPATLISAFVDGNILQVLFVAVLFGIALALVGERGRPVLSFLEALTAPVFRLVHMLMKAAPIGAFGAIAFTIGKYGVESLVNLAWLVGSFYLTSLFFVLVILGIVCRLCGFSVLKLIRYLKAELLLVLGTSSSESALPSLMEKMEKAGCEKSVVGLVVPTGYSFNLDGTNIYMTLAALFIAQATNVDLTLGQQITLLAVAMLSSKGAAGVTGAGFITLAATLSVVPDVPVAGMALILGVDRFMSECRSLTNFIGNAVATVVVSRWENALDRDQLSLALDGRAPPLQAP

SEQ ID NO: 16229 - protein, 314 aa, Xanthomonas campestris; identical to SEQ ID NO: 15851

SEQ ID NO: 16230 - protein, 931 aa, Xanthomonas campestris; identical to SEQ ID NO: 15855

SEQ ID NO: 16231 - protein, 404 aa, Xanthomonas campestris; identical to SEQ ID NO: 15485

SEQ ID NO: 16232 - protein, 478 aa, Xanthomonas campestris; identical to SEQ ID NO: 15486
  unsure (1)..(478): unsure at all Xaa locations

SEQ ID NO: 16233 - protein, 446 aa, Xanthomonas campestris; identical to SEQ ID NO: 15482

SEQ ID NO: 16234 - protein, 454 aa, Xanthomonas campestris
RIEHDSMGELQVPADALWGAQTQRAVQNFPISGQPMPRGFIRALGLIKAAAAGVNADLGLLSKSVAKVVQEAALQVAQGTHDAHFPIDVYQTGSGTSSNMNANEVIATLATRAGKDAVHPNDHVNLGQSSNDVVPTAIRVSALLAVQEQLQPALKHLRKTIDKRAKGLDKIVKTGRTHLMDAMPLTFGQEFGAWSAQLSSAQERIDDSLKRLRRLPLGGTAIGTGINADARFGGKVAKALSTLSGVKFESAENKFEGLAAQDDAVELSGQLNALAVALIKIANDLRWMNAGPLAGLGEIELPALQPGSSIMPGKVNPVIPEATVMVCAQVIGHHTAITVAGQTGNFQLNVALPLIAANLLDSINLLSNVSRLLADTAIAGLKVRQERVREALDRNPILVTALNPIIGYEKAAAIAKRAYKEQRPVLDVAKEDSGLSEAELRRLLDPAALTRGGI

SEQ ID NO: 16235 - protein, 640 aa, Xanthomonas campestris
MGKIIGIDLGTTNSCVAIMDGGKARVIENSEGDRTTPSIVAYTKDGEVLVGASAKRQAVTNPKNTFYAVKRLIGRKFTDGEVQKDISHVPYGILAHDNGDAWVQTSDSKRMAPQEISARVLEKMKKTAEDFLGEKVTEAVITVPAYFNDSQRQATKDAGRIAGLDVKRIINEPTAAALAYGLDKNGGDRKIAVYDLGGGTFDVSIIEIAEVDGEKQFEVLATNGDTFLGGEDFDNRVIEYLVDEFNKDQGIDLRKDPLALQRLKDAAERAKIELSTSQQTEVNLPYVTADASGPKHLNIKLTRAKLEALVEDLVKKSIEPCRTALNDAGLRASDINEVILVGGQTRMPKVQQAVADFFGKEPRKDVNPDEAVAVGAAIQGGVLAGDVKDVLLLDVTPLSLGIETMGGVFTKIIEKNTTIPTKASQTFSTAEDNQSAVTVHVLQGEREQARFNKSLAKFDLSGIEPAPRGMPQVEVSFDIDANGILHVSAKDKKTNKEQKVEIKAGSGLSDEEIQRMVADAEANREEDKKFQELVQTRNQADGLIHATRTAITEHGSKVGGDVIGKVEAALADLETAMKGDDKAQIEARSKTLEEAGQSLYAAAAAAEQGGNADAASGNAQASKAADDVVDAEFTEVKDDK

SEQ ID NO: 16236 - protein, 215 aa, Xanthomonas campestris; identical to SEQ ID NO: 15862

SEQ ID NO: 16237 - protein, 388 aa, Xanthomonas campestris; identical to SEQ ID NO: 15491

SEQ ID NO: 16238 - protein, 336 aa, Xanthomonas campestris; identical to SEQ ID NO: 15863

SEQ ID NO: 16239 - protein, 351 aa, Xanthomonas campestris
VATWLVTGGAGFIGGNFVLEAVSRGIRVVNLDALTYAGNLNTLASLEGNADHIFVKGDIGDGALVTRLLQEHQPDAVLNFAAESHVDRSIEGPGAFIQTNVVGTLALLEAVRDYWKALPDTRRDAFRFLHVSTDEVYGTLGETGKFTETTPYAPNSPYSASKAASDHLVRAFHHTYGLPVLTTNCSNNYGPYHFPEKLIPLVIAKALAGEPLPVYGDGKQVRDWLFVSDHCEAIRTVLAKGRVGETYNVGGNSERQNIEVVQAICALLDQHRPREDGKPRESQIAYVTDRPGHDRRYAIDASKLKDELGWEPAYTFEQGIALTVDWYLTNQTWVQGVLDGSYRLERIGATV

SEQ ID NO: 16240 - protein, 430 aa, Xanthomonas campestris; identical to SEQ ID NO: 15861

SEQ ID NO: 16241 - protein, 448 aa, Xanthomonas campestris; identical to SEQ ID NO: 15866

SEQ ID NO: 16242 - protein, 518 aa, Xanthomonas campestris; identical to SEQ ID NO: 15498

SEQ ID NO: 16243 - protein, 476 aa, Xanthomonas campestris
VDLFRHLTGHPMRYFTEHFAGALGNRITALGTAAGQIYGGLAWKILPPIVDFIGAIVVLFTVDWRMAATLIGFVAVVAAIITGFGIRGRAKHQSFAAQAARVGGELVDAVSNVWTIKAFAARDRESARLAQEIGHEAVAHRRSWMYVEKARVIHDICLSIMAGGMLIWAISAWRGGAVSAGDVVLVSALTFRILHGSRDLALTLVDTTQQLGAIADTLQIILQPHALPDADAPLALAEGDVRFEGVRFAYPDRPAVIEALDLHIPAGQKVGIVGPSGAGKSTLIALIQRLDDVESGRVLIDGQDIRSVSQDSLRDRIAVVPQETALFNRSIADNIRYGRPEASDAEVHTAARHAFCDGFIRDLPQGYNTLVGERGVMLSGGQRQRLGIARAFLKDAPILILDEATSALDTESEAEIQSALDHLMRGRTVLAVAHRLSTVIGFDRIVVLQDGRIVEDGSPAELRGRGGVFDSLWQRQ

SEQ ID NO: 16244 - protein, 261 aa, Xanthomonas campestris
KMDPRPDHGEDSYVGHGQLKGKRALITGGDSGIGAAVAIAYAREGADVAIAFLPDEQEDASRIGALIEKAGVRALLVGCDISDPNQAASLIDKVNSEFGGLDILVNNAGYQKYFENFEEITLDEWRKTFDTNVHAVFNLVRLSVPLMKDGGSIINTASVQSKKPTPNILPYGATKGALANLTIGLAGVLAEKQIRVNAVLPGPIWTPFIPAGMDEDSVESFGSQTPMGRPGQPVELASAYVMLASDTASYTSGTLLTISGG

SEQ ID NO: 16245 - protein, 653 aa, Xanthomonas campestris; identical to SEQ ID NO: 15499

SEQ ID NO: 16246 - protein, 353 aa, Xanthomonas campestris; identical to SEQ ID NO: 15871

SEQ ID NO: 16247 - protein, 389 aa, Xanthomonas campestris; identical to SEQ ID NO: 15872

SEQ ID NO: 16248 - protein, 262 aa, Xanthomonas campestris
VLVDATASDVVADWHVEWLTRGVHVVTANKLGQGTALSRAQDLYAARHASGAYYGDSATVGAGLPLLSSVRALVAGGDQIHSIEGVLSGSLAWLFHRYDGSAPFSACVREAMAAGYTEPDPRIDLSGEDVRRKLLILARAAGQPLEAEQVHVESLVPAALASVAPEAVDAHLETLDALVRTRWQQARAAGRCLRFVGRVDEHGASVGLRELALDHPLAGGAGTDNRVAISSDRYRDQPLLIQGPGAGAEVTAAALLDDVLRI

SEQ ID NO: 16249 - protein, 374 aa, Xanthomonas campestris
VRAGIDRDTAYGAVTPPIVLSSNFSFDGFGNKRQYDYTRSGNPTRDLLGEALAELEGGAGGVITSTGMGAINLVLNALLQPGDTLVVPHDAYGGSWRLFNALAKKGHFALITADLTDPRSLADALAQSPKLVLIETPSNPLLRITDLRFVIEAAHKVGALTVVDNTFLSPALQKPLEFGADVVLHSTTKYVNGHSDVVGGAVIARDAELHQQLVWWANALGLTGSPFDAFLTLRGLRTLDARLRVHQENADAIAVLLDEHAAVNQVYFPGLASHPGHALAARQQKGFGAMISFELNGGEAAVRAFVDGLRYFTLAESLGGVESLIAHPASMTHAAMTAEARAAAGISDGLLRLSVGIESAEDLLIDLRAGLARA

SEQ ID NO: 16250 - protein, 129 aa, Xanthomonas campestris; identical to SEQ ID NO: 15875

SEQ ID NO: 16251 - protein, 523 aa, Xanthomonas campestris; identical to SEQ ID NO: 15504

SEQ ID NO: 16252 - protein, 441 aa, Xanthomonas campestris; identical to SEQ ID NO: 15879

SEQ ID NO: 16253 - protein, 295 aa, Xanthomonas campestris; identical to SEQ ID NO: 15881

SEQ ID NO: 16254 - protein, 432 aa, Xanthomonas campestris; identical to SEQ ID NO: 15510

SEQ ID NO: 16255 - protein, 429 aa, Xanthomonas campestris; identical to SEQ ID NO: 15506

SEQ ID NO: 16256 - protein, 391 aa, Xanthomonas campestris; identical to SEQ ID NO: 15883

SEQ ID NO: 16257 - protein, 476 aa, Xanthomonas campestris; identical to SEQ ID NO: 15884

SEQ ID NO: 16258 - protein, 339 aa, Xanthomonas campestris; identical to SEQ ID NO: 15885
  unsure (1)..(339): unsure at all Xaa locations

SEQ ID NO: 16259 - protein, 623 aa, Xanthomonas campestris
SLLPNPGAISTYLQQHESKPLLRFITCGSVDDGKSTLIGRLLYDSKRLFDDQLAALESDSKRHGTQGDGIDYALLMDGLAAEREQGITIDVAYRYFDTDQRKFIVADCPGHEQYTRNMATGASTADVAVVLVDARKGVLVQTRRHSYIVSLLGIRHVVLAVNKMDLVDYDAQVFATIVDSYRALAAQLGIADVQCIPLSALAGDNLSSASTRMPWYQGPHLLQHLDSVQLETPDAVSGLRLPVQWVNRPSAQFRGYAGTIAAGQVRTGDAVVVVPSGRRAHVASVLDANGVVDSARAGQAVTLTLREEIDISRGDIIAAVDDPPEVADQFAAHVLWMDDAALLPGRPYWLKIGTRTVTASISEIKHKVDVNTQERLAAKRLELNEVGYCNLSLDEPIAFAPYARNRVLGGFILIDRQTNATVAAGALEFALRRAGNVHWQHLDVDRAARARIKGQAPRVLWFTGLSGAGKSTVANLVDKRLHALGYHTFILDGDNVRHGLNRDLGFTDEDRVENIRRVAEVARLMADAGLIVLVSFISPFRAERQLARERFDSGEFVEVFVDVPLAVAEARDVKGLYRKARAGQIPNFTGIDSPYEAPERPEIHLHADGENVEALARHVLEYL

SEQ ID NO: 16260 - protein, 856 aa, Xanthomonas campestris; identical to SEQ ID NO: 15889

SEQ ID NO: 16261 - protein, 228 aa, Xanthomonas campestris; identical to SEQ ID NO: 15886

SEQ ID NO: 16262 - protein, 557 aa, Xanthomonas campestris
VEDIKSTSRRLRGSLEQSLADPVTGALREDDQTLIKYHGSYQQDDRDIRDERRRQKLEPAYQFMIRTRTPGGVISPSQWLALDGIATRYANHSLRITTRQAFQFHGVIKRELKATMQAINATLIDTLAACGDVNRNVQVAANPLLSQAHATLYADAARVSEHLLPNTRAYYEIWLDEERVSGSGAEDEPIYGDRYLPRKFKIGFAAPPHNDVDVFANDLGFIAILREGQLLGYNVSIGGGMGASHGDAETWPRVANVIGFVTRDQLLDIATAVVTTQRDLGNRAVRKRARFKYTIDDHGLDTIVAEIERRAGFSLQPAQPFAFAHNGDRYGWVEGEQGDWHLTLSLPAGRIADTDTAAHLSGLRAIAQLQMGEFRMTPNQNLVIAGVPAEQRAQIDQLVAQYGLDAGNLAPTALARGAMACVALPTCGLAMAEAERYLPDFSAALQPLLERHGLAQTPIVLRLSGCPNGCSRPYLAEIALVGKAPGRYNLMLGGDRRGQRLNTLYRENINEADILAALEPLLARYAAERDQHADEGFGDFLHRSGLIALPPYPTHRH

SEQ ID NO: 16263 - protein, 753 aa, Xanthomonas campestris; identical to SEQ ID NO: 15890

SEQ ID NO: 16264 - protein, 318 aa, Xanthomonas campestris; identical to SEQ ID NO: 15891

SEQ ID NO: 16265 - protein, 251 aa, Xanthomonas campestris; identical to SEQ ID NO: 15521

SEQ ID NO: 16266 - protein, 244 aa, Xanthomonas campestris; identical to SEQ ID NO: 15893

SEQ ID NO: 16267 - protein, 275 aa, Xanthomonas campestris; identical to SEQ ID NO: 15523

SEQ ID NO: 16268 - protein, 736 aa, Xanthomonas campestris; identical to SEQ ID NO: 15895

SEQ ID NO: 16269 - protein, 141 aa, Xanthomonas campestris; identical to SEQ ID NO: 15526

SEQ ID NO: 16270 - protein, 248 aa, Xanthomonas campestris
TYNVNGIASRLPHLLQWLQREQPDIVGLQELKSTQEAFPEQAIRDAGYGVIWQGQRSWNGVALLARGAEPVEIRRGLPWDPADTQSRYLEAAIHGVIVGCLYLPNGNPQPGPKFDYKLKWFQRLLRHAATLVALPHPVALIGDFNVVPTDAHIYDPKGWRKDALLQPESRAAYAQLLAQGWTDSLQAIHGDAPVYTFWDYFRQHFARDRGLRIDHLLLNRTLAAGLRDAGVDKWVRALEKASDHAPPW

SEQ ID NO: 16271 - protein, 708 aa, Xanthomonas campestris; identical to SEQ ID NO: 15900

SEQ ID NO: 16272 - protein, 395 aa, Xanthomonas campestris; identical to SEQ ID NO: 15525

SEQ ID NO: 16273 - protein, 1380 aa, Xanthomonas campestris; identical to SEQ ID NO: 15530

SEQ ID NO: 16274 - protein, 275 aa, Xanthomonas campestris; identical to SEQ ID NO: 15902

SEQ ID NO: 16275 - protein, 477 aa, Xanthomonas campestris; identical to SEQ ID NO: 15532

SEQ ID NO: 16276 - protein, 327 aa, Xanthomonas campestris; identical to SEQ ID NO: 15904

SEQ ID NO: 16277 - protein, 481 aa, Xanthomonas campestris
PRVSLLIDGALVVSATTHWQDVVNPADQSVLAQVPFATPAEVDAAVAAAQQAFVGWRKTPIGTRARIFLKYQQLIREHMPELAAILSAEQGKTLADAEGDVFRGLEVVEHAAAIGNLQLGELANNVANGVDTYTLLQPLGVCAGITPFNFPAMIPLWMFPMAIATGNTFVLKPSEQDPMVTMRLVELALEAGIPKGVLNVVHGGEEVVNALCDHPDIKALSFVGSTKVGTHVYRRASLAGKRVQCMMGAKNHAVVLPDANQEQTLNAMVGAAFGAAGQRCMAASTLVLVGEARQWIPALVAKARGLKLGAGSTPGTDVGPLISCAARERVEGLIASGVAQGATLELDGRTPQVPGLEHGNFVGPTIFSGVTPGMRIYDEEIFGPVLVILEAATLEEAIALVNANPNGNGTALFTQSGAAARRFQEDIDVGQVGINVPIPVPVPLFSFTGSRASKLGDLGPYGKQVVMFYTQTKTITARWFD

SEQ ID NO: 16278 - protein, 377 aa, Xanthomonas campestris; identical to SEQ ID NO: 15907

SEQ ID NO: 16279 - protein, 165 aa, Xanthomonas campestris; identical to SEQ ID NO: 15908

SEQ ID NO: 16280 - protein, 391 aa, Xanthomonas campestris; identical to SEQ ID NO: 15538

SEQ ID NO: 16281 - protein, 623 aa, Xanthomonas campestris; identical to SEQ ID NO: 15911

SEQ ID NO: 16282 - protein, 435 aa, Xanthomonas campestris; identical to SEQ ID NO: 15541

SEQ ID NO: 16283 - protein, 313 aa, Xanthomonas campestris
QLETLRVALLGKNGSITAQLKQLGTLPADQRKAAGEAINLARDALTTALSERKQVLETAALDARLEGERIDVTLPGRRGERGGLHPVTRTLERIVEIFARLGYELSDGPEIEDDWHNFEALNFPPHHPARAMHDTFYFGDGRLLRTHTSGVQVRYMDTAVATKSGPPLRMIAAGKVYRSDSDQTHSPMFHQVEGLLVDEHSNFADLKGTLSEFVRAFFERDFEMRFRPSYFPFVEPGAEVDIAWQQPDGSTRWLEVLGCGMVHPNVLRSVGIDPERYTGFAFGLGVERFAMLRYGVNDLRAFFENDVRFLRQF

SEQ ID NO: 16284 - protein, 203 aa, Xanthomonas campestris; identical to SEQ ID NO: 15545

SEQ ID NO: 16285 - protein, 367 aa, Xanthomonas campestris
DLFDVRAQLSDDERAVQDAVARFTDARVLPGIGEAFDAVRFPRELVPELAALGLLGASLPVSEGGAGLGAVAYGLICQELERGDSGLRSFVSVQSSLCMYPIHAYGSDAQRRQWLPEMAAGRVIGCFGLSEAQGGSDPAAMTTRAVRDGDGWRLRGAKMWITNGSIADLAIIWAHTDDGVRGFLVDTRSEGFRAQDIGHKMSLRASVTSAVFLDDVFVPEQQRLPDALGLKAPLGCLSQARFGIAWGAIGAAVACLREALAYSGERILFGRPLAATQSAQIKLADMARRIATAQLLALQLGRLKEAGTLRPEQISLAKWNNCRMALDVARECRDLLGAAGITTEHVAIRHALNLESVITCEGTETVH

SEQ ID NO: 16286 - protein, 676 aa, Xanthomonas campestris
STLPLHYPQFDKIKDSDFAPAFDAGMAAQLKEVDAIANQKAKPTFDNTIIALEKSGATLDRATTVFFNLVGADTNDARKKLQADYSAKFAAHRDAISLNGKLFARIQTLYDQRSKLGLDAQGVRLVEKYYSDFVRDGAKLSDADKTTLKAMNAELANLGTTFSQNVLAEVNAAAVVVDDVKQLDGLSDEQIAAAAEAAKARKLDGKYVIALLNTTGQPPLTQLKNRELRKKIYAASVSRGSHGGQYDNTALVSRIMTLRANKAKLLGFPTYAAYSLENQTAKTPEAVNAMLGKLAPAAVANAKREAADLQAMIDKEQKAARKPTFKLEAWDWAYYSEKVRQAKYNFDESQLKPYFELKNVLENGVFYAANQEYGLTFKQRTDLPTYRDDITVYDVFDADGKQLAIFIADMYARESKRGGAWMNSYVSQSELTGFKPVVANHLNIPKPPAGQPTLLTWDEVTTMFHEFGHALHGMFSDVKYPYFSGTSVPRDFVEFPSQVNEMWADEPSILKNYAKHYQNGTPMPQALLDKVIAASKFNQGFATTEYLGAAMLDQNWHQISANQVPDAAGVMAFEAKALADDGIAYPPVPPRYKTPYFSHIMGGYAAGYYAYIWSEVLDANTQQWFKQHGGLSRANGDRFRQTLLSRGGSVDAMELFQNFAGHAPQIEPLLEKRGLS

SEQ ID NO: 16287 - protein, 175 aa, Xanthomonas campestris
FTDPKALALALAAEQGDAEEVRRLMKVEGVNPDTIFSKDGYPLLFWPIFTHNPTGLKAMLDNGADPNVAKPYPPEPGRNQTNVSNAMVWAAEQDDPLYLKLLLDHGGNPNTRNANNESLLFHAFIKQNKWDNIKLLVERGADINAVAGMGNSITAAYAIRGGFDFVYWLLQHGAD

SEQ ID NO: 16288 - protein, 254 aa, Xanthomonas campestris; identical to SEQ ID NO: 15922

SEQ ID NO: 16289 - protein, 636 aa, Xanthomonas campestris; identical to SEQ ID NO: 15920

SEQ ID NO: 16290 - protein, 264 aa, Xanthomonas campestris; identical to SEQ ID NO: 15923

SEQ ID NO: 16291 - protein, 491 aa, Xanthomonas campestris
  unsure (1)..(491): unsure at all Xaa locations
TEEGVWKPXPRPCVASPRVDRGGLFIDGQWRASTGSQTLDVIAPHTEERLLRYTEPSHADTEAAVAAARRAFDSGPWPQLPPPERGAALKRIAEHLRARMPELADAWTAQVGAVIGFSRRASKQAPDLFDYYGDLITTHPFVEPRTRSSGGRVHVVQEPVGVVVAITPWNAPLVLLCYKVAAALAAGCTVVAKPSPETPIDAYILAECISAAGLPDGVFNLLPAGREVGEQLIRHPSVDKVSFTGSTQAGRSIGVACAERLARVGLELGGKSAAIVLEDADIEKVLPSLVPYSMPITGQVCFALTRVLVPAHRREAILHAYCSALATLKLGDPFAADTGMGPLALGRQLERVQGYIAQGSAEGAKLVMGGGRPEHLPRGFFLEPTVFAGVTPEMTIAREEIFGPVVSFIDYHNEEDLIAKVNDSDYGLHGTVYSDDPERAYAIARRVRSGSHSINGMCVDIEMPFGGVKHSGIGREGGIEGLHGFLETKTI

SEQ ID NO: 16292 - protein, 457 aa, Xanthomonas campestris
WTYAELDDLIGRLAAVLQTRGCVDGERLAVLARNSVWQVALHFACARVGAIYVPLNWRLSGTELDALLQRAEPRLLLGDDVAAGRAQVEGFARFIDNAKQLAPAETPYIPPDRVSLILFTSGTSGQPKGVMLSEQNLQQVAHNFGVTTRVEAHSSFLCEAPMFHIIGLATNVRPVLAMGGSIQVSNGFEPKRTLGWLGNPALGITHYVGVPQMMQAFRSQPGFDPAALRHLTALVSGGAPHASEDLLGWLEDGIPMVCGFGMSEAGTVFGMSVDCEVIRSKLGAAGISSPTVQTRVVDNEGNDCEVGMPGELLLRGPNLSPGYWRDPQATAEMRDGAGWFRTGDIVRRDADGFFWVVDRKKDMFISGGENVYPAEIEAVLADHPEIRECAVVGMADAQWGEVGYLAIVPATETPDLERIRSYLSERLAKYKVPKHLRVVAALPRTATGKLQKARLKD

SEQ ID NO: 16293 - protein, 234 aa, Xanthomonas campestris; identical to SEQ ID NO: 15554
  unsure (1)..(234): unsure at all Xaa locations

SEQ ID NO: 16294 - protein, 162 aa, Xanthomonas campestris
LSLIVAFDRNHAIGRDNDLPWKLPDDLKRFKALTLGKPILMGRKTAQSLGRALPGRLNLVLTRSGQVPFEGMHAVVSVDEAIERAAQEGAQELCVIGGGEVYRLTMERADLLAVTEVDTAVEGADTHFPPIDPAVWVPAERSAHAADARHAFAFSFVDYQRR

SEQ ID NO: 16295 - protein, 143 aa, Xanthomonas campestris; identical to SEQ ID NO: 15928

SEQ ID NO: 16296 - protein, 280 aa, Xanthomonas campestris; identical to SEQ ID NO: 15931

SEQ ID NO: 16297 - protein, 303 aa, Xanthomonas campestris; identical to SEQ ID NO: 15556

SEQ ID NO: 16298 - protein, 460 aa, Xanthomonas campestris; identical to SEQ ID NO: 15557

SEQ ID NO: 16299 - protein, 594 aa, Xanthomonas campestris
GFERPTAPVVREVAIGETITVADLAQKLALKGGDVVKALFKMGVMATITQSIDHDTAALVTEELGHKAVRADNADFEDALLAHAEDAQGETTSRPPVVTIMGHVDHGKTSLLDYIRRTKIASGEAGGITQHIGAYHVETGRGVISFLDTPGHAAFTSMRARGAKITDIVVLVVAADDGVMPQTKEAVAHAKAAGVPLIVAVNKIDKAGADPLRVKNELLAENVVAEDFGGDTQFIEVSAKVGTGVDTLLDAISLQAEVLELKAVADGRASGTVIESSLDKGRGPVATVLVQQGALKRGDYLVCGIQYGRVRALFDETGHQPASAGPSIPVQVLGLSGVPEAGDDFVVVDDERLAKDVAQQRETKRRESRLVASATNRMEDILAQMGKGEGQQVLNLVIKADVQGSVEALKQSLVALSNDDIRINVIHSGVGGITESDANSAAASKATIIGFNVRADASARKIVESNGIDLRYFSIIYDVIDQVKQVASGLLGVEIREEIIGIAQVRDVFRSSKFGAVAGCMIIEGVVKRSKPIRVLRDSVVVFEGELESLRRFKENVDEVRNGTECGIGVKAYNDVKAGDQIECFERIEVARTL

SEQ ID NO: 16300 - protein, 477 aa, Xanthomonas campestris; identical to SEQ ID NO: 15933

SEQ ID NO: 16301 - protein, 490 aa, Xanthomonas campestris; identical to SEQ ID NO: 15936
  unsure (1)..(490): unsure at all Xaa locations

SEQ ID NO: 16302 - protein, 494 aa, Xanthomonas campestris
KYVLAIDQGTTSSRAMLFDRQGKVAGVAQREFGQIFPQPGWVEHNPREIMTSVYTTITELLNNAQIDAREISGIGITNQRETAVVWDKATGQPIYNAIVWQSRQTKDICTQLKEAGHEQMVRDKTGLLIDAYFSGTKVKWILDHVDGARERARKGELAFGTIDSWLIWNLTGGKVHVTDYTNASRTMMYNIHTLEWDAELLEMLDVPAQMLPEVRSSSEVYGMTQTQYFYGEQVPIAGIAGDQQAALFGQACFEPGMAKNTYGTGCFMLMNTGDKAVASKAGLLTTIAWGIDGKVEYALEGAIFVAGSVVQWLRDGLRMFGKASDSQAYAERAGDNDGVYFVPAFVGLGAPYWRSDIRGAVFGLTRGTSKEHFVRAAVESMAYQTRDVLTAMQSDSGIELKELRADGGAIANDFMAQFQSDILNVPVLRPEVAETTALGAAYLAGLATGFWSSREEIAKQWAVDRRFEPNMPEERREQLYAGWQQAVEATMGFR

SEQ ID NO: 16303 - protein, 492 aa, Xanthomonas campestris
PMGETYDLLVIGGGINGVGIARDAAGRGLSVCLCEQDDLAAHTSSASTKLIHGGLRYLEQYEFALVGKALAEREVLLRLAPHIIWPLRFLLPHQPHLRPAWMIRAGLFLYDHLGGSKRSLPRSRRLSLRTHPVGQPLQESLRTGFVYSDAWVQDARLVVLNAMDAAKRGAQIHTRTRCVGAWRDAGFWYAELEGRDGRRRTVQARALANAAGPWAVSFLDKVAAVPHQHALRLVKGSHIVVPKLFDHDHAYIFQQPDRRIVFAIPYEHDFTLIGTTDVDYEADPSAPKIDPAEVQYLCDAVNLYFQQQITPQDVVWNYSGVRPLLDDAEDNAAEVTRDYQLEVLTDGAPLLNVFGGKLTTYRKLAEEAVDRLTQALGARKPAWTARGEALPGGEQRDIASLLERVRTARPWLPAATAQRLVRNYGTCAEQLLGDAQDMAALGQHFGADLYQAEVDYLCAREWAQTADDILWRRSKLGLRVDAEGRARLEAYL

SEQ ID NO: 16304 - protein, 371 aa, Xanthomonas campestris
IDLLRESVAAFASHHIAPLAAAADHDNVFPAQLWRLFGEQGLLGLTVEEAYGGSGMGYLAHVVAMEEISRAGGAIGLSYGAHSNLCLNQLRKNATHEQKQRYLPKLCTGEHVGALAMSEAGSGSDVVSMKLRAEARGDRFVLNGSKMWITNGPDADVLVVYAKTDPSAGARGITAFIVEKGMPGFSTAQKLDKLGMRGSNTCELVFTDCEVPAENVLGTLNGGVRVLMSGLDFERVVLAGGPLGLMAAAMDVVLPYVHERKQFGEPIGTFQLMQAKLADMYVGLNACRAYVYAVARACDAGRTTRQDAAGAILYAAEKATWLTGQAIQVLGGNGYINEYPTGRLWRDAKLYEIGAGTSEIRRMLIGRELFE

SEQ ID NO: 16305 - protein, 267 aa, Xanthomonas campestris; identical to SEQ ID NO: 15566

SEQ ID NO: 16306 - protein, 244 aa, Xanthomonas campestris
ITGGSRGLGRNAAHALAAAGHDIVLTYHRQADDAAAAVAHIQQLGRRAHALQLDTADVSTFADFAARLKDVLASWERNQFDALVNNAGTGLHAPIADTTADQFDALVNIHLKGPYFLTQTLLPLIADGGRILNVSSGLARFALPGSSAYAMMKGGIEVFTRYLAKELGARGISANTLAPGAIETDFNGGSVRDNAQVNAMVASVTALGRPGQPDDIGPVVAALLAPGTAWINAQRIEASGGMLI

SEQ ID NO: 16307 - protein, 657 aa, Xanthomonas campestris
ANAIRFLAADAVEAAKSGHPGMPMGMADIAEVLWNDFFRHNPNNPQWFNRDRFVLSNGHGSMLQYALLHLSGYDLPIEQLKQFRQLHSKTAGHPERSETPGVETTTGPLGQGFANAVGFALAEKLLAQRYNRPELEIVDHRTWVFMGDGCMMEGISHEAASLAGTWGLGKLVAFWDNNQISIDGNTAGWFSDNTPARFEAYGWHVIRDVDGHDAEKIKTAIEAALENSDKPTLICCRTKIGFGAPTKSGKESSHGAPLGKEELEGARKALEWPYGPFEIPEEIYAGWRAGGTGTLRQAEWEQLFDKYAKQYGEQADELTRRSRGELPADFIAQADAYIAKAQEDGQTIASRKASQLAIEAFAPLLPELVGGSADLAHSNLTLWKASKSVATDDPNANYVYYGVREFGMTAIANGLALHGGFIPFDATFLVFSDYARNGVRMSALNPAHAIHVYTHDSIGLGEDGPTHQPVEHLASLRYIPNNDVWRPGDAVESAVSWKAAITRKDGPSCLVFSRQNLQHQPRSAEQIKLIERGGYVLADAEGGTPDVILIGTGSEVGLAVEAKKTLDAAGLKTRVVSMPSTDVFDRQDAAYREQVLPNAVRKRVAVEAGVTGFWRKYVGLDGAVIGIDTFGASAPADQLYAYFKITAEHVVEAAKAL

SEQ ID NO: 16308 - protein, 409 aa, Xanthomonas campestris
KMGIGFAIGLVLGLAVYYLAGSDAEWVRLVTKYVTTPFSQIFLNLIFMLIVPLLFSALVVGIAEMGDIRALGRVGWRTLGYTVVLSGIAVLLGLVLVNVLKPGAGVDPQLANQLIQENADRTREIISSSGNQPQGMDMLLSIVPNNVIAAASSNGAILSLMFFAVMFGVGMVLTADEKVATLKRGIEGIFEISMTLIGLVIRLAPYAVACFMFNLAALFGFDLLIRLGAYVGVVVLALGLHMVVSYGLAVKFAGRSPIGFFRQTQEATLMAFSTASSNATLPTALRVADEMGLPPRVSRFVLTVGATANQNGTALFEGVTVIFLAQFFNVDLSIGQQFMVMIVCILGGIGTAGVPSGSLPVVALICAMVGVNPVGIGMILGVNHFLDMCRTALNVTGDLALTTLVAKGE

SEQ ID NO: 16309 - protein, 379 aa, Xanthomonas campestris; identical to SEQ ID NO: 15946

SEQ ID NO: 16310 - protein, 254 aa, Xanthomonas campestris
MDLGIAGRWALVCAASKGLGLGCAQALAREGANVVIVARGREALEQSASNLRALPGAGEVRSVVADITTSEGRAAALAACPQVDILINNAGGPPPGDFRQWERADWLRALDANMLAPIELIRATVDAMRARRFGRIVNITSSAVKAPIDILGLSNGARAGLTGFVAGLARSTVADNVTLNNLLPGQFATDRLRGNFAAIAEQQGTSAEAVAAHKRAGIPAGRFGEPDEFGAACAFLCSAQAGYITGQNLLIDGG

SEQ ID NO: 16311 - protein, 674 aa, Xanthomonas campestris
GRPNPLGATWDGLGVNFALYSRNATRVELCLFDERGREQERIPLPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPENRGTFSALKTDELIDHISSLGVTAVELLPVHAFVDDQYLLEKGLRNYWGYNTLGFFAPQGRYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISANYGAEGETDNPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGNEMDEAAWHDPEARALMLRLDGRSPTTGLREIAANVTLLMLINAAPTSVAFTLPAMHDEHWRVLVDTARHGGRVVAGG

SEQ ID NO: 16312 - protein, 714 aa, Xanthomonas campestris; identical to SEQ ID NO: 15571

SEQ ID NO: 16313 - protein, 462 aa, Xanthomonas campestris; identical to SEQ ID NO: 15572

SEQ ID NO: 16314 - protein, 198 aa, Xanthomonas campestris
GCMRMSQSDQPDSSVTQAQAEEAVRTLLRWAGEDPAREGLLDTPRRVAEAYGDWFSGYREEPRAYLERTFEEVAGYDELIVLRDISYESHCEHHMAPIIGKVHVGYLPRGKVVGISKLARVVESYARRFQVQEKMTAQIAQCIQDVLQPRGVGVVVEGAHECMTTRGIHKRGVSMVTSKMLGSFREDARTRAEFLQFI

SEQ ID NO: 16315 - protein, 537 aa, Xanthomonas campestris; identical to SEQ ID NO: 15951

SEQ ID NO: 16316 - protein, 720 aa, Xanthomonas campestris; identical to SEQ ID NO: 15952

SEQ ID NO: 16317 - protein, 247 aa, Xanthomonas campestris
FSLEGKVALVTGANTGLGQGIALALAEAGADIAAAGIQAPTETEEKVKAMGRRFVAIEANLISIEPVQRILDETLAGLGRLDILVNNAGLIRRTDAVDFSEQDWDDVMNVNLKSAFFMSQAAGRHFITQGSGKIINIASMLSFQGGIRVPSYTASKSGIAGITRLLANEWGSKGVTANAIAPGYMATDNTAQLRADQDRNKSILDRIPAARWGVPADLGGAAVFLASSASDYVNGAIIPVDGGWLAR

SEQ ID NO: 16318 - protein, 339 aa, Xanthomonas campestris
WGMLAVLLVFTQLTIFAVTLYLHRSQAHRGVDFHPVIAHFFRFWTWLTTSMITREWVAIHRKHHAKVETEEDPHSPQTKGIGQVFWRGVELYREARAQRADIEQYGKGAPNDWIERHLYTPHANAGPIALLVVNSVLFGLPGIALWAIQMAWIPFWAAGVVNGLGHWWGYRNFESADTSTNLTPWALWIGGEELHNNHHAFPSSARFSMRRWELDIGWIAIRCLQALGLAKVLRVAPSLDIRPNIAVPDADTLKALLSHRFQAMTDYQRNVLKPALREEAAATGAKLRQLLPRRLRKGLVDDGRWLKPDAREQLQHWVAQRPRMRTLVEYRARLTAVLE

SEQ ID NO: 16319 - protein, 416 aa, Xanthomonas campestris; identical to SEQ ID NO: 15956

SEQ ID NO: 16320 - protein, 237 aa, Xanthomonas campestris; identical to SEQ ID NO: 15579

SEQ ID NO: 16321 - protein, 267 aa, Xanthomonas campestris
PGTIHELQPKADHGEQSYQGFGRLQGRKALITGADSGIGRATAIAYAREGADIVLNYLPEEEQDAAEVVQLIQAEGRKAIAVPGDLKDEAFCNQLVERAVKELGGLDLLINIAGKQTAIKDIADITTEQFDATFKTNVYAMFWLCKAAIPHLPPGASIINTGSIQSYQPSPTLLDYASTKAAIVNFTKGLAQQVAEKGIRVNAVAPGPVWTPLQPSGGQPPEKIPEFGSETPMKRAGQPVEMAPLYVLLASQESSYVTGEVFGATGG

SEQ ID NO: 16322 - protein, 491 aa, Xanthomonas campestris
VMPRFPDQLLYIGGRYVPARGGHTFEVVNPATGEVLANVHNAGADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLCGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 16323 - protein, 552 aa, Xanthomonas campestris; identical to SEQ ID NO: 15960

SEQ ID NO: 16324 - protein, 369 aa, Xanthomonas campestris; identical to SEQ ID NO: 15958

SEQ ID NO: 16325 - protein, 855 aa, Xanthomonas campestris; identical to SEQ ID NO: 15964
